United States Patent 7,365,185 (GENOMIC PLANT SEQUENCES AND USES THEREOF) - sequence listing, part 7

SEQ ID NO: 13246 - DNA, 1501 bp, Oryza sativa
ccccaacgagatgtccagttatatctagtaggaatcacctaatacctggtaggtatcatccgatacctagtaagtatcgcgtgatacatagtagaaatcatcgatatctgacatgatacctcgtgagtatcacgcgatacgtggtagaaatcgtctgatatcttacaggtatcacatgatacctcgcgagtattacacaatacgtggtagaaatcgtctgatacctgataggtatcacatgataccttgcgagtatcacgcgatacatggtagaaatcgtatgatacttgataagtatcacatgatactttgcaagtatcacctgaaacatgtgtagaatcgtctgatacctgataggtattacacctgatacctactcgggatcatcccgttcgaaaacgggattccgttatatagtagccccctttataaaaaccattcactttgggtccttcagtggttttgaccccggttttgtcccacgtggcggctgagtcaacgtgagacccacgtgggcctctgttgacagaaaacacgtggcctaggagatctgcttaactccagtgcagatccaaagctcgccttcagatgtgttagcgtgccagttgatttgatcctgtaatcaacaagaaatataagcaaaggaaccgtggttaaatctataaatgatagccgatcggctagatgccgatgacatatcatttatctttaagccgatgtcatctgtgcatcgatcgacagtcatgaataagtaaagaagaactaaatctactcgatcggctgtagatattcacgatatatactccttatatcgatgtatacttaaatcaagtgattgggatagatcggtcatcatgccgagacagtataaatcacttagatcgaaatatatatcaataacaggactatatatgtttatagcatagccgatcagatagatctagcatgtatcggctaatactccgatactactctatatcaggatattaaagtaagaataatatactgaacaagagcctaatatacttagacacaacaatatcttgatatagagggcagatttaacatgtcaatgaagcatatagaacaaatataagtaaatcagataagatcggctgaaactctgacgctattctaatcggcaactagaaggcaggctatagatcggtattctaagcacgactcaataggtcaaactcaactgatacaacattaagtatgaaaagaataacgatatctagacaatcaagccgctagaagtttcatagaatggtagatatctcttataatctagatcaacatcaagatctaacccaatcagctgccctctgcgtacagatgttagccgatagtagattaggtggcgatattgctagagattatataagatatatgataactcgacgaattatataaataagattagagtatcataaagatggaagcactaatcgtaaaaacataatccgtcataacgagttttacctcttgttgaagatcg

SEQ ID NO: 13247 - DNA, 1501 bp, Oryza sativa
cttccttgatcaaacacagtgagaataatgaagatatgagctagaggtataacctgtaggagcaggagacggcagccgggagccgcggcgcggagggtagagaagccgcgaacggcggtcgacagcgacgggcaggggatgagggtcaggcgacagtgcgagagggagccagtcagacggggttcccgagctcccggagctggcgaccggtggcggtgcggcagatggacgccttcgctcggcggtggtctgtggctgtgccgatgcggcgccgcggcggggaccggtggtgtgcgcccccgtcctccggcctacgcggctcgggacaagcggacggcggcggcggcaccgagacccagtgctcagtggcgacgaggagaggcagagagaggctgcgaggagaggcgaggcaacggcggcggcgcggtcacgcgcgtgcgagggagcagcgcagcgccgccgcgaagcgcattgccttaccgagacctaagcgcagcgcccgcttctccttctgcttattgggcctgagtagctgggccaaaatcggggctagtcccgaaccaaccgggagcgtttgccatttggaaaaagtatatataagatccctcatcttgtcaccgaattacaacatcgtccctcaactgaaaaaccagatatatatgatccctcaacttacaaaaccggatcaccctgagtcataacttacaaaaacagattactctgggtcattaggtggttgacaccagttttgtcctacgtggctgccggtgggtgaactcctcaagcgggggagtgaggccccctttgttaattcgggcggggggtagcgggtgagaattgagggtttggatggatgtgtgctgtagagggggtcggggcccctcaagagcaatgagataaaaggagtttatacaagttcgggccaatgagaagcgtaacactctactcctgtgtatgatgatttttttgagctttgaaagtctctgaatctcggatgtacaaactagagttggtatgcaaaagctaatcttttgatccccccaccaaggacatgggcctccttttatagcctaaggaggcaccacaggagtttaccggattacttaggggagaaggcgaaaaggaatttatcggaggatgaactcctcgagcgggggaccgtgaggctcctcctttgttagttcggcctagggcagtggatgaaaattgaggagctggaagtatttgaagaaatgagggggtcgggccctcgagaggggtgagacaaaagagatttagataggttcgggccgctaaggagcataataccctactcatgtgtatgataatttttctaagattacaaagtctctgaatctctagcgaggaagctaagactcagcttcccttcagaatttttaggtttcaaccacctccttcgtaggcctggacctccttttgtaccttaaggggttaccacatatgccataagagctacctagagaggagggaaaatgttctc

SEQ ID NO: 13248 - DNA, 1501 bp, Oryza sativa
caatatgactacaccattgtgttagttggtacacttacgtgagagacgtacgtgagagatggtctagttgtttactattgcacaaagtgtatctcttttttttcttcttatggatttttctcttaaaatatttattcgatctacaatatgactataccattgtgttcgttgtaattaaatatttataacaatatcttacatgattatattataataaaaaatatttatattgtaaattacttttatcatatatatgtaagttacttttaccatacgtataaattacttttaaatttgattaagttactttttagacattcactgaacaatatactttactttatcgttagttctataatatgttgattagatttaatttctagataaacttaggtttttacctccataatagatttacttttgatatcgtgacaagttactttttttacttttttaagttacttctataatatatgtaaattacttttaccatttattgaatttacttttatatatctaagaagtaatttaatgaaatctaaaagtaatttagatatattataaaagtaaattgtatttttcataaaaaaaatattatcatgtgagattttgttgtaaaaatttaattgttacgaatacaacggtgtaatcggatcatagatcggatgagtgatttaaaagaaaattctataagaagaaaaaaaacatgcactattgagtgtactagtagcaacaagagaagtcgttggttaagacagtctagcttacatctctctccatcccataatataagggattttgagtttttgcttgcactgcttgaccattcatcttattaaaaaaaaaattagaattattgttttattttctttgtgatttactttattattcaaagtactttaagcacaacttttcgttttttatatttacacaaatttttttaataagacaagtagtcaaatattgcaagcaaaaactcataatcccttatcctatagaaaggagggatgctagcatggatctcaaaaaccatctaacggctaaaaaacgaatgatggaaggcttataaatctgtcaaatgatagttagcaattccgcttaataccactaccgttcgtatactgaatttgactttgttgaacggtacattatgtgtgttgtacgaatttgatcaaaatagtgtgccgtgcatacgtttttttttctttttttctaaaacaaagtagcaggaaaactcaaagcactgccaagcgattctacacgtctgattctgcatgtccttcgattatctcaatgcgttcatctcgtgtcgttcgactgatgatctccatgtttatctcttgggcccttggggcaatacgttttatatatgggcttacgtatccttaagcaaaactaaaaacaaaaccttatttttttaaaaaaaaacaaaaacaaaaaccctaggtagcagccagcacacgctctccaaacatggcgccgccgccgccgccgtgcgaga

SEQ ID NO: 13249 - DNA, 1501 bp, Oryza sativa
gagcgaccagcaggcggcaacgcgaggggcagtccaccattggaggcctgcgggaggagagcgttgctgatgggcaccagtgagtgccagtgccataatgggcggattcgccgttgatgactaggtggtggtagtggtgcctcatctggcgtggcggggaggggcaagcacgacaatagcggcggccataggtatcatgaaaaaaaatgtcagttttgcttctagctaggcaatatttttttaacctaattttatgtcttacatctgtgttttcaatttctcagggattggtagctcagtgattatagataaaaagcatttttcttagcaatgtatgatgccattttctttgtacaaacagggggcggacaaagacttattatataatagaagtcattttccttcccaggttttttcttattaaagggacatatgttttcaagtctgtacatgttttggacctcatggttcatgtattgtttaattctagttaaatttagtaaaatatataagtcaagaatgtttgttgattactcgaatagagcatatttttattttacaacgtcagctttgtgcaaacctattgtaaacagttgctttctatactgcagacaagtacgagtctaagcacgaggttttactcctcatgtttgttgattggcaactattttttttttcaattttaaaatagtgccagcgtgtgcaaatctagtcaaatggataaaaatatagtttttatgacgtatgagaaaagtataatttctcagcctttttttcataaaattgattgaattccaaagggaaataaaaaaataaagcctataaagatggcttttttgcgccaaattttgtgcactttcattgtgaatagcaggccgggaatatttgaaaaattgtttgcatttcaaaaatgttttggaagttttaagctaatacgaatgaaagttcatttattatatttaaaaaaaaaaactttccacgtctcggacaaaatatttacgtattttcaaaagaaagttatacttctatataatctccctatccaaattttatgcctaccataccccatccctgaaaaataaatggatagagaacaaacaatctttttttattgccaggatgttctttttgggggacgcagattcagtgacattcccccgtgacattttgagtcactgacatgtggaacccacatgtgctgggcccacatgggtcccacacgtcagtgactcattgtcacagggtatgtcaccagagcaatgtcaccgaatcccaatccctttttgggccgggtataaagagaaaatcaatgagtcttcttttttggctgggacgtgtgtatgaaaggaaaagaaaaggtgcacacacactccgccgccgcaactagcgcaagaacgagagagagatgtgtggatagggttcagtggatggataggtttcctaaggggtattatgggtattatgaatattagttacattctttttgtattttaaatcaaaa

SEQ ID NO: 13250 - DNA, 1501 bp, Oryza sativa
agtactgttacacaaattgatactgatgaatgttacgaaatgttgatatatgaaagtacttacactataattggtgtgttaatttcaattccatataataaatccaaattttgtgtcaatattgcaaagatcccaatagggtttaccaattcagcttatttatttcatttaccatgtttcatttatatagagaatagtttcatttgcatttaggtgtggatggaacttttttatttgttggatcattttatttaaattttaaaaacataacgtgaatagctagtgggtgtgaaagtatttgtagttcgtagcaccattattcatggccacgccacgtcttcttaacgacaaaatttgctacagggcatcaaaaaaacatgtaattagccggtgggcaccgtaagatcgtgaatttgctgcagggcaccatcaaaaaatggtaattagctggtaaatactcggcgtattattttattatttcggaggaaaagaggtgtgagaatttttgaattggcgagaatgcccccggtggcgcacccagttatcccgattgggtccggtcgaaccagacccattcggtctcgtcgccgcaccacatatcccaacctaaccctagcctgcgagtgaggaggtggcggcgacctagatcggcgaccatatttggtgagggtggcagcgacccagaccggcaagcagcttcgttcacctgcaccagtggcaattgactggaattccttgcacacatgccattttcacctgcaccagcgagctgctgccagcaccaggttgatgttcgccacggcgaagccgagccgcgtcgtgccgagcgcagacacctaatagcacatcttgaacggtttcacgggcggcacgcgggatgggataggcaccgccttgaggttaacggcgatgctggtgacgcggaggtaataggcgccattcctggggttcttgaggaggggcacggggttgcagcggagaccttcggcgatctccacgggcagcgctgcaaggagctggaatggtccgcagatggccacgccatcgccgccgccgctagccggtggggtctagtcgggataacgtggtgcgctatcgggagcattctcggcaattcgaaaattctctcacctcttttcctctggaaataataaaataataccctgagtatttaccagctaattaccactttttggtggtgccctacagcaaatttgcgatcttacggtgcgcaccaactaattgcacgttttttatgctctgtagcaaattttgcccttcttaacatgcatgatagagttcaagatagagatcttttcaatgagaatggcttgcctaaaaggttgagatttagaaagtatgttcaagatagagttcttttatagggctccatatttacctcttaagatatgacaaactccctagccattcaattcttgatagtttattttgcaaaagaaaatgttgtctctagccaaaaataaattatccaacaacaaat

SEQ ID NO: 13251 - DNA, 1501 bp, Oryza sativa
attttggaggtggtggaggaaagcagtcatcatgttggcctgctgggcgaggatttgggtgagaatggcgttggtgtctggtggtggtggtggaggcggaggaggaggtggaggtgggctgccatggttgttgtggttgctgccttcgggttggttgccatcaccggtgttagcacttctcctggtcgtcaccatctgaaaaccccacacagaaccagcaaacagagagagctgacaattaaagctaaccacccacgactaccataattcttgaatttattactgctattaaattggttcattaaagttcaagttgcttcagcaaataaaataaagacaggctccgacacagttataccacacaccggcataaccatgccccacacgactccaacaagaagacaaacgagaaagaacacacgcgcaagcctactaactgctcgtctaccgctgcgacgggccaggacagaaggtgagcaacagtgcatcctccgtgctaccaacgccggaggcttccccctcctgaggaaccacgggcgcgggctcggcacgaggggtctcaacgaagcaagtccacgccagggactgacgaacaagctcaggcctggaggtgctcttgcgggcggtgatcttctggctgcggcagacgcggcggcgcttggggcgacagacctctccatgggcgatcttgagctgatgcagctgcgcctccactgcgtctaggtccttcttcagctgcagattctcctgacgcagctccaggatcttcatgctattctcgaccatcccacggcgcaccatctgatggaagtcgatacgagccgcgtcgtacgcctccaccatgcgcgccagatgcatgatggtagcgtcatcctccgagctagcatcccggaaggtggcgtagtcgcgggctcctccgcagcgagggtggtagcggtagggtgagtgctgcaactcgtacgggtagcgctggtgaagagtgccgatggcgaggagagcggcgttctggcaagcggcggagaaagaatctccacccgcggtgactgccaacgaagtcctctcgggtgagcccgtgaggatcaccgcagtaacctcccaagcagcgtggggctctgcatcgtcaccctcctgctccgggagctgcctgccctagtagtccactccatgcggataccccaagacaacgcacatgccccgcagctccaaaacgaaaccagtcaggtccagaccacgacggttgatgctgccggccatctacaaacaaaaacaagaagaaaagcaacattttaaaggtcagattttggcgataaatgaagcagcaggacagagagagactagaggattttcacaattaagacaggatttttatttttgaaaatattgctaaggcttgggatctaaggctcgtcctacggtcaagggggctctgataccaacttgtcacgaccggaattaacccaacgggcgttccatacgtgcgtgcattattccttgtcccagg

SEQ ID NO: 13252 - DNA, 1501 bp, Oryza sativa
aggggcctcaggaagatgaaggctttggtgtctagctcgtgcctgccgtcaagcgcctgtggtcgtcgccctagtcttccgttgtttctcgtttgtctttgtgtgtgctgggccttcgctgcccatgtaataaattaactatttacgcttccgcttgttgaactctgaactgtatcaacttttggtgtaccttgcctcctgggacaaggaataatgcacgcacgtatggaacgcccgttgggttaattccggtcgtgacaagttggtatcagagcccccttgaccgtaggacgagccttagatcccaagccttagcaatattttcaaaaataaaaatcctgtcttaattgtgaaaatcctctagtctctctctgtcctgctgcttcatttatcgccaaaatctgacctttaaaatgttgcttttcttcttgtttttgtttgtagatggccggcagcatcaaccgtcgtggtctggacctgactggtttcgttttggagctgcggggcatgtgcgttgtcttggggtatccgcatggagtggactactagggcaggcagctcccggagcaggagggtgacgatgcagagccccacgctgcttgggaggttactgcggtgatcctcacgggctcacccgagaggacttcgttggcagtcaccgcgggtggagattctttctccgccgcttgccagaacgccgctctcctcgccatcggcactcttcaccagcgctacccgtacgagttgcagcactcaccctaccgctaccaccctcgctgcggaggagcccgcgactacgccaccttccgggatgctagctcggaggatgacgctaccatcatgcatctggcgcgcatggtggaggcgtacgacgcggctcgtatcgacttccatcagatggtgcgccgtgggatggtcgagaatagcatgaagatcctggagctgcgtcaggagaatctgcagctgaagaaggacctagacgcagtggaggcgcagctgcatcagctcaagatcgcccatggagaggtctgtcgccccaagcgccgccgcgtctgccgcagccagaagatcaccgcccgcaagagcacctccaggcctgagcttgttcgtcagtccctggcgtggacttgcttcgttgagacccctcgtgccgagcccgcgcccgtggttcctcaggagggggaagcctccggcgttggtagcacggaggatgcactgttgctcaccttctgtcctggcccgtcgcagcggtagacgagcagttagtaggcttgcgcgtgtgttctttctcgtttgtcttcttgttggagtcgtgtggggcatggttatgccggtgtgtggtataactgtgtcggagcctgtctttattttatttgctgaagcaacttgaactttaatgaaccaatttaatagcagtaataaattcaagaattatggtagtcgtgggtggttagctttaattgtcagctctctctgtttgctggttctgtgtggggttttc

SEQ ID NO: 13253 - DNA, 1501 bp, Oryza sativa
tcgccatcgcctcgtcctggcgaaatccggctttctcccgagcggcttcctcggcctggcgggctcgggcggcctcctcccgagcggcttcctcggcctggcgggcccgggcggcctcctcccgagcggtttcctcggcctggcgagcccgggcggcctcctgggcagcctcctcggcttcccgtaggcgatccgcggcctctcgccggtcagattcccgcctccgggcctctgcggccgccggatcctcggcctcagactggccgagcttggaatggcgggagggacgcgacgggatctcgctgaaacaaaagaaaagaccagatgacgaacaagatgggtgagtgaaaactcgcgttgaaagaatgaatacagccacgatgggtgagagacgaacctgcgagggggtcggttaaacgaccactttggaggggaaatgaggtttccccgagatggttctgtctcccccatcttgcggggccgcttcttcttgcgctcccccttgggctgcgatgtcggcgcggccccctccgggcgcctgctgctggcacgcgccgccccgccccctcggggaggagatgggggaggtgatcctccctgcttcctcttcccccgggcatcggcagggcggctgctccccgggcccctgtcgcgggacccagaagcacgaccccctcccggggtagattgttcccccttgcggctcccgcctgcgccgtcgtggccctttggagctcgctcctctgaggccccgaccgctatcataatggtcaggatggaggcgcggtctggatcgctgcagagggggaggattccttggggaatgagggacgcctccacggagttgagattcagcacccgttggaccaatatcttgaagtcctcaggagcccagtcccatctcactccctggtgggtcctcatgaggtcttcggacccggtgtactcccaggcgccccgagcgcgccgctggagcggcgcaatccgacgacggaggtagtcgccgtacaccatggcccctgtgagcccctgggatcgcaggcccgccagacggtcgaggacggcgtcatagccatcccccagatctaccggcgcccgccagctggaagcctgtgccgggggctggctcggaagtcggaggcgcgcttcgtcggcgaggggggtgtagaaccagtcgctcttccagtcgtcccacttcttgcggagggcgcaggggatgtagcggttcagcaccggcccccgtggctggaagtagcagccaccaactaccgatggcggcgacaccgactgcacggtgaagaaccaccggaacagccgaagagatgggcgcaccccaatgaacatctcgcacagatgcgcgaagatggccagtatcatcaccgcgttgggggtgaggtgcgccatctagagatcgtagaactccagaacatccatgaagaaagaagaaaatggcggaaccagccctgccattgcaaaggggagaaagaagacggaccgcccc

SEQ ID NO: 13254 - DNA, 1501 bp, Oryza sativa
ctacctgctggagctcgaccggcaggagaggcgcgacgagcgcaccggcgccctggcgccgcagtggtggcgccccttcaagtacaggctcgcccaggcgctcgtcgacgagcgcgacggctccgtctacggcgccgtgctcgagtgggaccgccaggccgcgctctgcgactacatccccttccgccccgccggcgcgcccgccgccgtcgtggcgctgcggggcacgctcctcagggcgcccacgttccgccgcgacgtcaccgacgacctccggttcctcgcgtgggacagcctcaagggctccgtccgcttcgccggcgcgctcgccgcgctgcgcgccgccacgggcaggctcggcgccgggagcgtgtgcgtcggcggccactcgctgggcgccgggttcgcgctgcaggtggggaaggcgctcgccaaggagggcgtcttcgtggagtgccacgtcttcaacccgccgtccgtgtcgctggccatgagcctcaggggtttcgccgagaccgccggcgagctgtgggggcgcgtgcggtcgtggatcccctactacggtggctcctcctcctcctcctcccaggccgcggacgccggcggcggcggcgagagcgaggaggcgaaggcgatgtgcaggtggctgccgcacctgtacatcaacaccaacgactacatctgctgctactacaacgacgcggcggccgggacggcgaccgtggcggccggaggaggaggaggcgggagcgcgagcggcaaggcggtggcggcggctgcggcggtgcgagggaccggcggcggcggcgcgcgcgtggcgaggatgctggtggcgtccaagggcccgaccaagttcttggaggcgcatgggctggagcagtggtgggccgacgacgtcgagctgcaggtggcgctcaaccacagcaagctcatcgaccggcagctcaggtcgctctacgccgccccgccggccgccgcaagctaggccgacgaaattgctctcaaccaatgacgttgattgtactgctttagtacccagattacattctacctggaggatttacttacgagtatctcaaaggtttatagaagagtggttaaaaaaattgcgtaaaaaaaattaagattaggatatctcaaaaacaaataaagcgagtttgattattcacatttcgagcaaacaaaagaaccattataactgaactggaaaaacttaaaatgagagagtgaaaaaaagagagacaaaagaacgactccgctggggatcgaacccagaatctctggttccgtagaccagcgccttatccattgggccacggagtcctggatgcttaatgtgacatactatttttctttagttaaaatgaatgaccaagagaattgtaatttcggtgcccaaagatttagttatttcaagcactggtggtgtaccagcgaatactcgatccaaagctatcactttatcacaagacgatagttcactctagaatgagcaggaaac

SEQ ID NO: 13255 - DNA, 1501 bp, Oryza sativa
gacgaagcagtccgcggcgccggcgaggaagcggcggagggagcctgggacgtagtcggcgtagaggagctggaagatgaggcacctgcggtcgacgcagagctgcagcagcgcgacggggttctgcgcagggccgtagctggggcgccactcgacgtcgagccccacgatgagcccggggccgtacgcggcgcggacctcccggagccacccctccacggcggcgccggaggacgtcacggtggtggtgatcacggcgtcgccgaaggccacctcggtgacgtacgtgtcggtgtcggccgccgccatgtggatcgcctcgcctgcggcggctgcggtgcggagacgacaagggtcaagagggttttggtttgggggagaagaagaggggaagcagcgagtcgaacggtgattgaggaggatgaggcgcaacgggcaggtggcccccgtacataaaggcttggacagctggacgcctggacatgaagctcgcaaattccttcgcaattcaaaccggagggcgcccatccaaatattttccaatgtatagagaaatttacgaaacaaaaagaacctaaaccaaatactagtactgtactactactccaatgtgagaaaaaaaaatttagctgtaggaggagtagtaattcaaatttcaaaaataatgaaagatatcagagaaccgtactactttttggtagacttcggtagggggtagttttgctttttgggttggcactgtagcttgcgggagatcagagaacagagcgagcgaatcacgttgtcagacgagagtttgacccatcttatctaacgtacagtacgctcttggcttgctgggccctgggctcaacaaaatgatgtgttcacgtcctgtttgaccattggcacgtgccgtgtcacgcctgattgcaaagccacaatgttggggcgccttttggcaggtagtactagtattactctaattgctttcaaaattcttaattttaattagcacctgtttatatttatccacttgcaccatccgtactatacaaagttaaaaaccacttcaaatttagatgagtgcattcatccttagaaattgtccttttggacttagagaggacgcagttacacttacaccctactcaataagatgtacttcctccttcccaatatatttgacgttttacttcttgtggtccattgacccacaatgcttgacgttttagtaaggagcataaacatgagacaggcgcagcagagtacgattcaaattttactaaccgggtaatcaggaacatcagctcgtccatgattccaccgtggcaggaacggccggtgtatttttatctaaaatgactactcatcatggctatttaaagtaactagtactccagttagggcagccataatgtagcaatagaagggggtcttaagcctctaaagtggccctttatacattgtgatagtagtccatatattagtctttaagatgagctagccatatgcataatgt

SEQ ID NO: 13256 - DNA, 1501 bp, Oryza sativa
aatgtgatgctacagtaaagttttgataaatatggattaaataggcttaaaaaaatcgtctcgcggattagctctcatttatgaaattagttttttttattagtctatgtttaatactctaaattagcgtccaaacatccgatgtgacatgggctaaaaagttttagtcccaactgaacacccccttatcccccgatcccggcccttagggtgggtctccgaccccaacagggaaatttccgcctctagcaagaacttgacgtagccgatcgatgatctcatccaacatcgacgccttgatcatctacaagcaaaatcaaaccaaatcaagggcatgtttggatcttcagctccaactccatctcttctaaagttggaagtccaaacaaaaagttttagctccaacaataaaaaaaaatagagtggactaaagtgctctcacaaaataaactcaagaggtgaagcttgatttagaaagacttaatttttagagttagaactctatcaaacatgtcttaattgttcaggatcacataggttgacgtgacgtagattaaggtggtgtttggatccagggacttaactttagtctctctatttaaacactaatttaaagtattaaatatagactacttacaaaactaattacataaatgaaagctaatttatgagacaaaattttaaagcctaattaatccataattagagaatgtttactgtagcatcacataggctagtcatggattaattaggcttaatagattcgtctcgcgaattagtccaagattatggatgtattttattaatagtctacgtttaatatttataattagtgtccaaacatccgatgtgataggaacaaaagttttagtcccatctaaacagggtctaatttggtgagggttttgataacgaggctgaacccaacagtccactcgattcatgtgactttttttttaaaaaaaatgataattttattgccacaacacaaacacttcttccaggaggaatattaactccaaggttcacacaattctcactcacttccctgtggaccccactccactggtcccaagcctccccagccccacgggccataggtgacagccctacaccagaacagtgccatcccatccagcccagtgcctcctcaaaaggccaaaacagcaacggtaaggtccaaaacagaagcatcctttcccagtgctgagaagcagcagcagcaagccagcaacagcctgccactcctcccatcccatcccatcccatcccatcccatcccaatgccagtgaatgctgtcgccacgcgtcttcgcggcacccgatgctactctactgcctcccctcccgaacgttcgaataccccaacggctacctccactccaccaccctatttatatccgcctcccatggccgccacagcatcatctcctcctcctcgttcccctgtttccctcctctcgtgctctcgtgttctacttttgctagtcctcccacccta

SEQ ID NO: 13257 - DNA, 1420 bp, Oryza sativa
caatagcatttcatggattatctctttgtttatcgtagtgtatttgggtttcatagagaaatgctgatcgtgctgatatatctagtttgctttagccccatcttgatgtaaatcatggattcgccactggttgctgatcctgcagtgtcaaagcagtcactatgacacgtctaatcgatccttagctgccatcagcatcagctgagctcaaatcaaaacgcacaatcgatgagctgcaagaactaggtatggcaagggggcgagacaggtgcgggtccaccctgctccccctgcgagtccacccggccccatcctactagaagagatgaacccgggcctcgtccctggcctctttgatgacccgcaccactggggcccgcacagcgtgcctcactcacaggcaataatagcgattggtgggagatgaagggtgcggtcggctcgcccccgttcacccacgggtgataattagggggctgtttggtttccaggacttatttcaagtacctgtcacatcggatatttggacactaatttggagtattaaacatacattaattataaaacccatttcataagcttagactaattcgcgagacgaatcttttgaatctaattacgccatgattttgacaatgtgatgctacagtaaagttttgataaatatggattaaataggcttaaaaaaatcgtctcgcggattagctctcatttatgaaattagttttttttattagtctatgtttaatactctaaattagcgtccaaacatccgatgtgacatgggctaaaaagttttagtcccaactgaacacccccttatcccccgatcccggcccttagggtgggtctccgaccccaacagggaaatttccgcctctagcaagaacttgacgtagccgatcgatgatctcatccaacatcgacgccttgatcatctacaagcaaaatcaaaccaaatcaagggcatgtttggatcttcagctccaactccatctcttctaaagttggaagtccaaacaaaaagttttagctccaacaataaaaaaaaatagagtggactaaagtgctctcacaaaataaactcaagaggtgaagcttgatttagaaagacttaatttttagagttagaactctatcaaacatgtcttaattgttcaggatcacataggttgacgtgacgtagattaaggtggtgtttggatccagggacttaactttagtctctctatttaaacactaatttaaagtattaaatatagactacttacaaaactaattacataaatgaaagctaatttatgagacaaaattttaaagcctaattaatccataattagagaatgtttactgtagcatcacataggctagtcatggattaattaggcttaatagattcgtctcgcgaattagtccaaga

SEQ ID NO: 13258 - DNA, 1501 bp, Oryza sativa
ttgattgatgtggtaatgacctggcaagggcactcgctgtataagcaccaactatgagataccacatggtggcacctaagatgaagagcttctaagacattttcttcacagtgcaagcaccaactagtgttgtctcaccaaatccccctccctcacggcctcaccccaccacccccacaaatgtcatgcccggcgctggctctcccctcctccctccaccggcgtcctctcctcctagcccaaccgccggcaactctcctctcctccttctaccgttggcgttcgcggagatccctgaggcgcgcttcaatggctgcgtgacggagtggccggcgagctcccggtggcgcagatggaggctaggtgtgttcggcgagctcccggcaacaagcctcaatggcggcgtggatggcgacgagctcggggcagatctggcggcatcgacgcctcctcaccggtgcgggcaagaagctcatagcggagttgacagcgtcggcagcgatggtgtgggcggtgcgcggtttctcccccaaatccatcgcgagattggccggcgtcccccttctccctccaccggtgctggctctcccactcacgaccggcgcgtagaggaagaagacgacgacgagctctgccggcgtcaaggagctcccccgatggagcatcggcggggtcgtcgcgacgtggagcggcgacggcctcctcaggcttccccgacggcggcgacccaacgagggttgcatgcgccgatggttgaggcgagcccgacgagggctatggcgccggcggtcgagacgagcatggagtgagggttgcggcggcgccgagctcctcagctgcggtccatatgggccttctcctctggtcggatttggccgctcccttcccattctcctcctccggttggattgcacgacgcgggggcacggcgcgacgaaggcacgccctccacagcgcatgggcgacgcgctttccccgcccgtgcggactcgcggaggcgaagaaacgcgcttccctccatggggacaagtcgctctggtgggacacgactcgcaccgacacgcgggcgtttttccgacgtggcgcagtgaaggaacgcgccacgtccccacaccgtgaacggcttaataagcaaaactattcctatcgaaaacgtccttgagcttaggctgagttcttttcattcacccttttcattatgacgcttcctaaactgctaaattaaatagcattttttttcaaataaaagtttctaaaacaaattaaataaatcaatattttaaacttataatggtaatacactaatggcgttcccctttttttttagtcatgaaaagctacaaccaaactgttgattccatctgcctctaatttcttcaaaagcataatatttagagtaaatttctcaaaacaatgtgtagttttatcaaactatcacaaaactaaagatttagcgataaatttattacagaacaacagatttaaggctaagtatcacgaa

SEQ ID NO: 13259 - DNA, 1501 bp, Oryza sativa
caaaaaaataatagaaataagtgggctcgacctatcaatgctacatcttatactcccctcttctccattcttccacatcctccttccccttccatctatcaaacaaagacacacacacacactctctctctctctcccctcaacatgagcatgatttggcggctaacgttctccattacttggtgaaggataatagagaggaagacagtgacggcctccatgagatggcagaggaagacaacatcctgcaaagctccgacctccacttgtttccacaccttggcatcatttggggtaactgtagcgatggcagcagcgtccctaggcataggaggcggaacatgacctcctcaactccaccttcaccatgagtacatcatcctctttggcacacatgccaggcggctattgcatgcggagttcgacggaaatcagtgtgagaggagctagttgagagaaggtagtgagaccggtggatcttggtcacaccaaccgacaagagggggaggcaatggcagtcccatcttgacaaaccttatcttgctcccaacctcaccgttctctccttggcaaacaacttcttctttggcgagcttgcaatggagagatcctagggaggggggtaagagagggattgacttgagagggggcgaggagggacaaaaagggatggcaggtggacctatggatttattctatttttatggtgaccggattacaacgttgtcgccacgtgtgtcagctcatgttaaaaccgcacaaatagtgcttaggggttattcgtccagtttgagacgttcagggtgtaaaatgtctggttatgtcattcatggaataattcggactatcgccttaagttcagaggtaatttggaccttttcctttattaaaacagttgactaaaaaatgattaaaattttctttataaaatatacgtatactttggcaaaactaacaaaagaactacaaattaaaacttgtgtaccacagcactgcaaactggaggccaaatttactacaaaactacgtatttaagctcttttgaattataggaaaaacatattcagtagtggctttatgacaaaactacaaatcttaaagcttatcttatcacaaactatagaagttatggattttaagcctatattagaataacaatgtttggatgaagcacataaaatctatagttccatgataaattatatgctaaatatgtggtttaatgatttataaatttaaaatatgtaggttttagatgaaacacataaaatatgtggtttaataatttgatcaaaatatctgtagttcacggaatttaaattgaccaatactaacatctaagaaatgagtttcccatcttcaatttgcagctatgtgagcagtccccgcctactatacgagcctacccagtgcccctcaatcagctggtcggctggtcgcacacaccacgttccttctcccacctccgccatgccttcccgccttctccagcaactgccgc

SEQ ID NO: 13260 - DNA, 1501 bp, Oryza sativa
ctgatggtgacaaaaatagcacggttttatatatagatcaccggaagccaaatccagctagaccccaccactaccttcctcaagggtcaccatttctaacgttccccttcagcgatggtgaggaacgggaatcgccttgcttacatgattggtgacgcagaaggtggtattatttaccaacacacaatttctaacatttcaagtattatttaccaacacacaattctaacatttcaagtctcgtatgaatcaaaccacaataacaacttgattgaataaaagtagatgaaacatgtatgagcaatagtgcctcaaatctcacatattaaatgcactgataatctaagtcaaagcatgggagtgctaagtgctaagataacaaacttagagcaagtttaatagtatagccaactactagctccaatttatctatagccaatctaatagctcatttatataatagttacatactatactattattactccaatttacatgactttggtagtatacaagaaataaataaaaattaaacttaggtgcaccagccactgctgagttgcaaaaactggactcacgtgtcatccagtgaaaacatcaattcgcggactacaccacccccggacgcagtggagcatcgccgatcgccaccgacagatcttagctccatttcctcaagatacgaaacctcctacccttatctcactgactagtgggcccacgcagcatgatggtccacacgtcagtgggtgtgaaaggatacttttcccaccaccgcaacaccatcaccaaccagcctttttttcttcctcctctctgtggccgcgcacctaaccgttctcactgacgtgtgggacatgacgggcttggtggggcccacctgcctgaatttggcatgaacgcaagcaaagccccccacccacgtcgttgcgacgttcccgtctgtcttgctacacacaccaagacaaagtttacccgcaccaaacagccactcactgacatgtgggccgaccggggtgcccctctggtggaccccataggtcagccagatgtaggctctgccggattcgatttacagatgcttggtgcacccactgacacgagggcccgcacgcccgcgaaaaataccggtagaaggaagcatttccagacgcggcacggtacgtgcacagatagttcgccgacgagatgcacaaagaactcactgacatgtgggcccagatagccggtaagctcaaggtggacccacatctcagtgtgcgcgtagtggagtggctcacgtgcgcggagcgaggcgtggtttgacccctctcgtctcgctcgtcgcggccacctctctttctctctctctccattaaaacagcacctcgtcgcaacggaaaagcgcaatctcgtctcgccattctctctctcacacacacacctcgcgtcgcctccctccccgagcgagcgagcgagcgtgcgcgtgcctacgccctcctctctaccgccatggcgatct

SEQ ID NO: 13261 - DNA, 1501 bp, Oryza sativa
ctcgtgttttcacgtactcctcctgcgtccccttgcccaaacatggtggtactaatctatatgctttgctttcggggctcgctaatattaaacgtcggggagagatattagcgtatcgtcttgaaactgaggcagaacgaagaaagcgtcgagattagggataccaggcgtgtacgtacgggggaaactgatgagttgcccatactagagtatatatactactatatcctctagtctataatattacatgtatatgcaagtgtatatactatctatacatacgtataaactttgtatatatacatgtatataaagtttaggtgcgtatgaataaagaacttaaaaaaatacgtgtatataaactttatatatgtgtatacaaactttatatacgtatatacaaaattgatatacgtacgtaaaaaagtccaaaaaatacacgtatacaaactttatatatgtgtatacaaactttgtatacgtgtatacaaaattggtatgcgtaggtataaaacccaaaaaatacacgcatacaaagtttgtatacatgcatataaagtttgtatacgtatatacaaaatttgtatatgtacatattaaaaaaccgaaaaaactaaaaaagatatggaaagaaataaaaacagaaaaaagaaacgtgcgtaacaaaaaaaaccgcacggcaaagatacagaaagaaaaaaaaaacagaaaaaacaaaaagaaagaaaaccatccgaaaaaaaaaagaaagaaaaatcgttcggaaaaaataaaaaccgcgccgcccacgccacctctccgcgcgggggaggttgcgcgcgactggttcccccgcgactggtcgccgattagggttctcgtgtacgtacgccatatacccgtctcgcttgctgcgttcaaactcgagcacagctgctttgcagacctaccttggaattgtttgaatcgggaaaccaggcccacctgtgagtctgtgacacgcaccacagccgcggtgcatggctccggcgctagggttcaagcaatttttgaccttttcgcgagcaaagcgccacaaacatgggccgcaacgctatcagccgcgttgatttgtttagtagtccttgctaataaataatcgcgcccactaagagcacttacaatagcaggctataagccagctataaatatattttaaaaagataaaaaaagagaaaaaaaaaagcagcgggctatagacctgtaactagctgcagcacggattttaagacgtaatatgtgtatgataggtggaaccagatattaataagcaactattatatgaattagctattacattagctatagatgatttagagttagtagtgggctatactattaaactattaaacttgctctaaccagcaaaacacttgtgttttaattaaacgtctaaatcagccagggacgctgtgcggggtggggcccgcttgacagggagagggtcctgcgtcgtgggccccacgtccggcgcctgggcaga

SEQ ID NO: 13262 - DNA, 1501 bp, Oryza sativa
attctcaaataaaatttaccaaaccctagtgctaggtaaaacccgttgtagagtcagtagcagcaatagactagaaaagaaggatcatacaatatagtgaaattcaatcggcacaattattacccgctgatttcggagtttctgttttatagattgaggaaaacaaaaacgacatgtaacttaagccactatagttccgcgtagatggaggttcgttacgactctctttagactagtgtttcaaaattttttcttgttttaattaaattgtttttgtagttcgtccgatttcaacctacaactttgtatagtactcctatagtttctatgaaacaaatgccacaatgaattctctatcattttaagagagagatgagcgaaatggctgggatatatatgatccatcgctgtaccagggcggaatatgcggcaagtggccgtggcgcggcgcgaggtgggccagatcacgctctgcttgcgcgtggtgatgaaccggtacgtacgacgaccaccatgcacgcgccggatcacggggacgatcgcgagagccaccgaccgaaccaccgaaccccgcgtgcccgcggctgccgcgcatgaggacatcttattctcctccacttccgcgacgcgcggctccgaccgctggtccgtccggccggcgcgcgcagagaggtcaacgggagcgagtcacgcacaggcacagccacccgacacctacacgggcggcgggcgcgctcggcgctcgctaccaccaccagcgcggccggcagccagcatgttcgactgcctcgaccagccgcctggcacgtacggggcgtcgtcgggcccgccacattcttgctggtttttgtgattgtgctctgaacgacgtgcgcggcactgcagtgctgcctgtgactgcgagtgtgcatccgtcatccatccgcatgaccgcatggtccgcaccgcatcccataatcccatccggacgccggtggccaaggccaaaacgcggcagtccggcagctaccaatggacaatagagatggcagggcatatatacatgatacttaatatataaaggattgggaaagaaaataaaaacttggaagccttctttgaaatagtcctcagttcctcacgtcctaaaggaaactttcaataagttcataatgtcacctgctccctctgttccatattttaacaagttttggtgttttattttttttttgaaagtttgacaaatttcataaaaacattatagtaacatccacaaactccaccagtgacatttctttgacaattctatttcattcagtacttcacttaagtagcttcttttgggaaattcacatttttaccacaccaaagtgcttaattagagatataacactaaaaagaatgttacttggtattttaggctgagtttaaatcggttgtatggctgtagttgtaggccgctgggatggatcattaacgtatactataatcttgaaaatgaatttatttgattttttaagag

SEQ ID NO: 13263 - DNA, 1501 bp, Oryza sativa
ttccaagtttgtcttagtgcctaaattctactatctagaggaccgttctaatttttttaaagaaatgtcaattcagatgttggtttttttgtattgttatcacctctgtacatttggggtgttggttaatttccagctagtttgtatggaaaataaaatttagaatgatgtgttagtatctcacttaaaatgctattgacttcactagggaagatgctattggcagtacaggaatgagtgaagaatttgtatatgtgtttatcaagaccactcaataagtgaatctacagcagaataagtactcattagtcattttcaataagctaaggaattcttagaagctgctgcagtagcagcatattatttttctcaaagcatttcaattctcaaaagtttataggtcctaagtagctagtactccctctggtctcaaaaacaagttatttaagaatgcgtgcagtcacacaagttaattttgaccataaaaatcattcaaagtatagattttgggtatataaaaatgatattcaagtttgttataacaagagctttcataatattacacttgtgtaaccttttttttaatatgtgctaaagaactaggtagtcgaagttgtatatatttgaccatggaaagtccaaaacaacttggttttgagatcagagggagtaaagtactcctggcaatatagattctgaatcttttataagcttgcagtgttaagaattcatgtatgttttcttgaccttctccttgttttcctgacttctatatgatgataagtccagttagcggaatttgaacataatgaataatacttgtgatgaatggattgtaatgtaaattcgttctctccagggtggaggctggatcaggaaagttaattactaattaggctccagcttttaagcctaatattacatgcaaaggcaacttttatagtttacagtatctgagtctgcaaatgtctttaaaacattggtccgtcaagcattgtggttagctgagcagatactgcaattaccaatggaagacatacttgtattgactggttagcttgttgagaattttaatatggcttctaagtttggtttgaagaaacaattaggtagcggatatggatcaggaatagtataatggcctggcagctgacccctttttcttaaaaagatcatcctgcttaaacttcaaggttaaaattctgctgccatcttctggtaatagaaagaatgcagacaatagttatatatcaagaacattgcattttccatatgtgttgatgaagacaaaatttcttaccagcatgaactgctagagtgagatcatgcctgagaatgctgttttgtttcttttattctcacaacgtacagttgtgccgaatggattaatttgcatgacaagcacactctctaataaatgacaaatattctaatttgcagaacgatggcatgtccatttagttgaaaaagaacagttgggaggcccttctgtaaactgtag

SEQ ID NO: 13264 - DNA, 1501 bp, Oryza sativa
tatttttaattcttatatacaatttatattaatttatattgtagttatagtatacttgtggtggaattatattacaactatgttacatttaaaagtttgtcattcaaaaaaaattgcggcaatttttttatagtccctttaaataaaaaacactagaaacttcggtatgattgcggattgaaagatatgtcgccaagtattcaagtcaatgtgtaccacatgcatgtagtgacaagtatgttagttacaactcctgcatcacttatcggtagggtgactcaatacaatagccaacctagtgccatcagtgcctcattctcttgccgttaacatcattgtctctagggttccaatggtattactgatttcttcatccatgggagtggcatcctctcaattcgatcgacaagggcacatggagatgcggagctcgctccaaccatcggagcgtgcatgatgatcgaagggaatggtagcgcctgatcagcacttatgatcggcttacgcctaaatggaggtggattggtgagtcaagctcttcgctagtatatggtcatgctcaacctctaccaagaaacgaaccaattaccatcgaaggcaactgtatgggtagtgccttggtttatgattgaaatattagtcaaggaaaattcaaagtgccttcatcgagcacgatccgcctaggcctgaatggaggtgaattggcgagtgaagcacttcgctagttagtgtttgggttctgattctacaaaaacaaccaaaccaatgacaatcatttagaggtaactacacaggtggtgccctccatcattatttggagcgttactcgaggtcggttcaaagtggctaagatggttatggaagattgtgtgaggttttctttgattgtctttatggtgggtggaagatatcaacatgctctctttgttcgtggatgttagcgaggtactgagtggggtagaaataccggtctggtaattatctgggttgacggcattatcatttatttgttattttgttattaaaggcctatggacgaaaatccattactaattttaggttggttcgaatgatatcaacaacaaacgttaagtctttcttgaaagcgcaattatggagagctatataccttttcatcttacttataagagtgttagctgtcactagggaccatgatatttttgtgtcctcttgtttttttatgtgtaatgaaatgtccatttgcatcgtaaaaatgtgatactccatctagttataaatatttaacatttaaaatcagatctaatctaacttttggaaatatgagcaataataatttctcaaatgcttaatatacacacgtatggttgccttaaaaatacttgtatttccatacgtatgcttaaatacaggaatcagtttctcaaaagtaaacttgtcatactgtcacatgctgaaatactagatatagtttattgtgccaatatttcagcatcctgattcctgttcctgatgccatgca

SEQ ID NO: 13265 - DNA, 1501 bp, Oryza sativa
ttaacatttaaaatcagatctaatctaacttttggaaatatgagcaataataatttctcaaatgcttaatatacacacgtatggttgccttaaaaatacttgtatttccatacgtatgcttaaatacaggaatcagtttctcaaaagtaaacttgtcatactgtcacatgctgaaatactagatatagtttattgtgccaatatttcagcatcctgattcctgttcctgatgccatgcatacacgtatttttagtgtgtgtgtgtgtgtgtctatatatatatatatatatatatatatatatatatatatatatatatatatatatatatatttgctttgtagttttcttgttttttaattaagccgcgtagttttgtaattgataaacgttcttcctgcaacctatattataataattggttatatatattttttaagtaaagcatggatgaatttcattatctaacacaaatttgcttggttaattgggggaactcaccttaattacatgtcactgtgacaaagcatgagtcatctaaatcctaaatgaaccctgaacaagtggacagcgcgctaaacctcctactagaaattaaagctcctccttttttttttctttaagcacaacgctccgcatatcttttccttgataaattctaaataaaataaagatcaactttttcttgagagtagaaaagatcaacttgtagaattgaatagaaaagcgatatcaccttgttaacctttgccaatatatgcatatgatgaccttatatgcttcgactttacgtgacatgtgtatgaaatatatatatagttctggccgggctctacttatatatctatgtgggatatatatcagtatacataaatgtagatatagactagacaaataaagccctaaagcaacttccgtccattctgttttaatttcttttctttttttaaccattgttaccgctttttttttcacttctctttccggggacaaaaaaacaatgtgatgtagtatgccgttcgtgatcgactcgcgctctagcctttccttcacatgctatctcgtgttggtctactccgttcgtattcactggtagagaaaccatctttggtcggtcgacccaaattcacaatagtcccggttccattaaaaaccgggactaaaaattcactggtagagaaaccatctttggtcggtcgacccaaattcacaatagtcccggttccattaaaaaccgggactaaaaataatttttagtcccggttaataagaggaagatctttagtcccggttgttgttaccaaccgggactaaaaatcatctttagtctcggttggtaactccaaccgggactaaagttcatttttaggcccggttgattccatgtcaggccgtgtcagggccctaggatcttaagtcccggttagtaacaccaaccgggactaaaaacctatttttagtcccggttggtgatactaaccgggaataaaaattaaaacac

SEQ ID NO: 13266 - DNA, 1501 bp, Oryza sativa
accgtagggtaaagtttaatcctaaccattcattctttcaccacatttaatcataaccatacacttattttcatttctcaatcgcacctagcataggcgcgtaatccattttctaacaaggtcgtaattctatacgtccttggtcctaaaatatataatactagattcgacataatccagtgatgtgaccatgggtaccactgctacaaacattgctaacatcatatggatcagcaagaagacaaagatcaagtcctctaagtgctagaattcgattcggtcacctactaaattactaacttcaaagggccgccaaatatacatacgaactttattttcggcccgtgagtacttgatcgaaagatctcggagtcctctttccaacggatctagcttcattgccaaattccattccaatcatccgcaattgaggaaacaatgtgttgtgtcacctgtagtgggcctatgggcttggaacttcgtctgggaccccggcccatgtggagcccatgtggggtgcgccccaatctggtggagcacaaccctaataccctcatggtcgttcttccacctccttaaatagctaggtacccttcagggtttctcgggttttgttagatcaaagtttagccattgctacttgcttgcagcgcgcgtgtcggctagactgtccgtctgcttgtctttagaaccttagcttatagtgtgtatttaattcctatttgcaatatcatattgattttatcttattcttacttgtttcttcgatttgcttacatgaataaggttgatttgcatcggcaagatcaacaacccacggagaggtgtatcgatcgctaaggtgcaacgcaacgtcttgtacggttgtaatcagatcgtcaatattttttttcaaatcgtaattatctcaactcactgaaagattgggccaacaacaactttagtttcgagtggaactcagggtttatcatccagtataactaatctggacctctcatagtataatcatattatatttgtttagtgttaaaaatgttgctacgtattcttttttaaaacttgcttaaagtttgatgtttcacttaaaaaatcaaaacatattataatataaaatgaatagattatatcttgatagaaagaactttctttggttaggacactgcgttacatgcaactgctgcaactcaccactcacgtagcgagtagcgagcgagcgagtcatgtgccaaaaatgtggagctcgcgtgtcgtccaatggcatgcctcgccctgatttttatcgggccccaccagcccggtgggatcccgccacgtcagcgtgacccggagccaaaggattggattcccggcgccgcgtggcgcgacgcggccgcgctcgctatcccctcgcggataagccgcccatcccagctacgcttcccgcgcgtgcagatcccttaaaccgcccctcaccacacgcgccgtctcctcgatcaccacacgcgcacacgacacgacgcac

SEQ ID NO: 13267 - DNA, 1501 bp, Oryza sativa
accctacggtggtagtagggattacgaaccagcgattgagctgcataatcgcaaatttgcaatgtatgcagttgtgtttttactctctgatcatgtgttttctgtctgacagtttacacatgttattatcgaaagtataattatgaaaagagtaaagtgcacggcagtctttaaacttacgtgggtgtgttaactaggtccctgaactctcaaaatgaattttttatccctcaacttgtctcggatgtcatatagatccaaaagtgttccaacccgctccgtgtgctgacgtggcatgacatggtgacgcctacgtgtcagtggaccccatatgtcaaccacatgacatatttttttctcctctcttttttcatttgtttttttcaaaattaaaaacatcattttcttctctctctctctctcctctcttatttatttttttatatgactgacatgtggatccactggcacgtaagcgttaccgtggcatgccacgtcatctcacggagcgagttggagcccgtttggacttatatgacactcattacaagtttgggatccaaaaattcattttgagagtttagggacctaaatgatatatccgtaccagtttaaggactgtatgtgcatttcactcttatgaaaaataatctgatggcttggcatggtgctactacctactgcaaagaaatgttccaataccagagtcaccgtgacaccaatgaatacaggcaaattaatcttcagaattcttactgtatttcttctaacttgtgataaccacttgtttagagttcagaacttgagattattcacaggtagcatgacgcaccacaatctccgcttgacctgatcgagctgaagtttctctccaaattaattttgtgactgtcttatgatagagatgggggatcccataatacgttcttattttacacctcgtggactacggtgaaaaatgctgccgaggcagccagcgaggtggtttgcagttgcaggcgagatggagatcgaaaccctctgtgagtgacacgtggaccagcagcacccgaaagatttcagtttgacccgacgcagcgagtggtggaggcggaccgcgcgcaaagcccagtatgcgatgcgatgcgtcgttgcgctatccattctcctcctctcccacgtctcctgatccgtacctgcttaattccttcgtcttcctctcctcttccttcttcttccaccatggctgcaaccgcttcgtcctcctccaccgccaccgcctcgccgctcctcctcccctcggcccgccgcccgctcccttcctccaaaccgtggcttcccgacggcagggcgttcaggggcagcagggcgctgagttcagcggcgcggcgatgcttctgctgctgctgcaggtgcgaggccgccggtgaggcgggaacggcgccgccgccgcagcagcgcggagtggatgacggcggcgtggtctgtaccagcgccacccggtcccggaggaggagcgttc

SEQ ID NO: 13268 - DNA, 205 bp, Oryza sativa
tgggccccaccattttaaaattattattttgtgcagctgacatgtggggccattctttttattatttttccggggagaaaattgccacgtaagcgctacttcaatgccacgtgggacggaggcctagtcaaacaagccacgtatgcgccacgtcagccaaaaccgccgagggaccatgtttgcccggttttcgtaagttggggga

SEQ ID NO: 13269 - DNA, 1501 bp, Oryza sativa
ttatctgtgatctggcccatgacttcgcctggtgaatctatgaggaaaaagtatactttgactccctcaattatgatccaagtatgatttatgacctccaaccataaaaccgagtatattgactcatccaactatcaaaaccggtgcaaactttatctctatgtggttttggtctacgtggcgcctatgtggctttattgacctggccttcatcccacgtggcgttgacgtggcgcttatatggcattagaataaacaataacaaaaaaatatgtgggacccatttgtcattcacaaaatatattgtgggacccacaggacatcctccctttccttgttcctccttactctctcttccccttatctcttacccttcggttgttcgtggggaacgggcgttggagcggcgacgggcagcaggcgggcaagggccggagcgtcggcggcggagacgggcgtgggggcgaaggcagcggaggatcgtcggtcacaacatcgagcgacggagaaattgaaggaggaagcatgcagccgtctactttgtcgccaccgccgccgctagttgaagcgttgcctcctcgtcctccgccaccactcgcaccaacgccaccctaaatccccctttcttcatccgcgccagcaccaccccaaatccctcttcttcttctcctcgtccgtcttcctcttcatggaccatagcatggcaccggggttagtgccagacctgagctcccacatgtcgttgtgtagcacgaagctccccatggcgttcttattggtgcccatcgtcgcctccctcaccgtcagcaaccccatcgacctctgtcccttggtcgccatcgcctcaccgacactcccctcgctccgcgcccaaccgtccctctgttaacgaccaaatttggtaagatataaatcaggtttggtactggaatcaaagtggatttagcaaaggattgcgttcgaagaacagagtgtgcatcggctgcgaaggcattggctggagtctgcatcggctgagatgggtcggacaggggacagccaatacggccgatacagccgatgcagccgattcttttgagatggttataaaactgtttctggaatcggtcaatgtgcttcacaaggattgccacgatggagataagctctcagataggcaattgtatcttttatattttatgtaatttccttagagatatgtttaggtaaaagtctaccgtaaagacttatgtgtatcttagagtttgttagatataagagttgtgtccggcaaggacctatcatgtatctcgggtataaatatgacccgaacccgtgtgatctagaaataacggttcaataacactctcgacgcatcgccaccctttttcactttcgtttgtttcgacgagttcttactttcgagttgagctgcatcgattccgatcttcaactagaggtaaacttgtcatggcggtttacattctcgggattagtgcttccatctttatgatactctaat

SEQ ID NO: 13270 - DNA, 1501 bp, Oryza sativa
gaacacttgagtaggcagtggatatggatggtggtattgctacatgtcacatgcgtgggggcatggaattctgactttctgaacagagcattatctactcccatcttgcatgcatcaattccccccaaatccaatctttttcctacctgtaagtgctgcattgatcattctgttgtctgaatctctgttactccaaagaaacaacagatctactcagagtttcagataaattatgtgctttttagagtgcgacatgatgtactgttactgaacagtgatcgttgcttgaatggcactaggaagtaatcctatatgggaaatcaaaataagggcatatttagttcgagaaaaaaatgtttttggtgtcacattggatgtttgacaggatgccggaaggggttttcggatacgaatgaaaaaactaatttcataactcgcctggaaaccacgagacgaatcttttgagcataattaatccgtcattagcacatgcgggttactgtaacacttatggctaattatgaactaataattaggctcaaaagattcgtctcgcaatctttcctctaattgcgtaattagttttttaaatctatatttaatactctatgcatgtgtcaaaaattcgatgtgatgtttttaggaaaattttttggggaactaaggtttctgacgaaacgatcgatgaatcaatccatgatctgaagtctgaagagagcatggcaaggcatatgcatcatgatggatgggctaggagtaacagttatggagtatggtaagctatgatgcagccatgcaatgcaagccttgtgctgctcctcgtcatgaattcataactatatcttggtgggatgcaattacaaagcaagtttaatcggtactcctcctagcttgtaggttctgatggaaacaagagatggcagtatatatggcactgcaaactggctacgctcgaacaactggtgatagtttccgtgatttgttgtcaaatttgtgatccttgactttgaactttaacccaatgcgatttatgcttcatatcgatgattacatgtgttggtcctgaaatttctagagaatccaactgtttgcattctgagactgaatttctgaaaccctgaatgaatatgctgcaataagcaagtagtacagtaagcattctgcgttgcattcaggccaactgccatgctgctgctctgcgacgagaccagtagaccacagggagagcagcagaaagaaagtctgtgtccggcccatttagtcatctggcccaatatatggagaaggaataagttcacttaagctcccttaacttgtcaattaattcgattttcgtccttcaaccagaaaaaaccagatacaacaggtccctcaactatcaaaaccggtgcaaagcaggtccctcagtggttctgatggtggttttggctgatatggcgcttacgtgaccggtttgacttggtcctcgtcctacgtggcggtgacgtggcactggaagtaa

SEQ ID NO: 13271 - DNA, 1501 bp, Oryza sativa; identical to SEQ ID NO: 13267

SEQ ID NO: 13272 - DNA, 1501 bp, Oryza sativa
atgaatcattccttctatagacggtcacatcaacatcggtaaaaggacaattgtaacccatagaacataattcagaaatagacaagagattgtagtttagagatttaacaagagaacgttggcaatggaaagatcattagagattgcaatcttacccaatcccataacctttccctttccatcgtccccgaagaccatgttatcttgtgaagtgccatttggatcatgtcatgcccggaatttctatccaaaattccaaacgcttacatgtgtgttaaaccctcgtccaggaatcaaccgaggcacacaataacaaattgataatagagtacaaataaatatctatttgatattcgcaaataaataattactacagaggtagatagttcctctcaaagaaaaaccttctacgcagcggaaaaaaaaactataacaaactacggaacagctatggcgactccactccacaggcatcttaaccaggaacaagcctaatcctccagatcatcaccttcactgagatactcctcttctgatgaatgattattgcaaaaatgagcatatgacatactcaacaagtcacacagcaaatatgcaagtgcacaggataacaaaggatggcataatatagctcatttgcagaaacaacatttaataaatatttaagggaatggtaaaaacagttgaataattaatcaatattaaataacaccatacaacacacccatgttgcataggcccaacctcatatgaacaaccaaccccggttgtacaaatctaacctccataccaggaacgtaccattccaaaccaggagtcaaattaattatcacaattaccattaatgaataatatgggactaatcacgaaaaacattgctcaactcacccataaccgcgggtacggctattcgaatagattaaactctgatcagaggtgtaccactgtacccacaagtcacaatcccacaacatgttaccatgcgccttagtaccaccacgatacctcggaaaggagttgtgacaataccccttgcacaacataatcctttacagcgcacctttcctggatcataatcacccccttataaacaaggcatggactccccagcgacccccgtggacttctcgccacttcacagtctggcgcactataatgaatcatgctatacaaaagataaagccgttgcccacgctggcttgtggttggcacgataaatgtttcacaacagtagctcgcgaaccggtccttaattgtcatgagcacaaccatcaaaaccatatgctcacaacccaccttaaccaggttttaattatcaattaattaacatcacacgattaaccatcgtgagctaccatttaatgtaaccataaataaaataataatgtaacatagtttataattaatccctttagttagctaatgtttctaagcatggctaagcagacttacatatagcatttagctgaaccaatccaacatataaggttcatgctaatca

SEQ ID NO: 13273 - DNA, 1501 bp, Oryza sativa
aattgctttagtttccgacgttccggaggagagcgtttccgttgaggaagattccgaagcgtttgcggaagcccaaggcaagtcacacagatcccaaacaaacctttgagtatgttgaacccatttaaagctattattttatttcaactatgcattgttttcgaatgtcatcgggtggtgaacctttcccaattaattaatggccgaagatgatcttattttcctatgggttataaatttgattagcatgaaccttatatgttggattggttcagctaaatgctatatgtaagtctgcttagccatgcttagaaacattagctaactaaagggattaattataaactatgttacattattattttatttatggttacattaaatggtagctcacgatggttaatcgtgtgatgttaattaattgataattaaaacctggttaaggtgggttgtgagcatatggttttgatggttgtgctcatgacaattaaggaccggttcgcgagctactgttgtgaaacatttatcgtgccaaccacaagccagcgtgggcaacggctttatcttttgtatagcatgattcattatagtgcgccagactgtgaagtggcgagaagtccacgggggtcgctggggagtccatgccttgtttataagggggtgattatgatccaggaaaggtgcgctgtaaaggattatgttgtgcaaggggtattgtcacaactcctttccgaggtatcgtggtggtactaaggcgcatggtaacatgttgtgggattgtgacttgtgggtacagtggtacacctctgatcagagtttaatctattcgaatagccgtacccgcggttatgggtgagttgagcaatgtttttcgtgattagtcccatattattcattaatggtaattgtgataattaatttgactcctggtttggaatggtacgttcctggtatggaggttagatttgtacaaccggggttggttgttcatatgaggttgggcctatgcaacatgggtgtgttgtatggtgttatttaatattgattaattattcaactgtttttaccattcccttaaatatttattaaatgttgtttctgcaaatgagctatattatgccatcctttgttatcctgtgcacttgcatatttgctgtgtgacttgttgagtatgtcatatgctcatttttgcaataatcattcatcagaagaggagtatctcagtgaaggtgatgatctggaggattaggcttgttcctggttaagatgcctgtggagtggagtcgccatagctgttccgtagtttgttatagtttttttttccgctgcgtagaaggtttttctttgagaggaactatctacctctgtagtaattatttatttgcgaatatcaaatagatatttatttgtactctattatcaatttgttattgtgtgcctcggttgattcctggacgagggtttaacacacatgtaagcgtttggaattttggatagaaat

SEQ ID NO: 13274 - DNA, 1501 bp, Oryza sativa
tcggattaaaacattttcttatatagaaagagatgatattagatattcttgaccatgaacttatttcatctcttctacaactatatggtttctgcaattggaataaaaaaaagctatatggtttcttgaaatgttgtatatatgttcttatcagcatatatagtattttacatcttcaaaataacatgtccgttacaaaaaagaaaaacgaaagaaagaaaaggaaaggaacagaaaaatgtactaaattaatattcacaaaataacgagaccacttctttggagatataagtaagttggccattcagttagatgcatctctacagtaatgtgcaggaccggccatttactttatcagttaagctaaactactggatcaagcatgtacttatgtaatagaagtgtgtagttcttaacaaaagtctgttactgatacaatctatttctggtgggaaacaaacaaaaagcatagtgcatatacaaattgtgagagaagaacaaactaacaggatttgttttaactgtacctttatggggtcattagtgatagagggaattatgtttgaggtatgcagaacagtgttcattgctaactggaaaacagggaacatgaaacacaatgtttcaatcagcaatgcaggacctgattgtgccagatctgattaatattaaatggattctggcaaacagattctagctggttttaaaatgatcataagctggccaaaacaatttttccaagacacacaatttttctgagacacagtgttctgaaacatatattttcttctctctttcatcttcctagtcaatgcatccagagctcgcccttttctaaagtagtactgaggaaatgaattactgatgaggaatagtctgaatgacaggattttgttgaaaaggtagtgtcacgcccggaatttctatccaaaattccaaacgcttacatgtgtgttaaaccctcgtccaggaatcaaccgaggcacacaatgacaaattaataatagagttcaaataaaagactatttaatattcgcaaataaaataaattattacagaggtggatagttcctcccaaagaataacattctacgcagcggaaaagaaaaaaaacgataacaaactacggaacagctatggcgactccactccacaggcatcttaaccgagaacaagcctaatcctccagatcatcaccttcactgagatactcctcttctgatgaatgaatattgcaagaatgagcatatgacatactcaacaagtcacacagcaaatatgcaagtgcacaggataacaaaggatggcataatatagctcatttgcagaaacagcatttaataaacatttaagagaatagtaaaaacagttgaataattaatcaatattaaataacactatacaacacacccatgttgcataggcccaaccatatttgaacaaccaaccccagttgaacaaattaaacctccaaaccaggaattatccattccaaaccagg

SEQ ID NO: 13275 - DNA, 1501 bp, Oryza sativa
aaacaatcttgaaatacacatcgataaaatgagtgatttcaccccaaaagaacgaacaagttcaatgtgcatcgtaacaactggaccatgaaacaagaagaatcgtattcttgtcccacatctgcaggttgctacactcaccggcaagcaaggcatctagcagtagcactcactcactgaacactctccccacaaaagtatcactactacgcaaacagcgagagcaacggaagaaggaacgcggtgtggttgaacgactcaccgacgagcagcaagaagaggagcgcaacaaaagccacatgcgccattggcgtccgagcccccgagctccgctccgccgcctggtgcccctgccagtcctcctacccaacacaagccggtggccgcgctttcgcgatgcgtgcgcccgtggctcggtgcgagaccgtgcccttgccctgaccgtccgtggagtcgtggagggaagagagagagagcaccagcggagaggaaggaggacgagcaggcgaggacacgagctgacgcctgacggtcacagacgccacagcccacaggcacagagcaacaaagcgggcagtgcagtgcagtggagtgcgtgcgtgaccgtgccgaggcggacgcgaggtgggcgttataaaattgggttgagagtgttcaaacaaaagcggcccacgtccgtatcagtggtaatcggaccaagagagagagaaaaaaaagtgtgcctagtggagtcgtggagaatgcgagaatgtttgcggctggggagattcttttacatggaccaccacatgtcggtcgagctgaggagccgcggtaaaaaatgactttagaaccgggtcgtttacgcgttttgatgcttcttcactcgtgtggagtgtactttaccatgtttagacaggctcattagcgacatattctatcctgggctcctggttttcatttgggtagatgctttgcttgagaaaacagtcgcttaaatgcttgagaaaaccctttctggttcaggagcttgggcccattctcccagtagtagtaggaggagggggtccatggagtccacggccatgcgctcttgcagcaagcgaaagcgagggtagcgcgccggttaccgaggcgggagtgacagggacaggtcgcatcggtaagctcagtccgcccgcaaaaacacacacggcgtgggcccgtcccgcagcggcaaaggcagcgtcccttggtttggcgcgctttttggcgttttgggaagcggaggcgttatttaaagcccacctcaggttgtactgtttctccacatatcagacggttcacaaatgatcagatcggactggtggtgggtgctcgtcactgatggtcttatgaacactactccttccattaaaaaaataaaaaactatactaaaattatgtcacgtcccagtcctaggttaatttttttggacgaatagagtataatatatcttaatacaataaatctgaatataagtctatttaattttattatact

SEQ ID NO: 13276 - DNA, 1501 bp, Oryza sativa
tgtctccccttgtatgatcattgtgctatcttgcgtagtttcatgtgtattactcttgtttgatacatgttgcacctttctatggtttaggcttccttgtgaatcaatttacttgttgtgaggtgctcgaaagagcaactcacaactccccggaagttcctaggaagaactccggaagttccaggcagctttctttgctcggcataaaaagctaccaggaagttccgggccttttgccaggaagttctgggccctaattttaaccactgcaatttgaagtaaatttcaaaatcgcctattcacccacccccctctaggcgacataaaggtcctttcaagaaggtccatgtgcctctttgccattcaaatcacataagcatggtaagattaaaacaatcgaaacctagacgggagcctagggttgctcgggcacggaaacgtggcatgtccataggtgtgtgaaactcattggcgagccgcccagaaactccacttgttcttcgttaagaacgtacctggctggatcaagtgagtcacccctcctcagggttggatgtgtgtctctctccgagaaagaaaacaaacccacaaccacctggcttgccatggtaactccttgacttctcgagaagggatatcgtggcgttttcaccggcctaaggatgaggacgtgacccgtgggtataaaagcctagcggtaagttgctatagagagagacttagattccctcgaatatttatattgttcaagagcttaactctccatcgaaatagtaaaagcaaaggagtagtgctattatctggtaggaggcccaaacctgtgtactttctacgtgttttttctatgtttccgagctgttctgagcaagctaagatgcctcgcagcccctgccgacacgtgagacattgataggacgactgaacgagtatcggggagcgatgacgttctataccttcggccttcgtttgaccgcttctaatctatgttatgtgataatggtcatgcaggtgttgtggattcggtgtggcatgggattctcctaggccgaaattgaggggtggcctagatagaaccgctagaatcgctcttaggagattctggcttttatttttgatgctctactcaattcgatatagagtgccagtacacaaatgaaactatagaccatactagagtagtagattttaggctgtgtttagatccaaatttgtaactttttccatcacatcaacctgtcatacacaacttttcagtcacatcatactaatttcaatctaaacttctaactttgaaaggaaccaaacacagccttaaacgaaaaatttgacaaatggatctttgggaaagaaattttccgacgaacgagatgcattcaggagcaccgcaaacgaggctcaccttatcaactccggcgacaccagagggcatttgggacaattcatctgcacacagagacaaattattcggctcacacttcgcccccaaatgctcgcaagcatc

SEQ ID NO: 13277 - DNA, 1501 bp, Oryza sativa
gtgacataattttagtatagttttttatttttttaatggaaggagtagtgttcataagaccatcagtgacgagcacccaccaccagtccgatctgatcatttgtgaaccgtctgatatgtggagaaacagtacaacctgaggtgggctttaaataacgcctccgcttcccaaaacgccaaaaagcgcgccaaaccaagggacgctgcctttgccgctgcgggacgggcccacgccgtgtgtgtttttgcgggcggactgagcttaccgatgcgacctgtccctgtcactcccgcctcggtaaccggcgcgctaccctcgctttcgcttgctgcaagagcgcatggccgtggactccatggaccccctcctcctactactactgggagaatgggcccaagctcctgaaccagaaagggttttctcaagcatttaagcgactgttttctcaagcaaagcatctacccaaatgaaaaccaggagcccaggatagaatatgtcgctaatgagcctgtctaaacatggtaaagtacactccacacgagtgaagaagcatcaaaacgcgtaaacgacccggttctaaagtcattttttaccgcggctcctcagctcgaccgacatgtggtggtccatgtaaaagaatctccccagccgcaaacattctcgcattctccacgactccactaggcacacttttttttctctctctcttggtccgattaccactgatacggacgtgggccgcttttgtttgaacactctcaacccaattttataacgcccacctcgcgtccgcctcggcacggtcacgcacgcactccactgcactgcactgcccgctttgttgctctgtgcctgtgggctgtggcgtctgtgaccgtcaggcgtcagctcgtgtcctcgcctgctcgtcctccttcctctccgctggtgctctctctctcttccctccacgactccacggacggtcagggcaagggcacggtctcgcaccgagccacgggcgcacgcatcgcgaaagcgcggccaccggcttgtgttgggtaggaggactggcaggggcaccaggcggcggagcggagctcgggggctcggacgccaatggcgcatgtggcttttgttgcgctcctcttcttgctgctcgtcggtgagtcgttcaaccacaccgcgttccttcttccgttgctctcgctgtttgcgtagtagtgatacttttgtggggagagtgttcagtgagtgagtgctactgctagatgccttgcttgccggtgagtgtagcaacctgcagatgtgggacaagaatacgattcttcttgtttcatggtccagttgttacgatgcacattgaacttgttcgttcttttggggtgaaatcactcattttatcgatgtgtatttcaagattgtttctttttttttgggagatgaagaaatggaagagaaatgatcactaaaactatgaaaaatgcatgattgcaaatgtggcttttgcagggcattgcc

SEQ ID NO: 13278 - DNA, 276 bp, Oryza sativa
ggtggcccatgcttccgggccgccagggcgtggcgctgtggcagcgtggccattgcccattggctgttccccctatggcctggaagcgggagaacactttgccgagagtaggaaagccgtgtccgtgagctactcggatacgagccgcggcagaaggcaacgcggcttcgaagccctaaccccccaaattcgctgtcttgactctgctatcgaaacccgcgcagctttcggattcgagggcgaggcgcgcgcagggaacgcgatcgatcgtagcca

SEQ ID NO: 13279 - DNA, 1501 bp, Oryza sativa
cacgctatatgttacaggcattccccctgtgtaaagggtgtgttctttacaacatcttcctaacttttactttctcttctttcgtgcgcacgttctctgaactaattaaatggagacgttttttttagcaaaagtttgctatgagaattactttataatccatttctccgctttacgtgcccaggagaaaacgtttctataccctcccctaaagaatacacccatccgagctgggaaaataccttgactttggaagggtgccaatacattctcttcaaaccttgcttttgagaaagcaaattggatgtttttgtagctatatcttttactacatactcctaccccagtctacaaatatgattttttttaaatttttaatgttaaaaataaacctttctgaaacttatttcaagatctgaaccttttgaccacgggctgacatggtaggataaaactgtcacgtacgcccgtagcgggtggcgtgacagtgttattttgccacaccaaaatatttagattttgagaataagttttagaaggttttatatttaaataaaaattacaaaataataaaaattccacaaatataaggcgtgtaggtgcatatcttcgagttcgatagactgaggtagtatgcgctagttatagatggccatatggcctgtggcccgcggctcggcccaaagaacgcgtgtttggcccggcccaagcacggcgcggcccgactggagtcgtgctcgtgccggcccggcccgacagcgggcctctgtcgggccgtgcttgggccgcgccatcggcacgctgggccaacacggcacggtggaccggcatggcctggcacgctataacggcaggcacggcccgaccgaggcacgcacaccgcagcccagcccgctggcccatcgcctccctcgcatatataagccgcccccgccgctccgctcctccgcctcctccgctcctcaaaccctaaccctagccgcctctctctcgaccgctcgtctctctcgactgcttcgtcgctccaccgcctccacgcctccactccacggctccacttcctccacgcggaccagcggaccacgcctccatcgcttcgctcttcgccggatctagcaccgacggtcgccggcctaccgctggggacatgaggggctgagggccgttcttctctctctttttctttcatctccacctctccgatggccacgctatcgatttcctctttttttttgccaccctcgtcgttgctccgtgagcacttcgtcagatccacccccatttccagtctctgttctcgtcttcttgtagatctgtcgatctctgtcatcaacggcaactccggtgcttcggatgcgtaggtaggtagagtaaaaaaagtccatgtttttctttagttttttttccatgcgacccctaaaccctaattattctctgtgtattgtaggtcgctgagcggtgagcgccagtggtagccaccgttgaggaacagtagtgtcgt

SEQ ID NO: 13280 - DNA, 1501 bp, Oryza sativa
accatgatccatcacgtgtcgccacgtgagacagcaaatgagcaaaccccactgccttcgtccaggcgcgccccgcgctacggccacacggacacggggggacagcacaaggtcgggccaacgtatcaataccttgtcccgtcctgctgctcggtgtggaccaaccgattacgccgggagatccgcctcgggatgcgtgcccacacagcttccacaggggagagaagtacgatggccagactcattaaccgagaattaacccctgattaactgcgttaattgtcgtgctaatcccaccctgggtcagtaacgcccacaccgcgcaaagtcagtggccactgacacgccgatgcaatccaggtgggcccagcgaggagaaaagaacggtgccacgtggacgcgagacgtgggccatgcttataactacctgcccaccaaacgaggagagcagctcctgcaaaatcgagctccagttttgctgccgaaaccacacaaactgtccatcgagatccaactaattctcccaagcatttttaaacaactaaaagttctacatttttttttctcagtgctgcatgcttagtttaggaacagcaattctgttgcattagacagacgatttgttaggatccagcgcatatgtttgcgccggacaagtggggcccatcgcacagtgagaggaatgaacggagcagcagccaagcaagagacggacaaaatggactaggcaaagtacgaggctttcttttctgctttgctcctagcgtgagaagggaaggggggacgccgtcacggcggcatatgcagcagccaaaccgggcaggcaggtggtcgtggtggtgggcagtggaagcagggaggagagaaagcaggagcagaatgccgctgttgctgcaccctgcatgtggatgcaaccatgaacacactagggactactaggctgatcctgcattggtactgccattttgttgcttttcttttctactacactgcttactatctcgcctattgtttggccaaatcccgtaccatggacaattggaacaagaacagctggagactgcaacagaaagcaacagttcagctataatttttctcctgtggctctctctgtttttcggtggaatattttcatgctagattatgatcaagaagtaagcaagatgctaagctctgctagttgccccaatgtacactgttcgggtagcttgaaacaaacaaaaagacagaacagaatggaggacagcatcaagcaatttttgtagctgaatgaacaaaacaactgagaaaaaaaaaactaccaaagcaaagatgtctcctttttatgatattttctttaccttttcggctgcctggttaagcagctctttctctcgaatccatagctctaaccatcttctttggaatcaaccgaaaggagagagagcactgaacagccagtatgctcgctctctcatgctctgcttgctttcaagaacctggcttcgaggagaggaaagga

SEQ ID NO: 13281 - DNA, 1501 bp, Oryza sativa
aggagagaggggatagggagaagagggaggagtgacgataacacgtggggtcacatgggcctcaactttttttttattatcttgtgtgtagctgacatgtgggtcccacgtcttttaatttttacagaatcaaattgccacataagcgccacgtcaatgttacgtgggataaagaccttgtcaaaggagccacgtatgtgtcacgtcagttaaaactgaggacaataccaccgagggatctcgtttgtattggttttatatgttggggatgcgttctactcagttttgcgctcaagggactaattttggactcggcgactgagggactcaaagtgaacttattcctctgtaattcatgttgcgcgttcgtgtgaatacagtcccggcccaactaattgcggcagatgggaatcccgttccggcccatgtagttgggcacgtgtgtggggatccagttacagcccaactcgtgttgacggacctggcggtgcgttacttgcccggtcgattgatcagcaggttgacgcaggatggcgaaaggagccgaaaattccccgggaaggccttattttagaatcgccaaacaaggggagggtggtaatcgtaagaatttggatcgctgccacttattgcaatccaacatacggcgctctctggaaacttccgaaacaagagtgtacaatctcatctaaaaaaatgtgcgatctagagtatagcagccgtcgcatattcagacggatttgctattcagatgtgcatacgcgaatgatacttacatgattatcatttttaaaattacgaccaaaatttgctactccctcctttccatattataagtcatttgattaatattatcaaaatacattcaatgttaaatttaacaaaattaattttagattctgcaatccgaaggagccccaaggtacactagtgcacgtgcgctgttgttaaaaaactaacaactccaatcctacatatatgtcaaatggcatccgttggacgaacatgattcgtgggctggtcccttgactttcagattcagagatatgtagcttattatcaccggcacgtgtcactcctaggcgttgtcaaacgtcactagctaaagcggccgatgcaccgcgaaacacgcctatgagaactatatatgtctatggacgtgcagtagtgacgaagtttttaaatttggatggctgttttggaccttcaggttcaggagaactcgcggcattgctgcgatcgtgagttcgtgacaccggacggaggcgcgcacttgatcggcgctcccatctccaggtcgaattcgattccgccgcggcgaaccaagcgcatgcatgtgtgaatcttcaccgtctttggtacttagtcgattatcacatatatatatgtctcgcaccgaaagttgatttgatttttcgtcgagacatgttgacattgtgattttccatacaacgattgcatcttcttgagcatcatggccagatgcagccgtcgccgtcat

SEQ ID NO: 13282 - DNA, 1501 bp, Oryza sativa
catttaccagaaggattcagttattacgaatgcaatgccaaccatccacagtgataagctacccgagaaaacatttagcaataagtaactagtatcgatcattaacccttaatgacatggtaggtacgcctaacttctcttttgccaagtgaatcatgagggcaccaaagtcaatttgcattgctgtaaacttcgattttaaaaaccaatcatgcataatttctgtaaaaattcaatctgacggtagagaactacaaggaagtgattcttcagggggggggggggaatatccatcacaaaatagacagcacatgcattgagtctatcatggaataaatacgatctaaagtaataacgacatgttagacaatcaagttcagaaacagaaaacatcgatgcgattcgtgcgcggcatgaatacaccatgtcgcggagtatgccagaaaggtaactacaccatgaacagttccgatctagtatatatggcattcccctaaaagtattcaaatctacaaacttgcaccccggatgtgaaatatcatggaattggaaacgaaaaaaaaaataaggggggcaaaaacacaaggcgagccgacaacgaatcctctcattctcgaaccgattgagagcgcgcgggagaaaagatcgaaaagttcataataaaagggaagggaaatgagagaaacctgtgaagaatttgagatcgatgtgttgcaccaggaaggagagagaagaggagaatggcatctaggcggcggcgtatatatcgagaacggaggggtagaagggggattttgcagccttcaactaggcctgcaccacggtggcccatgggatcgatattgttgtaaggaaaaagtccacttagactcccttaattgttcatcgaatctaattcgtgacccttaactagaaaaccgggtagaatgactcccccaattactaaaaccggaacaaattgaatccctcggcggttttgaagagtggtttcgctgacgtggcatctacatggcaatgttgacttggtctgctgttgatgtgacgcttaggtggcattataactaacaacatacacgtgggacccatttgtcattcacatagaagaagaatttgtgggcccacatgtcagtctatcccttcctcatcctccccaatctcccccttatctctctccctcccaattcagcaggggggcgacggcaggcggggggcgacggccgccgagctccgcatctgggcgatgccgagcttcgctctcgagcctcggtcaggtctgagcggtagcgggcgcgacctcaacgaggaagttgggctgcgcgccatgtcggactcccagacgcagtcgtcggggtagcggacggggtcggtggtgggggtgccgaagttgatgcgggtggcgagggagaggaagaaggcgccctcgaagataaaggggtgaccggtggtggcgttgatgaggcagtcggagaggaaggcccgggactgagccagcgccactagc

SEQ ID NO: 13283 - DNA, 1501 bp, Oryza sativa; identical to SEQ ID NO: 13281

SEQ ID NO: 13284 - DNA, 1501 bp, Oryza sativa
cttgctgcatgcatgtgtctgcagtctgcaggcatatgttagatcggttattcgttggtgcaacaacgatgtgtgctacagggctacaggtttgtcgtaagtgtgaaattaataacggcgagatgcagaggcggaggcgcagatgatttactagttctcccctcctcgccgcagtacgtgtcaatgattatcgttatacgtgtttactgtgtgtattatttgtatcagaacagagccgaccagtgcttataaacgtgctatatatgaacatattcgcattgtgttgttgtgtcttgactgtgcatacatgtctctcggcatgcaccatgaaactattttatccctccttatttacatgtcacttaaatgattatgaaaaaaattaaaaaataaaaagatatattaacatgtgttatatcacttcacaaatatgcaagttcaaattcaacttatacatctcgcaacaaaaaaaaataaattaaactacaactagtaacgcatattcaaagttaaatttatttttttgttacgagatgtgtaggttgaatttaaacttgcatgtttatagagtgatatatcatataacacatgttaatatatctttataatctttttaattttttataattatttgaatgacatgcaaacagcgagtggacatccccactagacaccagtttggtagagtgtacctaaaatggtcccataccattcggtgcccaggctttggaaagtatgggggcagttttgggtttaagccgaggaataagttcatctaaggtcccttaattttacaccgaatccgattttcgtccttaaaccccaaaaccaaatacaaacggtccctgaactgttaaaaccggggtaaacgaggtccctcggtggtttagaaggcggttttggctgacatggcgcctacgtggatggtttgactaggtctccgtctcacgtgacattgacatggcgctgacgcgacgtagacgtggcaattatatctcagaaaaataataaaatccgtgggcccacatgtcatcctcacaccccctttcttccctctcccttttcttcatcttcttcccgtaggcgagcgaggctgcgaggcggcgacctcggcaacctcgccgccgccgccgccgccgccgcctcagttgccaggctcctccctcgccggaccaccgcctccatcctccttcccctgcgccgcctctacaccgacgcaacagccagcacgaggcggcagagcttgttgcgacggcgcttcgcatggaattccggccgccgctcgtggctcgtggcgaagaggcggagcacggcgtcggaaggggagagcacggcgtaggcggcgagaaggcgggtcgccgcgaaggcgtcgtcggcgaggcggccggagacgagcatggcggcgtggacgacggcgagctcacgcggggtcgtgcaacggtcggccaggagggacaggttcggccggcgccggacgctgctgcgggggaggcgggcgttg

SEQ ID NO: 13285 - DNA, 1501 bp, Oryza sativa
acaattgatctgaaaattagcagcaataagctgaatgatgccactagtaaaaaaagtgtttataatagtactttgctcaattgaacttaaaaggttacgggaacttgaaatatcagccaacaacattgtttgggcaattgcgtgcatcatgatccactgcttgcttacattttgacacttccgtttatttgtatccttacttccacttccagccttcttctccttgctcttcctaatgttcaaatgttctttgcaacttactattatactcagagaagattttggctgtggtgtgcttggatgttcaaggtggactccaactccggcgtcgatggtgatgacggcatgatccatggcggtagcctcaacagaggcagaatcaacagtgactacaggttcaccatccactgcatgcaggcacgttagcaaggatcaaaataatttctatcaaagtcaagatgaaagcattataggagaaacgactaacgacggcatgaagggctgccactgccaatgccgaagtgggcgttcgtgcgtgcgtagaaaggatgtcgtgcgtgccagactccatgccgttgcacacgctggactccatcacggtttcgtgaggcgcacctcggcgggcctcacgaaacgatggcgcgtggcgcacctcagcgggctagtgacggagttgagccggctgggcgggcctgcattcgtggccaggcgcgagggagcgattcgcgggcggagggcggcggccaaacgaaatgacgcccgcggcggccaaccggccacacgaagcgacgctgggattgggcggggggtgatttgcaaaaaaaacgagattactatggctaattgcgggcggttaagtgcaaaattagcccacctctgtccctagccatcggatgagcatcctgtggacttgattgagagtttccaagtttgcacaggatgcttggttttcacctgatacactgcctggctatgaaaaattctaaaaacaattataacataaataattgtgtgagatatcattacaccaacatgcaaatttaaatcgaactagacaacttggaatacaaatctgactagtagtattcagtgtgtatttctgtttttcacattttgtaaatcaagtttgaaattagttttttgcaggatgataaataactaattgaccaatagttttatttttaaagtgttctataactatttgattagtatttcatacttacaaacaaacgtggggacatacctttagggaatgaaaaaaaattcaataacatttgcttccatcggaagattttggtgccatatacttgtaggatcaaggaggccgactagaggggggtgaataggcggttttaaaacttaatggcacttaaacaaaactaacctatgttgctaggcaaggtgaggtgcaaggttaactaagcaactaagttaagttttgcaaacataggtgatatgggctcaaatatgtctctatgaaagtaaattgcacaaatgtaaa

SEQ ID NO: 13286 - DNA, 1501 bp, Oryza sativa
cacgagttcttattgttaagtagctgagggatacaaatcattgaacattttcctcgagtgagaacctcgagcacttctatcgagactcacattcaagatcatgtttgtgtctacttcctccatcttaaaatacttatcattctaaataatttagtataggtcgtgtttgtagtctaccaccgaagaagaggactcgggttccaccagctgaggggttatagtagacggcgacgggacaataatggtgaatccgtgaatagggtggcagcaagcaagcaagaaaatgggagaggaaggtgaccggattctcgacccctctagctcaatcctccaaccgcgtgtcctcgtgcttgtaagttgtacctgtccatccccatacatgtacgggcttagcctggacgagggatgaagctctcaccttgcatttcgagttagtgtagctcggaaggctatgcgggtaaccaaattattaacgctattcgtttgcacttgtgcatgccaatcaggctttatgcaagtaaccagacacgtcttttagccttttcttagcaagagatggttggttagggagatggctaaactttgatcagctagggaagagctagctagcctgataaatccactgaacacttatttttaattacttggttagctatttttagagatggctagtctgatacgtacgtagtatctaggtaggggcctcttacaaatgaatattgtacttatctccaatttaagcaaccagaggaatatatatgcttgtattcgagtagagttctttcatagtagtagatgcttagttaggtaatagtagatgcttaacactaatattagaaaatgccccccacgtgaacgtctaaaatgggaaatgccccgtacgtgaaaacaacaaaacaactcatagttgattcatgctctcgagaaaacattctctcgttatttacatggtatctaaatagttatgaaaaaatatagaaaaaatcaaatagatagattaatatgcagtataacactctacaaatatgtagattaaaatttaacttttacaagttgtaaaaaaaattaaaactatgactagttaacgtatatccacaatattttttttgcaacttatagaagctaaatttgaccttacatatttgtggagtgatttatcatatattaatttattttattcatgtttttcttatttttttacaatcatttagataacttacaaacaacaagatttataacaactcttgtactccaccgaaacaagaacaatggtcccccacacgacagttccacacatatcgcacgcttccccttccctccgtcccttgagccatggcgcgcgtttaggctttgcaaagagccaaagccgcgcaaaaagcctacacagctcatccatgcagctgtgacgctgacgcagatcaaccaaccactactaccgcccgcaagctcacgcagctccagcactggcctcgtgttcgatcgatggacatggcggcctgcg

SEQ ID NO: 13287 - DNA, 1501 bp, Oryza sativa
ttttttttgttgcgtttaaaattcaaaaattatatttattgctttatcatcactaacgtgtcgtaagttacaacccgtcagagatgagtcatcagtgacggtcaggtagttgcgacacgtcactgataactcatctgtgacgggtgacaagttttaacccatcaaagatgacttatataccggtcagagatgggttatctgtgacgggtgcccgtcacaggtgattttgtcatcagtgaccactaatcactgaccaagaccaaacccgtcaaaggtgagggtttgggcccgtcagagatgacctggtccggcgtagtgctccctcctcccttcccatccgatgcccagcgagggccgccgcctcctcctcctcctcccttcccgcacgcgtcaggcggggccgcgcccggcggggccacacgctgtaggcggccggcggggccgcacacaggccgcgcacgggccgagtagcgagtggtggcaggcggcgctaccggcatccattctttttttcttttttttacaatttgtgattcagcgagatgtataattttgtgatttgctgtatggatctgagatgtataatatgtgatgtatttggtctgtgtgtaatttttttatgatttgtgatgtatttgatttgtgtgtacaagtagcttaagatttttgatgtgaatgttttgtgatgttactttgatttggggtttgatttgggaatatgcatcccactcgatttgggagaaaatacagggattaaactctggctaaaaaataataaaaaaaagaaaaggagacctaatgggactgccgctaccctctctttagtcccggttatttcacctgggactaaagatagtgatctttagtttcggattcatagtcccggttgaataaccggggctaaagggggttacgaaccgggagtacaaagggcttgtttggttcaataccctaccaaaatgttggtagtgccaaaacctaggcaagttttggtactaccaattttttggtggggtagagttgtatttggtttgaggccaatttagaaccaagcattgagtagaatatagaaaatatcaaattgggcattggcaatgccaatgatttggcttcaaaccaaaattaccagatacactgttcaaactaccaaagtattggtagggcacgtttttggcactaatccaaaacagcccagagggtttctccactagtgataacaagaaacttgtttagagcgtacctgcttcccaagcgtgtcgcccttatccggctgcctcgtgtccagacacctggcacaacacacatcgcccatcttacacgtgcacatgctcccgtgtcacctcctcaacacttgcacgagttcttcgttgcttgccgctctataaatttccagcttcctttcgatcctcttcaacaattacaataatcatcaagcttcttcttatgttcatccaaatccacagccataaaagtagccatacttgagtttaggtagccagca

SEQ ID NO: 13288 - DNA, 1501 bp, Oryza sativa
ggaggatctttcgacgtggagtcgaccggggtcgtaaccacgccattctcgctcctggtaattgctgggccattcgagatcggcatcgtggtgtagaccgggaagacgatttcgccgacttgagtccacaccagcatcgttgaagttgaggctccttggttgatgccggggtcgacgctgtcgtcgaagaggcttgaagtcatagtagtagaaccttgagcaccaagtcgccctacctggcgcgccactgtcaacggaggatacccgtagacctggggtccgttggaacgaggatctacgtagtacggcatcaagcaaacagaaagcaatgattatactggttcaggccccttgataggtaatagccctaatccagttggtatgggattatatgatggaaatcacataatacaaagggaataacagaactcgatggtaccgacgagagagtagtcgagttggttcgactagatctcccggcgacttggctcctatgcgctccggcttcgtagctgtggtggatgtgtttgcggtgagattcgatgccctaggtcctgcccagggggtcccttttataccgcgggttagttgatctccaagtagaactcggagatatcggacctctcacgatatggtaaagacccggtcttgcccgagtaggactccttacatccgtggattctgtttctatcacgtgatagatttccttaacatatactggaactatccgtatacgcgtgggtataccgtatcaatactcatcgtacgtctaaggatagagggtataccttatccgtaaccctgacaatatatatatatatatatatgtatatatatatgtatatatatatgtatatatatatatatatacatatatatatatatatatgtatatatatatatatatatatatatatatatatatatatacatgtatgtatatatatatatatatatatatatatatatatatagacacacacacccctaataaaaaatacgtaaggtttccggattttttttccgtccgtcatcctgttcaaacgttgctaaaatcatttttaatcggctcaatagtcgagtcggaccattttcaatctacttcaaaatcacgattgatatagaatatgtattaattgattgaattattgaacacaactagcagcttgccaacttggttagcggagtgaaactttgctttggccagctgggttcgattcccaccaccctaactttttacatttataggtggtttcacttacgtggcatcctagtcaggaaaaaatatatatatacgtgaggtatatatgggtggtttcactgacgtggcatatagtcaggaaaaaaaatatatacgtgaagccgatatgtcagctgcacatttcttccccttctcctcttttctcttctctcttctcttcttctttcttcttcttcagtgagggatctaagccggccgaatttataggtggtttcacttacgtggcatcctagtcaggaa

SEQ ID NO: 13289 - DNA, 1501 bp, Oryza sativa
gcttgatcagtcgtcaatcatttggagaatggatgctgaacattggagtttgagcgagagccagtagttgcaatgtgcaatgcaaatttggacgtataatttggcctcgccaccggtctggactcctactatgtcagtccttttaatctgagacactaccgtccatttgtgaggggggcacttccacatttctcctaggagtacttcattctcaccaaaatataaaaatctagttgtacgaatttaaacagagactgttcagttttatggtactaagatatatcactgtccagattcacagtagtagtactatgacatgtcatatccaatatactccatccgtcatataaaataccaatctaatactccctccgtcccataatataagagattttgagtttttgtttgcactttttggacactcgtcttattaaaaaaattttggaattattatatacttttttgtgacttactttattatccaaagtactttaagtgtaacttttcattttttatatttgcacaaattttttgaataagacgagtgatcaaacagtacaagcaaaaactcaaaatccattatattatgggacggagggagtacaggatatggcatatcctaatactacgaatcatatgccacttccagttttagatttttgtttttttgggatagatgaagtaggttcttatgttttgggataaatagagtagctagtatctttcttttctttttttttctttgtttctgttgttgcaacaatattactgttagttgacttaattggcattttggcaatatgcaacgttgccctgcgctagagtgaagctcaaatagagaaaatttaccttgttttttcacgtacatatatacttttcgaacggttaaataatgtattttgttaattcattttttaagtttaaaataatttatatttaattgattatacgttaatggtttacgtatcttcttcttcctctcttttcactatcaaccaaaacacgcttgagaatgtatagtcactggtattaggttcgaagatgagaagagtagtaggcaagtagctcgagatagtttagctctctggtgtctaatccaggccttttggatcatggcccgtccacgtgggctggggtcggttaggcaagacgcggcccaaagtcgctacttgcgtgggccttgcggttgtgaatgtgcgtgatcgtgtgagctcaaagaccaacagtttccttatctatttcgctttaatttgaacagaatagcccccattttgtttttctcaactcaaaggcaggacgcaaaccgaatttgcgagatgctctactcttgctgcagtctgcactcgcgctagtttgttcatgatttctcgacacggaaatatgaataaaccctaaaccctataccctaaaccctataatcccagcgtagcattcaagacaattgttccttcttctcgtgacaagaagcaagctaggtacgctcgctagctgaaaaggcagc

SEQ ID NO: 13290 - DNA, 1501 bp, Oryza sativa
tcgccgcgaaaggcgacagcgccgaggccaccccacccacgaacgtacgcgcgtggatagcgtcggtgccatctcgtcacggcgggcgcgaggcgacgacgccgcgggcggcggtgcgtgacgggtggccggcctctgcccggccggtggcatgggtgcttcggtgcgcgcgcacgtacgcttgcgggttggcgcgacgcgtagctgggcatattgctactactacgactcactagcgtactggagtacactactaccgcccgtgtaaatacagccactgcactgcagcatgggagtgtatgcacacactgtatacgcacatacgtacaacacgggcggtacgtgacagaagctacactacgtaccagcctactacgacgtggcgtcgacacgccccggagttactgcggcctgcgtcggcattgattcgggaagtggatctacggcgccggctgttagagcatgtacaatagtatacttattaaccagctgcaaatatattttaataagataaaagataagagagaaaagcagcggactatagatctgtagccagctgcagcacggactctaagacctaatgtgcgtataacaggtaggactatatattaataatatagtaagcaaatattgtgtaaatttgacggagcgtggagctcctcaccgggagaccgcgcaggcccccctttgccggttcggccgggggcgctaagtgaggttcttcgccctcgatcgatcacaagacacgggcgatgtagacaggttcgggccgctgagaagcgtaataccctactcctgtgttctggtggatatgtgtgtgaaggagttacaaagagccggagagccagagagttcaggctccagaacccctctagcctccttttttctttttttttctctccccttttggtgggcaaggtcctccttttatatctcaaagggataccacatgcaccacttctacctacttttcttttgggtggggacctaccctatcttgaccaaaacttggctcgcgccttcgcctggaagctaaatcacagcttgtccttgagtgaggcccagcgccatcactcgcctgacacaggggataaccctgtcattccttcattaatgggtggagatttgcaatggccgctgtccgaatgaccctccgatgggatgggtcatacctacctccactccgccggaagcagatgcaacgtgggagcacggttgtctgccgatgacgtgaccggcgtcagaccagtcacagaccggtcattcttgtccaccgcatgtcagtttagcatgccgcacgtctacccttcttcatacaatgacttccttgccatggttgcgatgaagcctggaatgaatctggccgggactgacataccaactccaggagttagcacaccggctctggctagggacgagtgcctggaggctctcatcattccgacgggacggggcgaggcgtgtgtcaggccgcatgttgccacctaacccgtgatctgac

SEQ ID NO: 13291 - DNA, 1501 bp, Oryza sativa
cccgcgaagcagaggaagagtgggtggagaagaggctagcggttagacccagggtgcgcagcgacgatttagaggcagaggagcctgccctctcgaggtcacccacgccggagcaggcctcccgttgctgcaggcgagaagaggcgggggaggggaagcctccccgccgcaccgccttatgggggttggttcgtgctagccgaagaaaattttgtcttttgcaagcacgaggtggaggtttaaacccatgatctactggtcacacgaagagcatactactgatgcgctacctccatttttcaaacggaaacaaacatacactcaagatacattgtagtaatgctaatattataatttaattagttacatttgaaagtatttgacaaaataatataaaattttttgtgataatctcaaagagtacccgtattttttctccttcatgtcgataacaaggtactctctctgtcaaaaaaaccaacctgtctataacaatgaatttggacaatcctctatccatattcgttgtattaggagttaaagtttgttttttttagatggatggagtatactataaagcatgcccgaccggccagcccagacacacgtacgtactggcacgcatgcatgcaaaatgcgcttgtgtttctccctgctcgtcgattaccgggttgactcggccgcgccctgcttgcgcacgcgcgtgtacgtgctgtgttaatttgctgctgccatcgatccgatccagcgtcgatcgatcgaacgatacacggatcgatgttttccttgtcgtgaatgatggcagccggagacgacacgtacgccggccggccgcgtttttcctccttgctgatgatctcacgttggaaggagagtagccaccacgccccccgtcagacaaaaatgacatcagaaactgcaacttcgggatttccccaagtgtgcctgtgtgtgacggcactgacaagcggggtcccatgatgtttttccaaacaaattaattaaggacgaagcggcaccagtctcggatcggataaacatttgcaactttttgcaaggttaacattttatcatgttcctcgtaataaaaaatggtcatgttttatttaacgttcgaaatctctcattatagatggttcatatggagtaatcttcggtaaaattatgacatacgtatagttccacacaaaagacactctaagttaatcttaccagaaaaggaagatttgtctgcaatgtagcctttgcatggtctctcacgtggaactgaataacacagccatcatttcctcagcaatttactctctccatccaaaaaaacctaagggtgtgttttagtagaaggggattgaggagaatgggaaaagcgtattgagtattaaatattttatttaatactcatgattaattgagtattaaatattttaaattttaaaaatagattaatataattttttaaagcaactttactatagaattttttttcaaaaaacacaccgtt

SEQ ID NO: 13292 - DNA, 394 bp, Oryza sativa
gctcactgccaccccactctgtcccgctagcttagcgtggcgctggtggccacagtgaacaaaaccagcgccacatagaacaaaaccgtgtgaaatactgccctgtgactgcttgtgaccggttttagtaaagttaagggaccctcgatatctggttttttggttcgaggatgttttttatctcggtgacaagttgagggaccttcggtgtactttttcctaataatgacataacttagctataaatgggcctagtataaagggcccatgtctgggccggcccaatcaatttggatcccatacatagaccgactcggtgacgtcagcgtccatcgcgactcaaactccaagtccctatctcccggcgatctctgacttttcgccgctggtaagg

SEQ ID NO: 13293 - DNA, 1501 bp, Oryza sativa
gaattttagaagattatctgtgtttctactattaaagaaaagtcttattgatttattgcgcaataaagcatcccaggctgacgtcacccaaggggggggtggcgccgacatgcgggacccacgggtcagtgacacaagaggaggaggaggtgacctggcgggtgggtcccaccaggcagcggtccaagggaggggaggtggcgcctggctcggctcggctcggctccaaaccggcaggccatggaggggcggcggcgcgcgcagagctggcggcggcatgcggttgccggcgacggcgaccgtcggcgggaggcagcggcggccggcacgaaggcggcggcgcggcaaagagagagagagagggagggaaagggagggagaccgatcctcaccgaggggctcggccggcgcgggggaggagcgacggtgaacgatgacgatgagtgacgggaggacgacgacgatgggcggacgtgcttcgggaccacctaggggacaaaatgggagggattagagggagaagggtggtctacggcgagcggattcgcccggcgaaggcggcggccatggtggtgctcaccggcacgcgaggagaacggagctatggcgacgatttgcgtcaaccgagtgttggacggggtagccctcgcaacggcgaagctagtggcggtggttgcgcggcgtggcgacaatgctagcggtggcggcgcgcggccggagagtggcggcagcggcggcgctaggggagagcggcgcggcggcgatagaggcctcgggagagagcggcgacaaaaggaaaaagatagaggggggtgcggaggacctttataggggctcggtaggagcggacgtggccggggggcacccgattttcgccggcaacgtgggaggcggagagagagagagagtagggggattcaaaccgaatctcgccctttttgggtgcacggcgcgggcgggaaggcgaggccgtgggcggcgacgtggcgtggggtggggcgcggggtggagcgccagaggagcggcgaaagcggcgatgtgggcggcggttttggcggcggttgccgccgggctggaggtaggggaaaggactgacaggtgagccccacctgtcagagcccgggggagtgaggggaggcggcctggactttgggagggagcggtagagataggccggcggcccatgatgaaaggagagggagggaaaaaaaaggagaaaaagaaggggaaaaggaaaaaggggattttctggggattctttaatgcttgtgctcctttttaattggttaaaattatttcttgggctctgaaaattccactaaagatcctgttagcatattctgacatgtagaatccaagaaaaattcaacaagccaattccgattattatttgcatttattaatttagggattcaactctaggttaaattaaacaatttcttcggacgatttattttatgaactttaaagcaaggaggagaatttcagagcgtgacagata

SEQ ID NO: 13294 - DNA, 1501 bp, Oryza sativa
gatccgattttcgaatcccgcctctctctcctcccctactccccgcgttggccggcggaattccgcccctaccggccacgtccgggattcccctcccctatttaagctccgtcgccaccccctctctctttttccccattttgccgaactctcccgagctcttgatcgctcccgcaccgtgcatccgcccgccgccgcctttcccaccactccggccgcctctagccgccgctagactcgccgccgcaccgcgccgtcgccgccgtcgggttcgcgtggccgagatccaccccgtccgcccttcctccgtcgagattcgtcaccggaacccgcatcccctcgcgctctggtgagctctacccctaccgccgccttcggccatggtttctgattgccgtagttcgtctccctccctctaacctctctcttttcctcccttagggcattccggacctcgtccgcccgccgccgttgtcctcccgtagctcgccgtcgccgttcgccgtcatcctcctccgcgccggccactctcggtgaggcactccccctcctctattcccctccctctccctcctagccgcgccgggtcaagccgctgccccggtcgtcgccgccgccccggtcgtcgccaccgccttcgcgccgccgcctccgccgccggttgccgtcgcctccgccgctggttgccatcgccggcaacgcgtgcgcgcgcgcgcgccgtcgccatcgccgtggccggtcggccggccttgagccgagctaagccaaggcctcgaacaatgggaagctagtgaggatcatagctctgaaggatgagatagcacgcttgaagaaggagaatgctcagttgaagggtctcccagcgccaggaggagtccggatccgcaccacgccccgcaagacggcgactgcacccgtgcgcattcagcttgcgcccaggaacccacctccgcccgcaattctcgcagctccagctccaaccccagctccagttccagtgccagctcccgcgtccgctctctccttcgctccagcgtcagctgccaggggtccagccagtggcaacggaggttggttgtctgctactcccagtggcagccgcgaccacagcagcagcagttccagtggctcagagccgggcagcagggagacgtatctgccagactccaggagccgctaagagggatctggtgacgagcaggaggatgccttcgactccaccgaccgcaggagccgttccgagcattaggcttgctttccattagtttatcgactgtttagcatttgcctgttagtttgagtgtttaggtctgttcgcttgggggtcagtcgacggtcgatatcatatgcctatgatatggctgtcctaataaggatttttgcttgctttttaagtgttttaattcagatcagaacaattgcagtttaaattcctatataataaagcttagttcctgagcatctgtttttcttcttttcccccgtctgctcttcctcaaga

SEQ ID NO: 13295 - DNA, 1501 bp, Oryza sativa
aagccaaagagcccaacatatagcggaagctccaacaagaataagttttttgatttttttactaacacccacaagccaatttccaaacatatgagatatactatgtggaggataaagtccaaaagagaattgtatagctctccaaagaaatttagaaaaatggcactcaaagaatagttggtgaattgattcatttttcatacaaaagcaacatctcaaactaccattccaattccttctagtcaaattatctttagttaaaacaatccctttaaggagataccacataaaaatcttaatcttaagaggcattttaagtttccaaataattttatttttctctatgtaaccattattaattaaagctaagtacatagatcgaacagaaaattggccattttaatgaaaattccatctaaaaatttcatcctcgtctgttaagttaatatgcacaatggaagcacataaattatgccatctaattagattttgaccaactaaaactcctctaaaagaaacattaagcggaacagaacccataacattagcaattgaggcatttttccttctaactatagaaaacaacgaggggtacttttccttcaaagaatagttccctagtcacttatcctcccagaatcttacttgttcaccattattaataatccaggaacccatatttaaaaaggaattcttaaccttcatcagacctgaccaaaaatgggaatccccttgtttcctctcaacccgagtaattgatttaccagtaagatattttcgtttcagtaaatcttgccacacaccttgctcatttattaatttaaataaccatttacttaaacgacattggttttatatttctaaattatgaactccaagtccaccctgattttttggttgacaaataatatctcatcttgtcaatctatactttttttatgttcatccccttgccaaaagaaacgggatctataataatcaattttttgaagaacccctttaggaatctcaaaaaacgatatcataaacataataaacatagctagacttgacaaaacagaattaatcaaaaccaatctcccaccaacagaatttatcaacatttgaccattcattttattcaaaatttttgtacaaatatgaaaatatttacataaattttgatgatgaatcaagtcataataaattaaatgataattacataaattttttgaataagacgaatggtcaaacattggataaaaaatcaacggcgtcgtacattaaaatacagagatagtatttaataagagctaaatatatagccgactgattcaagcaacacaaaacagttccctttttggaaaaaaaaaagaacagtacaagtactggactggttcatatttgtttcctctttgggaggtgcatgcaccttcgttgatttcttattagtagagcccatctacctaattaccgccaacaacacaaaatctccaaggccgtgagcgccaataacaaaagt

SEQ ID NO: 13296 - DNA, 1501 bp, Oryza sativa
tccgcatcattcgagtaaatcaattaaatagctttgtcgagtgcaggctgcttctttacaatacttatgtaagattagcctagagctaatgttaaaaggtaatatttagtcatgaattggtaggctaaacattagcctagaatcgtatgtttggatctatgggcaaggctaaaaggtggagagagagtaaaaagagaggagagagaaggagagagagagctgtttttttatggtccccacacaaaattagccccattaacatatttggagagactaatgttttgaggggggctaattcatattagcccaaaattagcctacctgtttagattcttgtgggctaatttgaggctaaaaggtgagggctaaacattagcccatgaaatcaaacctggccttaattactcggccatcagctcttgtataattaaccgcataaacgtacgtactccgtagcatatatacaggccggtcgtactacattagtttagagtagctttgtaacgaggagcaaagagaaaaccggcaacacagcaggaagtaagaaatcaacagaaatagccgagggacaattgatcagtgatcaagggcgaatccagcctccaaaaatcattactgttggttgcccttaaattttacaagacgacacttaggcgtcattttagattctactccctccatttcatattataacttgctagtattgcttacatatatatgtgtgtgttttaatgaatttagacatatatatttagcttcattaacatatatatgaacgtgggtaatgctaaaaagtcttattataatatgaaacggaggaagtagaataaaatcattgtttgccaggttatctttctgaacgctgtatatacgatggtatccactactaaatcactactcccttcatatcaaaatattccaacctaagataagatataatataatctagcacaacgagaatctagataaaccaatgttagattcattgtacttgtactagattattacattccatcccatgttgttttgttttgggatggaaggaatagaccactgcaaatccgtttccatttacgttcgcaaaaaaaaaaatacgtttccatttctgaacaaatgaatcccgcggggactgtcctccactgaagaaaaggattggcaaatgggcaaggcaattgactggaccaacagtgcaagtggaacacatgctcggattcgtgcttttctgacccacccagcattacaagtggaacagcttagctccttccttgtcgtacgacgcaacagtccggttcggaggacgtgtcgagtcgtcgaccgccgaagcgaccaacctagctcgtcaacgagcatatgcaaatgcatcttcctttacaattctccaactaaattaaagaacgaagtgcacgtgccatatactcatgtcatgtcaatacgatctatttatgcatgctgaaaccagcgtcatagtaacgagaagcaatgcagagttcagaaatggggg

SEQ ID NO: 13297 - DNA, 1501 bp, Oryza sativa
gtgtacatacacatccatctcccctgcgcggatgcgggggcgcgaaaaattttgtctccacgacgtgtatttcgcgccttttttccgcaacggaaaaaaaaattgaaacggtgaggcgttattttgcctccatgtccgttacgcactgcagtgtaagtggtcgcagctgccgttgcgtcgcacgtcatggggtccaagcagaagtgcagaacagaagaaagagatcgaagaaaaaatgggtaagtacacccgcgttgcgtacacgtccatgacacctcggatatggtgcttgctgcctccctcgccacaaacaataggaaacccggccgacctcgtttggtataggtccagctaaattttgttatattcatactctaaactagctgaagtcttatatttttgaaaaaaaaatatagtagtcatagtcttgtcaaacaccatagagcttatgatgttaggtaggtttaatgtgccaatatttgtgtgtctgggtctagcgcaaacatgttcagtcaatgtcgtgtctatcatgaaatgttgtctttaaaaatttatacaaagaaactttatatttagagactattaatatagaaacatttagaaaaaaaatatatggttttgaattagaattagaatcagacatataaaatttttatggcctacaaacttaccagaaaatgaaaaaaaatatgatgctaaaaaagaaaatcatgcgtgattcgcacgatatctttttttgtaagatgttctcttcaagaaatctcgttcttgaaaaattgcattatgctgtaaattattgtttttttcctagcatttgttctagcagtttattttattaatggatcaaaagccggcttctacaccaacaagtgtgtacacagccaactagcggttcatattcatagtggtttttccagtggtcaccatatgggcagaacaaatacatcgacgttgtaaagtttcttggagcgatatgtttgtgcatgccaggatgataggaatccatatgattattcagcaacaaacaggcgtcagctcatctaaagaaaacaagtgtcagctcatgggaagcacatatatctctctttttgggggtcccttgcatgcaagggtcaaaatctggtgccgtgactaactggcccaactgtgcaatgcacacagcataattctggttctctgcaggaatcttcttgttggtttcaggaggaaaccaagtcactaagcacaaaccagaaagcctcaagagaagggtttgtagagatagcttaattaaatgttaacaaatctcaccaagggtgcaaggcactggctagcacctacttttcagggcttaatgctccttaacaagaatgcaaaacatgataataaaggcctttttttttccttcatccttccttccttcctttgctggctgttgttgccatttcatgagtgtccacttcacaacaaatgtgacctaaaaatgagagagagagataaccctttcttctttttttctccc

SEQ ID NO: 13298 - DNA, 1501 bp, Oryza sativa
agtaagtctaatgtaattgagtactagtactactaatacaactaatcacacgtgcttagattctggcacttggttaattagactgaaactgattaaccacgttgtttacgcgaatcgatcgatcatgacatgttggttttttttctagagagagttttaattgcaagagtggacttcatgtagtactaggtacagctagtagctggctgctacgtggaagctgtcaatgcattctccattctccaatgtcaattgtgtacagtatcattaacgaatacattagaacagtgattaatttagagggacaggtcttggacctctcgtgtttatgaagttgatggaactaaacctaagttagattacactccaatgtacttctaaaacatcagggttgtctatctgcaactactttagaatctatgcttaaatactatggcgttgttagaagaggtttagggcctgtttgggggagctttagattctgagaagcggctgtttggtagccagcttctgacaatctgaaaaaactctgaaacccagcttctccagcttttggcttcttagttcatttttcagaatctgtaaagctgtggactgtttgaggcagcttctaacagaagcagcttttgggaaaagctgcagctgggacaagctcccctaaacagggccttagacacttgcggcttctttcagaatcttcagcttcctaaagtagtctaacttctaaacaagatttcaatagttcatagttataaaaactagaaatgaatcagaacatagaaagtagaaaactcaaattttctatattctcacgagtagttgaaaaaaaatcacaagctcccctgtcctgtgttcttttgggaaaaattgaagtctgaactttttttgttctatacacacataagaaatgtaaacgtatctgaactttatctgaactggtcaacagttcctctcgatgaaaccagcttatggccggcattggagtgtcggttaggccgtcgaatcgatcaaacggtgcagttagtcgtcctctgtcctgacggacacaatcatggccggtcagaaagggatccaaatccatggatagcttctgattcaagcacaggctgcaaaagcagcgcacacaccacacaaaagccattcgtccttgtccgaacgaaagcaatccgaattaatcccctctagctaattgacaccaaatcaaaacacacctaggaggagaagcagatgctgtggaatgtttaaattcatgcgctttgaattaatctttctgaaatgtatgttttcgttctgaacttggtttctcttgtgtgttgattccttggcagaagaaggcgaggtttatgactgacgtacctgacgagatcatcgacttctgaacatttgatgatcggcattattgcatgcaaatcaccatgaaacagtagtgcagatggatggaggcgaattttagagaattaatgttttcagggaggagataatgagatggatcgattactat

SEQ ID NO: 13299 - DNA, 1501 bp, Oryza sativa
aactaactaacatcgtgcaaataagctgattgcaaatatattactaattataaagtatacttacactgggttgaatatgtggtagattctagatgcagccaagtaggtcaacaccgccttccactttgagaaatggcacctactcaacacaaagaagggaatcagtgatactacttaattagcagatcgaattaattgatgctgatcaggatttcaggtagatcacctgccgattgcgagagaaggggaacatgatgacacgaaagggagaattttccaagtagctggcggttgttgcactactcaattctggagtaggcgtccaatttttatatcgacttaagtggcgatcgagcgaggctgagagcacagagaagatcaaaagtgccacacacaccgcagctagtagggcaagtttaatagtacagtcagctgctaggttcaaatcatctatagttacttaatagccaatttatacaatagttacatataaatatatactacacttttaatatctggtcccacgtatcatatatacattgcgttttagagtccgtgttgcagctggctacaaatctatagcacgccgcttttctctctcttcttttatctttttaaaatgtgtttataagttagtataactgacttagagcaagttcaatagtatagccaactactaactccaattcatttatagctaatctaatagttcattaatacaatagttacatactacactattaatacataatcccacctgtcatagatacactgcgtcttggagtccgtgctacagctagctataaatctgtagcccgttgcttttctctctcttgatttatctacttaaaataagtttaagtagataaatcaagagaatggtattatagaatggtattgtacctgatcgtagagcactgcagtagtccagtccagcctggtttgtgactttgtgtaggtcagaggtttggacgatcatcgctgcctcgattggcgtgcatgcgccgccgctgattcttctgttcagcgcgcgatgatgaagacgagatcgacgagtccggccggcccacgcaaaaaagcaggtgctacgagcagtagatagcggcaaaagggcgtgtttttatggaggttttttggtgcgctggtggtgtgcacacgcgtgctacggtgctagcgcttcgatcaccggtcagctgctcggttcggttcggggcgtagtgcgccgcggccgtgtccggcgagatcgctttcgttgcgttgcgttgcgcgtcagctttgcgtgcgctcgcgcgtcgcggtattggaaccgggaatatcagaggcggaccacgtgatggctgatgcgcggccgcgtcggattttctcagggcccttaaatggcgtggcgactgcttacagacttccaggttgtttaccactgttttgtcaaacttgggtttctgaaagtctggttcctttggactccagtgcagcaacaacgtgaaggttaatcaaccagcct

SEQ ID NO: 13300 - DNA, 1501 bp, Oryza sativa
acgcaacatttttatgatttcgtacgtttttctgacggtaattttctgtcatatgtaaaaactttgtgccaataattaatacaagcagattttcattcccttgtgaaaacttgaatacccctttttttaattgtcgtcagtgctttagatgggaacccaatttttttactgctactgctactttgaataaatgggagtaaacacaccgggaaaaaacatgtggcctggcgagacgcctggtcgatcggcacggccagctggctgttgccggaactagtcgtggagctgtgacagggagttgggagctgagctgtgtgatgaatggacgggtggtcgagtggaatggctcatggaaatcacttgggagagttcttgattcgcttcctcctcttgttgcttaggaaaagacattgaattgatcataatccttcgatctccagtactcttgcgccaagtggtttctaattaatttgtcgcttgatcgatcgcaatactgcagagcgatatatattttcatgaagtaaaaatcgattttcatgaatcgaggcctttgaccagttcgatatccgagaaaatatatatagtgcaaaccatatatgttgtggaaacaactatcgttggatcgaataataaacgtctaagattcatccacgtcatgagtaaatctatgagtaaaattttttactcgttatgacgtggacgaatctcagacgttcaatttttaattcaacggtagttttcaggttattactatagatacgttgtttccaccctatatcttccgtcgatatccgatccaatcttgataactacactagaaaggacaggcaagtgagctatagagtgggttgctgaaagttgcaagcaagcattccaacaagaggccagcccattccagtcgaaaaagctaaggggcggctagttgcgcgcgccctcctccgcgcgactggacatgtgtcgcgcgcggagaggtcggcggacggcgcgccgcgactgaggagcgatttttccctttttttggtttttttcgtttctcttccgttttttttgtttttttcatttctcttccctttttttttgtttttttcgtttctcttccgtttttggttcccctttttttaagatgtacatattacaaagtttgtattcgtgttataccaagtttgtattcatacgtatacaaactttgtattcgtatttttttctctcggtttttaatatgtacatatacaaggtttgtatacatatatgcaaagtttatataagtttatatatacgtatgtaaagtttgtatacgcgtatgcaaagtttgtacacgtgtatataaagtttgtatatgtgtatattttgtatacatcgatttttggtacacataaaaattatatatacacgtatgtatatattttgtatacatatatagaaactttatattattaatacaaaatttatacatatgtatacaataatacaaatttatatgtatgtatacaaagtatataca

SEQ ID NO: 13301 - DNA, 1501 bp, Oryza sativa
aataacctgaaaactaccgttgaattaaaaattgaacgtctgagattcgtccacgtcataacgagtaaaaaattttactcatagatttactcatgacgtggatgaatcttagacgtttattattcgatccaacgatagttgtttccacaacatatatggtttgcactatatatattttctcggatatcgaactggtcaaaggcctcgattcatgaaaatcgatttttacttcatgaaaatatatatcgctctgcagtattgcgatcgatcaagcgacaaattaattagaaaccacttggcgcaagagtactggagatcgaaggattatgatcaattcaatgtcttttcctaagcaacaagaggaggaagcgaatcaagaactctcccaagtgatttccatgagccattccactcgaccacccgtccattcatcacacagctcagctcccaactccctgtcacagctccacgactagttccggcaacagccagctggccgtgccgatcgaccaggcgtctcgccaggccacatgttttttcccggtgtgtttactcccatttattcaaagtagcagtagcagtaaaaaaattgggttcccatctaaagcactgacgacaattaaaaaaaggggtattcaagttttcacaagggaatgaaaatctgcttgtattaattattggcacaaagtttttacatatgacagaaaattaccgtcagaaaaacgtacgaaatcataaaaatgttgcgtatacaccctaattttctaggcaagaaaaagatgcataatagtccatgtaccccctaaactcttgatataagtctatctagcatcttaaacattgaaatgagacatctaacctcctctaaactaactttgtaataccgttcaaattactctctagcattgttttggatggtagttttgggtatcttggaaactaaatgagtggttttgaatatagcaggtttacacatcatcgtcaataataggtcgccaatatatattctatagtgatgtcaccttactattatattaacatctgtctacattaaatgagaacaaaaaaataagggttaaaaagtcaaaactaaagatttaggtggatattttaacgcatatgtccaattcatatatcacgtaataaaactctcatccaacgtatacgtaaatcagatagaaagctatctataaaacctggtcaaggtgctagatggattttcaaccaaaatttagggggttatttggactttctcctatgaaaattgagtactagtacgaaactgtgaaggctcctgcagatactaaaatccactgaaagctacgttgaaggcttataccccctggcaagacttgaaaattcaagtcacgcatgctagtttgtttcacacatacactatcatcaagccgtttggtcatttccacgccagtgcgtataaacgccagtgcatataaacggtcaggaagacgccggatcatccgacaattgacgagttattgag

SEQ ID NO: 13302 - DNA, 1501 bp, Oryza sativa
aatgcttcaacagctctgaggtcaccaaatattgtttgtctgcgtgttttctcctcaagtgccttatgtagttagtcctaaaggtttacattttggacactacctttgttgtttgaggctaattacttaagataaagtctgttgtcaacttcaactcttaattaaccaaaccaatagttctagtttgttgttttgactgttcataatatctttcagtgtccaagatgtctatcagtgttgtactatcaattaatcctgattttttttcccgtgctgcagtttttcttatttgatactccttccgtcccataatatagcaacatagtaccggatggaacatttcatagtataacgaaacagtcctagattgccattgacaatagatattatgggacggagggagtacattttatcctgacaaactattgacaaacttatctgactggcacatcaaaaattgcactgaaatacaaggatggtgtgaaacttgagcattattctttcgttcatattaacaaggcagcctattaacaaccgggaccacctatacatttgacgacaatttttctcctaaaaatttgacagaagtaattacactacactgtaacttatatgtaattacactgtaacttgcatgtaactagagtgtaacttgtatataagtttcacgtaattttgaatcgttaaatctattacaagatttattttggtgaggaagaaaaaaaatcacagcacacatatatatgtaaggatttgttcccacaacctccattttatcgaaataacatattacaaagagatttttgaaagttacatacaagttatactatagttacagtgtaattacactacaattatactataattatatctgtcaaatttgttagagaaaatttgtcgacaaatatatagcaaaatcgttaacaaccttaggaaaggagggagtataatttcctcagcttggacacaccacagaggatcccgttccggcccaatagaccaacgtaccccccgggtccggcccaggatggcagcacccccacccatccgtagggcccacacgaaaatcaaattccataactacccttcaaaacccacgcctaaactcgcgtaaacgtcgcgttgaaggtaggggcagcgaggtaatttcacgcgggcgaaacgatagcgagaggatatggactcggctcggcgcggctagtgggcaaaaagaaaaaaaaaaaagaaagcgcgattgcggctagggttttattcctttcctcacaaacacaccctctcccccctcactacgtctctctcctctctctctccgccgccgccgccgccgccgactcttgcctttcccacgccctcgatcttggcggctggagagccatggcgatgcagtccggcaggcgagcctcgtagccaggaggggtcagttccccagtcacccaccccacacacgaagatagcgagcttgtagcgtgattttttttgtaggccgtcgaactcgcaccta

SEQ ID NO: 13303 - DNA, 1501 bp, Oryza sativa
tccaaaaacaaatagactcttatcttcctttttttttacaattagaaacttgcattcacttaagtaaccataatttctttcagaaaaaagagaaaatttttaagcagaaacaatcttcaggacaccaaaaagaaagatcattgcttggattttcttccactcttgattagatagtgaacacgaagtttagccagcagtacaaggcaacgatttcgtcggcaaggcttgtgagcttgtcaccttgcaggtcaggctcgaaacggaaatcttctgagaaaacaaacaccggccgtgtttggttgttttggcaaaaaaaaaataacgtatactaacacatatttaaagtattaaacgtagactaataacaaaacaaattataaatttcgccggtaaactgcgagacgaatctcttaagcctaattaattcgtcattagcaaatgtttactgtagcaccagtacaccacattgtcaaatcatgacataattaggcttaaaagatttgtctcgcaatttatatgtaaattgcgtaatttgtttttttttcgttcatatttagtgcttcatacgtatgtctaaatatttgatatgataaaaagattagaagtttggagggaaataaacacacagccactgccgcaattcgcaaatgaccaacgatctgcgattcgatcgctcaaacgatgagtagaccaaagcgaccgcgctcatgacatctacagccccagcccgtgcagctttaagcagtatcaactcaaatcgatcgcatggcacatctgcacgcctctagaaaataaatcagctataaatatattttaagaagataaaagaaagataagagcagcggactataaatttagccagctacagcatagacttcaaaatacatgtgtgtacgacaggtgggatcaaacattaattaattatatagtacatgtttataggtaattattatatgaattagctattaaattgactatagataatttagagcaataattagttgtacttttaaacttgctctatgacatcacgatcagagaaaccacgaacttgatcgctcctgcagatcgaacggtgaaaacgtgaacgctgaacgatgagatcattaaaaacggcaacggagagatatgagtgcttgacacaattggcccgtttattctgttctatccacgactctctttttcttttaaaaaaaatcgtttttatgggttcggacttcggagttctcttcttcgagcaacgccgaggccgacgctaatagatgggccgggccggtaagatttgacagaatgggcccgtttcttttctatctttttgttttttcaattttctggttgagtaggggttcggaattttcttccacgaacccccgttttccgcagctactatgcttttccctcgctccccgtgcgccccgtgattcaagataaggaggagatcgactaaatagagagatcaccgcgtccatcggattgatcgatcggttgttgctggccatgg

SEQ ID NO: 13304 - DNA, 231 bp, Oryza sativa
aacagatggacttgctaaatgttgatgcattctttttcatgagtgtagtttgcagcagcaagccagcgcaaagaggttgcctgctgtaatcccaggctaaactaacactaacagttgactgctgggtagtagggagattatagttgtgtgttttttgtattttcttttctagatcttgttttgtgttgtctgtttgattcttcttcctgaactacttgtgccctttacaga

SEQ ID NO: 13305 - DNA, 625 bp, Oryza sativa
ctgacacgcggtggacaaggatgaccgatttgtgaccggtctgacactgctcatgtcgtcagctcacagccacgttcccacgacgcgcctgcccccggcagaagtggaggtaggtatgtgccgtcccatcagaaggacgttcggagggcaaccgtgcaaatctccgtccatttatgtaaagaagaaaagtccagtttggaaagggaagagtgcatgtggtatccccttaaagtataaaaggaggaccttgcccatagggaagggaggattgattttttccagatttagagcctagaacaagggataggtcggctcagactttgtagctcctccacacacaaatccaccaaaacacaggagtagggtattacgcttcccagcggcccgaacctgtatacatcgtccgtgtctcgcgtttcttccgggcacgcaatctttccacatacagagagagcttgagatctcaccctaagcccccggccgaactggcaaaggggggcctgcgcggtctcccggtgaggagccacgagctccgtcatctggcgcgccaggtagggggctcagcgtgtgttttctgagctctcatactcttccgtgtgcgccaagtttcccttgttctgcctaa

SEQ ID NO: 13306 - DNA, 1501 bp, Oryza sativa
acctgtgatttgtgaattgttaatataacaatataattattttcttgtgataaacaatacatgtattctcatataaacaatggtggtaattttgttaacagtggacaacatgtaaaaagaaggcagttgtacgttgctttcctgaaccacatgaaaataattagtaatatagtacaaggtcaaattagttttctagaacaaaatgtcggtatcagagaagaaaaacatccccatttgccagccattacagctattaaccaaccattccagaactaactaatcattttcctcgtattgaccgtgcgtttttccaatgttgatttcgccttctaacagcggacgcgtaccgaacacgacgccgcctcctcttctctcgactgaattggtcgtcaattcctctccaatctctgaatctgacggcttgttcccattattttccttcaaaaatttatatctagaagaaccaaatcgtgtttttcttatcaggcaatctccaattctctgaattccgaacccgttcgagagtgtcatgcgtgatgcatgcgtgcccatttggaacagaaatgtaccgataatgccctcgggagtggatgttcaggcaatcagacttcagaattcttttctttatcagatttcagagctctgctttggttgtcttctttatctagaaggctttgattgctcctcttttcagtttttaatctactcaaaagtagctcaactaagtgatcactggagattatgtcactttaactaactttagttagtgagctaaccactttatccatttttgtgtaataactcttgaatcatactgtactgaatgctcatttcatgggtaccggaacacttgtcacatcattaaggttgatggttagcccgagctaatcctaccaaaatcagcatacccttttaagaataacaacaacaattttaaccactgatctgtctggaattaaaatgacagataattttatagccttatcgattggcatacgcttatcaaagaaaaaaatatagataaaacctttttatatatgttcttagagatttttaaattaatgcttaaaaaagtaaactacgatcatcagcttcaaaattaagttttagtagaaattaaagataaacgatgagggctgttaatcaccatagggaaacgggtaatctactgtgatccactaatcaggttctttaatcagagaagggcattgtggtaattagccggagcacgccacatgtcagcacccacgaccacggccacgcgaccagccaacgaggcgaggcgaaggtgaccgagcccttcaaagcctccacgccgacgctgacctccccttctcttcccacctcctccactcctccgcctcaaagccgccaagaacagcaagaaaagttgccaaactccatcgagaaatcttcgaagcatctcgctcttggaagtcggagcaccaccgccggttcgttgttgctgcggatcgaatcgcggagcagagcagggggtgga

SEQ ID NO: 13307 - DNA, 1091 bp, Oryza sativa
gagcaacccgaccccccccccctcggggaaatcaggaggagggcggacacctcaccctcgggcccgacgtccccgaaggtgccaggccacgtgggcgattccatctgcctcaagcctccgggcgcaatactcccggtcccatatcaccgacagaagcgtttatagaaatctcacgtggcaacttaagagcgtttgtaaaaagtctaatggatttttagtatataatagatagatatatttaatgctgaatttaatgaaactaattctgtattatagatgttgattttttttataaacttggtcaaatataaagaactttgactgagaaaatagttaaacgatttatataatataaaacagaggaagtatgtgagaaatagatgaattatgtattaataatatagtatatatctataactaactagtactattgtgtaagtaggttataaatgatgttttaatttttagaactagtagctgattataggctgtgtttagttcacactgaaattgaaagtttggttgaaattaaaacgatgtgatgaaaaagtttgaagtttacgtgtgtgtaggaaagttttgatgtgatgaaaaagttagaagtttgaaaaaaaaattggatctaaacacggtctatattacgcttgctataagctgtcacgctcacggagcgcagaggtccacagtccacacgatcgccaaatgcacgcaggaaaaaacgcaatcttttttctttttttggcgacatatgcttagcgaatttgacttggagcgccggagaactcgctataaaaaataacggtgggcttgcgtaagctgcgacacagcgagactccagcgaggcgccgaggcggaggcgtgcgtgtcgcccacaaaatttttccgcacgcttctccagaaaattttcggcctcttcttgtcttctcctctccccgtaatctcaggtcagaataattcagatttcacctcgcgcgaatacgtgtgtgtatggatgatatcaaggagacaaggagagagagggagagtagctgagtaggctagtttcttctcgtcggcgaaggcatcgttcggatttcacggcgaggtcgcca

SEQ ID NO: 13308 - DNA, 1501 bp, Oryza sativa
aaaatcatgtgtttgtgtaaaccttaaattgacatgttggcaaatgtcaatatagaattgtttttcagaatttcgaggtgttgaagacatttcagtgaggaaggttacaatataacatcgagtataaggtggttacaacgcatagttggatgatttcagaggcgtgtacaacatgcataaggtgtttttcatatttcgttttacttatatattttggacgtacatgaaattgttttagaatcagtggcgttctagacttggatggtactaacatactacaatcaatgtctttaccgcaagaaagattcaagttttccagtgtttgtagtaaaagtttctttatagggatttttatggtcaataggaggtatcgagaggttattagagcaaatacttcctccatctacttttgatagtcatatttcatcttgtcacacagaacaaggataagtaattctacttatcatccatttaaacatgctactagtcattcctcgtaaacaaacgattcattaatatttatatttctcaatggccatgtagccaatcatatgtggaagaatagtgagacatacattaaatccgagaaagtcattaagagtatatgttgttggattgaaatatgactatcaaaaataaatttttcagatttaaaaaaaatgactatcaaaaatagatggaggaagtataaaggtacataaaatctatttggagaggcctctcgattttgtcttaactagcgacgcctacgtggagaagtctagctactacatagtactacatgcatgcatttttttaatatacatgtacgtcctttttctcttcaaacaaagttttctcccaaattacttatccaatctataattcgattatataattgtgtttgttacaattaaatcttcacaacaagatcttacatgattatattacgatgaaaaaaatatttatatttgtaaattactttcattttatatgtaagttacttttatcatatatatatatataaggtacttttagagttgattaaattacttcttagacatataaaagtaaatttaatagtctaaaagtaatttacatatattatattataaaagtaacttaaaacaaaacggcagtaattttgtcacgacaataggagtaaattcgttgtagggataaaaatatgactttatctagaaattaaatttaatcagcatggatcaacacacataagtttaacaatttttaaaagtaacttcaatgttaattggaagtaacttttgcatggttcaaaagtaactctctatgaatctgtttaatcatcgattgttttttccctttcatttttgtttttcatgtagaatgagaaaagaagatactgttgtattttttaagttgaaaggagatactagatggagtacaaactagctaccactagctgtgtagtcacatccaattaaatgtcagggttacggataaggtatgccctctatccttggatatacgatgggtaccgata

SEQ ID NO: 13309 - DNA, 1501 bp, Oryza sativa
atatttctaaacttgggtgcactttgaatcaggacgaataggctcagttgaatctgtttttaggatgatgcttactggattgccaattttgaagttccattcagatcaaatattaatgatttatagattcaggtttgtctgaaaacgatataaaacaatatgctttgctgaacttaatactgggagatcactagggtggggtagacggccttcatggcgtctaggttctattgtggtccaacacatactctttttaccgatcctaatagatttggcataggtttatctacatctgactatgactactgtatattcctcaaaaatcctattagtatatgttttctgttctgactcgtctggttgtctcttatattaaaggtaaggaaattgaaggagttgtagctatccaaatacatcagcttctcaaaatagaagagctaaatatactagtaatatgcccgtgctaacgctacgtgtatgtttagtaatagaaatcatgacacatagtaaagaaaagataaagattaggaaaggagatgaaaattagattgaatacaaaaatttagggacggaatattcagtttttgttagcaataaataaataaattatgggccgtacgtgtggcttcagattgggccgctccaaaacccagactctggacggctccgtcacaagttacgccggccgcgccggcgccgccgccgccgccctgcagctccgctcccccggtctttgcgcgtctgcccgacgctccgctggcccttccctcgcttgctcgacgccattgccttccggccactgcctcgtgccttggcctggtgcggctggtcggcgcccttcgccgtccgccaccttcgtgcctgcggctccaacgccttcttcttgcgtgcggacgcctggagggcaggtaataacaaagctcttccttctcccagctcctctccaactccagtggtcctggtgctggtgctgtggcggtggctctcccacatgtgccccatttgatcttcttctcctctttttttttttttttgtcattgaaacatatagcttactgtatttaaagaaaatctctatacattgtagtgggacgggttcagcatcggcaattaatcgtgtctgatagaaattgaaggatgatgaagtttcatggttactttcctttattcatgttttcttctttggcaattatacattgccgactcccactgcttccagtgttgatagttacgccatataccgcttaagcccaacaaaaaaatgaaatcattatttatgttgtcaattaattttgaaaaactgttactatgaattattatgccagatttagattttattgctcaaaataaatgcttatggttaatcaatagtacagaccacagatagagagtagtacaagcaaatccaattatcaaaggtttccttaaaaagtggatttcagttgttctaaattgaaacaaggggacttgtaccaggacttcaagatttagatcgtaagaa

SEQ ID NO: 13310 - DNA, 1501 bp, Oryza sativa
gaaactatagcaaacatgtagtaaaataattccattctagatgagcagtggtagattagaaaataatcactaaaaccaccatacccacgatccaagaactccccaagatcgatgccatctacaacgctcttccacctcctaaccagactatcaatcaaaagtagtagaaagaacggactattccagagaatcctccttctacgagttattagacgaagggaagagaaaccctagaaaactcacctggccagccctccttcgagcacggcctgctcctcgggcgtccaccggacggagagccccgggtcgtggcgcagcgccgccgcggtgctcgcgcccggcggctgggccagcgccggcgcgggggaagggttgcggtggtggggcccgcccagaagcacccccgtggggtcggcgttcgcccccatctcgccgcctgccaccgccgccgccaactcggcaaccccccctcaggccaggggacgacggtcccgcccaaacccgagggaatctcgcgaaggcgcgcagggattccgcggaatcagagctctgcgcggccgggcggcggcgtcggcggcggcgagggtttggattctccggtggcgcggccggcggcgagtcgggggacggggagcgaggaagggagaagggaaacgaatgaattttgggctttttattttgtggggggtagatggatggatggcctggattggaactcactgtgagtaactgccttcaatcatgaaaaaacggtaagttcctgccttcctgcttcagttgagtcttcctttcactttttttttttgctagggtaaatatgaattgaaggcttccacttttatttttccgcgtatattttttaagcgtatgtctccattatatgatatatacgcgttccggtttatatatagatcgagagttagaacacttgtactacttgcctcatctatagacgtgtgtctgattaggtaggttgatatatagacgcgtgtttgactaggtacgttggtacggagatgtgtgtccgactagatacacatgatacatgaccccacctcatcatggggtcgacgttcgcctccatctcgttgtctgatatcattgtcgtccctgggagacgacggtcctatcgagtcttacctaaatcactcagagaggcggacgaattctacttgtatgatagtcaaatcagagcttcacgcacccttggcggtggagacaatgagcgtttttagactatccgaaggtggacgatggcgaacgggggacaagaagtgagaaggaagcgtgagatgaatatgtgcttttttgggggtcttggggttagatggatggctagagctcactgcctccaatcatgcaaatgattatatgtgaatttctcgtttagtcgcatctccatttcgtttgggtaaaggggtaatgtgaatatgaaggtttacgtccgtgtttctgtatatattttatgtttccgttatacgttgcatcccactctaatagg

SEQ ID NO: 13311 - DNA, 1501 bp, Oryza sativa
ccttgaaattcggtcttcactttccaaagagtgaaatgaccaaaagatcgaagaccgaaaccgaaatttttggtcagaccgaatacccactcctagactcaacccactagggttcaaatcctcgtgaatattacgtacatgcatatggacttccaacaagatttttgtgtgcggcctccgtctcattttaagcgcatatgagtttcaatgtccaattttaatcgtttgtcttatttttaaaaaaaaacatcaagtactattcatgttttattatcatataatacaatagaaatattaatagaaaagttttaaataagacgaacaattaaagttagatatgaaaactcgtagtggtgtttaaaatgggccggagggagtactatatattgacgtggccactctgggacgtcacggtcacaaactcacactgatgatctggagcgtttcgaaaatgggtccaagacaaacaggctttgccactagccacctggaagagcggaacagaacagaaagatggtatactagcgcccatggcctgcgcgcgcgtggagcgtgtggtccacgccaccgcggaccgcacagcaacacacgagacgcgcacagcgacacatacgtaatacacgcatccgagtgtggctcccgctgagcggcaaccacgagacggtgcatcgtgcgccgatgcaagcagcacgctgcgtgcgtcgctgccgtggtcgatatatctctcctctttcggccagacgcacgcacgagactggagggaaaggccatcgcgacgatcgagccgtgcgcgcttttacgtgctggtgtgcaggcagcagcgcccgcgggtcggcgggtgcggcagcggctggatcagagtgaattcgacgagggatcactgcggtggtgggtgctcgccggcgcgcgcgtggcatgcatgcttcgctttcgctgttgtgtactcgtgcgcatcattggtcgcgcgctctggggctcccgggccccggccaccgatacatggggtgttaagacactaaagttttagagaatttttacggtccagcaggtacttggtacctgcccgtacatgtaatttgaaccatcgatttcgtttgatctaacgggtgagaaagagttgtacctagtagtactgtccacgtgattttatagagcatagaaaggtactccctccattccataatataagtcacaaccactttttttagatgttccatattataaggcatgcatacatgtagagaattaactatgaccacttctccaataaaatattacttttttagatccttcactctcatgctttctaattctattggatgcatgcattgtatttattaggatgatccaaactacaagataataataataattatttcttggtctttgggttagggtggttatgccttatattttggaatggatggagtactaaagaagcaagggtagttaagtaatttcgcgtgtatcttcttcatcttcctcctgtcttttctctctc

SEQ ID NO: 13312 - DNA, 1501 bp, Oryza sativa
cgtggtgaaggtggcgacagagagagggggaaagaggaggggttgggttagaggaccacgtcgaacacctggcggccgatgaatagtgtcttttcctatttaatccccattttagcctatttcttgtaaatttgattctataaatcctggattttgtataaatgaagtttactcaatatttgtgtcattctaaccaatggatttactctagattaatattactcgtattttatttatataatttatttgaatttttaattagggttaattcttattccgtcgtatttagatttaattaatacaaatatgactgcgatgatattttattcatttctatccccacctcaacctttattttaaattatatttcagttatttattttgctcatttaattttaggttttattactaattaattattctttattcgcgatcaacaaactccgaaatcaaaatccaatggaataggcgaataaaattggcatgatgcaatttatttaaaaagtttttgaaggcccatatttttagagtttagatttttgtcggtcaaattttcagggtgttacacaatagcaaactattagccagctataaatatattttaatgagataaaagatgagagagaagagcagcaggctatagatctgtagccagctgcagcacggactccaagacgcaatgtgtgtatgacaggtgggaccatatattaatcttatagcaagcaactattgtataaattagctattagatcggctatattggagctagcagtgggctatactattaaacttgctctaaacgtcccaaacacctgcggttcctaccaacgccacagcgttggtcacaccgtagaaaggcgtagaataaaacctgcgctctgtgactatggggctatgattggtcaaggtttactcgtggcttggggatcaaatgaggtgacgccgatgtgtggcatgtgatgggacttggctggcgcaaagtgcccggacagggcatgatggaagaatcatgtgaacttccggcacttgacaggctcaagcagtcaggccaacaggtacttgcctgtttagttgcccagagatgatcaatttgatacactaagtacatcactgtagaagaaaacaaatggagtagggtattttactagttctagtagtactaggatatgtatagtgctagtacggtgtgatgtgttcgtatacttcttccgtcctaaaatataaatatgattagtatagtgtcaagtcaaatatttgtaactttagctattaatagcaaaaagataaaaaagatcaaccatgtaaaattgatgttactatatttatcattaaacaaacacaatatacaactctttttatttgaaacatctcacttttatagatatcgttagtcaaagtagcatcttaaagatcatgtcgaagttaaaaaatacttatattttgggacggtgggagtagctttgaggtaaacaaagcagggtgaattattatcttaaaaaaa

SEQ ID NO: 13313 - DNA, 1501 bp, Oryza sativa
atatggacttccaacaagatttttgtgtgcggcctccgtctcattttaagcgcatatgagtttcaatgtccaattttaatcgtttgtcttatttttaaaaaaaaacatcaagtactattcatgttttattatcatataatacaatagaaatattaatagaaaagttttaaataagacgaacaattaaagttagatatgaaaactcgtagtggtgtttaaaatgggccggagggagtactatatattgacgtggccactctgggacgtcacggtcacaaactcacactgatgatctggagcgtttcgaaaatgggtccaagacaaacaggctttgccactagccacctggaagagcggaacagaacagaaagatggtatactagcgcccatggcctgcgcgcgcgtggagcgtgtggtccacgccaccgcggaccgcacagcaacacacgagacgcgcacagcgacacatacgtaatacacgcatccgagtgtggctcccgctgagcggcaaccacgagacggtgcatcgtgcgccgatgcaagcagcacgctgcgtgcgtcgctgccgtggtcgatatatctctcctctttcggccagacgcacgcacgagactggagggaaaggccatcgcgacgatcgagccgtgcgcgcttttacgtgctggtgtgcaggcagcagcgcccgcgggtcggcgggtgcggcagcggctggatcagagtgaattcgacgagggatcactgcggtggtgggtgctcgccggcgcgcgcgtggcatgcatgcttcgctttcgctgttgtgtactcgtgcgcatcattggtcgcgcgctctggggctcccgggccccggccaccgatacatggggtgttaagacactaaagttttagagaatttttacggtccagcaggtacttggtacctgcccgtacatgtaatttgaaccatcgatttcgtttgatctaacgggtgagaaagagttgtacctagtagtactgtccacgtgattttatagagcatagaaaggtactccctccattccataatataagtcacaaccactttttttagatgttccatattataaggcatgcatacatgtagagaattaactatgaccacttctccaataaaatattacttttttagatccttcactctcatgctttctaattctattggatgcatgcattgtatttattaggatgatccaaactacaagataataataataattatttcttggtctttgggttagggtggttatgccttatattttggaatggatggagtactaaagaagcaagggtagttaagtaatttcgcgtgtatcttcttcatcttcctcctgtcttttctctctccaaaagatgctgcatgcctgcatcgatcgatggctctcaccagggatggacaggctagccggagtggaggtggagggggccgacgagcctccgtgcaccacttcccccaagctcgccggtgacatacgtctaccgcggccct

SEQ ID NO: 13314 - DNA, 1501 bp, Oryza sativa
ccaccaccgcagtgatccctcgtcgaattcactctgatccagccgctgccgcacccgccgacccgcgggcgctgctgcctgcacaccagcacgtaaaagcgcgcacggctcgatcgtcgcgatggcctttccctccagtctcgtgcgtgcgtctggccgaaagaggagagatatatcgaccacggcagcgacgcacgcagcgtgctgcttgcatcggcgcacgatgcaccgtctcgtggttgccgctcagcgggagccacactcggatgcgtgtattacgtatgtgtcgctgtgcgcgtctcgtgtgttgctgtgcggtccgcggtggcgtggaccacacgctccacgcgcgcgcaggccatgggcgctagtataccatctttctgttctgttccgctcttccaggtggctagtggcaaagcctgtttgtcttggacccattttcgaaacgctccagatcatcagtgtgagtttgtgaccgtgacgtcccagagtggccacgtcaatatatagtactccctccggcccattttaaacaccactacgagttttcatatctaactttaattgttcgtcttatttaaaacttttctattaatatttctattgtattatatgataataaaacatgaatagtacttgatgtttttttttaaaaataagacaaacgattaaaattggacattgaaactcatatgcgcttaaaatgagacggaggccgcacacaaaaatcttgttggaagtccatatgcatgtacgtaatattcacgaggatttgaaccctagtgggttgagtctaggagtgggtattcggtctgaccaaaaatttcggtttcggtcttcgatcttttggtcatttcactctttggaaagtgaagaccgaatttcaaggcaaaatgtcagaaccgacaaattcggtctctgtcttttcggtctcggtctcggtcctaaccgaaattcaacaatattttcatatatgcaaacaaataatgaaaaatttcaacacaaaaatcacaaaaaatttcgtaagcacgtattagtaaagactcttattaggttgcatgcctaaaagaagtagggatgtgaaaaatagagtttaatcctattgaacttagtgggttttaggttgcatttagatatttttgctaattcggtctattcggttaaccgaggagactaaccgaattgagagaacaaatttcggtttttcactgcctaggatcgaattgatgaccgaatttttggtctcggtctttttctacctacccctaattgagtcatgcacccacgagtccatgacttcatcaccacaccgctggtgcttcctaatagtactactattagtatatctctcctccatgtgtctgccttctttgtgaccccatcgatcgatcgatcgatagctttagagtgtgtttaagaaggaggggattgaggagattggaaagatacgtaaaatgaggtgatccattagcacatgattaattgagtattaattatt

SEQ ID NO: 13315 - DNA, 1501 bp, Oryza sativa
cctcgcccgccgcccgagcccgcctccgcacccatccccggcgccgacctcggctcatcgcgtgccgccagcagcccgcgcccgctaccgcctcgcctcctttgccctcgccgccgcctccgctggcggcaacggctgcaggtagaacctctccttcactggagggcagtggtaggaggccaagcttgatgggcttggcggccttggtgagcgctgcctgcgcgagggcgccgccggtgatcccagtggcgacgaggccgagcatggcgcagcggctggtctggacgttagcggcggtgtcggccgtgacaggcgtggcctctgatggaacgctgatggagaagagagagagagagagattgggagagagagagactgacaggtggggcccacctatatttttataaatgaattgttgactggactgccacgtaggatcaaaaccaccgtggattaagccagaggggttatttgtccggtttgcaaagttgggggtgaagaatgtccggttttgtgattaaggggggtattttggtcgaccgcgatagttccgcggggggagggggtaattcgtactttttcctttttttatgattaattataataccacgtaaacgtaacgttagatgaagattaggtcacgtgccacgcatgcacttgtaggatgaaatcatagtctcaaccccttgtgagaccaagacgggtcggttttaataattgatggagcttctatgtcatgttttgtggttgaaggacgataatcatactgagatgatagagagagccatctttttttttctattttgcaatttgttggactggaagtccatcttttatgcggtgcagccgtgcaggttctgccatctgccgttcagggagagagagagagccttagggtccatagagcgttaagttacaaacaaagttcgtagaagtaactaagtatatgtcagatcatggattcgacaaatcttggctatacgaactgaattaaacatggcaaagtgtccctcacaaaaaatgacagtgaaagtttatcaaacagatgcattatcaaccgaaattcgccccaaaaactgttcggtgccttactataaagaggtggtggtttgatacaagttgatgcgaaacataaaaactagataggtatcccgcgtattgctgcgggagaattacgtgataatatagagatatgagttctaaaattttctttcttacctattatacgatttattttcatgtgtttatatattttttgtacctttatcaattatcctaaggatggttgtatggtgtttcttttggagggaagagatggaatttacacccctgatgaatcatccaaaggctaaaaacaattgagatgatgtggcttcatgagagaagagagaattagcattaactacatttagtggagataaactttatagatatataggatgtgataagataacaaggtgtagcatggtaattctctcagcagccaattcacaaaacaaaa

SEQ ID NO: 13316 - DNA, 1501 bp, Oryza sativa
ttttctgcacggcataagtccgcgactttcttgaacaattcgcaatcggcgggttccctccggaagagggcatcagaacagaacatttgtttagtaggcattcgtttattctgttcttggtttcttcagcaatcagtgtacgacgtcacgcccccaagatcgatgcggattcttcttctgtcacttggatttctgaacattccttcgcactgtgcaggcgacagcgaggcgaagcgatggagcaaactgacactgctactgcgacaggttgcacatgccggggtggagcgagcaccagagcggctggatgggctcggcgcggatgccgcgctcgaccatccggtgcctccagtcgttgaggcggtcggtggcgttcgcgtagcgcttcttcccgttggagcccttgttgccggaccagagcgtctccgcggcggcggcggccctcggccacagcctggcgtccagcaccgtctcgtccgactgctccgaccacagcgccacctccccgcccagcaccagctgcgcctcgtcgtcggtcagcccgtgcaggatgtcgtagtcgtagacgcgctgccacgtcttgaacggcgcgcaccatgacccgcccgtgccgccggggtcgttgaacagcggcgtgccctcgcgctccttctcctgcttgtcgtaccggctgtcgttgcccacccacccgccgtggccgcagtccaggtagtagtacgacgccgacgacacgatggcgcggtagcccgcggcgacgacgcgcttcgtgttctccggcccgtcgttccacgtctgcagtatggtggtctccctgggcagaatcgtggggccgacggtgaccttgggcccgaggaggacgtcctcccagtagaccaccgtgcggttcagctcctgcgccacgaacgggcgcgtcgcgttgatgaacagctccaggaggtggtcgtgcgtgccgccctcggcgaggaaccggcgcaccaccgggtcgtcctcccagcacgccgtgttcacctcgtcggcgccgccgtggaggtacgggtccgggaacagggccaccatgtcgcgcagcacgtcctgcgccacgcggtacgtcttggggttgagcgggttcagctgccccgtgccgggctccgccgccagcgccggctccgcgtgcggcgcccagaacctgttcgcgcaggtgacgatctccgggtacgctcccgcccacgaacccgtgtgccctgatccgaagcgcgcgacacttagccttgagtatactgtttattcggagagcaatggaattgaaatgcaggagcagcagagggagtctgggatttctcactcaccgggcatgtcgatctcggggatgacgcggatgccgaaggaggcggcgaagctgacgatgtgccggacgtcgttctcggtgtagcgcatggtgggggagtaggagccggagttggcgaggttggggacggtagggaggacgatggggaaggactgggcgtcggtgatgtgccagtgg

SEQ ID NO: 13317 - DNA, 1501 bp, Oryza sativa
tttattgcttcctcggtttgaaaaatgcacttcagtgatccaattagtgttgtgcgagcgttcggtgtctctcgagtctgcgcagtaagatttctccagcgttgggaatctgcaaaaacaaatttggtaaagaaaatttctactaacagctaggagtaagaaattaaatgaagaggacaaagattgctgaacccctgtcccatcccccaccacgcatgctgcccacctctaacgaagagatttgccttttcaagctcacaccacccaccaccacggcactgctgatgccttttgaattactagctcacagtggtggtcgaggtcatcaatggcagcaaggcacatgtggagcaaattgggaacacgactgcgcatgcagtacaccggcggcggcactctactgcatgcacgtaccggcatggtcatggactcatggagatgctaaaatttaatggaaacatgctaagggtgataataagattcagatctagagtattgaacaactagttagggctactgtggaatggggagtccggatccggatctcgcggccatgaacgccaccggaactggatatctgattctcttctccctcgtcgttgtacacaaaaatccattccgttgatagggatcagctccgagatatgcaaacaaacttgataacctaccttgagagagggaaagcttcagcacagatctccatcgccattattgtccaaagaaatactaattagctcgatatgttgacgttgagacggaacatccatacccgaccacaaagcatatcggcgccgccgaggacgccgcacgcccgcacgcgcatcacggtcgggatccggcctcttcatcgatagatctcggcgaacatgtcgcgaatcgatcgagacgccaccgtggcctcctcatcgatcgatagatcgatcgagatgccaccgtgcctgccggttgcacctccaccgctccacgtacgttcatcccatcttcgatccgcgtgatgtgtatatgtgcatgggcagacaaaactccggccggcgaaggaactcggccatggagatcgaggaggaagacgtgcacaagttggaggatgcgtcgagagagagagaggagaaggaaagtgccttgcgtttggggaggaggaatcgaagatgtaatagccggccataaatatgatatatatggagccggcctcacaataaagaagatgagaagtgggccgatctggcggcgcggaagacgtcgtcacaaatctaccggctctacgcctctaccggcgacgtttccgcgcggtccttcaaccaaaaaaaccagatgcaacaggtccctcaactattaaaactgatgtagataagatctctcgacggtttagatggtggttttggctgacgtggcgcctacgtcgcaaattcgacttggtcttcatctgacgtggcgcttacgtggcaatttgatccgaaaaaataataaaccatgtgggacccacatgtctgtttcacatacaaaa

SEQ ID NO: 13318 - DNA, 1501 bp, Oryza sativa
cactgcataaaatgcaaagttcatgcacatttaacagagtttcactttctttctagagccttctatctcaaagagaattcaactggttgacacggtatcagattcatagcactcaactagtcatcccttgaccatttcaagttcaaccacatacttctagtcctctagccatgtatgagctatgaggcaccaaatgcaaggagagtgaacaaacaatagcactaatgtttaacttgttaaacatacaaattcgtagcttatgcagctaacttacagattatatccacgtgcatctcaatttttagatataggaacagcacccatggagtcaaacgaggtactataacaaggctagaactcataggccacttccttttctcttgccaaggatgtcggtgtccttacatcaatgttagacaatggacatctaaaagaagcagaagatgtcacagatacattattaagtatgactggggaaccatccagtatgctctgaggtggggcaaataaaatcagtaacagtttgatacaaatttacagacaagaaagtaccactactggttggaaattttagcctgaacaggaagggaaacataaccgcccaaagttcactaaattgtcaagtctgggttgagcagattgctcgccagaaggattgcataaagtataatccctgcaataaaattcttaaatcccaaaatcaacgaaaggcacgttatcaaaaagagatttcatgggtgaaaaggatatttttagtaatgcaaacttgttcttagtgaaaactctgacctaaggaaaattgatcacagataatttgttcatgtataactcttaagcatggtaatataagaaagaaccaaacaaccagctatatacaaagttgactgggattaagtggaaccaattggaatttcaatgtgggtttcaacaggtgtatgtaacattagctcaatagagaaaattagataagtacaaagtcaagaaacaaagctggtgctacagaaaagtggtccacagcaacagcctacatgcagcacatttgtcaacgatatgtaacttatacaaatttatatggtcccaactcccaagtacctccattagttttacctttgtcttgtgtactcgccattatacatccatgacctcacaacacaccaacaacaaagatcaaaataattcaagcttttaactggaaattatgtagataaaggacaaacataaattatctcttttaaggtgcatttgaaatttctgagggctatttctttgggacattttgggatttagttcagatttaaactaattactaaggatgtggatccaaatcaataattcatattactttttccaatgaaaaaggccttgtgaggcatggtagaccaaatcaatgatcatttacatttctttcatgggcatagcaaggaaaaagaattatcttgttatggtcattttcccatgtggtgttttccctattttcaaagaatacccagtttcgaacagg

SEQ ID NO: 13319 - DNA, 1501 bp, Oryza sativa
acagccgcccctgccgcttctccttgtaccgcctcaccttctccgccctcgccgccggctccgccacgctccatgccgccgccgccgccgcgggctcaggcgacgccgacacctcgacgaacacctgcacgagcatgcgccgccggtgtcagtgtcaccacggggcgtgtccaagaagagtggggcgagtggggcgcttacggagtcgagctccagctccgccgcggcgttgtccgtgccaccggcggtggcggcggcggcgccgccgatgtagagcgagccgcggcccgcccaggcggcgaggatctcctcgtagtcgagcttcagcagcagcgaccgcgccgcggcgccgccgcttgaggcgcccgtgctcgccgcggaggagcacgaggacgacgtcgtggtggtggtggtggtcgtcgcgctcggggacgagctgctacagtacacccaccgctcccgcccccgtagcgcgcgccgcgccaggtcatcctcctcgccggagagctccttcccgccagaaacgcccggcgaggccgcggacgacgactcgcccccgccaccgccgccgccgccagcggaggcgccgaggatgtcggtgagcgacggcgccgccgcgaacagcgtggacggctcaggatgcagcgcgaacggctccatctgcggcttttcctcctcatcctcacctccatccccaccgtcctccggcgacgacggcgcctcatccttgggcaccaactccggcgacctcaccgccaccaccaccacctcctcctcctcctccttcttaatcaagaaccgactaagactcagatacttggtcctcctcttcacattccccctccctccccggcgacccttcctccgccgcgcgccgccgctcgccattgcccccctcccaaccaacgcaaataccacgcaacctgagggacctcgctgcaaaaaaagcgcgggagaagagaagcagcgagccaagctatttggagggaaagtgagggggatctctccgcttttccgtgatcccttgctgacgtggcgagtcggggtgacgtggcggcgcgccattgggcggccggattgcggtgtcgccttttcccccgccgtactcgatgtggtggggtggtcggaggaagaaaaaaggagaggaggatttttatgggaatcacgggggttttgtgatggattagggtggatgttcacgtcatcgccgttggatctgtactatcagtcatcagctcctattttactctagaatattactctgttttatgttatgaaattatcttttaagaaattatagatctcgaatggaagttagcatagtcgatcatgtctgtgtctttgactgttatgtgttcaatgtcgatccttagtttggtgaacttgtatagatatagaagaacgccgttttaagtgaatccacatggaaatgatgtttactcgtagacgatcgtttattttcttgtgagtatcctaaattattttcgagcttgacatggaa

SEQ ID NO: 13320 - DNA, 1501 bp, Oryza sativa
aattgtactatcagaacatataatagttgtgttccatgtcaagctcgaaaataatttaggatactcacaagaaaataaacgatcgtctacgagtaaacatcatttccatgtggattcacttaaaacggcgttcttctatatctatacaagttcaccaaactaaggatcgacattgaacacataacagtcaaagacacagacatgatcgactatgctaacttccattcgagatctataatttcttaaaagataatttcataacataaaacagagtaatattctagagtaaaataggagctgatgactgatagtacagatccaacggcgatgacgtgaacatccaccctaatccatcacaaaacccccgtgattcccataaaaatcctcctctccttttttcttcctccgaccaccccaccacatcgagtacggcgggggaaaaggcgacaccgcaatccggccgcccaatggcgcgccgccacgtcaccccgactcgccacgtcagcaagggatcacggaaaagcggagagatccccctcactttccctccaaatagcttggctcgctgcttctcttctcccgcgctttttttgcagcgaggtccctcaggttgcgtggtatttgcgttggttgggaggggggcaatggcgagcggcggcgcgcggcggaggaagggtcgccggggagggagggggaatgtgaagaggaggaccaagtatctgagtcttagtcggttcttgattaagaaggaggaggaggaggaggtggtggtggtggcggtgaggtcgccggagttggtgcccaaggatgaggcgccgtcgtcgccggaggacggtggggatggaggtgaggatgaggaggaaaagccgcagatggagccgttcgcgctgcatcctgagccgtccacgctgttcgcggcggcgccgtcgctcaccgacatcctcggcgcctccgctggcggcggcggcggtggcgggggcgagtcgtcgtccgcggcctcgccgggcgtttctggcgggaaggagctctccggcgaggaggatgacctggcgcggcgcgcgctacgggggcgggagcggtgggtgtactgtagcagctcgtccccgagcgcgacgaccaccaccaccaccacgacgtcgtcctcgtgctcctccgcggcgagcacgggcgcctcaagcggcggcgccgcggcgcggtcgctgctgctgaagctcgactacgaggagatcctcgccgcctgggcgggccgcggctcgctctacatcggcggcgccgccgccgccaccgccggtggcacggacaacgccgcggcggagctggagctcgactccgtaagcgccccactcgccccactcttcttggacacgccccgtggtgacactgacaccggcggcgcatgctcgtgcaggtgttcgtcgaggtgtcggcgtcgcctgagcccgcggcggcggcggcggcatggagcgtggcggagccggcggcgagggcggagaaggtgagg

SEQ ID NO: 13321 - DNA, 1501 bp, Oryza sativa
acatcgaaaattcagagtttcagagactatagtgcgcagacagacagttatcaagttgccgtaactatcactgtagcaaatactgcaaggacgagttcagactgacatagtgacagtgaatctgtgatccagtgaagcttagctgcagctgtgagagagtgagctagaatgggaggtaagctgcagcatctcatggagaggcttcacctggctgggaagggcggcggcggcggcgcggcgagggacgtgccgaggggacacttcgcggtgtacgtcggcgaggctcgggcgaggttcgtggtgccgacggcgtacctgaggcagccggcgttcgtggcgctgctgaagagcgtggaggaggagtacggcttcgaccactgcggcggcggcggcctcaccatcccctgctccgagcgcgacttctccgccctcctcggccgcctcgcctcctcgccgccgccgccgtcgtggcgttgatcacgacgagctcatgacgatgacttagcacatcgatcgatgaatggctagctagccgtgttcctgttcttggtttctttcatccacggcaaacgttggaattcgtaggatttttctatttatcagtggcgtgtaagtgtaattatgcagccattggtgtgccgaatcagcgcttaattttttaagagtgaatcagcgcttatttgaaaaacattttaggacttgttcatatgaattttacatgtttttttaggaatcagttcaattcccccaaaaattctttaaaattcttacataaaaaaattaaaacattataaaacagtaatactgttccaacgaaatagctaaccatgctaacctcataatggtacctatgagtatcgtgtatggtaccatgatactagatccaataccgatattgcgcttacgtcacactaccgttaccacacataagttattatgttagaatggtacttactccatctacttttgatagagatattttcaaatatgaagaaattacttttgatagacatatttcaatccaactacctattcttttaatgactttcttgaatttaatgcgtgactctccattcgtccacactgcataggcatcgagaaatgtaaatattaatgaattgcttgtttatgtttaaataaatgataggtataattatttatccttggtcattatgccaagatgaaatataattatcaaaagtagatggagggagtatatcgttatgtatgcccctatgtagtttgccctcagtttttatttatgggccggtccatatccgacacgccggcccttttacttccctttgttttaaggcccacaaccatgtcggcccatgtgaaagccatcttcgcttttctctccgaagaaatggctctcctcttcctcttcacctccaccaccctctcgttctcctcctcctccccgcgccgccacgcgctcgcatcgcatccaccagcgcccaaaaaccctacacctgcaaaccctagccgcccgcggtaa

SEQ ID NO: 13322 - DNA, 1501 bp, Oryza sativa
tttattttacgtttatgattgtagatatcatttaattattatgaagtgtataatattgttattatttcatatttttacaatttattgaatggcatgcaaaagtctaaaattataatccaaaatgacatcttttcctcaaagttaaattattgtggaaatttggtctttagctgaagatttaatcataaataattttaaagatataagcggataaatattagttgtttgatttaggtgttataattgctgaattatttaataaaaaaatttttttttcaaactctaataataggataataaatatgtaaaaaatatgaagaaatcgagggaagtatgggtggaagtacgtactatcctataaaagaaacgtatgtaacgtacaggcccatggtataccccggtttggggttaggtaggatttttctttagataaacctattgttggaaaataagggtccacctaacttaatgaaaatcagtggatagatattttgttttttcttagaaattttataaatttatataatttattatagtaccacgtggcggtttatgagcgtctgtaggatgccacgtggcggtataggagtatcggttgccatggctacttacgggacaatggtgtaggtggaaggatttgtttaaattgatctggcggatgaaaatagtgggtccaccgacttaagttaaaatcatgggataaatattttgtttgttcttagaatttcttggaatttctctattttttagagtgccatgtggtggcttgagagtgtttgtaaagaataaatggattaaacgggctagggtatttcaactctttatgtggtactatgtttgaacgacttgcaaagggtcaaaataaaatgaatgcaatttttacaagtgcaattatagtcaacaggtgtatcaaattttaatttgtgattttaatcatgcataaataacgtaatgatacaaatagaacgtataattaaaagttaaaagatgttatgattatttaaagtatccaaaatatttcttataaagaatagccaaatttggtctgttagaaattaaagaaacattcgtaaagagaaaaacggagaggaggtacataccaatgtgcaaaccgcacacaccctgcatccacgggaagagggacaccttttattattaagaaagagaaaaaaatgtaatccaatggattggagtggtgagtctattatatttagtgaaaatcaaaggctatttgtttcttttttcttagaattcctaaattttattctaatttattagagccgcacgtgacgctatagagcgtttatatgggtggcatgtggcggtttaggagcgtttataggaagtataatagatttttagtatataatagatagattggatatcatcaatataatttgggacgtgtttgtagaattatttaaggtgacataatatatgttgtcaactttttataattaaaatatttcctggttatattttgttgcgatgcaaagaatat

SEQ ID NO: 13323 - DNA, 1501 bp, Oryza sativa
ttgacttatggggcctctaatccgtgtaaacgtgtcttggatgtgcagaggtgcattttgtcgtatgacggatgtgttttcacctcaaattacctgcatacacatattgcaccaacactagtggtaatgattagtaataatacctaccactaagttggataccatgttttatttcattatatatatgcaggtattgacggtcagatattatgatttaaggaccgtcaacaacacccccacacttaacctttgctcatcccgagtgaaggctatggactctacaatagagttatgacttccttactaacaatcatgcaaacaaattattcaaagtcatacctgtacttgtggatctttgtagtgtctaccatgcagtcctgggcaattgagaaatggaacaatcttgattcaagtcaccctaacttttcaggaagaacaacttggggtttttttcaagtaagacgaatattataactttgctttgctcctccattgattctctcgatcactcaaagtgtatgattcctcacaaaggcatatgattgtgccttttcttttcctaccatctaataaggcttatgtggagttcagggtatggaaaagagtagagcattgcttgcatcacatatattgcaaagtaaaataatggatccacggaaatacaagacatactttctggtcaagaatgtgcatgtgtatgtgtatggtaaatttgtgagtggaaaaaggaaaatgaaaataactccttttgtatgcctcctcctccatttattttctcttttgaaatttgggagagtgcatggctatctttttttttcttttttttttctcatcatcatgctccatacttgtatgagcacttttttttcatagccatgcccctctctctctctcttttttttaaagaactttggaggaagaggcacaaatgacatggagtatttattttgtggactatggatgaaatgaatgacaaatgaggaatgctaacttccagtgtataagtcaagcatatgtgcgtgtatgtggggtgtgtgtgatcttgaccatgaaagtatgaaaagcatttcactagggtcacaaaacttgacaacgctttatgaaatgacaagcagcgtatgtagcaagctaatcatgaatgatcaacctatggctctaataggaataaaaagatcaatgaggaatttagcatcattatatgtttttttttctttttataaaattcccaagtgtacaacatgaagagcaagatttctatcatcagactatatcacattcatcaattaccttgatagcatgggatccctattggatttgtcactacaagaaacaagtaatgagcaaagaataataggcatgcatgttattttcagggagaccatgaactctaattgtaccatccctagcttgagtttaattatcttcgatattttagaattgataatcaaattaaactcaagatagaatggatgtcccgaggaaattgtgcaaacctgagccc

SEQ ID NO: 13324 - DNA, 1501 bp, Oryza sativa
tcaccatatttcaaagataaatattttagaaattatttataattaaagattttaaagtttgaactcacacttgtccaaaacaacaagtattatcagtccggcaggagtactcagtctttcagagttgctcacaggagtaagtatatgtacgttgtgagcgtttacatttatattgtgttctagagaaaaaaagtcaacttgattaataagttcacaaatatactcctttaattaaaacaaagggtcaatctcgttgacccttacagggtaataagcatgtagtatatgtcattttttatgcgtgtagcctcgagtctcaacgagatcaaaaggcagagacactcttatatggtcggccatcacaagcatatgcacacgtaccacacggcacacgcatttctttaggggccaataatggcaataaagcagcggcgtgccggccacattgcatgtatgcgccgagccactttgcgaagacctcaattgtttaacggagttgctagaaatatggcgccatatgttagagttgattttttttagccacttacatagtagttacacctcatttacatcccacttacatatataattagtatgtaattttcgaatttacatatgtaattttagtacttacatatgtaattttaagacttacattgtaaatacattaaaattacatatgtaatttagggacttacaatgtaaatacatgccgactattttttgataaaaaatatggcaccataaatatagctacacccttgtttaattgatacttcattattttctctttttttcttcataccgtaccacctgttagaggagctttagattctgagaaacagctgtttggtagccagcttctgagaatctggaaaagctctgaaacccagcttctccagcttctagctttttagttcatttttcagaatctgtaactacagattctcaaaagttgtagactgtttggggcagcttctagcagaagcagcttttgggaaaagctgcagctgggacaatctcccccaaacagggcctagtaccacatactactactgtacttcgctccctctgtatctgtttcatattatatatcgtttgacttttttcttagttaaattttttaaagtttgatcaaatttgtagcaaaatatagtaacatttgcaatacaaaataaaacatttgcaatacaaaataaactttgtaccaaaatatttttaatgttaaatttaatgaaactaatttggtgtcgtagttagtgttaatttttttctttaaacttgatcaaagctatagaactttgactaacaaaaatatcaaacgaattataatatgaaacggaggaagtacaatttatccatataaggtagtatgttcctaagtattctcaacttaataggtttcctaaactactaaacaatatatttttttaaaaaaatataagatttgcttttaaagattatattaatctattttcaagttgtttaagctaatatttaa

SEQ ID NO: 13325 - DNA, 1501 bp, Oryza sativa
ttccccctcgtcatcgtcctgctccttctctttgccgcggcgacgggctctctcaccgccgtgtttcacctctccaaggccgacggagcgcacctgtcgggcacctcgccatccgtcaagccgataaagtaggccttgtccttgtcacccagccatggcggtcgaggagcatctcgaagatgaggtcggggaccgggagctcaccgtcgcgtaggtatggcaggaggaagagctccatgagcatctagtcgcccgcttcgaacatgaacctcggcgagaaccccctgcgacctcgccgccgcccgcttcctctcccatagcccgtaacccgccgcgcgccgctccttctccccatcacccatcgtgcccgcctccgcctccgctgctagctaggaggcgtcctcctgcgagtccgccaccacagcgtcgtcgcgacggcattcacgccgcaccccgctccatcagtagccgcgccgcgaagaacggagaaggaagaagagcagcaacaaccgtaggggattgaggatgacatgtggggcccaccattttttattattttgtggcgaaactggcaagtgggttccacgggttttattattttctagatcgaattgatacgtaagcgccacgtcagatgaagaccgagtcaaattagccacgtaggcgccacgtcagctaaaactgctatctaaaccgctgagggagctagtctgcaccggttttaataattgagagactcgttgtatctggtttctggttgaagaacggaaatcggattagttgacaagtcaagggaccacagatgaacttattccttatttttatgttgccttccgaggccttttaatcttccgggtgtattgggcctaatagctggaattttaattctaaaaacaaaaatcacccaagcagccatttttgcgcgacagaaatgaattcgcgggcctatttcggcccgaaaaccacccatcaaagcttgcccttacggataaaaatgttttttttaaaacacagtacaaaacgcaggcgctcacaacgtacgcacactcacccctatgaacgcacacacgcacaccctaccctatgagcacctccgaaagactaggcctcgctgtcgacgggtacgtcgcctaccactgaaagaataattagccgtaaatgcgagcacccgtgtattttgaatggatataaacatgcacaactctcattaacattcaactaattaaactgccgacccagaactcttttaacgcggttaaaatatttttctagttaacaatcggttagggatgggtttcatctcttttacggataagatcgtattttagacacggtttttacagataatttcccgagaccacgcgctcccctcgccgctatatatattttgcgttagcccttcatctcctcctcctccctacctagatcaccgacggaggtagttgccgccgccgccgccgccgccaccgccggcgaggaagaaccaagatgtcggcgacgg

SEQ ID NO: 13326 - DNA, 1501 bp, Oryza sativa
cttggtttcttgtgcctggactcggtaaatattatgtagttttgttgtacacttgtactccttataagccgcatccttctctatcagtacataagcgacaaagcttctgcccttcttttttaaaaaaaaaaataaaaaagacattggtgtcgctcccctcgcgctcaattgcggtggccgtcgataaccaccatgaacaggaagggctgagggagaggggtggtgagggcagagctggggaccgtccccgtcgcctgggaggtggtatccgagtcggagaagtcggccatggacggcagatccacattgatgcaggatcctcgccaccgccggtgggactctttatcggataggaggcggtctatcgtgagcgacggtggacgacgcacggtgctggcgagagaagcaagcagaccatgcgcagcggtacctgtcgccatccttacatcggatgcgtttcgactgctgctatctatgctcgcgtgcaggagacacatatctatttttcttgtttttgtgtactctctacagtaaataaattattatactcgtatgtatggtgttgagaaacatccaagtaattatattactacttacaataaacctcagtaaataaatttgctatggatgaaactaattaagagcgacaagacatggaaatgttaacgggacctaatctggcattgacccttttttttttaacttttgggcgattgatgcatgcaatgcaggaagcaagaaaatattttttttaatttaatcactgccagggctttatcttgtagtgtgatttaatttgggagaatagccaatatggtccctaaagtttcgcttctggatcattttagtccttaatctttcatattgttcaaacaagtcctttaattttgtcacgtgggctgatatagtccttggtcccaccaaaatcgccacatggacatgccatgtcatattcctatgcaaaatctatataatttgtccaatttacccttatatatatcatagcaaaataaaaagacaaaaggtaaaatgtaagagcaaaagtatacctcaaaacggtgaaaaaaaaggatgagtatttttttcctatggttatgtctaattcacccttatatttatttttctatgatataagtaagagtaaattggacaattcatcatagattttgcatgaatgatgacatggcatatctatatgatgattttggtggacccaatgactattctaggccttatgataaagtttaaggatttctttgaaccatttaaaaggttagggactaaactgatcctacggagaaactttagggactaaagtagctattctgccatttaatttcattaaaagaaaagtatttacaaaatgataattacaaaggaaccactaaaaacatcacaaatgttgtaaccaataaaaactatttgctttaatgggaaaatatcttttttaaatgaagcaagaaagtaatttttttactgaagcaaacaagtattttttttt

SEQ ID NO: 13327 - DNA, 1501 bp, Oryza sativa
gtaaaaaggcccatgtcgtattggcacgaccggcaaaaatacatgcatgtaggtatgtaggtattccttcttaagaaaagtacgtacctacgtagagtatgtacacagctattcctatgaacagtgcgtatacacaccgcgtcccacatccttatttttttttcttctcatcatttggattagatagaaaaccaaactaataatttaaactaatatcaactatgctttgagttgtaaaaatatatgctatttcgagttgtattcaaattaggcgtatgtcatcgaaacacccataaaaaatataaataaattgaaagtatagattatgtgatagttaaattagacttacattttccaaaataaaaacaacttcaagtgtgtgtagaatttcaaaaattactcactctctctctctctcttgtaaaaaatactgatatggaaaaatgatgttataaatttatcagaaatatttttttatgtattatgtgtttactctattcatatattattagaaaattgaagatcaaatatattcatttgacaccacgtcaatatgttttttctcctacttagcctttgttcgatctagctcattgacttagcgtatccagggcacatgaaaagtcacaagtcattagcacaagattaatcaagtattaaatattaaaatcttgaaaatggatttatttgtatttttagaaaacttctataataaaaaatattttgtaaaatatgcaccgtttaataattcggtaaacatggtcatgataaataatgaagtagccactccgataagcactttagaacttaaccataaatttattacttatgcactaaaactaaatatgtagtgtataatatactttgtgaatctagaatagtataatatatcaatcgtatgtccccgataaattctatgtaataagttctatatacaaaccagtgtcaacaatcgtcaagttatattgtttatgatacatccatgcacaatgcaattaataattagttgacatccaatatgcacgtgcgtcatcaagcaccgaagatatatgatgatacttagtgggaacccataaaaaaatgatagataagtagaggatgacacaaaatcacaacaaacaatagttgactacaagtagactatgagtttaagcaatagtgttcctatacttctacaaacacttgtgagatgtcatgtgatgctctaataaataggaggaaatttaagaaaaaatataaggagaaaacaaaacatctacccatcgatttgcacttaaaccgatgaatccattattttcaaccattaaattagatttattcaggtaagcccttacttctataaactagctaatccctctctatgcacgtacatatacaagagatgacaaaaataaaaaaaagaagtgcgtgtatatatgcacgtacatatacgagatgtcaaaaataaaaaagaagtgtgtgtatatggtccaccacgtctggtagttttcaatttctttct

SEQ ID NO: 13328 - DNA, 1501 bp, Oryza sativa
caaccatgaagtctgctctcgaagcagcggtttcatttctcatgacattccgaggaggcgaaaaggctaggaggcggcagccggcaggtgggcttgaactaaaggcagagggagcgccggatagggggagggacacgacacgggagaggaagtgacgggcgccgtcacctaaggcgctgcggtatagggaactggagggtttgcctctggttagggatggatacccgttgagttgggccataacatgggcttctttcggcccaataaacaaccggggaactctgggaggctgcttcatggcttcccttccgaatgattcagatcgtacggttcatagcaaatggggcgatgtgaagcaccaggaagcagagatttcctagtagtggggatgatttgtataggtatataggataaacgctcttcaaaaggtgcttttttaattttttttatgtcacgtcaaacgaccaaccaccggtcacaccatgctaagagacaggtataattcttgaggcagcctacttgccaccctcccaaataatgttatcatagattaggtggacttgaaatgatttggtactcacaaactcatccaaatgtataaatttggatgtcattaagcaagacctcttcatgttcctatgtgttcgatcctctcatgtgtttgatctgttaaattaggatggaacgacgccgacttcattgagcgtcatcttttcatatttacatacatgtatttgatcttataaattgggatgaatttgtgaagcgccaaataattttaggccccctagtcaggcaaaaaagatcctctaagagggtcgcaactcacaagtgggccggctgcaaaattgctaatgcccacgcatcagccggcgttaacattggtgaagtttaccacataagaaaaaatgtcctttggaaggtgttttcaagaaagaaaacactccaaaaacgttatggatatactcaatccgtttattgatagatgactaacttttgaaaacacaatcgggaactgactatccaattgtcgggtgatttctaacaaaaattcacctagattttttctactattatatttacatccaacagactacgaaagaaaatagcaaaattgaatcgggaaatactctatactccagcaacaactgggcccattcgctcggcccggcccacctcctcgcacgccatgcccacgccacgggcgcgcacgcgcagctgaagagagagcacccgcgcgcccacgcggcggcgcgtgcccggcacgcggcggcgcgcgcccccgcggcgaccggaggatctccgctcgaactccctctctctctctctctccaactaaccgcacgtcaccggaggccgccacgtacatgtgttatacattatatatatcagtcgtggtcgagtaggaggtttcttgcagagatcggggttcggcgccggcggcgagttgttgagaggcaaggcaaactcaggcgactgagctaaagaagccgcactagta

SEQ ID NO: 13329 - DNA, 1501 bp, Oryza sativa
ctttgggcattgtcctgccaactcaagaaaatagctctgtaagtaacagtgatgcaactactctcagtgcatcgttgcattcacagccaaataagatggcttctgtaactgaatggacagatgatcagctatctgaactgtttgctgactattaggataggagtgaatgtctgatcaaggagctaccagatttggtacttaatttgaactggctatcttaatggttgatgcttttggtagactttagcgatttactcaggctatcacgtcacactctggtttcagataagtgcagcttcccagatcattacaacatcattatattaaattgtaattgatgttttcagtggatgagaccttctctcatcacgcaaaggagcctttgcagacaacggaattgtttgtttcaatcttgtgcaaacctgcaatccctggttaatatgataggattgaaggatcttgtcagcttgtttcactagaaacttgaatgctacttcctctattccaaattgatctacatatttcatggtatactaagaccaagaaaaactaataaatctctcatactatatttactctagcaacaaactcgatgcatgcatcattctcactatttcctagccaataacaaattaagatattacatgtgggttataaatacttgtatgcatggatgcatgcatcaatgtctatttactccaatgtacaaataacgaatagacttaataaatgaacacaaatatgtagatcatttaggaataacttcaaaaaaactatatgtagatcaatttggaatggagggagtacttctcttcagaaaatgtagccttttggtcttttagaaaagaaaaaggttagccttttgtatttatcgaaggtcagaaaagttactgctagacaatggcaacttcaatctaatggttaatggaggaaaatgcaaagaattacaatagtccttaattatgagttttgttttttgctctatttgagttatacatcacaagtaaaaaagtataattgatgtaggtgagtgggaccacttttaactgtcatttagcactctctcatgcaacttatctctggctttttgagagctcaaggccctatttcaaatgtcgagacttcaaatattcaccaaatgtaagaccactttctcatagtatttggcaaccagccgaataatatatgttcttcagctagttggaacatattttatctttttaatctcaacgccgatgaaacgtgcatgaacgtagcaatagggatggcaatgaacactaaagaaatcgatcaaggttagtagaagctagtccggttcatgcaatgttctgcactctcggaacgatgcacaaatcactacagagccctggtaatcaatttaaccgttcaacgttgcaaatagtttacacttagttttttgttcatactgagtgtgtttgatgatcatcacatatcagttgacctatatgttacataaagatggcaatagatctcattctat

SEQ ID NO: 13330 - DNA, 1501 bp, Oryza sativa
aaattaagtgtttcacgtaaaatgatgtggtaataatgtgtcttttaaaaaaaagtgataataatgtgtgattaattgagttttaatttttataaacttgaaaaataatcttatattttaaaataactttcatatagaaagttttcacacaaaacataccgtttagcaatttaaaaaacgtaccatttttatctaaaagtttatacagtttttttgagaaaagaacaggacatagatgcacggctccacgccgcccgcagcatggcttaaacaaaacaacgttaaacacatgttggtcactattaaccaaatcttcctatctagcttattttaggttattatatctacacatatcataaattaaagcaactgaaatgtactggagtagaaagagattagaagcggccctgtttggatcagggactaaaacccctatcacatcgaatgtttaaatactaattagaaatattaaacgtatactaatgacaaaacccattccataactttagactaattcgttcgacgaatctaaattaatactccctccggttccatattaattgacgttttggacaaggctgaggtcaaacttttataactttgaccattaataactttaaaaatatttagtttaaaggaactagaacaacatatatagatttgtcttttaaagtactataataaaagtaaacatgtatttatttattatatatattataatagaaaaataaggtcaaagatatatcttgtagaccgtgtcattgtccaaaacgtcaattaaaatgaaaccggagggagtatatgattaggctatgtgatgctagagtaaacatgtgctaattatgaattaattaggcttaaaaatttatctcacgaattagctctcatttatgaaattaattttataattagtctatgtttaatactctaaattagcgtacacgtatccgatgtgatatgagtatccgatgtgataggaataaagtttagtcatggatccgaacaccaccgcgtagctgagtcagtccacataaatcgaaattaaagcatgcacctctcgaccagctggaatgacaggagaaacttttttagcctaaaacatttagaagctctgcattaacttttgaattaggacttcgagggaatgactacggccggccgtgttagaccaggtatatgccctggtgttcacggtaagatgacctcgcaagtcgcaatcatttctaccaacacgttcttcggcactcggcagtgacgactacagttgacaagtactacgtgacagtttcctctccgacaagctagcgatctgaacgaaggacaacccacaaattatggaagtggtgtaaatcttgatcaactctgaatttatattgcaatctagttctgcggtctgcacttctctatacagtactattgtgaatacttttgcattggcgtgaattctcgatcttttttccccggcctgttagagtttctgggcctcaagaagcccaaccac

SEQ ID NO: 13331 - DNA, 1501 bp, Oryza sativa
aatgggttttgtcattagtatacgtttaatatttctaattagtatttaaacattcgatgtgataggggttttagtccctgatccaaacagggccgcttctaatctctttctactccagtacatttcagttgctttaatttatgatatgtgtagatataataacctaaaataagctagataggaagatttggttaatagtgaccaacatgtgtttaacgttgttttgtttaagccatgctgcgggcggcgtggagccgtgcatctatgtcctgttcttttctcaaaaaaactgtataaacttttagataaaaatggtacgttttttaaattgctaaacggtatgttttgtgtgaaaactttctatatgaaagttattttaaaatataagattatttttcaagtttataaaaattaaaactcaattaatcacacattattatcacttttttttaaaagacacattattaccacatcattttacgtgaaacacttaatttttatctcatctccatttttgggagatttaaacaccaccatagtcaaaagttaacgcagagctcctgaaggttttcagctaaaaatatgcttatgctttcgatctacgtggacttgcttagctatgaaatctctgtctgcacattccagttggttacgtcgaaatagtagccccatattggtggatgaaatagtaactatatacaagtatgcttaaaaataaatttgacagccctaaaagaacgagacatgcacgtgaagaaccagactctgaacatgttcacacctagattagacccatttcatctcagccacatatatattaattttatctggggcaatcaccttgaatttctacgttgccttattttcattccacaccatacttgtccctgttttgcatattaagaattgcgaaaagtctaattaagtaagaatatagtgggagaattggaaagttgggtagaagcaaaggagcgctaagtaagtgtagaatgattcaacatgttgctttctttcaagaattatgctcccttctttttatattataagactttcaaacattgctcatatttatatagatattattgaatctagacacatatatgtctagattcattaacatatacttcctccgtttcacaatgtaagtcattctagcattttctatatacatattgatgttaatgaatctagatagatatatatgtctagattcattaacatcaatatgaatgtgggaaatgctagaatgacttacattgtgaaacggaggaagtatatgaatgtgggcaatgctagaaattcttataatatgaaatattcattaacatatatatgaatatgggcaatgctagaaagtcttataatataaaacggatgaagtacttggaagatatcagaagagcctgtgcaaaagtctataggcatgtcttgtaggacaatctctagttggaaaaaaagatgaattatccctgaactatcgcggtcgatcgaattacccctc

SEQ ID NO: 13332 - DNA, 1501 bp, Oryza sativa
gtaacttgcacagtaaatcttgcttctatttatttgtggctctcattacaatttatatttcctaagcaaatcctgataagaattgtagtggcttaaaatgtagtaatgttctcttacatgaggtactgatacgtgcatttaatttgacaatttaaccctttccgaaaactaatctcgcaaatgaatcatggccaaaactttttttaaaaatgacccttttgttcagcgccaaaattgtatagcgctgaacttagacacctcagcgccacgtcaactggtgctgaatgctgtgccaccgcgaatgggaggctaagtcggcgtgccaatgtgcattcaacgccgtgctatttgatgctgatatatctaagttcaataccatacttgacattgaacaaaagggtcatttttaaataagttttggctgcggttcatttgcgaaattagttttcggaaagcgtcaaattgtcaaattaaatgctgatatgtgggctggctgattctagggcccacatgtcagatccgtctccggtggcttggtgggtaagaaccaggtcgctcgcaatgattcaggagcaccacggtctcacttgttggtaggtaggataggaaaggaggtgcagagagtgggatcacactggaagagagaaaaggaggaacttgtaggaaccacacacgatatggtatttatttaaactctccacataatatgtaaaaactctgatatgtccaactgtgtcacaatatatagctgatgatttattccttcttggtatatagggctgtaaaagaaaacgtaggacttgacagggataggagctgttggcttaaggtcataaatatgagctcaacactaaacgagggatcagatccttatgagcgaagctcatccatgctttgattaggccctaaatccccaacacatctatatctatctatctatttatctatacctagctaattaagataacatgatgaccatgttttactctatatatatacataatacatggatctagtctacctcctaatgaaatatataggttgtatgggtactcggtatctatatcatccacacaagtgcaccctaccgtccatcccaatctcatccacagcagcgccatggcaagcttcactacctccacatcaatctccagggctacctgcctcgctgtgcaagagttccacttccaggaagcatgttctggtggtctgacaactaagcagggggaacgagggcagcacgatgacagaggtggtcgtcatgggacgaagatggctgatgaggagttaggtcccgatcttccgataggtattgataaacagttgagttgggcggagtcgtgacacaactcgatccggcttctgaacaaacacgctactgaaccccgcaatcacagcaccacgtctcctctggttatcaaccgtgccgaaacccggttgacctcaccgagaaggctaatccctgcatgcgaatcgaagaacacaagcgagaataagatag

SEQ ID NO: 13333 - DNA, 1501 bp, Oryza sativa
aggaatattagaagaggagtatagagtccatatagaaatacaattagaaaataactgaaattcggaatcaaaaacaaggaatattagaagaggagactagagtccatatagaaatacaattaggaaataactgaaattcagaattaaaaacaaggaatattagaagaggagtatagagtccatatagaaatacaattatggaataactgaaattcggaattaaaaataaggaatattagaagtagagtatagagtccatatagaaatacaattaagaaaaaaatataaattcggaattaaaaaataaggaatattagaagtagagtatagagtccatatagaaatacaattaagaaaaaaaaaagaaattcggaattagaaaataaggaatattagaagtagagtatagagtccatataagaatttaaaactaactaaaatttggaataaacataataaaattaaaagtagattttagagtccgtataaaaatataatttacaaataactaaaattcgaaattaagaaaaacatgggaagaagtgtttaaagatcaatataggaatacaatttagaactgaaattcgaaatttaaaattaaagaatattaaaagatgagtttagagtccacacagaaatacaattataaataataaaaattaagaaataaaaataaataatattggaagaagagcataaagtctatatagaaatacaatttacagaaaattcggaattaaaaaaataaatattaaaagacgagtctagagtccatataggaatatatataatttataatttactaaaatttgatattaaaaataattaataactaacacgtatataaaatataatatgaaaattcaaaaataaaaataaataatattggaaaaaaagcatagagtctatatataaaaatacaatttacggaaaattcggaattaaaaaaagaaatattaaaagacgagtctagagtacatataggaatatatataatttacaaataactaaaatttgatattaaaaataattaataaataacacgtatataaaatataatatgaatattacacattagtagctttgtaaagttattgtaaaatttaaaattacgttgtcattttaatatatttgaataatataattagaaaacatatatgttattatatgagagaaaatataatgattctagtcgcgcagattgcgcgggccattatgctagtttataatatgaaacggtgggagtaatatatatttgtacagagtgcgtgaaacttatttggtgtgtgtaaaaggaatgcgaacacgtgtgttcgtgtacgtggggtggatgggtgtacccgctagacttgggtgaccaccaatagcacccggccaccaacccccgtcttcgtttcccgcgctatataaacgcgccaaaacttcgcccactccacgaacacactactacgaccacctttcatcccaacgcacatacgcacctacgcatcactcaatcgat

SEQ ID NO: 13334 - DNA, 1501 bp, Oryza sativa
ttggtcagaattttccgtacctagcacttcaactatctaatgacgaattcaaacaacgctctcaaaaattagaattttttttcatacacggtcagaataaaaaagatactgagttggtcaggaatctcctccaccgttttcatccctagcgtctatgtttgttgacatatacacgatagaattttgatgttatcacagggattgaaaaaaatattttttttattagcaaatattcaacgtagttagatttacccaggctcttcaaatttattggctctgccactaccaaccaggacggccctgcagacactttggttaattttcttgccgactacagttagatgatacttggattgatctggaaaagtatattgagctggtacaacgtcgtcttttgtatcgctgtgcaaattaagctaacctaccacttcattcggcatgcattgtatggtgattttgatggccgggacgaatcaacagatagacctgggtaaaagaataggttggttgctgatactttactgcacacatacacctggaccgccctattctgactcctgctgaagaacataatacaagagcagtagttgggttgggtcttggttttccaatctactaattagcattaccttagtcattggaccatactcatttaaaagatctagtggcaggttttatttaaagatgtctactctaatcatagaagttccatgcagtctgaacaagcctttataacttgcaggttctgttgagggaaatacaaggtcagatgtattctcatttcttattgacatgtactcccccagttccaagacataggcggtgtttgaatctgatgaagattaagtgtttcacgcaaaacgaagtgataataacatgtgattaattgagttttaattattacaaacttgaaaaatggattaatatgatattttagaacaactttcacatacaaagttttcgcacaaaacgcaccatttagcagtttgaaaagcgtgtcactttaatccaaaatttaatccacacttttaggtggattcgaacggggccataaatatttttagtttcgtcataagttaaacttgatcaatcttaaaagagtttgacttagaacaacatataaatgcttatattcatggactaggcgcaataatgtagtacaatttttgcatgtgttcttcgggggaaaaaaacaaaataccatcgtttcacacaaaaagaaatttgaaaacaaaaatggggatggtctacatatgtgtccacgtaggatcaccacgtggtcacgtggatgaatggcaagttagcaagcaaaggtggcgatcgagagcgagcacaccggtaactttcagctttgcatgtcacgcaatctcaggaacaaatgccatctcgatcgatgccaaaagcgaaagcatgagagagtaggtcaagcgaccacgacatatggagacaagcatatacactacacatacttcctttttttctggatcgatttaatttgtta

SEQ ID NO: 13335 - DNA, 1501 bp, Oryza sativa
ctcttctcttatccatatgcaactcgatcaattcagcatcaagcaacagcaacattagaatgatgccatgtcatatttcaacctgtaaaaactaaaaagatgataaagcttctagagcagaagcttatatacacgcaacaaccgaaaatgtatcaaccctgaaaactgaaggaaactttttttccctttctttctttgcactgcatgaactgaagacatcaaggctacatcaacccatatatatgtacataacaaattaaatcgatccagaaaaaaaggaagtatgtgtagtgtatatgcttgtctccatatgtcgtggtcgcttgacctactctctcatgctttcgcttttggcatcgatcgagatggcatttgttcctgagattgcgtgacatgcaaagctgaaagttaccggtgtgctcgctctcgatcgccacctttgcttgctaacttgccattcatccacgtgaccacgtggtgatcctacgtggacacatatgtagaccatccccatttttgttttcaaatttctttttgtgtgaaacgatggtattttgtttttttcccccgaagaacacatgcaaaaattgtactacattattgcgcctagtccatgaatataagcatttatatgttgttctaagtcaaactcttttaagattgatcaagtttaacttatgacgaaactaaaaatatttatggccccgttcgaatccacctaaaagtgtggattaaattttggattaaagtgacacgcttttcaaactgctaaatggtgcgttttgtgcgaaaactttgtatgtgaaagttgttctaaaatatcatattaatccatttttcaagtttgtaataattaaaactcaattaatcacatgttattatcacttcgttttgcgtgaaacacttaatcttcatcagattcaaacaccgcctatgtcttggaactgggggagtacatgtcaataagaaatgagaatacatctgaccttgtatttccctcaacagaacctgcaagttataaaggcttgttcagactgcatggaacttctatgattagagtagacatctttaaataaaacctgccactagatcttttaaatgagtatggtccaatgactaaggtaatgctaattagtagattggaaaaccaagacccaacccaactactgctcttgtattatgttcttcagcaggagtcagaatagggcggtccaggtgtatgtgtgcagtaaagtatcagcaaccaacctattcttttacccaggtctatctgttgattcgtcccggccatcaaaatcaccatacaatgcatgccgaatgaagtggtaggttagcttaatttgcacagcgatacaaaagacgacgttgtaccagctcaatatacttttccagatcaatccaagtatcatctaactgtagtcggcaagaaaattaaccaaagtgtctgcagggccgtcctggttggtagtggcagagccaataaatttgaagagcctgggta

SEQ ID NO: 13336 - DNA, 1501 bp, Oryza sativa
aaaccggacaaataacccccctaaacactattttgagcggttttgactagaaatcacacacgtgacgccaacgtggcaatccagtcagcaaaacaaaacaaaataactccctgggcccacttgtcagatttatccctcaacccccctgctctctcttgcgcatgatcttggactagtagccagcgacaggcggcggaggcggacctcgcccggtcggcagcaggtggcggaggcggacttcgtccggtcggcagccggcggtggaggcggacctcatccgggcggcggtggcggacttcgtccaggcggccggcggcggagacgagccttgctcagtcgttgggtggcggagacggaccttgtccaggcggcgggtagcggacctcgtccgtcttggttgaagtcgatcctctctttgtcgtggtcggagaagatgcggtcgccggggcggcctcgagcccatgacgagctccacggagatggaggcgtgccagtgctctcctctcctctgcactcctctctctcctctcctctgctctctgctctctcccctccacgcgcgccacggagccggcgcggccccttctacgactcccgcaaccacctccccaccgttgggagccgcggcgggcgagccgatgcaggaatggtccgtaaggaggcagtcgtgcgaacaggaccgtgtcggcgcctcgtcgacctctgcccaggggcgaagctacatgcagatatgggggttcttaggaatccgggtaagaggagagttttagctatggttaccccggagccgcctgcctgcgcgtgcacacgggagagagagagagtgtgaccggggggagagagagaggggtattacaggtgggcccaagggaggcattcttttttttatttgctgactggattgccacgtaggcgccacgtgtgcaaactcaagtcaatattttagaggtgcttatataaggtgtgcatattttgtattcatatgagtgagtgtacacatattataagtgtctataaactttatagacgtttcttttaaaaaaaagtatgcaagaatactcgaagaaaattggacatgttgtaaccataggaacataattcctaaagtattgcataagtatcaattaatcttatagggtaaacaatactagtaataatattaattttgtctaaagtgtgacgatgattacttcagtctgatatcaacttcaaaaaataaccaaatctagtttaactgcccaagtatcgaggctaaagcatctcttgcatatacattgacacggatcctctgtcatactatatctaaagtagcagtggctaacaagtaaacccacatatcagtgacaactattacatatgtcaaactacatacaatccttactggtacataccacgtttgaaattcttgtcaagctgaatcattttttggttagctagctaggtatggtagcttcaaaaaattacttcctccgtttcacgatataagtcattctagcatttc

SEQ ID NO: 13337 - DNA, 1501 bp, Oryza sativa
aatataagggattttgagtttttatttgtaaagtttgatcactcgttttattcaaattttttttgtaaatataaaaaacgaaaagttgtgcttaaagtactatgaataataaagtaagtcacaaataaaataaataataatttcaaaaaaatttaaataagacgagtgatcaaactttacaagcaaaaactcaaaatcccttatattatggaacggagggagtatatattctagtttaatagttaatgaaaagtgaattactaattttttaaaaaaatttaatgttgttttatatttgcacacgtgaaggccaaaataaagttattggtctgatatgtgaacagtattttggtcaatcactgatctaaaccaacaaagtacagccatgtactctacgaaacccggaacaactgtttttttgtttaaagacgactagagcaacgagtacgtgtgcgcgtgcgtgcggctagtaaggaacttttgtttttttctactttcaatgtctgcaagactggaagcttccaggagaaaaggaaggaggagttgaggaaggaaccaaatagcggaggagcaccactgttttggaccgctcttctactcgatccatccgtggctgcttcgtttccactgaatttccaagctctccccagtgtcaactgatcgttttctcctccaaaaaccatcgagatacagaaaagtagtccctcaggttaataattcgtagccctaaaatttaaatttttaaacttgattttaaagttgattttaagatacttcaacataatttattttcaacattggctttaaatcactacgaacaaatgtataaaaaaaattgtctataaattgtttttattccctaacaagccgtattgaacaaaagctcacgttttgaacaaaagctaacatcaaattttatttttttaactataattaaattctaaaatattaaccatacatattttagtattaaaaaagtactttaataaaataatatatttgatgatatttctatatgtattataataaaaatgatagtacaaacaataagtattatcaatgacaggaactttttttttctctacctaacgcgttgttgttgtactatagtactatatggtacctgtaaaaaaaatgtgaatgaagcaacacaactgtcacgttttccgtttgcactttgcagccagcacagccgacggcgatctcttgtgtttccagcgtgacgaaacggatggatggctacggatagagtggtgctttggtgtgcttttgttttaattgttgtctcttctcttctctcgtgcaaggccggcagtgtaccgtgtgctgataagagttcaaccactaaagttccgagtaataaaagacccagacagtacagaggagccactttgcatgcataaaactcctactctactgtactcacagttgcacggctcagaatttatagcatactggagtatgtggttgtttatgcaggaccagatgatcaaaagttggt

SEQ ID NO: 13338 - DNA, 1501 bp, Oryza sativa
ggctccacagccacaaggacctcagcatcgacccgcggcgagctccgaacaactactccatggtggacttcaagcggttcttgatgtggcggtacgcgctgccgcgggagcacgcgatccggatggaggaggaggacaagagcaagaagccgcggctgctggtgatcaaccggcgctcccgccgccggttcgtgaacctggacgagatcgtggcggcggcggagggggtcgggttcgaggtggcggcggcggagctggacgcccacatcccggcggcggcgtcggcggtgaactcgtacgacgcgatggtggcggtgcacgggtcggggctgaccaacctggtgttcctccccatgaacgcggtggtgatccaggtggtgccgctggggaggatggaggggctcgccatggacgagtacggcgtgccgccgcgcgacatgaacatgaggtacctgcagtacaacatcacggcggaggagagcacgctgtcggaggtgtacccgcgggcgcacccggtgttcctcgacccgctccccatccacaagcagagctggtcgctcgtcaaggacatctacctcgggcagcaggacgtccgcctcgacgtccgccgcttccgccccgtcctcctcaaggccctccacctcctccggtgatcgccggcgatcgatatatatatactccggtgaggcgatcatgcatacagaacacacgtacacaggattaattacagcagaagatggagttcattaattaattaattacagtggtagatgatgatgtagtttaattaattttggtggttgcgcaaggcggcaacgtttttgtatgataattaatcgatcctgtttcttttttttttcttttttttctgttgcggagccgtgttgcgacgtgcgtacgtgtgtgttacggtaagttggcctgctgcaattagctggttcaacatgacagaaatgcatgtgacacttccatcctttcttgtacagttgtactgttgttaccttacaagctacgattattggctggaagcctgtgaggaggatactggcccaggtgatctatgggccacagcccatagaaggagctgggctgtgtgctgttgctcgtaatggcccagatcagtctatagtcttgggctctacaaatacggcctgtttctcggcttctcgcaacgccgttgctgatgatgattcagccgaacggtcagggtccaactcgacctttgaattttcacggattaaaactctcgggagtttggccggagtagtaaattctgattcattcttcgcgttggtaatgggcatatgcatggctcagacgtgatatgcgaggcgtcgccatgaacgcggctttgattgctcgcgcttatcccggtggacgtcgtcctctataaaacaaagcactccagctcgatacagcataacgcagttcgcaagttcaatcgcaagagtactctacttctgcaagcttattcttcgactgatcaagcaaggtagagaca

SEQ ID NO: 13339 - DNA, 1501 bp, Oryza sativa
aaataaaggaataagatcactttgactccctcaactgaccaacgaatctaaatcgtatccctcaagcgcaataccagaaatcttatcccctgaacttgtaaaaccggtgtaattttactcccttggtggttttggatggcggtttcgctgacgtggtgcacacgtggcagtgttgacctgatctttgttccacgtggcatttgacgtggcgtttatgtggcattaaaataaaaaaatatatgcggggcccatttatcattcacacaaaaaaaaattgtgggacatgtcatcttctctctcactatccttcttcctcctctctcccttatctctctctctctctccccttgacaagagccgatggcaggcgggggctcggtggcggcatcagcgagtgggtgcccggagtggtggctgtggtgggcggtggaccttggagcaatagcttgcacgccccaacgcgcggcggcggactggcctcgagcgctccggcgtcgacctggccatgatgcggaacagcgactggagctcctcctcctccgacacgggccccctccccgaccacgtccgccgcgagaccgccccttcttcctcttggacttgccgccagccgtgcccgcggcggcctcgcggaggctcgggaagttggcagcaggagtagggggctcggtggccgccggggcggcagcgttcttgcgctcctccacctcctcctcggtgcgctcggtgtcctccgccgcgcacattccttcgtgccaccgtgcccggctcgctccctccccaccacggccgccccgcgccatcgtcgccggaatcatcctgctcatcgctgttgtgccctcgccgccatgccctcgccccgccaccatccccatctcccgtggcgccagcgccgctccagtcccggacctgccgaagctgaatccttgctactgcggcggcgagggcggcggcggaggcggcgcgaagaccgtcggctgccgctccgtccattgcccgccgccgccgctccccacgcacgaagagaaagagggagagatagagaagggaggagggggaggaggaagaagagataggagagggtgacctatgggatccacatgtcagtgggtcccacaaattttttttgtgtgaatgacaaatgggtcccgcatatatttttttattttaatgtcacataagcgccacgtcaatgccacgtggaacaaagaccaagtcaacactgccacgtgtgcgccacatcagcgaaaccgccatccaaaaccatcaagggagtcaaattgcaccggttttgcaagttcgggggtcaatatttctggtattgcggttgaggtatacgatttagattcggtagtcagttgatggagtcaaagtgatcttattcccaaaataaaatcccttctttgcatgaatattgtgagtttcaccaatactatcactgaatattttttcagtttctacgaaatttgatctgttttgcacattaaaactcacagatggc

SEQ ID NO: 13340 - DNA, 1041 bp, Oryza sativa
aggtggtgtcggggggcagggtgagcgtgaggccggagccgaggacggggtcggcggcgtcggcgagggagaaggggatgggggagggcgggccggaggcggtggaggcggagtggacggcgagggcgcgggtgtcgaggaggaggtcgccggagtgcggggcggagagggtgagcagcgcggaggcgtggatggtggaggcggcgaagtcgaggtagaaggcgagggcggccttggcggtgaccgggtggtcgccgtcggtgtacgagtggggatccaccggcggcatggctgagctgcagcggcggaggaggaggagatcggagtggagggtagggagggagggacagggtttggctttggcctgtgtggatttggtcgaactcgaatcgagacaggattgaaagaagcaatgcaacacctcttcagggaaaaggagcttcaaacctcgaattgaaagaagcaaatcacatgcttaacttttttttttaaaaaaagaatacagtactccatccgtccagaatataagaagatttagagttgacacggctattaagaaagtatgaataattaaatggtgaaagattgggattggttgaaaagtgaaggtaggtggggaaattaaatggtggagggttgtgattggttaagaaaaaaatgttagtggagaagttgttatattttaggacaaattaaaaatactaaaagttattatattttagaatggaggaagtacattattaacttttaaattatatactcacactatatctatatatagtacattattagtttctttaatatactagtagattgatcgtaagtaatgtgtatacgttttttctacgtgtcggtccgagatcatacaacatatactatactcgcactaagtcaaaacaatatactaatagattgatcgtaagttgtcagggttatggataccacatatctaataatagttgactaaatctcgacaagacccaccacataccatgtcttatacggaaacaaccttcagatataggaggagttccgcataag

SEQ ID NO: 13341 - DNA, 1417 bp, Oryza sativa
tgccgcgccaagacgccaggccgcgccacgacgccgtgacgccaagacgctgcgacgccatgacgccgccgtggcacgccaccgccgcgcaatgtcgccgccgcgccgcgcgccacgccgaagccacgccgcggctccgctgccgccacatgaatgaacgatcgatcgtgaacgaacgaaacgtgacttaggcgagaacttaacgacaacgtgaacgttaacgaacgaccatgaacgaacgtgaacttaacgtgaatgtgaacgaatgaacgtacgtgaacgtgaacgcgaacgtgaacgaacgtgaacttaacgtgaacatgaacgaacgtgaacgaaacgtgaacttaacgtacgttaacgtgaacgaacgaacgtacgtgaacgatacgtgaacttaacgtacgttaacgtgaacgaacgtaaacgaacgaatgtgcgtgaacgaaacgtgaacttaacgagaacgcgaacatgaacttaatgtacgttaacgtaaacgaacgaacgtaggtgaacgaaacgtaaacttcacgagaacgcgaacgtaaaatacagtatatgttactttgcgtttagcctaatacatttttttgtatgttgcagaaaagaagttgttgtcgtcgtccctcaagccggagtggtagctagcccttgaaggaattcgcgcaggcaagtgatgtaaatatatgattgttagacttagcatatatgattatctagggttgtaatgtacgacacttagacttagcatatatgattatctagggttgtaatgtacgacacttagacttagcatatatgattatctagggtcctaatatacgacacttagacttagcatagttgactattagagttttaatacaagattatttgagttttaatataagattattagagttttaatacaagattattagagttttaatataagattatttgatttataattagacttagcatatatgattatctatggttctaatatacgacacttaggcttagcatatatgactgttagagttttaatataagattcttagagttttaatacaagattatttgagttttaatataagattattagatttgtaattagacttagcatatatgattgtctagggttctaatatacgacagttagacttagcatatatgactattagatttttaatataagattattagagttttaatacaagattatttgagttttaatgtaagattattagatttgtaattagatttttaatatatgattgttagagttttaatacaagattagtacagttttaatgattatctagggttctaatatacgacacttagacttagcatatatgattgttagcatataagattgttaaagcaaatatgacctatagacctaacaaatattttttgtatgcacaga

SEQ ID NO: 13342 - DNA, 1501 bp, Oryza sativa
agagctatctcaatcgggcaaacggccgtcacggatgattctatctcaatcgggccctaagtaaagcccgtcaccgatagctttgacccagacaaccagtcaaactatagcccgtcacagatgacctatcttaatcgggtcacaactagcgcccgccacagatgactcttatctgtgacgggcattaactatagcccgtcacagatgagtcatctgtgacgggcattaattatagcccgtcatagatgagtcatctgtgacgggcattaacttatgctagagttaattcccgtcacagatgagtatattccaaaaataaataaattttattttttggctagccctcactcgtgtgcacccacgcggaaagttctttagagattggcttccggaaaagtaattgtaacatgttggtatgagtattctattaatcttattatgccctaagccaggatgtcaaatttgggttactaaatgatttcaaatagaaaagtcaccaaaaccaaagttgtagaactcatcgaggtgcaaaatttttattttggtcatttctccatctgactctatttaaacaatttgaaatttgaaattcaaagtttaaaaagttcaaatagaattttagatcagtgaacgacttcaactgaaaaagtcatcaacaacaaagttgtataactcatcaaaatctataacttttattttggtcatttttctatataacattttttgaaccgtttgaatttaaatttgaaaatatgacaacttcaaacaacattttcaaatactaaatgatatcaactgaaaaagtcatcaacaacaaagttgaataactcatcaagatctaaaacttttattttggtcatttcttcatacgacaaagtgatagtaacattgttcacaaaattgacatatctcttatctggttttttataaactataacacatatatgtaaaatttgtgaataatattactaacatttcgtcagatgaagaaataacaaaaataaaagttttagatcttgatgagttattcaactttgttgttgatgactttttcaattgaaatcatttagtatttgaaaatgttatttgaagttttcatatttttaaattcaaattcaaactgttcaaaaaaaatgttatattgaaaaatgaccaaactaaaagttgtaaatattgataagttatacaactttgttgttgacattttttccatttgaaatcatttctacccgtaaaattattttgctatagtcaacttacaaatataaacatttcatatgaaaaatggaaaaatagtcatcggtgacaggctttagttaatgcccgatagagattaagtatatagcccgtcactgatgagtcatctgtgacgggtctagttgttatctcaaacgggcctcaagttggtgcacgtcacagatgaggtgcacgtcacagatgatggtcaggcccgtttgagatatagaattttatctcaatcgggcctaaagttgtggcccgt

SEQ ID NO: 13343 - DNA, 1501 bp, Oryza sativa
atagcagactataagctagctataaacacatatcgagaagataaataagaagagataagagcagcagactatatatttgtagccagttgcagcacagactataagacgcaatgtgtgtataataggtgggaccatatattacttgtgtaatatatgtttatatgtaaaagtatgattagattattaaattgattatagataatttagagctaatactgattggctatactattagagcaagttcaatagtatagccaactactagctccaattatctatagtcaatctaatagcttattcatacaatatttacatactacactattaatacctggtcccatctatcatacgcacacggcgtcttggagtccgtgctgcagctagctacaaatctgtagcctgctgcccttctctctcctcatttatctccttaaaatatgtttgcagctgacttatagtctactattcctcctcttaaacttgctctaacgccagagaataattttcgcgtcagccagccagccaaccaaccgtcgaccgcaagcccaggcacgtatacaccggtccacgtagtacgacgagcccacgagcgcgcgtgcaacgcacgcaaacgtaaccgcgcgtccgcgacccgtcgtttccccacccgacctgcgcccggctgcctctgctgcatctatggatcggggacgcgtacgagcgcgtgcgcgtgcggcgtgcggtgcgatgcgggccgcgcgcggctgatcaccccggggtgccagtttgtccggacgcctcgtccgatcgccaccaaacggccaaacagctagtagtagagcgggcgcgccgcgcgttttcatacgtttgcctttggagttttttgcagcctcgcttgtccggagtcgtcgagcgggcgcgccgcgcgcgcgggcgcatgcgtgcgtgcccggtgggggtggagcacatcgccttcccaactaattaatcagagcaaaactaataatacaaccgatctaataatacaaccgatctgttaagtataagattttttttagccttctctcagcatgtttatataatagttagctctttataattaatacatgacccacttatctctctcaaagagtttattggttcttatgtgttcaaaccagctataagtttatagcccacttctcctctctctctcctctatcctctcctccacctcagcatttagtcggcttatagcatactattatacttgctctcaagtgcgcctccgcgaccgacgaccgggttcgcacttcgatcgcgcagttggtttggttggaaggtgtagtacgtggaacgagagatttttttttcaagtacagctgtggataatttgctaaactttttcagcggggcctaattcttttcaggttttaagggctactggactttcgtgggcacgtcttgtaagacgctaaaattttccatatacgggtatatatacgttcgaataattgtatcaccttgatgcaattgacttagt

SEQ ID NO: 13344 - DNA, 1501 bp, Oryza sativa
agacgatcaagaaccgggtagggaaacaaaacggctaaatcaggtaagatcggctgaaaccccgatactatctctattagtaatcaaagaaagagctagataagacgtctcaagatagcacttaacagatcgaacctaaccgatgcaacattaagcgtgaaaagaaacataagatctaagcaaatcaatgagaactcattcaagatggtagatatactgcacaatctagcttggtgtcgatatctaaatttatcggccgttttcgatgatagaggctagccgatgaagttagatgacgaaatctatctagattatacagcatatatgataactcggtgaatcacataaacaggattagagtgtcataaagatgtaagcactaatccagagaacacaaaccgccatagcaagctttacctctttgtcggagatcgaacccgatgtagcccaactcgaaagcaaaaactcgtcgaaacaatgagaatagaaaagggtggcgatgcgccgaagtattattgaactgtcgttctgtgattacaaggtgtcaggtcatatttatacccgaagtcagggccggcccttgccctatgcagccaaggcgaccgccgggggtgggggggcaacacctaatactagtaatctagtaccttatccgatgttgagatcaatgatttttattcagaattaaaggtattgcaagtgagttttctaaattcttcgatatgatgtccgcgcctgagattctgaaatttgttatgaatgcatatttctatccaaatgtttcagatgcctattgaattctcttaaccgtacctgtgacggtagcttcagctgagaagtttttcaaaattgaagttgttgaagaactatttgagatcaactatgtcacaagaaaggtcaaatggcttggctatgtgctcaattgagaaggatatatcggacactattgatcttaattccgttctggatgattttgcatcaagaaatgcctgaagaagtatctttacataggaagcagtggatacgatggggttctattcttcattaagttaatgaataatgatattagttccaagtttcaaatatattgttattttggtcgactttatttcttaataattaccaggcatgttaaatttaatatatggatgtattacaagaatatgcggatgggccaaaaaaataaatagtttgggccagaaggaaaagaaacagatgtgagaaaaaggaataagttcatctaaggtcccttaactttcaacgaatccgattttcgtccttcaaccacaaaaccagatacaacgggtccctcaactatcaaaaccggtgcagattagatccctcggcggttttgaaggcggttttggctgacatagcacctatgtggctagtttgacttggtcttgatctgacgtggcattgacgtggcgcttacgtggcaattcgatccggaaaaataataaagcccgtgggacccacatgtcagtttcacatagaaatt

SEQ ID NO: 13345 - DNA, 1501 bp, Oryza sativa
gcctgacaggccctgacagctttccggttggtaacacaaaccggtactaaagatcaaatatgcccgttacccttttgaaccgggactaaagatcatctttagccccggtttttattgcatccgggactattgtggaaatcggccgaccgacgaaagatggtttctccaccagtgcactgaactccttatctagatttatctttaggaattatttttttggggtatagagggagagtacacgttagttagttcggcttacaaattttcaactggtctcccttatcttctacaacaccaagaaaaataaggaccggccaagcagctagctagctatagctggtgcatttcgccgaaaatttggaaggcgtgcgtacgtgtcgagttgtagttgtgcatttcgccgaaaatttggaaggcgtacgtacgtgtcgagttgtagagttatgcatggatcgtcggtcgcatatggtatgaattccatcgatcgtctagatactggaagaagctttagtacgtgtaggtggagaaaaacgttggaattctcctctctcttccggacaacttaacacacacgtacgtactacgcatgagtcaagcgcatgcaccccaacataatacaagaaattttaacattttgtttgatcactcatcttattaaaaaaattaaaattattatttattttatttgtgacttactttatcatattaggggacggaggaagtaacttagcttagcatgtacggccaccatcatgtctatattttctttattcttagaattacatagtacaacgcagacactcaccctgtgagtgtctttgaagactgagccagcaaatccatcttggagattgcgcctcgctgttgatgggtacgtcgtctaccactgaaagcataaagccgttaaatcctataaaatttgcttccatagggagtggaaccctgacctaagatactactgaggctcttgtaaccactacgctataggccctgtcggtgatatgggaccgggagtatcatgaccagaggcttgaggcagacgcaatcgcccacgtggcctggcaccttcggggacgtcgggcccgagggtgaggtgtccgccctcctcctgatttcccccgagggggggtcgggttgcgcttgccccggccccgagggccgaggcaccccgaccccttaaggaagtctgcgccacatatatgggataagtgagcacagctgtgctcacctaacagcatttattgcagtctggtcaagcatgtcacgctgcatgcaacgcagtacagcgcgttcctttatccggtctgtgaccagtcacagaccggtcagatcacgggttaggtggcgactggcggtctgacgcacgccttgccccatcccgtcaagacgaaagcctctaggcactcgtctcaagccggagctagcgtgttatctcttagagatggcacgttagccctggtcagatttataccaggcttcatcctaaccattacaggcaagg

SEQ ID NO: 13346 - DNA, 1501 bp, Oryza sativa
agcagagccactcgaatgtgcaatcctcaaactgcacatgcgtgatcgatgcatgatcaccaacgaacaaaatggaaatcaattagctagaagaaaatctatcagcgtcagtgcttacactctcaggaagacagtatccattgtcgattgtaaccagggagaggccatggccttgttcgtctctgcaggtgaggatgttgccagcgtgcatgtcggcgttggccagcctgatgtccagcacgcaggtcccatctcgccgagcgctggcctcactatcgtcgactcctccactccggggactgccgccaccgccggaggaggggtggcgaccacctcttcatcacgccgaggtccacggccatcgcctcgaaggacgagctccccccgcagcctcagcctcagccccgtcgcagcaccgactgcccagcctcatccgctcccttgtctccatcatcaccgtcgccatcgaccgggtggacgagctccctgcaccaactccgtccaccacaccggcggtgctgccgctccagaacccatatcacctccagcccaccgccgccgccgccgctccagctagcttgttagcaataatcttgtctttagagtgtatgcatttggtttgtataggttttgcacaaggtagtagtgtgtggcagcaaaggatccgagccagtacgtgtgaaacgtgcttgctgtgagctgtgcgatgcggccggacgaacgtgccgatatctacgatgtgtaaaggctgttgcattagcatgtagaactagtgattagcggctgcatgcaagcatttagttggatgtgttaagatgcatgcagagctgcagctcaagctggaaggccacgaagtgattttgtggcggaagaataggtctagctagttaccttgttgcatggcatctgcatgttggagtaaggcgtgagtcaaggccaaattagttggctgatccttatcttttgcatgtacttaagtctatgtaatgaagaaaatggtgtgagttgtgattagccacatcaaccaaaagcctgtgtgttttgttcagttcttgtgtgtttgtgtccaccgagtaaatacaagtgtttatgttagtgctagtgattagtacttaaacattcagagaggagagattctaacatagctcccgcgtcagctcccgctgccgccgccggttcagctcccgccagccgccaccacaccgcggcccatgccccgccgccggccgaaggggaagaaggggagagaacgaaagagaagggagagacggaggaggaagaaggaaggaaaaagtccactttgactcccttaattatcgacagaatctaattcgtgatcctcaaatcgcgaaaccggataagacgactccccgaactattgaaaccggtgcaatttgactcactcagtggttttggagggcggttttgctgacgtgtcgatgttgacctagtcttcatctcacgtggcgcttacgtggcattcgaattaaaaaaatatatg

SEQ ID NO: 13347 - DNA, 1501 bp, Oryza sativa
  unsure (1)..(1501): unsure at all n locations
tggggttggaggaggcgccagccaccgccactccggcccccgtccgccgccgtcgccgacgatctagcccccgtccgccgccgccgacgatgacgatctggcccttgctctggccttcgcccgcccgccctcccgccgncgntagcccccatcctacgctcgcgaacagaaagagagagaaagagagggggaggttgaagaaggtagataagagaggatgacacgtgggccccaaatgtcagtgggtcccacatatatttttttaattcgaatgccacgtaagcgccacgtgagatgaagactaggtcaacatcgacacgtcagcaaaaccgccctccaaaaccactgagtgagtcaaattgcaccggtttcaatagttcggggagtcgtcttatccggtttcgcgatttgaggatcacgaattagattctgtcgataattaagggagtcaaagtggactttttccttccttcttcctcctccgtctctcccttctctttcgttctctccccttcttccccttcggccggcggcggggcatgggccgcggtgtggtggcggctggcgggagctgaaccggcggcggcagcgggagctgacgcgggagctatgttagaatctctcctctctgaatgtttaagtactaatcactagcactaacataaacacttgtatttactcggtggacacaaacacacaagaactgaacaaaacacacaggcttttggttgatgtggctaatcacaactcacaccattttcttcattacatagacttaagtacatgcaaaagataaggatcagccaactaatttggccttgactcacgccttactccaacatgcagatgccatgcaacaaggtaactagctagacctattcttccgccacaaaatcacttcgtggccttccagcttgagctgcagctctgcatgcatcttaacacatccaactaaatgcttgcatgcagccgctaatcactagttctacatgctaatgcaacagcctttacacatcgtagatatcggcacgttcgtccggccgcatcgcacagctcacagcaagcacgtttcacacgtactggctcggatcctttgctgccacacactactaccttgtgcaaaacctatacaaaccaaatgcatacactctaaagacaagattattgctaacaagctagctggagcggcggcggcggcggtgggctggaggtgatatgggttctggagcggcagcaccgccggtgtggtggacggagttggtgcagggagctcgtccacccggtcgatggcgacggtgatgatggagacaagggagcggatgaggctgggcagtcggtgctgcgacggggctgaggctgaggctgcggggggagctcgtccttcgaggcgatggccgtggacctcggcgtgatgaagaggtggtcgccacccctcctccggcggtggcggcagtccccggagtggaggagtcgacgatagtgaggccagcgctcggcgaga

SEQ ID NO: 13348 - DNA, 987 bp, Oryza sativa
ctccaatttttaaatgacaaactttttaaataaaagcacataaatacggatgctacaggctgacgcctccaccctgccgcacagcagccgaccagcctcgtcgcggcgcaccggaaagaaagccctcgccacgcacatcgacgacgccgcaggtgcccatcttgaggtacatgatgggcccgtacttgcgcgctagcgacgccaggtcggcgtgcggggctgggccgacgagcgggagcgcgccgaggacggggacgcccgggggtcccaaggggaggcggcggccgccgccaggggagggcgggcggtaggagcagagggagaggttgaggaggaggcaaaggaaggcggcggagagcacgacggggtcggtgcagagcgcggcgagctccatgcatctggagcgacgaggcagggcgtcaacgacgccgtggggagggatgggcgaggacgtcgacgactcgcggggggagagaaagagaggcggcgagggggactccgctccaggttgggtgaactctggccgggatggggttggaggaggcgccagccaccgccactccggcccccgtccgccgccgtcgccgacgatctagcccccgtccgccgccgccgacgatgacgatctggcccttgctctggccttcgcccgcccgccctcccgccgccgctagcccccatcctacgctcgcgaacagaaagagagagaaagagagggggaggttgaagaaggtagataagagaggatgacacgtgggccccaaatgtcagtgggtcccacatatatttttttaattcgaatgccacgtaagcgccacgtgagatgaagactaggtcaacatcgacacgtcagcaaaaccgccctccaaaaccactgagtgagtcaaattgcaccggtttcaatagttcggggagtcgtcttatccggtttcgcgatttgaggatcacgaattagattctgtcgataattaagggagtcaaagtgga

SEQ ID NO: 13349 - DNA, 1501 bp, Oryza sativa
tataacactctcacgaaaattactttattggtaaaaatattacatgcaaaattttccattatagttgttcattgtagtacaattgtagtatagtttgtgtataaaaaaatatttcaccaatggaaagcacgattgtagtatagtttgcgcataaaaaaatatttcactaactgaaagtataatacgcctcatcctagtatattaatccgtcatagctaaaatttagtgttgggtttgccattgataacagccttccacatttccagaatcctcaaaccggataaacatatattattgaatggactattgctatagattacctatttcattacaaggagaaagaaactcaacagattacttacaacaagtagtgttaacaatatagcaagtttttagatgccaagttattccgcaatagatatattttcgtaacaaaatggtacttcctccgtttcacaatataagtcattctaccattttccacatttatattaatactaatgaatctaaatagatatatatgtctagatttattagcatcaatatgaatgtggaaaatactagaatgacttacattgtgaaacggaagggagtactggataccgcggaatcgtttgagataagcaggtttgtgaaagatattttcaccgtgtctacatcatttctttacaaaagcatttgtgatttgtatggtagtacaaaaggtttccaagtgaccacgcaaacaatgttgtccgctgaagtgtccacctttatcatgggccgaagagggaaatatcctcataccccgtcgtcacccagaaggccagaatgtcacttgacatccttgtcgcggccattattctcgttggaagctatccatcttgcgaagacgtacgtgcagaatgcatcatccatgatattgtttgtcccgtccctacatcacgccaaaagtcacaacaaaaacacagtaaagatagtttggaaagaaaaaagaagttattctcgatataaaactggcaatatttggctataagcgagtgtaatttccgtcaactaaagcccaattgaatcaaggttcatagtttcagaatatattctaaaataatggataatatttgaccatcattatgtttttggtcaagtaaaagccaaagccatatggttcgcacttcgcagtttcaagaatatttaaacacggtaaattacccaatctgaactgagatctttgggtggtatctcgtgcagtagctggcctccataatctttaagcatataccatccctgacagtgacatcgactatttaaggttaggtaggaattaacgcccaattacggatagtgtggatcaaacttgagttcactggactctgccactacggaaatctggatcgcatcttaattaagcctcgagagagacattagtatttttattcgctcattccaccggtcagaaacgtgtgcaagctaacaacatcgctaggcaaaaggaagtcgttgctttcgagtttcccacccatgg

SEQ ID NO: 13350 - DNA, 1501 bp, Oryza sativa
gggtgagtgtctgcgttgtactatgtaattctaagaataaagaaaatatagacatgatggtggccgtacatgctaagctaagttacttcctccgtcccctaatatgataaagtaagtcacaaataaaataaataataattttaatttttttaataagatgagtgatcaaacaaaatgttaaaatttcttgtattatgttggggtgcatgcgcttgactcatgcgtagtacgtacgtgtgtgttaagttgtccggaagagagaggagaattccaacgtttttctccacctacacgtactaaagcttcttccagtatctagacgatcgatggaattcataccatatgcgaccgacgatccatgcataactctacaactcgacacgtacgtacgccttccaaattttcggcgaaatgcacaactacaactcgacacgtacgcacgccttccaaattttcggcgaaatgcaccagctatagctagctagctgcttggccggtccttatttttcttggtgttgtagaagataagggagaccagttgaaaatttgtaagccgaactaactaacgtgtactctccctctataccccaaaaaaataattcctaaagataaatctagataaggagttcagtgcactggtggagaaaccatctttcgtcggtcggccgatttccacaatagtcccggatgcaataaaaaccggggctaaagatgatctttagtcccggttcaaaagggtaacgggcatatttgatctttagtaccggtttgtgttaccaaccggaaagctgtcagggcctgtcaggcccctccgggatctttagtcccgattggtaacaccaaccgggactaaagatcgtaacttaccaaccgggactaaagatcccggtgatctttagccccggttggtgctaccaaccgggactaaagtcccacccctatatatatgtcttcttcctcctccagctgcccgagtaagcttcaaaatttcttcaaaaaagaggggaggtcatgccaaaatttctattgaatttattttggtgattaattacatacaaatcggaggtgcctaaaaggtttgcaacttcatcctccaatgttttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatctgaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtacggtttttttgactcatgtagatggatcggcaat

SEQ ID NO: 13351 - DNA, 1501 bp, Oryza sativa
gcggctgcctctgactagcgcgctggattattcccagcctccgtcagctccagcccacttccgccaccgctccagctagctcccgtgtcagctcccgccggccgtcaccactctggctctcgacggcggggaggagcctcgacgacgggaacaggtcagcgacgccgaacctaatcgccttcttctgcgcctcgcccagcgtctccaggaactcctcacgccaccggaagccgcactccccatgatggcgcgcagcgtcaagtcggtcagcgtcccgatgatctgcctgctcacgttcagtgccggcagcggcggcgatggcgccaacgagcacacccgccaaagagtatcctcaccgtggtgccgatggagtccctcactgtacgcccagccatagaggtcgaagcccttgggctaggcgccaggagaaggccgagctccatcctcgcctttggccatgatggtatgcatgtagcgatgcctgccttgggatgaaggcgaggcatatcatcaccttctcgacatgatttttgatgagcaggaagtaatcgagctatacagctatacacatcctcttgcttgctcgccttctcctatgctgctacattggtgtgtttgttgtactgctgctcgactctgccgaggctgacccgtggagcattgtgggggttggccggattgccgggctgggttcgtggactgcatcctcggagaccgccgccatcacgcatgcggatacgccgaggtcaaggtcgatggcgatggggaagctggcgcccgcccgctgctaccgcgtcagccatcgccgccgccgccgccgccactccggctcccgcttgccgtcgccgcccttgcatgcagattacgctacgagagagaaggtgaagagaaatgggggagataaagagagagaacgtggagagagggagggggaaggagagagtgaatgacatgtaggcccacatgtcagtggggcccacaatattttttatgtgtgaatcacatgtgggtccatagattttttttaattctaatatcacgtgggacgaaaactaggtcaacatcgccacgtcagcgccacatcagcaaaaccaccctccaaaaccaccaagggagtcaaattgcactggtttcaatagtttagggagtcgttctatccggttttgcggttgagagacatatattagattcgggttacttttaagggagtcaaagtgaacttattccagtctgaaagtagggatctgaaagtctcaatttgtgcaaattaggcctattaataaagcccattgggcttccaggcgattgtcgcgtgggcgccgcaaccgagacacagcaaaaggccttaaggccgcatctcaccaccaggaaaaaacgcgagcgcatctgaagccgaagcgacaccagcggtgttagcctacccgcagcttggcgagttcagttgggtaagctagggtttaggtctcggcgcgcggcggaggggaggaggaggcgatggcgg

SEQ ID NO: 13352 - DNA, 1355 bp, Oryza sativa
cgaaagaatagggacgtaaaatagacttattttacctatatatatatatgtcagcccaaagaggaggggcggaaaatagacttacttcctccgtcccacaatacttgtctctttcgcatttaaaatttgtcccaaaataggcgaaattgctatttggcgatcggtcgcgcgcacccctctccgtgcgactggacacgtggcgcgcgcggagagggggcggcgacggcgcgccgcgcgagaggagctccgtgttttcccttttttttttgtttttctcggtttctctctttttctttttctgtttttattccataatatccgttttttcttttccgtatcttttttctgtataaatatgtatgtatgcaaactttgtatacgcgtatataaagtttgtatacgtgtatgcaaactttgtatacgcgtatgcaaactttgtatatgcgtatgtaaactttatatacgtgtattttttttgtttttatatgtacatataccaattttgtatacacatatataaagtttgtatacatgtattttttttaggtttttatacatacgtatacaaagtttgtatacacatatataaagtttatatgcacgtattttttaggttatatatacgtattttttaggatttttatacatgtatatttttttatagtagtagtagaatagtagtactagtagtattacttactactactagtaataggtagtagtatcactgtatgagtagtaattgtagtctagtagtagtagtgcttagattaagatggtagtactactcctaggttgtgattagattcaaagtttgatccaaacttcagtccttttccatcccatcaacctgtcatacacacacaacttttcaatcacatcatctccaatttcaaccaaaattcaaactttgcgctgaactaaacacagccctggagtcctggggcgtgcgattaggaggactagtagtagaagtaccttagtactagtagtggtcgcgcgcctggaggtgcgcgcgattagtcgcccattagcgtcaccccaaaatagttgtcacttgcaagtagtacttgtcacatcaaccacttcaaattcaaatttgtctccatcatacccccaaccaccattcaacatctaactatataatattttattaagggtattatagtctttttcttctaaccttagcacatgctaaacaacctagaatgacaagtattctgggacagaggtagtatttcactatatatatgtcacagtctaaattggagggacggaaaatagacttattttcgctatatatatgtcacagcccaaacaggagggacaaaaaatagacttatttaaaaaaggca

SEQ ID NO: 13353 - DNA, 1501 bp, Oryza sativa
ccactaacaagattcctgtcgatagaagggacatgttgcacgttcttcagctgcacgatctttcccgaagtaaacttcatatctaccgtgccaacaccatgaatagaagcatgtgacccattccccactaggacggtggaaccccgtgcgacctgataagaagaaaacaatgagatgtcagcataaacatgtacattggccccagtatcaacccactaattagtagactgattaactgaaaaaacaataggtaaattaccatacccgcttcgatctccagtgttgccaatggtcacattagcagacttagaagtctggcttgtaggtgtcttcatccccttgcgctgtggacacttcctagccagatgaccaggttggccacacacaaagcaagtcctctcatcctgattaggattattgttgttcttcttctgcttcttgaagttggtggtctgttgagctttgtatttccccttctcttgttctgggccttatgcacaacattggcactgtactgcccaccatcgcccttagacacaacatctttttcccgagctttctcctcaacatcaagagacgctatcaacccctcaacggagtattcctatctcttgtgattcagtgcagtaccgaaacttctccaagatggaggtagtttcgcaataatgcacccgaccacaaatttgtcgggtaagacacacttaaggagttcgagttccttagccatggtttgtatctcatgagcctgttcaactacagaacggttgtcagccatcttgtagtcatgaaactgctccatgatatacagatcattgctagcatcagtagcaccgaatttagtattcagtgcatcccacaactccttagcgtcggtcatatgcatatacacctcgaccagacgatcgccaagaacgctaagaatgcattccacaaagagagtagtggcttcctcaaattgcttctgctgatcagcagtaagaattccttaaggtttgtcagtactcacccagaagcatttcatagctgtcagccatagagtgaccctgatatgccatctcttaaagtgcacaccggtgaatttatccggcctcagtgcatcggcaaaaccagccatagtaaaatcacagcacctataataaggtttttggattgttgaaattataagcacataatgatttaatttattccataaataaatcatgacattggtgatgtaaactagattgaacgcatcattagatctacacatgtaaattaagcagtaaaacatgaacagatcaaatatgcgcaacatgttgaacacgtaccgaggtgccggaaagaccggttgctccgcaggaactactcgcagttgcgggcgtcgacgaaggagagtcgcacgcgagcggagaggaagacgagccatcgcggacgaatagggagcagtcatgcgaagcgcttcccaaaaaccttattgccgccttctcccggtgcaggacgtcgaagacagaggttccggaga

SEQ ID NO: 13354 - DNA, 1501 bp, Oryza sativa
tgccgtgctatgagtgcgtcttgagtaagtagacaaatatgaaaccaggtataaattctaacagattctaacatatctcttgtagtctttctatgcaattcagctgatatagtgtctatgcttcttgtaaacgcctagtgaagcaacctccctcgcaacaaaagaaaataaagtaaacttgtgcttcgaaacacaagattattagttttatgccgtgagctttgaatttttttagttcaacttttcttttcttgctttagtttgttcgttccttacagcattgcaagaacactcttttgcctaattgcatgcatgcctgacgatgcttcccatgcacgcctagtacgtgttttacacagcacgttcttcataatcatagctcttaaggattcagtccaaagttaaacgccgagttgatatacgtcttttaaccgaaatttaggagcgaattttaaaattgatttggagatgttagtaagatttgatccacggaacacgtatgtatatatatatatatatatatatatatatatacacggcaaatacttctactgcatgcaaattaaccaattagttaagtgagcatttgctagctagtttcaagaggaagaatgttttactagtccttgcaaatatctctacctctcgtctccaaggagaatataaggaagcttttttttttctgtttgtgtttgaacaaatactgaaccgaaagtctgataattaatctgattaacgtgcatgcacatatatacgagctgtgagccgaaagaaaatggttgattatgaagtacttccttcgtggttaagaaaaaatgttagttaattccgccaaagaaaggcaagagtgaaaccattctttttgtctctttgacggtggaccaagattccagttactatatagacaattccaatgcagtgcatgctaaggcatatgcatccttggttatggcatgtttaaacatagaggttatatatatgactttttttagctgtgattagtcaaactgtttttgaagaaatgtatgtttcgtgagtaatgccactaatatgtgctgttataaatgctattcctttgttattaattccataaaatccatgaataaaaatgtcagttgttctaatttgacgacaatacaagatatgagacaacattatatgtataattagcggacccgccaattaatatcatccttctcaaaaaaaataaagtttgcaatccaaaaataatctgcaagcaaggtataagtaacctttcaatgttgttggcccctttcaccggtttcaatgcatgtgttgtgcctgcattgagatgcacttgtgtgttaaggaaaggaggaaactagtgctgtgctggctagtcattttataagttcataggtcgtcttcaagttggggtcaatgggaggaacaatcgagaaagcgacctccaaatacttgcagtattttatgacggattattcctactaatccagctcccctgatcctggcctaaacactg

SEQ ID NO: 13355 - DNA, 1501 bp, Oryza sativa
cggttttgggagttgggggatatgttatacccggttttgcggttgagggatgcgattcaaccaagcgcaagagatgagggaggcaaaatggacttattccagaaggaattaactgactctctctgagttgatcgatcacgcatgaatcatcagcagccagcgaccgcattatggttgtcgctgccgtgggcggcgagacgcagacgcagcggagcgccgtcgcttggacgcggacacgataacacctcggcggctcgacgctgccgccgtaacagaatctggccccatttggcaaaattggttatatagcattgagagttcacgtttttagttttatagcatccaaagatacaggttcactttagtaacacccaaagttcaccccactcctatttttaacacttccgtcaattctcgatcgttttccgtccgcgttgatcgctatttacccagccacacacacgatatgacgtttctatcccctcattgccatgcattctacttttacatgaactttgaatgctattaaagtgaaccggtatctttcggtgctataaaaccaaaaatgtgaacttttgatgctatataaccaattttgccataggggcagaatgtggcgggtttattattaactattttcactagatttggtagaaatatgtttacagatcatttaagaagagaattcacccgccatgagacaaaatgaacctccggccaatcaagtgcgagtacaaggattggaaggcccacatgacagtcaaaagcgatctaaagtggggccaaagcatcctcaaccaccataggacccacttgtcagagactaaagaaagtcggtggccagaggtggttcggccaaaccaacctcggcacctctaaccgctagcttccacatggcgcttccttattggtccccaataactattacatggatttaccaacttaaccactgacctacaaccgtcatagacctattataaaaggatgacttcatcacacttcatataaaggatgacctgttataagagagtgataagaaaagaaagagatagaggaagctggacactgatacatgggtcccacatgatgtctcggtagggtggactatgtcaacgtgccacgtcagtgaaaaccacaaaatatctaatggttgaggcatacgaatcagatggtacgagggtgtcaaagtggacttatttatttgtagctatccaatctccgttggtctttgtgggccacttgcagtggtggccttccaggtagttaggccgaattttccgtgtgggaccatcaaccatgaccaacctccccacgtggccacgccaccgtcaacttctccattgggcgttagacttgcacgagtccgccccgtgccggtaagacggagtccagctacgagtcgcggatcccgtcaggtcgccggcgtccgtgcccgggcagtccagccaatgccaatgcagatgtcatactcgtcgacacccacgaccccgagatgtgctta

SEQ ID NO: 13356 - DNA, 1501 bp, Oryza sativa
ccgcgactcgtagctggactccgtcttaccggcacggggcggactcgtgcaagtctaacgcccaatggagaagttgacggtggcgtggccacgtggggaggttggtcatggttgatggtcccacacggaaaattcggcctaactacctggaaggccaccactgcaagtggcccacaaagaccaacggagattggatagctacaaataaataagtccactttgacaccctcgtaccatctgattcgtatgcctcaaccattagatattttgtggttttcactgacgtggcacgttgacatagtccaccctaccgagacatcatgtgggacccatgtatcagtgtccagcttcctctatctctttcttttcttatcactctcttataacaggtcatcctttatatgaagtgtgatgaagtcatccttttataataggtctatgacggttgtaggtcagtggttaagttggtaaatccatgtaatagttattggggaccaataaggaagcgccatgtggaagctagcggttagaggtgccgaggttggtttggccgaaccacctctggccaccgactttctttagtctctgacaagtgggtcctatggtggttgaggatgctttggccccactttagatcgcttttgactgtcatgtgggccttccaatccttgtactcgcacttgattggccggaggttcattttgtctcatggcgggtgaattctcttcttaaatgatctgtaaacatatttctaccaaatctagtgaaaatagttaataataaacccgccacattctgcccctatggcaaaattggttatatagcatcaaaagttcacatttttggttttatagcaccgaaagataccggttcactttaatagcattcaaagttcatgtaaaagtagaatgcatggcaatgaggggatagaaacgtcatatcgtgtgtgtggctgggtaaatagcgatcaacgcggacggaaaacgatcgagaattgacggaagtgttaaaaataggagtggggtgaactttgggtgttactaaagtgaacctgtatctttggatgctataaaactaaaaacgtgaactctcaatgctatataaccaattttgccaaatggggccagattctgttacggcggcagcgtcgagccgccgaggtgttatcgtgtccgcgtccaagcgacggcgctccgctgcgtctgcgtctcgccgcccacggcagcgacaaccataatgcggtcgctggctgctgatgattcatgcgtgatcgatcaactcagagagagtcagttaattccttctggaataagtccattttgcctccctcatctcttgcgcttggttgaatcgcatccctcaaccgcaaaaccgggtataacatatcccccaactcccaaaaccgttgtaaattgactccccggacggtttcgaaggcggttttgtcccacgtggcatctttgaccccgttgaatggctgagtcatcaggtgggacccaca

SEQ ID NO: 13357 - DNA, 1501 bp, Oryza sativa
gcgtgtccgtcctgggcgacggcattggccggagcacggaggtcggcggccgatggagaaggcggcgacggtggcgtggccgcgttggtggtgggcccgcgagaagaattcggcccaattacctgccacgaggccgtcactgtgggtgggcctaatcttacggctccgcataaattatgggctttatatgtggcccagatttccaacgcggttaaagtgggtgggccagaagaagcaaccatactggatgggtgacttaatggaaaaagtccattttgactcccttaattattcatcgaatctaatttatgacccttaactggaaaactgggtaggacgattccccgaactattgaaaccagtgcaatttgactcctctaacggttttggagggcggttttgctgacgtggcgctgacatggcggtgttgacccggtctttatccaatatgacgcttatatggcattaaaattaaaaaaaatatatgtagaacccatctgtcattcacacacacaaaataattgtgagcccacatgtcatcctttattcctcctccctctctctcccttctctctcttctctcccccttttctcttccccaccggatcggcagcggcggcgtgcaggcgaccacctccagctccgcgccatctccatgtcatcgtcgtcgtctgtgtccccttccccccctttcgctacgccgcctctctcctctcccttctcggacggcggcggcgcttcggcagtacaggaccgcaggctcccgccgccggccgccgtggacgccgcctcatcgcctccgctcgccggcggacgaaacaaccccacgagcgtatcgtagctgacgcttcgtcttgacgccgtcgacgacgacgatggcgtcactcttcccgacgcccatctcgcgaacccgaaatcgcccaccttggcgcgcagcgacgacgtgagcagcacgttggaagaggcttgtcggccccctctctctcccggcggccatggacggcgagggggagcactgcgcggcacgtccccccggtggtggaggaggcgacggggtccggcgttgggagagggctcgagctcttgctgctgctgccaccatggtgattccgctgctgctgcgctgctgctcttgttggccatgtccactggctcaggtgaggccccaacccagacctgcatcctctgcgagaaaaaaaagaaaagcaaataaaactcgtgtttgttcagtttttcttgagtttcctgcccctttttattattaccaccatgtagttgcttgtaggaatctttgcctagagcaatggctcaatgttatcttgcgatttcttgcttagttgcatagcctctttccctttttgtttttgtgcacactagaaacatcaaagaggaaagattcacttcgaggctatgctagtgctagatttgaatcagattgagacatgcattcagttctgaacttttgagctactgatttgagctaacctgtgttcccatttgg

SEQ ID NO: 13358 - DNA, 1501 bp, Oryza sativa
tggcggaggctactatactacaccctcgctagctagctatactgtgctacctttactctctcgatcgtactcgtgtctgcgatttgtgttgtattaatgtactacctccggttttaatccaagtgtagtttaattaattaatccacgagaaaagatccgacttatgatcaagtctctgtgcgaattgaggaatctctcggtgaattatactggaagcatatcaatctgaactagttttcgatttttttgtgtgaataatcgtccaaattacatcggttttccgtaggtaaccaaatggtaatgacaaagctgctcatcagtacttcagctttgcagttaagaatgagaaggcccaacaggcaacagcccattagatgctagctagtgcagtacttagatggtgtttagatccagggaattaactttagtccctgtctttagacactaatttagagtattaaatatagactacttacaaaactaattacataaataaaagctaattcacgatacaaattttttaagcctaattaatctataattagagaatgtttactgtagcatcacataggctaatcatggattaattaggctcattagattcgtctcgcaaattagtccaagattatggatgagttttattaatagtctacgtttaatatttatagttaattttcaaacatccgatgtgatagggacttaaaagtttaaaagttttagtcccatctaaacagggccttagcacggcccatcacatattgcatcggtgacgtagtgagtgacgcacgctgttgcagtgctctgcgcctctgcatctccttctcctgcacacttccctctcgaattcgaaaaactcgtataattcccctccacagctcaacggtcgggatcccatctcatcgtgcccgcatggcgccatcttctccgagaagaaaccggcatcggacggctacgcccacaatcatacggtccccgaaagtccacgccgccgtctcaatttcagcggccgccccgcaaaaaattcacaaaaaaaaaaaacccgcaacagcttgcactgcacgctgccccctcgccatgttccccgcgtttcctaccccaaactcactgacgcgtgggggacaaccggtagggcccacatgtctgtcggggtgggcggtggtggtgcccactagcctggttacctggagatattgccccccaccccacgacgccaaaatccgcgcgggaaacagctccgcgcccgcgcgccaaacttgctccaaatcgaagtattattttctctcgcgatttctccgatttttttttctagcgataaattaattaatgctcctctcgccgcgccgggaaagcatttaaatctccccctcctccgcgcggttctcccaacccaaaccctaccacgattcctccccactcccaatccaatcgccgcggcggaggcggcgggcgcgcgtgcacaccaggtgttcgacggaaggcctcgccgggtggggggcgaaga

SEQ ID NO: 13359 - DNA, 1501 bp, Oryza sativa
cgtcgtcgccccggacctcctcccgcttcggcgtcgcttccttcggcttcgccgcgtcctcgccgacctcgtccacccctccgtcgacccgagccgcgccccgtcgacccgagccgcgccgccgcattcccccgcttcggtcgccgttcccgtcgtcgccgtcgaccggggtgagccgtggaccgcccacttcgtttcccccttccctcccctctctcggccgccgctccgccgtgcctatggccgccgccggcgaccataggggtgcgggcgcgccgcctcccgtcggctgtgccggcgaggccgccttcgggcgcgccccgcggctgccatgtggcgcccggccgtcagccgcccgcgccctcgggtgcggctgacgcgtgggacccacggcgccggccggcgtaagccgcgtgcacccggtccaccgtggaccgtgaggctgccgcgtgggccccactcccgtggacccggtccgcgcgcccctcccctcggctgacgcaataaatccgattttaaattaaaatttaaatggagaaattcgcaaatatccatctaaagagcatataaacttcaaatggccataacttggccatttgaactcggaattggaccgttcaagtctctaatttttccttaagaagccaagaaccaatttttgtgctttgtttctgcttgttatatggagtttattagagttaaagccttttcttttccgttggtatcttcggggatgaaaagagaaagataattgtcacgaccggaaataacccaacgggcgttccttacgtgcgtgcattaatccttgtcccaggaggcaaggtacaccaacagttgatacaaatcagagtttaacaagcggaagcgtaaatatatttattacacgggcagcgaaggcccagcacacaaagacaaacgggaaacaacggaagactagggcgacgaccacaggcgcttgacggcaggcacgagctagacaccaaagccttcatctccaaggagctcctcttctggacttgggaaaaattgagcaagactgagtacaaccaccgtactcaacaagacacacccacaaatgcagaataaatgcaagggagtacaagggaatttataataagggttagcgttgcagtaaacagcatttaaagacgtttagttgctcaaagctattttgtaaacacgatcctagaactatacaatgttattaatcaaggccgtgaacccacacgaacctgccttaacccaaggcctatgatgattcagaccgaactggcaacccgaccctgggtcccagctcgtcccaagccaacccaggccaaccattccacattttagttgttaagcaagttttaagaattaaaacactaacttgggtacattgctcggcttgcccataaccgagggcgcggctattcgaatagattatactctgatcagaggtgtacatctttacccacaagacacatcttcctcacgtgcaaccacgtgccacataccacca

SEQ ID NO: 13360 - DNA, 1501 bp, Oryza sativa
gaacggtaagcgcggaaaacggagcgatctattaacacgtggttaattaagtattagctattttttaaaaaaaataaattaatttaatttttttaagcaactttcgtatagaaacttttttaaaaaaaacacaccgtttagcagtttaaaaagcgtgcgcgcagaaaaggagggaggggatgggaaaaggtgcatgcgaacacagcctcgctagcaaagcaaggccgcataccgtatatagtttccaagctaaaaatggtatcggcatgttcaattcactggaaccacttaattacctctttttctcaagatactaatgtattatatactcactctgttttaataaagtgtattaaaaaatataaaagttaaaacaatataatttgagatggtcaaatcactaattttgacttcttgactttataatataccttaaaaaagtgagagagcactatattagtcatatgtagatatgtagtgtaggtcatcgacaatgcacaaatataaacacactgatttaatttttgcattggtttcctccataaatctcaactcgatgtttacttcttttttttttcgttcatgtagatggtctatagagttgcatgcactcattaactattattagattttcctagctaaaaaaatcatgaatccaccattgatcaaagtgacccgttgttgtctcatcacccctatccactagagagagtcggtactacttcccttctaaattgtgcctcctcctgaaccaatctgcaccaagttttcaactttttttctttaaacttttaacttttccatcacatcgaactttcctacacacacaaacttccaatttttccgtcacatcgttccaattttatcaaactttcaatttttgtatggaatctctaaattttatttgggatctcggtgaaggttaaagatccaatttgaaatcccacaaattgttgaatgcatggtaccacattgtaatactctgccctttaaaatccaaattggtatgctctcacctaaagctgaccgacataccacctcactagacacttatacagttttaatcttacactgtataattgggttaacccttttattccggcaaacctttagggcttagggttggaatctctaaagtggccaaatataaccctgctcttatgctaaaatttcgtaaattggtgaatataacactacctctaaaatatacattagtacactctcacgtagagtggatctacgtatgcacgatacctacttaattataatttcgtcttcacttttgagtaaaggattaactcagatataagagttgtatcgtcaaactaaccacattcatccgtctatattttcagaatgaaactaaaccacctattactctacctctagatcacacgaacctcaccaatccctattagcctacaggtgataaacgggttgcggtgttacacacgtgtcacatttcacggttacaagatactccctccatcccataataata

SEQ ID NO: 13361 - DNA, 1501 bp, Oryza sativa
taacattaagttacacacttggcatcatcaacattaaccatcaaagctaacaagaggccatcttcggttctcaggtgagttctcccaaaccacagatgcaaattacacgaaacttggcagaaatgatggtatacgagtcccttccaagctatccaaaaaaacagtccaaccggacactgtttgacccctcaaactgacattctaccaattgttgcgcaagctgtaactgcagtaactcgagctgacaaaccaccactcaaatccggtgctatattcaacccatccttatacaaatcgaccagattgaagtgctcaaagtgagaaacaaacttaccaagtttagtgccaatccaaccacgttcgagcctctaatcgctaacttgatgaagatagggtaagagctcccaagctgaacaaactgcacatcttctcccctctcctttccctctcttgtgttttgctagtttcttcttcaccccaatcgccgctactatctctcccccaatggaaggtagggtttttctttccatcataaagagatgagacaatttccatcattgatcaaggcataaatcaatggctcatatttgttagacttttgggttgcaatgggctgaaagcaaagactccatgtggagggaattttgcccgaacaagaggtgactgtgataatcatattggtctcaccgagcaacgcggcctaccaatgctttagtgtacttactgtcagcgccaacaagaatctagagatagtggtcttgtttactttataggagctttcaaccaaaccaatatttgataatattaaatttaggtacattttgatattatcaaatttaagtagtgttgaatatatttgattcgaaatcttatcaaaattttgtatagttctgaagagcgaaaacttttagaattagcaaaatttaacagaatagcattggtaagaacatgttcagttttttccccccatcaaaatttggtaggatcgaacacgctcgacggctcgagaatcaagacgatggtgacgagcaactggaaggcgttcgcagggttgtggttgttgtacgttgttgttgacggcgatggttatggcgagaggcttcgagggcgttctatagtaaaacagtgaaaccatgcggcgcacgagccactcgcactcgcactcgcactcgcaccaccaaacgtcgcggccgcgccgaaacgtgcatcgctctcctcaacccgacgggacgtgtcacacactcacaccgcgccaccacagaccacaccacgtaccgatcgatcgcacatcaccgtccgtttcgctcaactccacaaaaacccaaaaaatatttcgcccaaattctcccacgtactagggccaccaccccgcacgcgcgcgccgccgcctccgcctccgcctccgcctcgatcccatcgcgcgctatggactccggcggcggcggcggcggcggggcgctgaggccgtcggcgctggacctggtggcggcgctgctcacgg

SEQ ID NO: 13362 - DNA, 1501 bp, Oryza sativa
gggataagaaaaaactctctccgttagaccatgtgacttatgagataataaaaaacagcttctaatagcatgggaccataagaacaatgagcaaattttgtatctatcaagttaggccatatgacttgggaggtgttgagaattgaagtgtcttctcgcatagcgtttgcactaagagcaaggcttacaagcaagcgagattagccactacacattgtttcaatctgacgtgggagagaaaaagcagatgtgagagaaggatgccggcacttccacagttgcccactcggcacaagaacttggaccatcaagagaaaggaggtataggcagtgtttagttcgtgtgtcaaaattcttttaagtatacggacacgtatttgaagtattaaatgtagactaataataaaagaaattatagattccgtctgtaaactgcgaaacgaatctattaaacctaattaatacatcattagcaaatgtttactgtagcaccacattgtcaaatcatgacgtaattagactcaaaagattcgtctcgctatttacatgcaaaatgtgtaattgttttttttcgtccatatttaatgctccatgtatgtgtctaaatatttgatgtgatggaaaagttgaaaatttgaagaaaaacttttgaatctaaacacggccatagtgcaaatgagttgcatcaatgtcccgatagtggcaacactcttagctcttctctatatcatgcaaagaaatatataattgtaattttgagataagagattgggggattatgaattgaacttccattgagttgggtctcaatggcttatatattgtgtgcataagagatgaaatacctcaaaactgttatgttttttatggacctgctcctaacttggcacgtgctcttttgcatgctgagttgtggtgtttagccgaggctcgtggactatttcttttttattgcacaagagctgggtggtttgtgccgtggtcatttttttttctttagtgtgtttgggattgcgtttgcggatacgcatggttcctagaattcaatgtgcgtgtttggttttgtacctgtggttctatcccatctttcttcttcttaatataatactcccttcgtttctaaatattatgtttaaccgtttatcttattaaaaaacttttataaaatatgtaaaactatacgtatacataaaagtatatttaacaatgaatcaaatgataaaaaaataattaataattacttaaatttaaattttttaataagatgaacggtcaaacatattttaaaaaaaattaacggcgtcaaatatttagaaacagagggagtaatactcagatctcctgcaccttacagaaaaaaaatatctctagtgcccctagatacatatacatttaaaaataattagatcatagatcatcacttcactgtcttggtaagttaatttggataatcggtaggatatgtccattggaattatcgttgtcacgtgatgttttagta

SEQ ID NO: 13363 - DNA, 1501 bp, Oryza sativa
  unsure (1)..(1501): unsure at all n locations
cgacccccactccacccaagccgacgcctcccacctacaagccacagcccaagccgacgcctgcgccttacactcccactcccacaccgncaacatacaagccgcagcccaagccgaccccgccacccacgtacaagccgcagcctaagccgactcccactccctacactccacccacgtacaagccacaaccgaagccgactcccactcccactccctacactcccacgcccaagccgaacccgccgccaacctacaagccacagcccaagccgactcccacgccgacgccgtacaagccgcagcccaagccgactccttctccctacacccccaagccaactccgacgccgccgacctacacaccgacgccaacgccgccgtaccacaagccgccgccgtcctacacccccggcccgccgccgccctactagttgtgttccgccactctccgtcacgttccgaccaaaggtatagtacgcccaacacttcagacgctcacggttcagtttgcacatttacttattttcggaaagatttttgagtccgaacaaatttaaatataactaatatttttacaataaaaatttcagcatagattcacttatcaacataaaattttatattgcttattaattaacctgcatgcatggacgaacggatatcttgaataagtctcttaaaagcgggtgcttaatggcgtactctgtttgttttctgtctttgcaggaggtgaccgaccgaccagagttgtgcgagaggccaaagaggctcttccttccgtgaagattgctgtgcatgccgagctgcgctgcctttaattacctatagctaattaattagctagggccaatgttgcgaggagaataatgcatgcttgagtgccaatgttgctagctcgctccctctctagatgtgatgtgtatcatgtgttgtgtgttgctcgaatttgtactgtctagcgtacgtcgatcccgtggtgatttgtggagtatggtattgttgtgttacggtataaccaaaaataacagcggaaatggaagtaaaagctgttttcgatcgtcccagcatttcttctttcctctattcctgttctttcgcaccgtgcaaccacgagaaattgatgattgcatgcatgtcagagaagactctaaactttactagtacaaattgtactgataattaaactccacacagtgacatatagagatttcacttgaaataaatagtacttcctccgttttcgtataacacccgtttcaaagatatttgatactgtttgatcattcgtcttattcaaaaaatttaagtaattatttattcttttcatatcatttgatttattgttaaatatatttttatatacacatagttttatatattttataaatatttttaataagacgaacggtcgtgctgctactgcgtcaaatattttaaaacggagggagtactcccccagaacgagccacaagggtacgactatcacaattggtgacgc

SEQ ID NO: 13364 - DNA, 970 bp, Oryza sativa
aatgcatgtatgttacattggatatacggatatcaaacgtagtctaataacaaaacaaattacagattccatccgaaaattgagacacgaatttattaagcttaattaatccatcattagcaaatgtttactgtagcaccacattgtcaaatcatagcgcaatttgggccctgttcttttctccaataaaaattggataaacttttagataaaagtggctcgcatttcaaactgataaactatgcatttcgtgcgaaaactttacatgagagttgttctaaaatataagattaatcattttttaagtttgttgtaattaaaactcaatgaatcacatgttattaccacctcattttgcgtaaaacacttaatctttacttcatcgtcatcttcaagagtttcaaacaccacctaggcttaaaagattcgtctcacaattttctggtgaactgtgtaatttttttttacatttaatactctatgcatgtatccgaatatttaatgtgacggcgtgaaaaattttgtttgggagctaaacaagccctaactatgcgggttgtatgcgtatcgactagcatattggggtgcctttgtaaatatttttttatttagagggagcatgcaataatagaaggggttccaatataaattgtcagtcctgatccgggtattgggcggttgcctttttcccttcacgagtaaatttctccgcgtggtgagtcgctaacaattctctggctccgtccttcgactccctttctacatataagggcattcacaatgtgaaaataagagagggtattatgctcataggtctacttatatattgtggaggtggttcttatagctatccttttcttgaggtagcattatgcataagaaccacccataagaaccacccataaggaataaacaatccgatcttatttgctctagctttgtctctctccaaagtagttggttaccgcca

SEQ ID NO: 13365 - DNA, 837 bp, Oryza sativa
ccctacaggcaaacattgcaaacaggctataagactactgaaacaggggacaaaaccatttttaatggattctacacatttttcttgatttactgagacttgaatgggcttaaacggagctcggatgaattagttatgaattttagaagattcactgtgtttattactatacaagaaaaaccttaaatcatttattgcgcaatatattccagggctgacgtcatcaaggcggggcgcagcgccgacatgcgggccccaccggtcagcggctcgggagagggaggaaggggcgccggcaagcgggccccaccggtcagcggctcggggagggcggtccacggcggatcgggtccacggaccggggaggagcggcgcaccacgcggcgggggctcgcggccggtgcgcgcgggcacggcgcaaaccggcccggcgaccatggcgcgcgacggcgcggcgcacatgcggcagcggcgcacatgcggcagcggcgcaagacggcggccgacggcgaccgaccggcggcggagagcggcggctagaggtgaagcggcagctacgcggctaagcggcggcgcgacggctaaacggtgcgggagagagagaaagaggaggagaggcctcaccgataacggtcgacgacggcaggcgacggaggacgatggtgacggcgggacgagctccggaacctcctaacgaacaaaaggagaggggttagatggagagaggagagtgcgagagagcgagggcgccggccgaaggcggcggccatggcgtcactcaccagcgcacgacggggatggggctccggcggcgaatctctacggaggaggggtgga

SEQ ID NO: 13366 - DNA, 1501 bp, Oryza sativa
tgtaatttacaacggagagagtagaaccgtgacaatgctacacgattaacacttccataggcttattagcatgtgaatgctacgctatcgattaattgcggcatattaggggctcagcctccaccttctctctttacaggagagcagcgtttcaacagtagtttttccttttactttagcagttctttgtttttccttttttttcttgcctcaaggaaatggccgtccgatcgattgcattttgtaacttaaaattttagatctgctttcttctaatatactccctcctttcctaaatgtttgacgccgttgacttttttaaatatgtttgaccgttcgtcttattcaaaaacttttgtgaaatatgtaaaattatatgtatacataaaagtatatttaacaatgaatcaaatggtaggaaaaaaattaataattgcttaaattttttaataagatgaacggtcaaacatgtttaaaaaaatcaacgacgtcaaccatttagggacggagggagtattattatgcaatcgtttgcgcgttagtgaaagaaataattgcggcctatcaccctatagtttggtggacgctagaaactcatttctagcggacatgttgtaatcaaaagacacagctagcgatgaaccgagatgacagtagacagcgtcattatcgcgcggcagtgcatgttcctggccattgatcagtccgagcccaccgctgatcacccgctaattaaactcttttcagacatcgccccccgtcggcccatgcagccttgccggccggccggccggccgccgccccccggccccggcgcccatgtcgccgccacggctgtcgtcatcgcgtcgccgtcgccgtcaccgtcgctgcctcagataattcattcattcatttggtcatgaatacttaattgttccttccgtttcatattataaaccacttaatttttttcatttatttggttatgaataattatttcctccatttcatattacgagtcattttattttttttcaaagtttgtttaagtttatagaaaaatataacagagttttcaacacaaaacaaatatattgtcaatatacatttagtgctatatttaataaaactaatttgatgttgtagttgttgttaaatatttttataaacttgatcaaatataaataaaggttggtttggaaaaacgtcaaaacgaaacgggggaagtatctacgatgaaagacaattaatcatttggttattatgatggggttttgtttgatcgattgatacacgttggttggatgggatgattagttgatttggctctgtgccttgctggagatcgacaggtcaggccgggaaataattttgattcttggagatgattttgatcgatcgatgtgacgcggggtttgtgtttggtttgcagctgattgtgattgagaaggttgattagatagccgtggggcttacgcgttttaatcaggctgtacctcgagatgggttgatcaatgga

SEQ ID NO: 13367 - DNA, 1501 bp, Oryza sativa
ctagttgtgctccttttgccgacggagagagagagagagttatagaaggagaggttgacgatttcgtcgtctcgttctcatcgtctccggcgacgtggcagcgatttagcgaggcgacgaggctgctcttcggcgagccgactcggcgtctgctgttgttgcggaggtgtcgcgccgtcgattgcgcaagattattccagtggctttcctttttgtttttttttccttttttgttcatttccatctcctatttagcatgctacatgttgtgtttcgttgattctgtagtactagtcgttctagttttcgtagatctgagcaccttttgtttcggtgtttgtttcattgaatccccatgattcgtgttcgattttgcttttgtgatttttttttaggtttctatgatatatttgttcataaatttgtgctatgcgatgttctagaaagtttcgtttatgtgatgtgtgatgtgtgatctgtgatatgtgatatgtgatttacgaattgtgctctgtgatctgtgatgtgtaaagttagatctagtttttcccatgggaatttgagttgattctatagttgctcccttgttctccggatgttaggttgtgatttgttgaatctgcgagttgctattttagtagatgcgtgtgatttgttttgaatgatgtttatgaagaagtttgctcatgtttggatttataaaagtttgtgttgcattattttgtatctctaactatttgtactttatttgtagtcttcaactatttgtttagcttgctagctgatgaattattgttagctgttgatctgatagtgaattattgctatgatttatgtattgattatgtttctattttccctgtgtgctatgcaatgttctatttttgatttcattttttccattgcttctgatatgtgcatccttataataactccttgtgctttttttttctctctccctttgttttaattattagatgggtcatcaaaagaactgttgtatagattcagaaactttgcatcatgatgatgtgtgtgatttagttgtgtgttgtattactattgctacataagtactatatccacgttgtattttgttttctagttctttgtgtgtactcaaatgtaagctagaaatatgaagcctgagatattgatctgaagtgtagatcaatataggttttaacttatatagatcattcgattcctatatagacagccccttaatttaatttctgttaagttagggcaggcaggcaggttaattgattttgttacgctagtttattgagaactttatgatctatgcaaatttgttagccttgtgggatttggatgtctttttgtggttgttcataatgtttgtattagactggattacactctagtgcaaaccccatttttgttattggactcgggtttatgtacttaggtctaacatgtcttcccctttggggatttagacgccatttgtgtcggttctactgctaatgtttgtagt

SEQ ID NO: 13368 - DNA, 1501 bp, Oryza sativa
aaatccccaaaggggaagacatgttagacctaagtacataaacccgagtccaataacaaaaatggggtttgcactagagtgtaatccagtctaatacaaacattatgaacaaccacaaaaagacatccaaatcccacaaggctaacaaatttgcatagatcataaagttctcaataaactagcgtaacaaaatcaattaacctgcctgcctgccctaacttaacagaaattaaattaaggggctgtctatataggaatcgaatgatctatataagttaaaacctatattgatctacacttcagatcaatatctcaggcttcatatttctagcttacatttgagtacacacaaagaactagaaaacaaaatacaacgtggatatagtacttatgtagcaatagtaatacaacacacaactaaatcacacacatcatcatgatgcaaagtttctgaatctatacaacagttcttttgatgacccatctaataattaaaacaaagggagagagaaaaaaaaagcacaaggagttattataaggatgcacatatcagaagcaatggaaaaaatgaaatcaaaaatagaacattgcatagcacacagggaaaatagaaacataatcaatacataaatcatagcaataattcactatcagatcaacagctaacaataattcatcagctagcaagctaaacaaatagttgaagactacaaataaagtacaaatagttagagatacaaaataatgcaacacaaacttttataaatccaaacatgagcaaacttcttcataaacatcattcaaaacaaatcacacgcatctactaaaatagcaactcgcagattcaacaaatcacaacctaacatccggagaacaagggagcaactatagaatcaactcaaattcccatgggaaaaactagatctaactttacacatcacagatcacagagcacaattcgtaaatcacatatcacatatcacagatcacacatcacacatcacataaacgaaactttctagaacatcgcatagcacaaatttatgaacaaatatatcatagaaacctaaaaaaaaatcacaaaagcaaaatcgaacacgaatcatggggattcaatgaaacaaacaccgaaacaaaaggtgctcagatctacgaaaactagaacgactagtactacagaatcaacgaaacacaacatgtagcatgctaaataggagatggaaatgaacaaaaaaggaaaaaaaaacaaaaaggaaagccactggaataatcttgcgcaatcgacggcgcgacacctccgcaacaacagcagacgccgagtcggctcgccgaagagcagcctcgtcgcctcgctaaatcgctgccacgtcgccggagacgatgagaacgagacgacgaaatcgtcaacctctccttctataactctctctctctctccgtcggcaaaaggagcacaactagcggagcaaaacaacaacgaatcgagcagcaagctaacaaa

SEQ ID NO: 13369 - DNA, 1501 bp, Oryza sativa
ttgtttaagacacatgcactgtgaagtgtggttctttatccggttctttgtctagctggaggctttgagctcctcatgtgtgttacccgcactgctactggccttataccgaattcagggcgtgttctcgagcgttagcgacgccacgtggctcagcccgattgcaaggttcgctccctcgctcgcagccgtcggatcgcgtatccatggtcagaaatcgatgcggtggagctaattgtaatataggaagtttaagggggctttttccaaaacggtgaatacctcttcgcctgttcggtcttgcgcttgtttccgtctaaggacagaggaactccctcttccttctcctcggtcgcgttgtcgccacttacctccaccaattccgccctgatcccctccgaacgtgctcatccgcgggctctcgacgaacacctccggccgcgacccagtcggactcggaggaggccgccagatttttctactccctccccctccgtgccgtctctctacccctctgcctccatttgccgcggccttgggacggaccaccatcgccgtgcggacggacgaccggagcacggcgtatacgacatcgtgtgcggcagcgggcccctcgacgagcctgcgcgcgtcggatttaagtatgtctttttgttgttctgaagaaattgtgtgtatcatttcttcaggtgccctgttgcaattgaagtatggaggatagtttgctacgctttcaacattagctcgctaagtgtgcataaacctgtcagtaatctggctacattattttcaaatagcactaattgttgttgtcagcgtatcgatttgctgccttgtgtttacacctaaatttgacacctatggacgaaatagggaaaaattgccaaagtttggaaagtgccgggtttccttcacaagggccggttagaccacatctatgtggacggtctgaccggctagtagggtcggtctgaccgcaggtatgtgggcggttagaccgtcagggtccgagtccgagtctgttttcgtcgggtctcgggtttccttgctcgggaaggcatgtttcgtgtttccattggtttctatcccgagttggacgtggagaagggcctgtagagagcaagaccaacccctatttaagggacaaggccggttcattgtaaaaccccctaatacaatctacttgaatcgttcttttactgtgttttctattttaccctagtttagtccatctttgtcggtttgcgccgtaaaccgtccgccaccgctgcgagagtgcgacacctctttgtaggtttgtcctgaaaaccttccgttttgcccacgagacgggtagttatcctcatatcgatctaaatcggcctagaggctgattttgatctctaaatcggctccattagccggtttagctgtttttctacaaaacccatcttgatttggccgcttggctagattaaggtggttggcgaggcgtttaggtgttgcgatcgtgcttatcgac

SEQ ID NO: 13370 - DNA, 605 bp, Oryza sativa
atggagtgcgaaagatgtgttcttgggatcctttttctgattattcccttcccgccctgttcttcgtggaggggtgtgtgttcttgaattcagcaatgcgcgactgcgcgtgttcttaggttgtactatgatatatatcggttcttgaattcgcttgtggacgaattcgtcggattgttagtggagcactcacttctgcaccaaaaattgtgcagaagttactttttttttcttgtccatgatggagtctgttagactgcatcggaatggggtacttctggaatttgtttgtgattatatcgattctttgctcactagtaaaatgcaaccttttttgttttgttctaattttgcctgctgcttactgctgcaccaaaagcaaaaggaacggcctttgagtcctgacaagatgtgcttcccattgttgttgtttgtttcatacgcatggtgaaggtatacacttgtttgtgtgacattgtctgtttgttgcttttggatggttcttcatgatgttatcaatcttgtctgaacatccttctgcgatagctgggtggttttgcaaaacagaagtatatatatgttcttttttttcactctatttgtat

SEQ ID NO: 13371 - DNA, 699 bp, Oryza sativa
  unsure (1)..(699): unsure at all n locations
tcggctttgatnactgatatacncatcgctcgcaacnnnccaaganntatnctgtgcaactagaaccatataataatatatcaatatatacggttcttatgaaattcactttattttacctacagcaacaacgcttaaaacgggtgctgtatcatttaaggattctagttgcattcgagttttcttcagccgattgaactcatgggcttaacggcaacgatctgtaggccttgcaatgcacaagcatattgtaggcccatattttcaaagcacaagcatattctaggcccatataggcccaggacatttttaacgaataattgtatttggaataagttcgtctgaggtctcttaacttgtcaacgaatccgattttcgtccctcaaccggaaaaccagacacaacggatccctcaactatcaaaaccagtgcaaatgaggtccctcggcggttttgagggtggttttggctgacatgatgcctacgtggctaatttgactcggtcttcatctgacgtggtgcttacgtggcaattcgacccgagaaaataataaacccgtgggatccacatgtcagttcacacataagataataaaaaaaatggcgggccccacatgtaattgtcattgtcaccccctctttattctgcttttcctttaatctcctatttttaattttcttccctatcccttttccagc

SEQ ID NO: 13372 - DNA, 1501 bp, Oryza sativa
cgactatatcttctcaagtcatattcatattatacaccgacaaatatatggcctacttataggtagaggatttcgctaacgtggtaaaaccgacatgtttaagatcgttaatatgctaaataagtggttttgggtagttcaaagtaaaataaacgtaaatttagctagtccaaagtaaaaagattggactagagtgatctaaagtgaaactacgacaacaaaaggtggttaaaagtgcaattcgctcaaacttgtgagaagatgtgcgcataggttggttacctaatccaagaggatcgaaaccgaagtctcccgggaggctgccgtcgagccacggaggaggggagctgccggggaaccagagcggcctgtcgggccccagcggctcgcacaccgcggacacgccgcccttcgtcgcgccggcgcggtggccggccatccttgcaacggcggcgttctgcgacggcagcgtcggcgcgcgcaacgccgcccgcaccctaagctcagaagaacacaagaatgacattttcgcaacacacggaatcgaattgagatgcttcaatggcacaacacaaaaaatgagggaaaatgagggagaaagggaagaagaagacgatgaaatagatgggtgttgctgaattattatgattattattaccttggttggatgctacatgccgcgaatgagccggagggcagagccatggaggagagtgaggagaacagggagagggcgagtgaagctggtgaagtgtgaaggagggaaaagtgcagagcagtttatctgcttggagtttaggatagggagggagagggcgtggcgttcatcgacagggagccaatgaggccttgccaggtgtgaccagcatctatcatacaagttggggtcctgacttttgtgggcatgtaatttggaggcccgtgatacaaatctgtttagagtttggcccgtttaagattacaagaatcttgaaaagctggaaaatccaacttatgactaagatagcccactactagctccaattcatctatagccgatctaatagctaattcatacaatagttgcttattatactattaacatatggtcccacctgtcatacacacattgcatccgtactgcagctggatacagatatgtagcccgctgctcttctctctcatcttttatttcattaaaatatgtttatagctggctaatagtatgctattgcacatgctctaacaattcttaaaatataggtgacaacccggactatttgaggagctcaagattttagaagttatggttgtgaaaagctcccccaagcaaggcctctatatgataatgatggcttccgagtattataggcctataatttagggtcttagtattgagcatatgaaataattgaagcaattttgtagcttcggcaagctaaacttcatgagatgatttaacttcatgagaagtaacgaaaaggaggaacttattgaagtatacaaaacaactttacggatg

SEQ ID NO: 13373 - DNA, 1501 bp, Oryza sativa
ataaatatacgtgtaatgtgttaagtttgctgcattaattccagacaatgaaacacatatgctactcgaaggaaacatgactgattaacggtacgtatgggggagccaacaggtatgcacaaatattctatattgatttgtcctttttcgtttagtttggcacatatatattactgtctctagcactcgtttatttatggattaccttaaattttctcacctccatcacattcaaattaatgaatttctgtgctagatggccaaaacaaattctgcgtacatgtggtatgcaattttatgagttttacttactgcatctatatatgcaggtttttcttcgtatttaacttactttcataaaaaaaataacaatcttgaattggtgaaacggccgaatgatttcatgtgctgccacactaatatatcagttgtcatttgaataacaaattctgaatgtttcaccctatgcatgatacatgcaattaattaaccaagaaaattttcagggagctgcagtatagacatccaacgtctcgccgccgatctcgagacaaagctatgcaatgtggatttggacggcggccggcgatggcgccgctcgccggagtgcctcatttccaaggtgaagccgcaggtccgccgcgtcgacgactcgcagtacaccccgcaggtggtgctcgtcggcgcctaccaccacaaaccgctggacagcacggaccagctggcgaagtggacggcactccgccgtgtcctccccgacgacggcgagcagcgggcgtccacgctgaggcggtgcctggaggcaatcgccggcgttgaggacgaagcgaggagctactacgaagacggcgccaagacatggagggagaatcagatgttcgtgcagatgctgttgctcgacgcgtggttcgtcctcgacatcttcaacgtcggcggcgaggcggctgcggcggtgggtagccgcggcgggagcgcggtggactacatcttcgccgtgcgcgacgtgttctacctgctcgagaaccagatacccttcttcatcctcgagaaggtctacgagctggtgcgtgtcggaaattccggccaggatcaagatcaacgcacgcaaacgtgtacttctcctccgcctcctcagcctccgggagctacagccatcgccggcggcggcccgtcgtcctcctccaccgttgttgtggatggattcttgcgccatctccggtcgctgctccaggaccagggctactcgaatgtggaggtggacatcaccagcacacgcccctgtcacctcgtccacttactccacatgcacttcacacccatggcgatgtcgccggccgacgacaccgacgacgctgccgctgtccccaacaggcgcgcgcgcgccaccgtttaccggtggcgcggggcgacgcagtaccacgccgccggcgtgaggttcaagaaacgggccctcggcgccgccgccggcgacgcgcggtgcgtcctcgacgtggagctccgg

SEQ ID NO: 13374 - DNA, 1073 bp, Oryza sativa
gttcgtcttattgaaaaacttttgtgaaatatgtaaaactatatgtatacatataagtatatttaacaatgaatcaaatgataggaaaagaattaataattacttaaattttttaaataagacaaacggtcaaacatattaaaaaaagtcaacggtgttaaatatttagaaattgagggagtatatttaagtgaaatcccaagctgctaagttgtcattcttatatatttaattgaaatcccactcctatgtactcttatatagcaaaaccgttttactgtagacttgttcgatggtcgcaaaatgcattgacagtgatatgctatcaaccataaactctggacagaaagttaattagggttgatcaaagaatagtttgtcaggttttgctgctatcatgcttcttcagcaagctctcccttggtctgttcaatggtatacgcaaccaacttcgtatgtgtcagaaaagatgcaaagcaaaatgctcaattcagtagattgtcgacaagatttttgacgacatcgagcaatggagcagctgcgggcaaatgtgctggtgcatttctctcagagagctagataaacgttggaggcggcggaggcgagtgcgtcgggaggcggcagacgagggcgagggtggcggagcaggcgaggtcggctgaggcggcggaagggaggagtcgcgagggaggttctctcggcatgggctccagatgcaggcgtcagttccagaacgaaagaagatagggtagctattgttataaagtgaaagtgacgattatatccctccgtaaataattttatatagataaaagtactctccacaattctactaccactaagtgaggtggtaataaaaatagatctgaacccttcgatcaaataagatcaacagttcagattttttttctactacaagtagaaagcatcggagtgaggctttagtaagtatatactgtattaatttgactggcctgtgaataccaatgttatatgtagtgtgcatgaacacctgaagttattatttccttttttttatgctcctttaacatcattcttttttttcctgaaga

SEQ ID NO: 13375 - DNA, 1501 bp, Oryza sativa; identical to SEQ ID NO: 13129

SEQ ID NO: 13376 - DNA, 1501 bp, Oryza sativa
ttcgagtggttgacgggcacatctcagattgaagttgactagcaggctaagggcccagcaatgtctccaatattcctctctcgaggcgtcggatgtttcattatgcttgtttgatgacttgaattattcacttcatctctcaaatataataattttgggatttacatatgtaatttttgggacttgtattgtacataaactaattgcataatatgtaatttatgtacttacaatgtaaatacatgctaactattttttagtgaaaaatatagcgccataaatatagcttcgcaatatgcaaagtgaggatcataatcctatggcacgaacaaacattattataaaaaaaatcacattattatggcatgaaactgtttcgcccgtgatttatcttttctttcctttttttctgaatttggtttagaattattcaaatttgtttaaacttaaaaaattcgctacaccctatatatgtggcaaacgaaattgaaaaccattcgtgttttaaagtaaatttcatagaaatactagtgatttgtaaatttttaaaccataatatttagagtcatatggtaacagccagagggatacctcaactcaatcacgtctctccgtgaggagtgactacaatcacgttagcctagggatggggccaacccgcaaatttgtttataggtcaataagtaataatcagtagattccagaataattaactatttgccactcttacgagtggtgataaattatttatcactggacccatatgtcatagacaaatgagagcccatatgtcatagacaatgagtggcaaataattaattaccacatcttaaaagtggcattgagttaaatgttccgcggattcccgcattgtggtccggcttaccgcatctagtaatgcaagtggatcgatatataaatccacttacacggtaaattaatagacaatccgtaggttccctgctaattttatctataatctactccctccgtcccaaaataaatacagttttagcacggttcatgttcaatgtttgaccgtttgttttatttgaaaaaaagattatgattagtatttttattgttattagatgataaaacatgaatagtattttatgtgtgactaattttttttaatatttttcataagtttttcaagacggatggtccaagcgctaaacacggatatctatagctgtacttattttgggacggaggcagtagttggctggtatttgtcctcgcctgcgtcgaacagaggaatgtgagaccgacgacaactcagacgagggagcaaacagaggcagggcggctcacgcgagcgacacgatgagtacgtgtacgtcgcaaacaaaccgcctcgtaatgtattcctagacaagcacacgtccaaatacaccgcgcgaaaccccgtacggtacgatacacgtacgccctccatcgcgcgcgatccgccgcggcgtcaccaagccatatccgccgccgccgatctccatgggcg

SEQ ID NO: 13377 - DNA, 1501 bp, Oryza sativa
aaagtatctgaagcatcaggttttgtgatgcatcttgctggtttcatgatcacaattggagactggaaattttcagaatcaactatttgttcagaggccttcttttgaatggctgttaattcaggattgttgtcgctctggcttgggccatcctttttgtgcagtgtgctcaatatcctgagagccctcagttccttgttgcattccgacaactctagacccctgagtcttctctgtatgtcagcatagatggatgcagttcttggcttcacttcagctgcacgtcctgttacagctctctcattctgtctccatggggctgcttcagggataattcttggagaaggattggttttcagtactggagagtgattcttctgcaccgggacactatgatcttggttcttgatcctttgacagtgtgacggctgatcaatttgcgtgccatggacaggtgtaggtgaccttgccgtctcatggatgtcaggagtagttccttccaaccccatgagcttggcaacgacgctgctggcccgctgatggctcggcgattcttggtgcttcagaacatccaggaggttgtcatcagttcttatgtagccagagttcttcagacgtgaacatggattcatggattcttttctgctgtccaaggacagcctgggaagctccttgagctttgctgaaggcttcttgctgtcttgcgcttcgaccgacctcaggagttgccgatcgtcgcatgagaagcgtggtggcctgctggattcatgaacatatccaggaacgccggtgctcctgtcgatcccaatcacgtaagttccatcggttgatttggagatcagcaacggccttggtgagtctttgtgcaatccttttctggactcctttgtcgacgtcttgatggtcataccatgggtttcccggttgatggactccttgacaatgtctctaaagccagtgtgtgggtctttggttttggcctctgtcttggaacatttcacactctttgtctgtgagcttcttggtggcttcccagcaaaacgctctttgttgatgtaggagagctcttgttgtattggtctgttgatgtctgtggacgagaacgaagagcacgatgaggaagaagaagatgcccgcgatgattccatggagaggctactgttctcggtcatacttttgctgaaggttttgtcctacacaagtaagtattatgttttgagtcaaaaaccagtctgtttgaggcagatgaactgcatacttgggatatatatttgtcatgcacagtacagtaggaaaattaccagagtgttgtttgaagcaactgggttttgaatcgagacattgctgttgctgtttggcaaaacatggcctaaagaaagtattcaggaaacagttattaatatgaactgtatttgggtataaaccaaaagaaagttaccgcagttaaattataaatatctaatttgatcgagggaaggaaaagatcaatatcataaagata

SEQ ID NO: 13378 - DNA, 1501 bp, Oryza sativa
acataaacaaagcagcaaaaaagatcgcatctaaacagttctagcacaggataccaaatccatgacaattatagaatagaagaacaatagcccaaacaattaaccaaataggaatgaaggattgttcacccaagaaatatgagatccatcatttcagtcgctgtggatttgtactagccactataaagctttttcatgagaaaaagatactagtacatatccacagtaatcagttaaagctaaagttgtttggcatggaatatttaatttgaacaagccaaacagaaattcaggatgctctccctgtagaaccttaaagataattgatcacctcaaataatctccctgaatagaaaataaaaggattgcattacaagaagtcccacaagagtcccatcttcactcttcagtcagcacatcttgcacagaacagaacagcccaaagcaaggtttgataaaagatgcatacctcatatttgttgttagctaatcttcaacagaggaacctccataagacattcaggacagaaatgtagcaaacgggcaggcatgcataatcctgaaatagtgaaatagcaaaggcaatatatgtggagtttcagtactatttccacttgagttagatttctttgaattagtaccagacgaagctaaaacaaagtttactacaattttcaaagttctaatctcttctaacaacctctgttttgtttcgaatgcaaacatcatgaactccaaatgctcagtccacaaacggtccaaagtacaaaagtagtgccagtccataaatctaaaactaacataatccaacgagcagtaccaaactccaaaatagatgctcaagaaataaaattccagtaacaagcagagggatttgatgatttgctagacaatgaaaaatagcaatagcatgaagattaattccacaaaactagacataagcatcactagttcaccttcaagcacaaggaaatcaaagagtattcctgatccatgagaaaaaaaaaaagttccccaaaaggagcccagtgaaattcgtcttgtggccagtgacattagctaattaaggtaatcagaaacaaaaataatagcaatcttccataataacgtctacatgagcacatcagcagttccaaactccaaacatgcatgctccagaatcaattccggtaacatgacgaggaatttgcaagacaatgcaaatagttactacaacacaaagattagttccccaaaattagacataaattaattaaaacaaacacaagttcagcacaaggcaaccaaagacaacataggagagatcacatattcacatgatacaaaagcattactagtgtatttcgaatccatgaaacagaagttcctcaaaagcagccccacctaattcttcttacagtcactaaatccccaacatccatttcccatcattgatgcactacagctagtagataaatagatcaaactaatattactactagcacaatagcaccaggtgcag

SEQ ID NO: 13379 - DNA, 405 bp, Oryza sativa
aaaagagagggaaaaagaaaaagaaaaagaaagaaaaaaaaagagaaaaggattttccctggaattaaaatatttcttgctcaattttaattggttaaaattatttctagggctctgaaaattccactaaaaatcctgttagtgaatttcgacatgtagaactcaagaaaaattccacatgccaattccgattattatttgcattgatttaaaagggtttactcttgctttgcaccggtattttcttagggtctcttataaattaaattttagacttgggaggagaacttcggggtgtgacaccggccggcgccgtgggtcccacgcgtcagccgcacctaagggcgcgggcggctgacggccgggccccacgcggcagccactcggcgcgcccgagggcggcca

SEQ ID NO: 13380 - DNA, 1182 bp, Oryza sativa
cacggttttctataaatttcgatcggttttcgataaattttgaccaaatctattatttaacctttgaaattctaatcgaaacttaattccgagccgtgtcgaaacgtcgaaatttcatagaattcgaccggttttcgtcggaattgtgaacctgcggaggaaagcgcggcgaaaaattaagtattttttaaataggttaggttagattagattggtaaggataaagataaagataaagataaagagaaaagaaagggacacagcacagggccggaatgcggtttatgggcttacatggtgggccgggcagcccaacccattccgccccacctgcactgaactgaccggatcgagttgttcatccgcaccgcaccgcaccgaagcttctccctccctcccggcctcccttgccgccgccgccgccgccgccccgcgcccatcgaccgacgccgacgctcctccggccagatccaaccccctagctacggcgctccctttctgtccgtttgatgggcggcggcagaggcatgtagctagctagggtttcaacaatgaagtccatccaagactatcttgctcgctccaactccaagtccaaggtccctcctcctctccgcccctacacattctgaattctcgcgcctccctgtattcattctagttcgatacagctagtagaaaattcatcagctttgctcaattgctcaataagattataagaaaatttatgtttctccttccttttagactaggcgtaatatacatatatgatcagtcccttaactcttgaaaccgggtaaaaacatgtacctccaacctgtttaacaggggttttacccaaactggagatgggacctgcttgatcatcgtttgtcgtgtgggcccaccatttatcctcaatgacaagtggacctcacctcctatgctgctcaaaaccatgtcaaacggggacaagatttatcctgttttgagagtgtgagctatgagttgtatctagtttttcaattaagggatgactagaaaaaatgcccgtgcgttgcaacgggaaaagactattttaatcttattattattatatgttttaagtcaggtgaaattcactgtagaaattcgcttgaatatatgtattttacaaaaatcatgagctgtagttaggagtccaaccgtgtaagttagcatgcg

SEQ ID NO: 13381 - DNA, 1501 bp, Oryza sativa
gacataagtatttttatatttatataaaaaaataaataagacgaatggtcaaacgttgattaaaaagtcaacggcgtcatatattaaaatacggagggagtatatattaaccagctttgcatccctaagcctaactaagcaacatggacatgtcattatccttctctcgtctctgtacggagagactaggtgattttgtcaaggtagtgatatagcgcctattgattgacgtataatatacccgacttgtaccgactattatcttgtacaattgccgccaatttgttcggagcctcaaatatgatgcctatatacccctccgtactcgtaaaggaagtcgtttaagaccatgcttaaatcaaaccttaggaatataaatcatgaataactctcaagttgttgagtttgaaaatgtaaaaattatatgaatggatctgtcttgaaaaatactttcataaaagtatgcatatatcactttgcaataaatatttttatagaaataagaagtcaaagttgtgttttggagaccgtatcgctgtccaaaacgacttcctttataagtacggagggagtatatggtaagttactgcaattattatgttccattaatatctctcatagtttgtttgatgttttatcagccacaactaaaatttaaaatttaaagttaatcttagttgttttgggtttttttatcgtaatctactttgcagcattggtttttttataccatgaacaatgcaaaaaaaattgtcattgcttattagccatagcttaaccaatcacaacctaagcgaggatagttttgtatgaatttttgtgttggctagattctagagattaggtacaaaattcactactataaaaagttatttttatgcggtcaaaatccattttttccgtgcggtttggtcacccatctacccaaaagtgtctgaaaaattactattttttccatgcggatgcttatattgtccgcacacgaaaataaaaatcacgaaaagaattccaaaaatcccatcgtcgtcgccgccttcactatcgctatcaccgaggccaccatcgcccttccgtccgccggatctgccaccgctgctgtcggtgacatgggaccgggagtatcatgactagaggcttgggcagccgcggtcacccacgtggcctgaccccctcgggggggtcgggcccgagggagacgtggccaccccctcctctgtctccccgaggggtcgggccgctcctgtttcggccccgagggctggggcaccccgaccccctgtggtattggcgccacgtgtgtgggttaggtgggcacagcggtgctcaccaaaccacatttattgcggaatggacaagtgcgccacgccgcatttaatgcagcacggcgtacgcatatccggtccgtgaccggtcgcagtgtgtgaccggtcacagactggtcagatcgcgggttaggtggcagcaggcggcctgtcacacgcctcgccccgtcccgtcggaa

SEQ ID NO: 13382 - DNA, 1483 bp, Oryza sativa
cctgaatgcgcgtaggtgcattttgtcatatgacggatgtgttttctcctcaaattacctgcatacacatatttcaccaacactagtggaaatgattagtaataatacctaccactaagttggataccatgttttatttcattatatgtaggtattgacggttagatattatgatttaaggaccgtcaacaacacccccacacttaacctttgctcgtctagagtgaaggctatggactctacaatagagttatgacttccttactaacaatcatgcaaacaaattattcaaagtcatacctgtacttgaggatctttgtagtgtctactatgcaatcttgaacaattgagaaatggaacaatcttgacttaagtcaccctaacttttcatgaagaacaacttggggttttttctcaagtaacacaaaattataacttcggtttgctcctcaatttattctcttgatcactcaaggtgtatgattccccacaaaggcatatgattgtgccttttcttttcctaccatctaataaggcttatgtggagctcagagtatggaaaagagaagagcattacttgcatcacatatattgcaaagtcaaataaaggatccatggaaatactagtcatactttctagtcaagaatgtgcatgtatatgtgtgtggtaaatttgtgagtggaaaaaggaaaataaaaataactcctttttgtatacctcctcctccatttattctcttttgaaatttgggagaatgcatggctatctcttttttttcttttctttctttcttttttttttcatcatcatgctccatacttgtatgagcatttttttctttctttttcatagccatgcctctctctctatctctctttttgaaagaactttggaggaagatgcataaatgacatggagtatttattttgtggactatggatgaaatgaatgacaaatgagcaatgctaacttccagtgtagaagtcaagcattggtgggtgtatttggagtgtatgtgatcttgaccatgaaagtatgaaaagcatttcactagggtcacaaaacttgacaacgctcaatgtaatgacaagcagcgtatgtagcaagctaatcatgaatgatcaacctatggctctagtgggaataaaaatatcaatgaggagtttagcatcattatatgtttttttttctttttataaaattcccaagtgtgccacatgaagagcaggatttctatcatcagactatatttcattcattaattacctagataacatggggtccctattggatatgtcaccacaagcaacaagtaatgagcaaagaataataggcatgcatgttattttcagggagaccataaactctaattgtaccatctctagcttgagtttaattatcttcgatattttagaattgataatcaaattaaactcaagatagaatggatttccaaaggaaaaattgtgcaaacctgcgctc

SEQ ID NO: 13383 - DNA, 1501 bp, Oryza sativa
aggatggtgtcaactgtacatcattgagcacataggcaaacaattttatgagtttattcagccagtaagcagcaaactgctgccacagtagcaatgctacacaccagatttatagttcaacattaccatcccacttaaatgagaaacatcccaaaattttcatcataagaaaaaactgaaaaaaaaagcccaatcaccctgatctcaccaatccggatgtattagttcaccccattccataacctgatattggcggaaacattgtatatactgagcattgcacgtactgaacgacagcaattggcattgtgttagcgctaggcataaactaaccggtgggaccacgggtcacggtgcgtgacggcgaagcatgacggcgaactggccgcgtgcagcggggagtgggtggcggagcagatcggcgtcggcggcgacgtggcgacggagggcttccggtggcggggaggtgtgggacaacgggtctagccgcacgacggcgaactggccgcgtgcaatggggagcggggagtgggtggcggggcagatcggcgtcggcagcgacctggcgacggagggcttccggcggcgggaaggtgtgggagcacgggtcacggcgcgtgacggcgaactggtcgcgtgcagcggggagtgggtggtggagcagatcagcgtcggcggcgacctggcgacggagggcttccggcggcggggagggacacggtttggggaagcgatggagggggtcgggcgtgataggcgacggcggcgttggagagggaagggagcgacgacgatggtgaggcggcggcgcggggcgatgggagacacggctagagccgatgaagggggcgagattggggcgattcacgggaatcacgagattgacggggcaatcgcgagaaggagccgcgtggacgtggggaggagcgcggagggagaagggagtaagctgcacacgatctggaccgttggattatagagcaggtagatatgagccgttggatatgtaaggtgtaagagtgtaaggatgagatatgagtaagatgagttggtgaattatagggtagatgactcatctttatatagatgttaaaaaatctagacacacacatgtttagattcattaacatctatatgaactagctgggtggcccgcgcaattgcgcggctagcaaacaaacaatatttttcagtatgattttatttaaaatttattaaatagctgaaagaccaaacattatcatccccgtatttctaattatataatttttaaaagtcgccctagctgctaccccttacttctatcatatccttctttatttgcttgctcgatctaccactatttttattcattctctttgaaacctttaaaaattggatcttagtttttagaggttattgtctcactgggtttcgtttttataatttctagaagtcccgccaaacgctgccattatacttctctacggcccgtccactgtcttttttctttattatcatt

SEQ ID NO: 13384 - DNA, 1501 bp, Oryza sativa
tcttttttcagttgtacacataaactcatcattttgactaattctgattttttagcaaggatgaagtctctcttgttaatagatgcgaactactttgagatttagggcctgttcactttgatgccaaaaaaaaaaacctatgttgctaaaattttggcaagataattattttgaatgtgttcactttgttgctaacgtacattctaccaaattttggtaacatctggtagcgtttagattgcatccgaagtttttactactacccaacagacgtgctgtaccaccctctgtcacctgattgcttcaagcagaggcggaggcggaatagccaaaatttgggctgcgctggcccatgccgattttggtcagtactgtgcaagttaccaaatttctagtgtttttaccaaaatttggtaagaaactaaacatatacacaattttagcaaatttaccaaaaaatggtaaggttagaaatgacatcaaagtgaacaggcccttaagaccaaataaactattaaccctttttaaggaataagttcatttgccttccctcaactttacgtctagtctgattgatatgccatgggacccaagttacacggttttgtatagtctaggaatgccaatcaaactcgttgagggacagcaagtgaacttatctcttgttttaatcatctccacatggacaaatccagcccactcatgagcaaaatcggcccacctcttatttcacgtgaacaaagtctgcccacctctttcactccaacgaattggcccacctctttaatgtgaacaaaggcaacccacaaaggaataagttcaccactgtggtctttttatcccttaaccacaataccgagtattcctctgcccttcatccccggtccgactcgccactgctaccctcccatgtccaactcaacatcgccaccctcccccgatccggctcaccaccgatgtctacttccttttttttctctcacctatcagtttttattttctcttaatttattaaatgggaaataaaggagaacattatccagtgtcagaaatggagcctctattgccaatttgtcacaagttattctcttgccagtttttcattgcaacaagtattatttttttcataaacatccatgctaattgtttattatcatttgcaataaatctacttgctataagttttcgcagcaacgcggcatagtgctatctagttttttttaattctaatgttaaataagcgtcacggtgaaagccacatgattatttttttaattagtatttgattaatcaaacactaataaaatctttcgtgggggagaccagttttcagcatgtcatgcattttacgtgcaggggagatcaattttcaacgtgccacgcggcccacgccgaacacagccagttggcagtatgcgcagaagaacaccaaaaattcacaattttccaacggccagaacacggcaagttgaaaactaatttgcccagcgcagcgcatccg

SEQ ID NO: 13385 - DNA, 477 bp, Oryza sativa
cgcgtggtgcggccgctaggtcacggcagcccccgtgcgctcaccgcggagcacgtcgcacgcgccggcaacctacagccctcgccggcaaagccgcgccgggccgccggctgcctcgccggtcaccgagaagaagaagacctagaagcggcggcgacgcatccccgatgtgggaatgccgttgcagttcagtacacccatgagtccgaccgtgacctgcttggaagggaattttttttatttttaattttttttattaaaagttttacaaaaataattttccattttgaaaattgacggaagtagtcgcctaccgccctctgggagagcgatttttaaaaatcgccctcccggagggcggcgaaaatgacgtggcagacggccgttcgctctcgggcgacggccgtcaacgaaatttgcaggcggcccccttgccgctctccgcgagggcgattttgtactgtgcggggggccgcc

SEQ ID NO: 13386 - DNA, 1501 bp, Oryza sativa
ttaatattgcaatgattggaacgactagacttgtagttgtggccttgtgggacactcgctattcgttaatcaatacgtacttgtcaccttcgagtttcgacttaatttatgtagcggtgaggctcgatcaggaggaggagagataaccgggatctgcccgagctgtaaagcgtgagcaaagatggtggcaggtgaagaagaacggaaaagaaaagaaaaggcacgtacgttttcggagagtccaattgttttgggggggtatatggtgctttcatcaatcattactaatctctccgttttatattataaaatattttaacttttgtaaaatcacctttttttcattcatttaaatctataaaaatacatagtaatatttttaacccaaaacaaatatactattaaaatatactcaatattatatttaataaaactaattaaatattaaatatattactaaattttcttaaacttctgtaccttccctttttttttctccagggaaaaccttggatgttgtatggtggtaaaaactttgtttctcctcctgcttaattaaactaaaaaaaaagtcatttcctccatgccggccctgcgcgatcgcagctactgtgctgtgtccgttccaacgccaccgtcgcgcgtcgcgagcacctcgccgacaccgacgagcgacagcatatctgccggcagtcgaaacggccccgacttcacgggcgcaccgcgcgcggtggacggatcgcgtcgcacttgcattacaatgtcatccggcgcacgcacgcacgccgtcgcaatccttcgcggtggacgccgccacgctggacgagcaggcgaggcgagccgcaccacgtaccgatccacacgcgcgaaccagtgttgtacagacgcgtgcgggccgtgacggtccaggcgcagccgcgcggcagccgaattagcgtcggcgcggcccgcagccccgcaggtgaagccgatatgggccatcctgccgaccttgccctccgggtccaactccaaaccccctgcgtatgtgtgcaattctggtggccgcacgtctcgcggtcgcgggcacgcgaatacgcgatactgtggaattgtggaagcgatgtggtgctcactaggcaggggtagaaatggtcacgaaaaagcgccgttccgtataatgagtaacgttttttaccgttactgtttatggctgtatttaatttttgttttttctattttctttatgcactgtattaatatcgacattgagtagtttaagtgatacatatggtcaattgctagccgatcgaacgtcgtttccgaagagatgctatcgattccgaccgttttcacccttttttggaaacggtcgaggaaaggtcgaaaaacagctcaaccatcctcgtaacctttttttttctgaaaaccaaaaaggaaaatggtataaaaaatgttgaggactctgaagcggaattgtacaaacagaaacatgtcagaatcgatcggatcatcggaaacc

SEQ ID NO: 13387 - DNA, 1501 bp, Oryza sativa
ctttgtattaaaaatgttagtatatttttccacagtcttgatcaaatttaaaggtatttgattaagaaaaaaagtaaaatgatttataatatgaaatatgggagtatttatgtgttaatagaaaaaaaaaagcagtgtccgattgatggctggatagctaatccctccaccatatatgcagccacgcaccgatagagtaccctatcttagctgtgggtggcactaatccacccacgaattaatcattcccaaatcgagtacacaagatcccctagagcacttgctcgtgtcctaattgtgctcagctttggaatatgtcaatccatcgatcatctcctcctccgatctccactcccatatggatgtgaatacaacactgcacactagcttataaattgcgccattctctctctcgcgcgttgtgtccccacacgataatgagggacaatttttttattctaagcccctatatatctgaaaaaaatataacacagttctaggcctttaatagctttttccaaaatctcccgaggttctctaaatggtccaaatttatttaaccaatagataagtaaaagctgaaaaacacatctcttctagatgtttttaagaatctccggcaatcttccaaacaagatctaattgtgaatggactaacacgtggtggttaatcactatgttacaatattaatcatgatgtgtcattaatttagcaattgatacagtaacatacaagtatagatgcatatggatatatatgcctccagcagcaacagtagtggatgacattaagcagtatatttagctgagttaattaattgtatagtggtcaagaggtgcgattaattaagaggatacgtggcaattttttaattagctactctgatgacatgcttcatgcattagcgttacgtatacgtgcggtcgttgcatcaacaagagcgtcatccttacgtatacgtacaatggtcacacagcgccactcgccatgtgtacaggtgtttttggttattattctgtgatgaacaattggcattagagattattggttttgttatttggtatttattcatgaagtggttttagagatgattggatttcacaggtgatcgcaggattcgtcattttatgtgaccggtcagaccgggctctggtaaccggtcagaccggcgtgtaatgcgcggtcagaccggcgcagcccgcggtctgaccggccgacgctgtgtcagtttcggtttcgggttgtttgtttggatatccgtgattatttcatgattatgacttctagatggatactatacgtatgtaatactactgtttgctactaatgagtcaagttggagatagcttggtctcggaatatggtttctttgtttatttcatgtgtaggtgactcaatgcctcgggagagtatttgcggtgatggatcgggaatcggcttggggataagacgacgtccgtggtggtcagagatcatgcggaatacttaggctagagttga

SEQ ID NO: 13388 - DNA, 914 bp, Oryza sativa
ctctctctcttcccccaaaccgccgccggctacctcgttgccgacgccgccgccgacgtcgtcacgcccgatcacgactccgccgcgccgacgatgccgaccccgacctagaggcggcatgcatcggcgacgacgtcacgacgaagctgcaaagccgacgaagccgcgccacgacgccgcggcggcacgacacgccgggacaccacgacgtcgccgcggcacggcaccgccgcgccgccacaccatagccgtgcgacgccgccgccgcgccacgccgatgccgcgccgccacgccgccgctgcgccaagctgcagccgcgtagccccgccgccgctccgctgccgccacgtgaacgaatgaacgtgaacgagaacgtgaacgtgaacgaacgaacgtgaacgtgaacgtgaacatgaacgaacgaacgtgaacatgaacgtgaacgagaacgtgaacgaacgaaatgtacgtgaacgagaacatgaacgaacgaacgaacgaacgaacgtgaacgaacgaatgttaacgaacgtgaacgtgaacgaacgttaacgaacgtgaacgttaacgaaaagtgaacttaacaaggacgcgaacattacttaacgtacgttaacgtggacgcacgtgaacgaacgaacgtaggtgaatgaaacgtgaacttaacgagaacgcgaacgtgaaatacaatatataagattgtgtagggttctaatatacgacagttagacttagcatatatgactatttgagttttaatataagattattatagttttaatataagattattagatttgtaattagacttagcatgtacgacagttagacttagcatatatgattgttagcatataagattgttaaagcaaaaatgtctcatgacttagcaactatttcttgtatgaacaga

SEQ ID NO: 13389 - DNA, 341 bp, Oryza sativa
cgtccgccgcccgcccccgtgcgccgcgcccgcagccgcctccgctcggccttcgccacgatgccgtcgtccgccgtccgcccccgtgcgccgttgcccgccgctcgctcctccgtgtttcccaccgccgccgatagagtgaatcaatgaagagtgagatagagtgagagagaagagaggaagagtgggagagaggggaaagtgaagactattacatgcgggtcccataattttttattagaaaacgctgactgggataccacgtatatgccacgtagactaaaaaccaccgcggattgggtcgaggggggtaattcgtccggtttacataattgggaggt

SEQ ID NO: 13390 - DNA, 421 bp, Oryza sativa
aaagttgggagtattatccaaagatttattaaattcacaattaataaataaatttgctgaaagagggagactaggaagacgggatgttgttagggtgatgtgagcttttacgatgctcgtgtcataccgatgttagagcaagtttaatagtagagctaactgctggccataaatcatctataacttaatagccaattctacaatagttacatataaacatatactacacaatcaatatctggtcccacctattactacacaatcaatatctggtcccacctattatatacacatgcgtcttagagtctgtactgcagctgactacaaatctgtagcccgctgtcttttctctccttttttatcttcttaaaatatgtttatagctggcttatagtctgctattatacctgctcttagcagc

SEQ ID NO: 13391 - DNA, 753 bp, Oryza sativa
actcacacttgtcgatggcatttctggtatttggatgcttgtcaatggcatttcatgaaatatctcattagaagatagatatgttttcatttgagcctacttaattgagacttgaaacatgaatttaagtatctaaaacatttcaaatgaaaaaaaaatcacctataaaattataaatctcgtcaagagctataatttcaaataaaatttgtccaaatctgtgtccatatgaaaagaaataagtttaactatgagatttgagatgaattttgagacttgaacgacttcatttcgagtttgcatgaattagttatgaattttacgatatttaatccaattaaagcctaattaaaaggattaaatagatttatgatatcatttacaattatttttacactgataaaataggattaataacgtcggccatccgtcgcgaacccggttcagaaggtccctcaacttgttatcgagttacaaaatcgtcccccaaccagaaaaccagatacagagtatcctccaacttaaaaaacattcattttaggtcctttggtggttttgaacccggtttcatcatacgtggcggctgagtcagcgtggaacccacgtaggtcccacctgtcagcgtggccacgtcagcaccctctctctctcttccccctcctctcccttcctcatctctctctctctcactcttctcggcaagccggccggtggctggggcgaaggccgccagggtgaggcggcggcggcagg

SEQ ID NO: 13392 - DNA, 1501 bp, Oryza sativa
agtcaggccacttccttgccgccacctccccgatgacgacccggactccgacttcgcgcccgacaacccggacctcctccgcaacagccccgtccccgaccgcctcctcgtcgtctccgggggtgtcgccgccaacctcctcttcaccttcctcatagtctacgccctcggccgcccgccgccgcccctcttgtctccggcctcctcggccgtagatggggaagggggagagaaaggggagagagaggggggaagggaagagccagacgggttggagagagaggatgacatgggagccccacatgtcagtgggtcccataatatatatatttttttgtgaatgacagatgggtcccataatttttttttaaaattctaatgccacttaaggccacgtgggacgaagactgggtcaacactgccacgtcagcgccacgtcagtaaaaccgccctccaataccgctgagggagtcaaatcgcaccggtttcaatagttcggggagtcgttctatccggttttctggttgtgcgatacgaattagattcggcgtacaattaagagagtcaaagtggactttttcctaatagcaataagccaatttttcaaccctaggctgagttaatagccacccatcttggtaacaaattaggcccaagctcagatcaagtcgcattgtcctaggttgcccataaataatacttaggatatgtttagattgtagccaaaataaatcttactaaatttgacatttacaatttggcaatattggaaaatctttgagatgactctggcaaaattccataatgcaaccatagacaatcaaccatccattaaatctgcttgattattggctataaattaagcgtttaatgggctagacaaaaggcccaaacaggaattgggtgtttgttgggcctgatcaaatatatattccttcctagaaattaaatactccctccgtttcgaaatgtttgataccgttgactttttagcacatgtttgaccgttcgtcttattcaaaaacttttgtgaaatatgtaaaattatatgcctacatgaaaatatatttaacaatgaatcaaatgataggaaaagaattaataattacttaaattttttgaataagacgaacaatcaaacatatgctaaaaagtcagcggcgtcaaacatttcgaacagagggagtatttattattgggtctgcaaaggctgagtgctactgtggtagttcaaatattcaactcttcaacttcaaggcctcgtcaaatccaacaatattggcactcgagtggtttttttttaactgaagcactcgagtggttagatgtggttagactagttcattgaagatatggagagaagggccggagaggaagacagagcaagaagaattacaagcccaaaaggaaagattttagaggaaatacatgctccgaagcaaaacattttagaacatacctggttcaaagtgaaaccattttgtgagaaatacatataaga

SEQ ID NO: 13393 - DNA, 1501 bp, Oryza sativa
tcggtcgcccggctcgtcgtctcgcggcgccgcctccgtcgtcggcatcgcagcggcgtgttccacgccatccttgtctttatgcagccgttgtaggctgcccacgtcgcctcctcgccggccccggtcgtcgtcgtcgtcgccctctcgtcgttcccggtcgtcgtggcgttcgtccctccgtcaagccgttctcgttcatcgtcctcgcttcgtcaagtgccgcagccccttcatcgtcttcgtcctcgcctccgcgtcgtcaagcctcgtgccggccgtgtcttgccttcgttcaaggatcgccgccgaagtcgttccctcgccgtccgtctctgccgcgcccgttcgtcgttgtcgttccgacgcctcgtcgcgtggcggtaaggatctctcctctcgctgccccgtcctcatcctttcggtgtcgccccgtacccgttgtgcggttgtcgaccccgatacccgtgtaccggtgtcggtagtcgttcacgtgtgcgggtggtgaccgtgtagtgtccatgttagtgtgcccgctcggtagccgcgtggtttccacgtgtgcagcccgtgtggtgtctagtggagtccgtttgtcggccactcgcctcggttgacacacggggtccgcttccgtcgacccgtggaccatctctgtgtactcggtctaccgcggtcctttaggttgacatgtggggtccgcatgtcaacagcgcagccttcctgtcttttccaggcttgcgcttccacatgttttatagttgcaaagtttaattataataatccgcaaatctccatataacagcattaaacttcggatgatcatatcttggtcatacgagctccgaatcgacccgttcaagtctcttaatgtttgttataacctaaagaaccgtgtgctttctttttatgtattgttattgcttctttataggcttgtagctttgcttgtgtgcttcgcgtagcttctgtcgttccggaggttcccgaagcgtggttcgcggccgtcgccgaaggttcggaaggccgttctctctgagcaaggcaagtcacatcatccttgaacatattgaatcccaatttataaaattattctgatttaaattattgcattatcgctttatttaaattcacgcgttatcactgttttatctagccatgcctatttacctttgttatgaccttattattggtgttattgttattattaccttgttcaccctaggataaacaaaaccccaactagtgggtactctattcatgggtccactagtatgaatttaggtagatgcttcgctgattaattaggcaatattaggtggttttataactttagactttgggaattctcatatcatttggacactatggaatagttggcttatgttggaattggacacacacctccccctctattcaaaacccacaaaatagttttaggctgggctcgaggtgcgtggttgggtttggttagtcgtacctcgggtactataaggattaa

SEQ ID NO: 13394 - DNA, 1501 bp, Oryza sativa
cagcagtcgattgctatgtgttctcgcttgaagcagacttgacaggtgggacgcttgtccggtcctcttgtgccgtgtcctcggctgcgtccttggccaccaccgtgtccttgcgacgtgcccctgtcgctgctgccggagttgttgccgccatcgtgtctgccaatgcccctaccgcaatttgtgacaaaaggcagcccccccttgactggtgttgcggtaaaggtcaagtagggtttcatagttgaggagttgagagtacaactcccaactgtcataggtttagtctttgtgcacagagtggagacgattggactgaaatcttcatctaatccggtgatgatgtactggactagatcctcctcatcaaggggccggccacctactcccatctagttgccaagggccttcatcctggcaacgtactctacaaccttcatggttcccttcttggtgttgatgagggcgagccaagtgttcactgacctcgcgcgagtgcaagaggagtaaatcttctcaattgctcgccatgcttcagtcgctgttttccacatggcaacttggatcatgacatcccttgacagaggcgataggaggtagccaaaaacttgctgatcattggcctttgttaacgccaacgccaacagtatactcagctcaaggtcagtatactaatactaacaaaccttatcttctagaagctctattgcatgtataggaaactatatttcacacatatggtatggaacttcacattagtgaatgcccaaaataaaaggaatattccaagaaaatattaattaggtcatattgaaagaaattctataaggatatcacaaaacatgcatgtgtatgtggtgtgccaaattaaggatcatataatgacaagatttataagacgatcagagggtggaaagaggtatcatatgaagtaaaacaagaaaaaaaggtcgatctaggtagatgacgaagcctatgacctttagggcgtttaacttattttattaagtagattaggcaacttgacttgatattgttgctgaatatttgtactccttccgtttctaaatatttgacaccgttgattttttagcacatgtttgaccgttcgtcttattcaaaaacttttgagaaatatgtaaaactatatgtatacatataagtatatttaatgatgaatcaaatgatagaaaaagaattaataattacttaaattttttgaataagacgaacgatcaaacatatttaaaaaagtcaacggcgtcaaatatttagaaacggaggaagtacaggcaacaaatatcaagtgtacgtatatgcaatatttttagaacatatttgtgctttctgaaattaatgttgatgagttatgttctttgtttgctatataggacactaattttgcgcttgatgttggtctaacgcttttgttaggagttgatgtttggtaatttaaccatgttctgagagaaaaaaaattcatccctccgcccagggaaat

SEQ ID NO: 13395 - DNA, 1501 bp, Oryza sativa
agacaaaacgtggcacgcatgtagtgggagaccggcagaaccggtggagaaaccgaaaaaaaaaaagaggaatggctccacagctcacccaatcgaggagcttctacaccctacatactacatatcacacctaacgaggagaaaaaaaaaattcaaataagagcaaggataatagtataactcacttcctactattagctcattttaaagccaacatatataatagattagttataaggttggctatatttttcttctcttctctctatctctcacttatgcattcaatatatttgtcttggagcttgtgataagctagctcttgcatgagagcccacacctttgattttttactatctctctcctccacctaagtttatagtagacttatagctcactattatacttgctctaacaccacacaacacatgcagtccaacacgtaatcaagcacgagaagccaaaacccaatttcaaatacgtgtcactagtaccgaggagccaaaaaaattaaaaaaatgagaaaatcagtagcactaggggttttattaattgatgaggtacgtagaaaacggagtggtcgattagcgcgtgattaattaaatatttattattttaaaaaaatggatcaatataattttttaaagcaaatttcgtatagaattttttaaaaaacactgaattttttaaaaaaaaaacacacatcgtttagcacatgattaattaagtaattattttttaaaaaaaatagatcaatatgattttttaaagcaactttcgtatataatttttttaaaaaaaaacatatcgtttagcagtttaaaaagcgtgcacacgataaacgaggaagatgagttgcaaaggtcaggaaaagaactcaactgggctacatcaccattgtttggtactatgtcaactcacctcaccatttgctttgccttttttttttcttcttttggttggagttcatctgttgtcctacaaaattttgcaatattcattttcccacttggctcctaggttatttatttgaggaaaaaaatcaaaattctaatgtgagctttcttcttgcaacccaagttattttaaaccgaacattgagccccctaaagattctcaaaagatccgagcaacccccaagtagatttgcttacatgctgcattaagccattgacccaacggttttcattgctaacaggctgacctaattatatcttggcatgacgctacaatctttgtagttgtgacattgtattatggtatttctagtgttgtcaaatacaaggttacggttttctgtttttcaagccaaagaccacggcttaaaggtgcgtaactgcacagtaaccacgaccttacctttaagatttgaaaatttcgaattcaactttttggatatgaaattcacgtggttcgtgataaccaccgtaccgaatgtgggatgaccgcagggccggacacatcctctaatgcaacgtgtaccatattttaggaaaccttc

SEQ ID NO: 13396 - DNA, 1501 bp, Oryza sativa
ttatatctcgcttagtccagcgtgacagcgtcaaccatctgatctgaccagctggatcctggatcaatcatcgaagatgaagctttggaagtatcgggcccggggacgacagcgatctacgtacgaaaggctgggacaaactgaggtacgaaacgacgccgtattactgtgttgctgtttgattgccaatggccagtggagattggctcggaagcctaagtcggcagtcaaggggccgaggcgagcaaccagaatcctgtcaactcaatcgatcgggccgaaggtcactgttggtggacgggcgaggctgtccaaaacgatcgattcgacctgttaggcgttaggccattcacaatgcatctacatggcatttggtctcaactgtccagctaaacagattgtatacgtggagaagaaaagaaggtggggcccatgtattcaccagcttcgcgcgtcctcatttggctccgagagcctcatcagaaaaacagcttttttaatcgcatttacacatgagaaagcaggacagagagagagaagggggagaagctgacccaaaaaagtaaatttttgtggtggggcccgcatgagaaacagtttggtggggtccacctaaagacacgcgcccacgccgcattgtggagagaggagcttcacgctgtttcttcgtacgtggcttcgtacgtggctgtttaggctccttagaaaaatactacacagtgctaatgcccttgctaggcatctgtccgcgcgctcaccggcggcggcggaccgggtcacgcgaccctgaccgagcctcaccgttaaggatcacatcatgaagcagcaccaggccaccagcacgtactacctccgtctcagcagccgtggaaatccgtgtccaacgtttgaccatccgttttatttgaaaattttatgaaaattttttaaaaaattagtcacacataaaatactattcatattttatcatctaataataataaaaataataatcataaaaaaaatttaaataagatgaacgttcaaaacgttggagatgaatagtgtaaaactacatttattttaggacagatggagtactgtctgtctgctggatgtcactgctaatcgtttcagactgcatgcgcctttgcctgaaaggcctctgtttgggattgtttttttttttaaacgaacctctgtttgggattgtcgcggatgtgttctggacttctggtgttctaggcgcttggaggcatggatcagcaaactcaaccaacctgatcgactagcccttgatgtcattataaagcatggagcagcaaaccaacctgatcgatcgattagtagtccagtagtccttgatgtcattatacatgttccccatttttcctggaacatgtgccattcaactagtaggacttttatattagagagaaaccacaaacaaaaattgaacacatttttaggcccggtcgctccgccccaggggtgacgcgggcggcaacacctcaccgtcgcc

SEQ ID NO: 13397 - DNA, 1501 bp, Oryza sativa
aactacatttattttaggacagatggagtactgtctgtctgctggatgtcactgctaatcgtttcagactgcatgcgcctttgcctgaaaggcctctgtttgggattgtttttttttttaaacgaacctctgtttgggattgtcgcggatgtgttctggacttctggtgttctaggcgcttggaggcatggatcagcaaactcaaccaacctgatcgactagcccttgatgtcattataaagcatggagcagcaaaccaacctgatcgatcgattagtagtccagtagtccttgatgtcattatacatgttccccatttttcctggaacatgtgccattcaactagtaggacttttatattagagagaaaccacaaacaaaaattgaacacatttttaggcccggtcgctccgccccaggggtgacgcgggcggcaacacctcaccgtcgccccctcctctcccacgcctcgccgccgcccgagcagccgccggtaaagccgggcggctgcaaagacggcggcggcggggctcccctttctcctcactcctggtcaagtggttggggcgccgatgagaccggagcacgaggggcgcagctcggcgaggactgccagatccggcgccgttgaattcggatccggccctcccttggccggatctgggctggacgcgcaagtcggcggcgaaggcggcagccgcggcggcgaccgcggcgcgagggccgcgcggaggaggcgacggcggcggcgaccgcagcgcgaggggcgcacggaggaggaggcggtggcggccgtggctcgaggaccgcacggcggcgactgcggcgcgaggacctcgcggcaacggtggctgcggctcgcggacgtgcgtcaactgctgcttctctggcttgtgtgcacgaggaagtggttggcggcggcgacgtctcttctcccaggcggcttaaaaaacccatctcgtggagctcctcccctcctatggccagatcctgttctggccgtggggagcttcaggagagggtggacgcggcggcttgtgcagaggacgacggtgccatggcgacgtgcgggaacaagccgcgagcctacctgagccgtggggtggtgaactgggctaactggtggctgatgaaatgatgtggtggttcggcgacggttgttgtgtggttcagtggtggcgctggacgaaaatcattggcgaaagccttgcttagcctttggctggcacgacggcggcggcgcctttggcatcgttcccttcttggaggcgtcgttatagcgttttctccacgctaccagtctctaggtgaaaactgtgatccggtttccggacgggcgatggcggcgtttcacgtcgtatcctccttgggggcatcgtcttggagaaccttacccatgcaccatttgccgcttgtggactcctgtgtcagctcgatgtgctagatgcctaggtgcttggcgaggccttgtccttcttggttcctttcttgtattggtggc

SEQ ID NO: 13398 - DNA, 1501 bp, Oryza sativa
caaatgaccttgaatggaaaaaaaaacccaaaacgcaagttgataaatttttctttcaaataatctatccaacgaattacctttgaatttctcatatttgaggttcaaaattttcaaatgaccttggataaagaaaatgaacaaaacaaaagctgtagatcttaaaaagtcatacaactttgtagttaacaacattttaatttggctcatctatccaaggaagtttgcatttgaaatttcccaacatttgaaattcaaatttttcaaaagacctcaaatgtagaaatgaccaaagacaaaaggtgtcgatcttgaaaggttagaaaattttgtagttaattgacaacttttttatttgaaagcatcaatccaacaaaatcaggtttgaattgaacatattagaaattcaaaattttcaaatgatgtcagatgaagaagcgacaaaaacgaaagttgtaaatctcgaaaagttgtacaattgtagatgacagccttttcatttggctcatctattcaaggaaaattgcgtttgaaattcatattttcaaatgacctccgacggagaaatgggaaaaatgatagttgttgatctcaaaaagttaaaaaattttgtagtcgataactttttcttttgaaatcatctatccaacaaagttacgtttgaattgctcacaatgaaaattcaaaattttcaaacgaccttagatcaagcaaccaaaacgtaatgtggagcagcgggctacagagatgactaacaaagttatgtttagcccgtcagagatcaacaaaattacgtttgggcccgtcagagatcaacaaagttacgtttgggcccgtcagagatggcctggtccggcgtagtggagcagcaggctacagatctgtagtcagctgcagcacggactccaagacgtaatgtgtgtatgacaggtgggaccaggtattaatagtatagtaatcaactattgtatgaattagctattatattgactatagatgatttagagctagtaatgggctatactattaaacttgctctaaggccagcgatgaaaaccgtttgatttggcgtctgaaatctaggcactagtcccggccagattacctccaatctctttgcttgaaggcgtgcatagcattattatattcttacaaaatacaagcaactatcagccttaatataatacggaaatgctaacaatttcgcaggccctattagcaaactgttatgtaaaaataaaggttgaaaatcttcatgagcactctgctaggatacatggcttgcaactccagggatctgcagctgcccgatatgatcccactgaaaaagaacagagaatcgtaatcaaacaaccagtaagcacacagaattgacctgcactactgtaggaatagtaaacgagggacgagctttagttgagaacgtactgtagtattttgcgttcagcttgttcgaaaagtattttccacacctaatgtatgcatatagtttaacagttat

SEQ ID NO: 13399 - DNA, 1501 bp, Oryza sativa
gtagcggtggtggcgggtgagggttggagcgatggtggcatgtcctgtggttggtgacggtggctgtgaccaaggagatcggagacgagagtgccagtggtggttgggcgagggccagtcgcaacgccgtcaagctcttgctcgtcggccgccgccgagctcatcgagctactcctatacctccgctgctgcctgttgaagcatcgcctccattcgaggctatcatcgggggtggagaagggaggtggagaggcagcgtcgccaagctctcgcccgtggccaccaccaccagccacggtctacagctcttctcatagcaacacggcttgaatccaccgctctgctctgtgggagtgacaagaagagcctttgctgctcgccgtcaccattccaccctttgccgccgttgcacagcttcagctctatgcctctatgggaaggagagagaggaggaagaagggaaggagagtatgattatggactctatatgtcagtgcgtcccataatattttttttgtgtgaatgataaatgggacccatatatattttataattctaatgctataaaaatatcacattaacggccacgttggacgaagatcaggtcaataccacaatatagacgtcacgtcagtacaaccgtccttaaaacttttgagggagtcaaattatatcggatttaaatagtcatgtgatcgatatatcctataatgaatcagattcggcctagacttactccctccgtcccattttaagtgcaaccataagtttccgcgctcaacattgattttccgtcttattcgcaattttttttataattagtatttttgttgttatgagatgataaaacataaatagtattttattcgtgttttatgtttttaattttttaaaaatattttcaaatattacgaacaattaaaattggatgaagaaaaccatgtctacacttggaatgggagcggtgggagtatttctttcgcgaacaaaaggaatgagaagtgggaggggacgcttgtggtgggtaggtagcgcgccgctcctgaaaactggccgccgtctggtagtacaaccacttgcaagtgggaccagcagatcggctaagcggcccccaccttcccgggaatctctctccgccacgtaacgtgcccgtgtaccccagtagtaataagttacactcactgccgtgtgggacccggcctgctggaccaggttggccccatgtgggccctggtcttctggaccgagccgcgacgcgacggccgcgcgagaagcgtgcgccctcggatcgattcctacataagcagcgcccgtgcaccacacttttctcggattcagcagcggggaaagcaacccacggaaacaaatccaaaacccgcttcgtgcgccacacccgctaaggccgccgccgcttcttccgaaatggccgccgccgccgcgtccccctcctcttccccgccgccgccgccgatgtcgccggcaccgcaggccgcttcgccgg

SEQ ID NO: 13400 - DNA, 342 bp, Oryza sativa
attaccgcggggccgatgttgacattaggcacttcctttaagagttttaagtggttcgggcactcttaccgtggtggatatcgaggtcaggttcaccccgggtcatcaggtcaatgcaatataagatagtcggattctctatacttcatcaaggtagcttaggttcagggtaaagcttgagagcgtgttggggccagtgagtccagagaactctattagtgcccgttgaaagttgccaataggtgtcggtattctgtctgacaacaattggtcggcacatatgggggttttccgtcagacaccaattgggcggcacttatgcctggggctggcccctatagg

SEQ ID NO: 13401 - DNA, 431 bp, Oryza sativa
agtccctctcaaagaataacatggtacgcagcggaaaataaaactataacaaactacggaacagctatggcgactccactccacaggcatcctaaccagaacaagcctaatcctccagatcatcaccttcactgagatactcctcttctgatgaatgaatattgcaagaatgagcatatgacatactcaacaagtcacacagcaaatatgcaagtgcacaggataacaaaggatggcataatatagctcatttgcagaaacagcatttaacgaatatttaagagaatagtaaaacagttgtaataattaatcaatattaaataaacaccatacaacacacccatgttgcataggcccaaccacatttgaacaaccaaccccagttgaacaaattaaacctccaaaccaggaattatccattccaaaccagg

SEQ ID NO: 13402 - DNA, 309 bp, Oryza sativa
agagtaaattgcgttgacggtacaagaacttggcgggtgggtgcgattaagtacaagaacttgaaaattagacatatcgatgcaacaacttggctaggtgggtgcgtttgtggttcaaaagactgccacataagattttttgccacgtcagctttccaccttggacaaagtctacgtgagggccctttacacatcatattaattttgcacaaatcccctgttgtttttcccatttgaggacattttctagtacgatcaattaatcaccatgagggataggacctcaaatatgtagcttccggctgcagc

SEQ ID NO: 13403 - DNA, 1501 bp, Oryza sativa
agtaaacaatgttattagtactgatgcttatttctttatctccactggatcaagaaaaaacacctttctgtctcaatcatttgtaggagtatgaagtcttcgacgaaaaaaaaaagtgttggtagaatgacatgagcgggaagatatggcgagcaaaaaaaaatatggaagaaaatgacaccattatctggcgctagatagcattcgccgccctcgtgtttggtgttgctgaagcaaccaccttaagcaaggataatagtaaactataagtttatatggagaaggaagacaagaaaagtacaaagctctagtcatatgcttcaaggtacatgcactaaatacataagcaagaaaaggtgaagacaaatgttatagccaatcttatacttgtaatatgagtttataagtagttagctctaccattcaacttgagtaaagtgcattggcggtccttcatcttatagggttgtgttatataggcctctaaactctcaaaatacatatctgagtcacgtaacttatcaaagtgtatcatctagattctaaattgacacatcacctctaggatcctacgtggcgttgatgtagcatgccacatggacatgatgtgtccttttcttttttttcttcttttatttttctttttattttccattttcttctcattcttctttttttccttttaaatttgtagccagctgcagcacgaactctaagacgcaatgtgtatatgacaagtgagatcatatattaatagtgtagtatatgtttataggtaactattgtatatattggctattaaagtaactatagataatttggagctagtagttggttatactaatcttgctcttagagcaggtacaatagcaggctattagccagctataaacatattttaatgagataaaagatgagagagaagaatagcggacttagatctgtagccagctgcaacacggactccaagacgcagtgtgtgtatgacaggtgagaccatatattaataatatagtaagcaactattgtatgaattgactattatgttggctatagataaattggagttagtagtgggctatactattaaacttgctcttatgggtgtaaaggtactaggtacagaggtagtgttccctcacgctgtcgtcaccatgacacgtcatcagtcgttagggtcggcacagcatctccattttgctacacgtccccccacacccacccaccccaaaaatgggccacgcctagtacccgtagccccgcgtgccaaccattttataccccggtgggccaccacccccacctccacagcccaagagaaaacacacgcgagcacacacacacccacacacaaaaaaaacacacacaaaaaaaaaagaggcgagagctacaaaacgaggccgaaagcgaccaaatctcgcgacgaattccgcctccactttcccttcccttcctcctccacctccacctcctggtagcgatccaaatccgaatccggcca

SEQ ID NO: 13404 - DNA, 534 bp, Oryza sativa
cctatggcggttttcactgacgtggtgcctacgtggctaatttgactcggttttcatatgacgtagctagtgacgtggcgcttacgcggtaatttttatttggaaaattgctatttgtggtcccacatgtcagttacaccaaaaaaattcattcaaaaatggtgggacccatatgggccccacatgtcattcttaccccctcctcttcttcctcctctctccccaactcccctctcctttgtcctctctccaggccgggcgaggctaggcggcgcgcggtagtcgggagaggagggcggtgcgaagcggccgggcagggcggcgcgcgacggccgggagaggtgggcgggcgcgcgacggccaggagaggcgggtggcgcgcggcggccgggcgaggtggggaggcacccatgaccccgctccgccgcagcacgtcacgcagatgcgcgccacgccacacgaaggttgagatggcgctggcagttgaagccgacggtctggcgcaccatgttctgctccttgtgttggttgccc

SEQ ID NO: 13405 - DNA, 1501 bp, Oryza sativa
gagccagctaatgtggcctgtactgccagtgcttttgatgtgccggaatgggtacaaattgctgcttgctttcatatggcaccaacaacatgagagcattgctgaaagatgtgtactcgaagtacgacagaccgtgcaagattgcacgatatgtatttgctcttttttctctttttggtgaatgtgaacatgtgattatctgaaatgtacagcagaagaatacgtgaagtttgtgtgaaaacaatagaaaaagatcactggatcaagacttgtgaggctctgagatcttgaatttcttgccctagttttgttattttgagcaaaggctcggttcagtttactcttcgttttcatccaatggctgagaaacatgctcccaattcgtgccggaacgggtacgaattgctgctggctttcgtatggcaccaacaacatgagagcattgctgaaagatgtactccttttgtccataaaaaaacaatttctggctacaaatctggatgaagaatgagtatactcgaagtatgagagaccatgcaaaattgcacgatatgtgtttgctcttttttcctttttggcggatgtggtcatctgaaatgcacagcagaagaagaatacgcacagtttgtgtaaaaacaatcaacaaagatcattggatcctgacttgagaaaatctgaactcttgaattctcgccctcattttgatatctttgaacaaggcacgttcactcttctttttcatccaatggctgagaaatactcccaattggggtagaaaaaggtttgttcagtctgaacaaacaaccctatctgacagagatcttgacattgcatacagcacacaggaacaaaaagaaagatatgctatgcatgagtagctcaagttcagtccagtaaaacaaacctgttgccctaggacaaaaccaggtgctgttcataccttgcaacttgccaaagatacaactccttatgaacatgattgcattaccaaaagcctaaaatactgcactttgcatgttcatatgctgcaaggaccaggtgagaagagagagagagagagaggagggttgcaaaagcagaagccaactcaagaaacaaacaaccaccatgtccttgggtaggtaggtagaaggttaaaggcttgagctgttcttcttctctcttttgcctttccagtttccttcacctgcaactctgttattgttacacctctctatctccataaaggcagtggtacatacactggcaggcagggcaagggcagcacattctctcttccagctgccaccctgttgagttttgcttgcacagagtcacacagctgggtgatctcctttaattaggaatttagggaggctgtcagttctgaaccccaatcataaaaccatccctggtttctctgtcctgtcctgccatcattcctgcctgcttctgctttctctctcttctcttctctcctttcctcttgagaaagaggaaagggagagagaaagaggagaag

SEQ ID NO: 13406 - DNA, 492 bp, Oryza sativa
tcttcaggaatcaatatcaggaggaatatgtctggcacggttcgagtttgcatgatttgagagttttgaacggttgcaaaggagaatgtcctttgcaaaaaaaatgctcgaacctggaatatgatggcaaccgaaccgatggttggcacagcggtactaaggctttcagcgcaaagtttggattttgattaaaattgaaaatgatatgattgaaaagttatgtgtgcatgacaggttaatgtgatggaaaagaactgaagtttgaagtttggatccaaattttaaatctaaacacagcctaacacatggtgtttgacttgtcgtgagcaaccgggcagccggcgcgacccgaccctgacagacaggtaagcgacgtgagatcaggctcagcagcgaaccagcaccacggatgtgagatcacgtgaggatgatccgaggccgctgcccgcgggcgcgccggccaaaccaccccaaccaggcacaggcagagga

SEQ ID NO: 13407 - DNA, 535 bp, Oryza sativa
aaataatacgtgaataaaacttttatatacgtgttcttagtgatctaaaagcaaatgctgaaaaataaactttgataaagaaactttaaaatcaccttcaaattttaaggttgaaaattcaattttgatgataaggataagtgtaagcgaaaagatgaggcgcttcttctcccttcatctcaaaatataagacgaataaccttttcacaatgtctcataacatatggtatatacacgtataattaactagcacatccctctactgtaaatttgtttttttaatcctttagtacctttgataccattaggtgattttttttttaaatccttcactcttaatatttctaataccattgggtgcttgagccttgaggtgaccaaagcgaagaaatgataataattctcttatggtatttgtgtttagagctttatattttgagattgagaaaatatttggatttgccacaagtttaccgtgcaaataatgtactatcgtactataaatcatgtagagaatcaacgtgacttgcacaaa

SEQ ID NO: 13408 - DNA, 1501 bp, Oryza sativa
gcggcacgccggggctgcacggcctgcctatggagatgacgacgggggagatggaggccgccatcgtcgccctccctgcgaagaaggaggcgctgcgggaggccccttcctcttcccctcgccggttgccgctgcaggcgctgccgccgttgagccgactcgattaattatacttccattccaatattctatggaagcaagcttaatttgcaaaagtgaagtgaagctgagcatagcatagcagagcatccagctcgctcagatggccttgaggaggtcggcggcggcggcgatgtcctggccgtcagcaagggtgacgatgttgggggactctatggccacgacgtcctccgtggtaaacccgtcctcgtcgcagaggagctcttcgctgccggcggcgaccatccccggcaggatcaccgtcctgtgcagccccgggaggaggcgctccctgtcggtatcgcccttctcgccgacgagcaccgccaccttggataggtcgatgccccactgtatcgacaggtacctgaaagattaatgcgtcgaacggttagagacgacgagatggtgatgaggtggtggtggtggtggactggtggtgatggtggcgtcgctggcggcggcgtctcacctgatcgcgcatggccgggagagagggatgatgttgaggcacatgcacgcgcgcgtgtagacgaggtttctttggaagccgcgcatccgcagcacctgcttgatccaatcgatttcttcaagaagtgttgtcatcaaatggtgttcgtggcaacggtggtgctctgcttaacttggatgtgtccttggcgacgtaggcgtggcagtgcacggagcaggcggcggcgtcgacggcgaggtccgcctcctgtgcgccatcggccttcccgagcctcggcacggcggacctcacgtggtcctctccccccggagagacagagagaggatagagatgagaggggagaaagaggatgacatatggggcccacatgggtcccaccattattattattatttttgtgtgtgaaactgacatgtgggtcccactggttttattatttttctggagcaaattgccacgtaagcgcacgtcagatcgagaccgagtcaaattagccacataggcgccacgtcagccaaaaccgctataaaaactgccgagagacgtaatctgcaccggttttgatagttgagggatccgttgtatctggttttgcggttgaaggacgaaaatcggattcgttgacaagttaagggaccttagatgaacttattcccaataaatatcaacgcgcctttcggcccaaatcttcttctccaagacacagcgcgagccattatcttacgtcacggcccaaacgccgaggcggtggtggtcaagtcgcaagggggccgaaggggagaggaggatccaaaccccaaaccccccccgatccccacgacgcgccgccgccccgcaccgagatggccgccggggacgccgccagggcgc

SEQ ID NO: 13409 - DNA, 1501 bp, Oryza sativa
aatctcggcagcagccggcgtgctatctcagccgctggctggtggaaagaatattcaatggaagaaacgagtaccttctgttctgttgtgttgttgtgttgtgttcatgattgtttccatgatcatttgcccagtacttgtggttaattgaatggtgacaccatgagcccatcaggggaggagaagaagaccccaggcaactagccaactaccataacatgattaatcagtaaacctatcagtgtcagtaggagtagtgctactaatctaatctaaatggagcgtcctagtcatgctacaatgcaattctgcaaaccacagtttacaactctgtttttcagaatacaaatagtctatcatttaaaatttatattaaaatataaaaaattatggagtactggagtactgtactattgaccacccctcgtttgatttctctctccattatcctcgatcgaccacattttcctacttatttaagaagttatagaagaactacaatcttttctacttaattttaatctaaactaaaatcttttaaatatgtccatattattgaacgaaggtaatcttcacctttccactctgcgatgagacattcattctatctttccgcttatatttatacttataagctaaattttaaattttgaagttttttttatcataatttatttttcagcttttaccttttagattgttataaaaatatatatataaaaattttatttatatattatttttcgtttacaactatgcgtttggatagagccgattgcttgagctaactactacttcattcgtctcataaaaacgaatttataattagatgtgacgtactatagtacgataaatctagacatatatatgttaaatttatagtactagaatatgtcatatttaatataaggttagttttttatgggacggaaggagggagtacgtgcctttccatcctcccctgttagcagcagtacgggcaaagcaagtgagagccgcattggccgtgggatggtgtactaggtcagtcacacgtactacgtgtgaccgtgagagccagccagactcgcagacgcagtgtgcaaagtctcacacgtgtatctcatagctttggaccagaagaacacatgtatgtaggggtgatgctaactacactacgcatgaggtgtgagggtagaatagggctgtgggtgtgtttagttctaaattttttctaaacttttaactttctatcacatcaaacatttcatacacacaactttttagttacatcgactctaaatttaatcaaattttaaattttgcgttgaactaaacacagtcagtctagaatggtagagggaagaagaagaggagaaatgtcgtgagaggaggtggggtccacagggaggtaaggtgtgtgatagtgacaactgaaagagaagtttgtcccttcctatggcactaatggtgttaatgtcttcagagacattggctgcctcttctttctctgatggactct

SEQ ID NO: 13410 - DNA, 1501 bp, Oryza sativa
ttttttgttggtcacaattaagataaagttagctaagcgtttaataagtctaacatgtgagctaagatgctaagaaaatactatggcaatagtaactgagacaataaatccaatatataactaatgaggaataagtaaggtatagcgtaatgtacgtgataagttgggattttcaacgaacctgctctcgctatgcacgatccgtgctaacccagacagagatggaatagccgagtagtagccagacaattcaacatcctctcacgcgttcctggaacgctagttgtttatatatatcgagcatagaatatgtataatcactttctagtgatactaatactactagtatcataccctatattttattgtgaatcacacgaataaatgtatgttaactatataaaaattatataaagaatatgaagatgatgatttgatatacttgtataggttgaactctataatgaaatgttaatgatgtgtgttatgtttgcacgatatttaagggcatgttcggctgcccgttaacgcggctgggctgtagcagcttaaacaatgctactattgatgattcagttgttgcagacgtgagatgcaacgctgcggctgcacagcaatggctgccaaacacagtcttgggtgataatcaatctttgtgataatcaattaagatgttttaaaatagtaatactattgggtgatgatgtacatctttgtgataatcaatctggaaatataggaagaaccgaaggattggtgcagattccgagaaggcacattagatacagaaaatatcaaaagaatccacaatgcatacgtgatgacctttggctattgtctgcatatttgtagctaagagctcgtttgcgtcaagccaatgtgaaacttaaagtagggccaaagcgaaaaaggatattactataaaaattagagaaggttatatatattgaccctgttttgaaaaagagaatagaaatatcatagtaagtctcaaataaatttcacactaaaaaaagaggagttctttgattccccccctccccccaacaccttgatggcacgagagggcgaggagatcatcgcccagaaacatagtacgtggtcctcccgccaagggagctacaaactaggcttcgcgtgcaaactcacaataatttcattagaaactatgttttttaaattgacgtgagaaactatgctaggaaaatgtctaattttcctatctcaaccgtaaatctaggcataatacctccctcaaatatcaaatcatatcagtttaccttggttttgaaggtggcttcatctgacatggtgtctacatgactacgtggcatcacaattggaaaaaaaagaatttaaccagtaagaaccgaactctaattctttctcccctacctcctctctctagcatcgctcaatgactgtcccaaagctcgctgacctccccactactccctccctcggcaccagccttcactgttgtcggtgatatgggcccggg

SEQ ID NO: 13411 - DNA, 1501 bp, Oryza sativa
aaattaaatgaaaagaaatattgtaattgattgagaaggagtagttgaagaaattaaatggttgaatgttatatatgtatggttggttgacaagataattaatacaatgtaggttaagaagttgttatattttaagataaatttagtacgttataagttgcttttatcttgggatgtgggagccgagttctatactccatgcatgcatgtccccattgattaattatttctttacttaattatcacttaggttttattatgtctttatgatattgtggtctaaagcaggcgcatgtgtgtgattactattttctactactataatcatacagtaatgaaactattaacttattaattaacttattaattgtaagagcaccttttttttagcatactgataacatttttggcgatcaacattaatattttttatatatattaggtacttaaatttgaggtttgacagcaggcatagggtgtcatatatatatagtagtacatatttttgcttgaagggttccctatatttaagaatgctatctcaatgagtatactggcttatttgagtagtcataaggaccacatggtgacatggacatgaaaatactcaaatggtcgtcatacatacaaacatacatatattttttatgccacactttagtagcctgacatattttattgttaaaagtattttgcaaaagaaaatgagtggtcaaagtatgaatagtgtccgttgtcagtttatttaaaaacagatgggtactatccctaaaattatttttttagcacaaacaaagaatggatttgtttcatgtgaatcgtaacttcccaaaatgaataatctgatttaagtagttgtgttataccttggtggaaacctagctaaataaatgttgaacccgcaacaattatgatctcatatacttgagaaaatttggaaaatacataatacataaaaatcgtgaattgagcgtagctcaactggttaggttcttcgagataaaaacatgtacatacgggtgcttgtaaagggtgcttgtatttacagttaattgttcttttaagtagttaggcgatgtattaagatccgtcggttcagtctttagagatatggtgtgtgtgagtttataggtatgaatgtacgtatatctatatgagcgtcccgtcgatactgtcttttgaaaaaataaataaatataaaaattaacgagtagtattgatcatctaatccatccatatatatacatatatagagcagaattgatttcattgcatacagtatatcttcaattgattgcctctctatttcttatctgcctcgttgcatatatacccttttcttttggaaaaagtacacatgaggtccctcatcttgtcaccgaattacaaaatcattcctcaacccaaaaccagatatatagcatcccttaacttacaaaaccgggtctctaagtccttaggtagttttgaccccggttttgttctacgtggcagctgagtc

SEQ ID NO: 13412 - DNA, 1501 bp, Oryza sativa
catacacacgtaacatccgataaatttaatctgtttttaaccgattccgcaccatttttgatatccgaaacaatcctcgtctgtattcgcatccgtacactatccgcacttgctccgaatctgctccgttttcacccctaaatttaactcaaaactgcagctagtgtaactccacactaatgtgcatctaaactttaaaatatgtagttttctgttaacttttttacccattagtttttgacttcaccttaaatctacaggttcggaacaaatttagtaaaaaaactatattttgttatatattgtattaaatcagctgttttgtgaaattaagatgtatgtagtcttgtaaaatttaaatatttatcttactcaaatttgaatatccttacttttagtactttatccaatttaatagtagtactacatgtactatgtagaaaacggacaggtgtactcagctaaagcaatagatatagagcaggataataaaccctccatttcgtacttttctctttttaaagtttaatcaagtttataaaaaaatataatagtatttttagtataaaataaatatattattaaaatatactcaatgctagattgaaactaatttgagaatttagatatcggcatatcgctaaattttcctatatttttttttcaaactaaacaaagtttaacaaaagtgttaaacgacgtataatatgaaacgaagggattaatgagcaataactataagcaaccatgttaggtaggtgctcgcacagtctcttgcaagcttagttggggaaaatttttaagtttagttatcacatcagatatacggacacacatttaaagtattaaacgtagtctaataataaaataaattacagattttgctagaaaattgggagacgaatttattaagcctaattaatcatcattaataaatatttactgtagcattaaattgttacattatagcgtaattaggcttaaaaattcacctcgcaacttatatccaatctgtttaattggttatttttatatttaatatttcaggtaggtattaaatatttgatgtgacagcttttgagaatttgccggccgcatacgaggagaatacacctgcgttttcgaatgcaggtgtcgcacgggcacacgtacgtgtgcggcatgcagggagcgacgtatgccacgtggacggcaacgctgcgtttgctggcgcggatgcaccgtgatccgtgggtttgacctgtacgcttgcacatgcgctcgatgcattgagattcggcgagaagaagatgcacatgcgttgtgtgtgtgcacgcctgcatcgttcatgttgttggcactatgtagtattatttacctcatccatcctaaaataacaatgtttcatactaatatataaggttaattattgccagtgagagggagatattatttttatgttttcagtgatgccgacataagaaacaacacattcatttacacatttaattgatgattaaaa

SEQ ID NO: 13413 - DNA, 1501 bp, Oryza sativa
aaagtacttttaaggataaaacaactcacaacaaaataaaagataatttcataatgtttttaataagataaatggttgtcatacttgtgttgaataattaacgattatctatttaaaaacgaatgtactagtatttgttatttttaggctgctaggggagggacgcgtagtacgcgtcgccggcgcgcactcttccgacaagcccacatgactacgtaaggcccatgcaactagcgggacgtgttttgattttttccgtggatttctcaatcatacgcgcataattttttttcacaaattttttctcagcgtgaatttttttaatcacgtgcacacgaacgtacagtaactaatccgtccagataatgatgataattaagataagatttttttttaatatttttttaagtaatagattgaaaagaaatttatacgtgaagtcaaattctgaaaaaattcaacctagatttgaaaattttcaactcgaaatttgaatttttgaagtcaaaatttgaaaattttcaacttattatctcggttttgaaaactctcaactcgagatttgaaaactttcaactcgattttaaaaactttcaactcgattttgaaaactttctactcaaatttgaaaaattttcaactcaaaattgaaaaatttcatctcaaattggaaattttcatttcaaaattcaaaaaattcaacttgaattttgaattggaaactttttactcaaatttcaaaatccttccactacaaatttagaactttcaactattttaaaagttgtaactaaattatgtatacatggtttttctttaaaatagtgctaatgatgacaattgacactaattacttaattagtgggtgggcctgagcgctagggagtcgacacggcaaaagtgcgcgctgcttctcctcctcgcgcatctgcgcgaagtagggtgtagtaggtacacccgggagggatcccgtctaaggatgaggaacacataatacttttagtgaaaccttgtacaaatcacaagtgcggaattgagcggcttaaaacaataaacaataagtcacgtacgaagtgagcgtaacttaattggttaggtttcttgtggtgaaactaacccaataaggttaagttataaacttgacataggtgttcataattataattaattattcttttagtgcaaggtaatataggtgtgcatgtgcgtgtgtttataaggatgagtcatgtcgagtttcgtgtctgttacgatccattttacaccgggccgggctgccaaagtgccaattgatcgagggccggatcagcttttgccgtggcccgtgaggcggaggtcgacgtacgtgacgtgttttttcaccgcctccgagcgcgcgtcgctggacagaggtggatatggtgccgtctacgaactgaccaaagaatggcacgcagaagtaggaagttgtgagaacactatgaccaatggcgagctctgcaccggtggcacacgtcagaga

SEQ ID NO: 13414 - DNA, 1501 bp, Oryza sativa
tataagaactctgatgaactggttcatagttcagtgatgtctgagaaagaaaggaaaggagctttgggtcctcgtcataagcactgtctctggtgaaccaaagagttagggtgagtctttcaccttcagtcacctgcaaaaatagctgcactttattaataaacaagaaagggcacgcatcaacctcagaagaaaaataaaatcccttgacaagataatactttggccacatatgaattgattgtttacaaaaaacaaggtgcaagggaaaaggatagacataaattaggactaaatcattgataacaaaatgtagcctcaattacctgttgcaacttagagcacactcaaacaaataattttatttgattcatcaaaacaacaataatagtaacagatatactaacatcttgctgattatccaagtgaaaacagaaaatgtgacaaacaatgccaatgaaaagaataggcatgaacccagtacagaaacaatcaactggcccatgcaggaaacagaaatgtacctcatctacacaatgggtattactattatctgcagtgtagatgacaacatcctgaaaacaacagtacttctcagaaattccaagaatatatattcatttaattattaaaaaaaatgcatgcatgcaaactgtaaatcaaaatgcattagcttacaccagcaactggagtaataaaggaaggttcaccatcctgaaactgcaaaattccacctttatagtccttcccatgatcgtttaagtagcacactgccttttgattgaaagatggaaatggtgcattccatgccatattttaattcagaaggaaaaagggtcagaacaagaactgagaagagtgttagtcaaaaaaaagaactgagaacagtacatttgagtaaaaagggccgcattgaaatataaacaactacaacaactgagaaaatggaagagtatattttggacaggacctagatagtcccacaaacagagataaattactcatacaaaataagattaactagataatcatacaaaaaaaatgcaattcacaatatcagaagcaccgaaatgaatgcttgcatgaaatacagtttgttggaacagacaaaacaatatgtagacatgaaaacaactataaaagttgactaaatacccaaagatagattgaccctcaccgtgaaggctctttgcctaagataaggtttgttgtcatcactgtgccacccaatagaagctcccttgcaccaactgcagacccaacagacaggattccaatacgaatagcattttagtgtcaactgtcgagtattttcagagaagaactcttgaactagctttcgggaagcaagtgagtaaggtgatgacgtttttatatggtaaaacatactgttcattcttatgcagttgctagaacaataagaggggctgtttttagatctcaatgttttcccatgtactaatagttaggaaaagctgtcataacaatggttaggaaaagt

SEQ ID NO: 13415 - DNA, 1501 bp, Oryza sativa
ctagcaaaattgtagggtagaacgacataatagatcctggcttctccatttaattcggagaaaaagaggtatttttgttcatggaacattgatagagaaaaaagccgactatcggatttgaaccgatgaccctcgcattacaaatgcgatgctctaacctctgagctaagtgggcttacataacagaaatagtgtaacaaatagaaatatgtatagtataggaaatccgtaaaatgtcagatcttaattattaatcttagctattaactagttcgaaattggaagttctacttagaaaaaaatactagaacttcataaaataaagttagatagatttttttgaactttcttttttctctaattcgcaaatctatttttctaatagaatctattccaatttctatattgaatttgattttagatatttttaatttgatatggctcggacgaataatctaatacatggaaaagaataaataatatatattatatacgaaaacataataaagagaacatgcgaatttcttgtattttcagtccatcattatagacattttttgagatattttgtttttttttgttatttgctaataatttaatgattaatatttcactaaggagaacatagaatcatagcaaatgaaattgctaattctgattagcaaaaaaaaagaatgaatatcaagcgttatagtatgattttgaatactctaaaaaaggaacgcggtaggtgggggagagaaaaaccttgggatatattgattcgcattgaattgcaaatacatcaacgatagaatcaattcaatgctgaattgcaataagcggagtctctcaactagagacgaaccgctagactacatagagtaatgaattcaacgattcaaaaaaaactaacagatggaggaaattgcacaaggaatcctggtctcaaagaaaaagaaaatggggatatggcgaaatcggtagacgctacggacttgattgtattgagccttggtatggaaacctgctaagtggcaacttccaaattcagagaaaccctggaattaaaaaaggggcaatcctgagccaaatccatgttttgagaaaacaagcggttctcgaactagaacccaaaggaaaaggataggtgcagagactcaatggaagctgttctaacgaatcgagttaattacgttgtgttgctagcggaactcccttctaaattagggaaagaagggctttcgaaatctaatacacacgtatagatactggcatagcaaacgattaatcacagaactcatatcataatataggttctttaattcttttttaaaatgaaaataggaatgattatgaaatagaaaattcataatttttttagaattgttgtgaatccattccaatcgaatattgagtaatcaaatccttcaattcatagttttcgaaatctttttaaaagcggattaatcggacgaggataaagagagagtcccattctacatgtcaatactgacaacaa

SEQ ID NO: 13416 - DNA, 1501 bp, Oryza sativa
taaagaacctatattatgatatgagttctgtgattaatcgtttgctatgccagtatctatacgtgtgtattagatttcgaaagcccttctttccctaatttagaagggagttccgctagcaacacaacgtaattaactcgattcgttagaacagcttccattgagtctctgcacctatccttttcctttgggttctagttcgagaaccgcttgttttctcaaaacatggatttggctcaggattgccccttttttaattccagggtttctctgaatttggaagttgccacttagcaggtttccataccaaggctcaatacaatcaagtccgtagcgtctaccgatttcgccatatccccattttctttttctttgagaccaggattccttgtgcaatttcctccatctgttagttttttttgaatcgttgaattcattactctatgtagtctagcggttcgtctctagttgagagactccgcttattgcaattcagcattgaattgattctatcgttgatgtatttgcaattcaatgcgaatcaatatatcccaaggtttttctctcccccacctaccgcgttccttttttagagtattcaaaatcatactataacgcttgatattcattctttttttttgctaatcagaattagcaatttcatttgctatgattctatgttctccttagtgaaatattaatcattaaattattagcaaataacaaaaaaaaacaaaatatctcaaaaaatgtctataatgatggactgaaaatacaagaaattcgcatgttctctttattatgttttcgtatataatatatattatttattcttttccatgtattagattattcgtccgagccatatcaaattaaaaatatctaaaatcaaattcaatatagaaattggaatagattctattagaaaaatagatttgcgaattagagaaaaaagaaagttcaaaaaaatctatctaactttattttatgaagttctagtatttttttctaagtagaacttccaatttcgaactagttaatagctaagattaataattaagatctgacattttacggatttcctatactatacatatttctatttgttacactatttctgttatgtaagcccacttagctcagaggttagagcatcgcatttgtaatgcgagggtcatcggttcaaatccgatagtcggcttttttctctatcaatgttccatgaacaaaaatacctctttttctccgaattaaatggagaagccaggatctattatgtcgttctaccctacaattttgctagatacaaaacaataaaataaataatatatatacaaaaattcagatgttgatgaaattccatttttttgtggtacttttagtagattttactctgtttatcctttactttaattcagttttaatttcgatgtattctgtaatgtaaatacaatgaaattaattgtgtaaaatgaaatttcaataaaaaaaggagtcttca

SEQ ID NO: 13417 - DNA, 1501 bp, Oryza sativa
catcgtcggatgtcctgaaatcagatcgttgcccgaggagggcatcccagcttcactgaaaaaactactagcaatgcgttgcagcgtcgacctgaaggatcaactcaagagattagaagaatcaaaccaagatttacaagtattctacatctgatcacccaaggtaagacgtgatgtcccaactcctttgttttttactctttcatctgcagttgttcatatttaaactcttttttacctgttcgttgttactgttgatcatctagcgagccaccactactctcttttgaacaatgaagtgcagatacacattctaaagtcatttgaacaatgataaaaaatcaaatccgatgggaaaaaacaagaaattgctagaacatgttggacaatcgccatcttttcttactgtgcgcaacaagcctaaccttggcattatggaaactttgcagtaactttgcagtaattagatcgtggatgttctgtacgttgctttattgggagtgatgaccaaaccatttgccacacatagcttgtttttttcaagagaattacagttttgattaaggagcaacacccaaatgattgtggagctaacctcgtttgtctctatttcatcatatgttatgttacagttttgattaagcagtattagatttagatgagagcaactgtaattgtttatggttctggtaacacagtttcatggtcattagtaggagaattctttgaccttattaacttgttccctttcagcaaagcattgtggaatggtgttttttttagcctattcagaaccagttttttacataatggaagctttattaatctcagtaaatttcatcaagtgatacaattattctgagagcacattcggcttctgcaccaaagagtacacacagccaacaagaaagaaacaaaagataaactcatcatccaaaatagcagaaacaaaaagaactttaggagcccgctaaccgtagcctagaacgtcacccatgtgctggggtagaaaactactatatggccactaactctaattgttgacaaaccgcaatgatagtaccctgcaaattgaccttctgaagcatagcctatgagcggagccaatgtgtaatcaaaaagataacctgcaaaggagaagatatgttttttcctttcaaaaaccacattatttctgaaaagccaaatagaccaaatagtggtagttgcacctaataagaccaaagatctcaaattgcgtgattgtcttcttatccaatgcccaaacatatgagttgtactattagataaaactaatattcgaagcaaactgaattaaagaccaaaccgcgcgggcaaaataacaatcaaagaacaaatgattaatagtttcatctttgtggcagaaagaactagacttgtttcctctccaattccttttaatcagattatcttttgttaagattactccatggcgtaagttgtcacgcccgaaaattcactagtaatttccgaacttatt

SEQ ID NO: 13418 - DNA, 1501 bp, Oryza sativa
ttaagaagaaatgagtgaaagaagtccagggttttggaaaaatgctacttatgtcatctaattttggaccattttctatttttcggttgttaaatacaatacttatgttaagtgttttttctctctgtagagcaacttgaaagacaatgggatggcattattaagtcaagtgtcgttgataatggattatgtactatttgcccatttatgtaaatagaaatgatagaggccttgacctctctttttggaagaagataacatgacttgagaagcatactaacatagactatcttcatgatagtgtgagtgtgatgtgacgtctcaatgccatttgaaatctgtaggaagccaacgacatagtctatttgtaccaccataaacattatctgcatacatattcatactagtaccaagtttaaaatgtcaaatgaaaaagttggagagaaagataaacatatattggggttgagagagggacaatacaataatgggtggagaaagtggataagtaaaggaacaccaatatttgtgtggacgatgaggctatcatgttacgtatttttacctatctcgactgagggaaactattttaatcccttgaggggatgtctcctcattgtttgcatgtcacttaaatggttatgaaaaaattgaaaaaatttaagaagatgtattaacatgtgatatatcactccacaaacatgcaagttcaaattcaactttcacatctcacaatgaaaaaaacaaatttgactgtgaatatacgttaactagttgtaatttaatttgttttttcgttgccaaatgtaaaagttgaatttgaatttgcatgtttgtggagtgatatatcacatgttaatacatcttctcaatttttttttaaattttttcataaccatttgagtgccatgcaaataacgaggggatattctctcgagggatcaaaatccactccccctcgacagataaataaccatttttttttgcgaagaacaataactttttatgacattattaatacagatgagttttatatttataccaaacttcaaataaaaatatttagcagtatttgctactcgtgttaatctctacagtacaagttctcaagaaaattacactttgccccgtggggagttctaatcttccagtatttctcgtcgctctcgatgcaattgaaaaaaatacacacgagttgtaacgaacaaaaaggaaaaaccgcacgggtttatcatcaaagctggatctgcacaacaaacagcctcgcaacagaaagagaatcaccacgggacaaaggcggtgacgtgtcacgcggcgcggccccacacgtccgcgtgggcccggcacgtgccccgcggcgcgggggccacctggcgccgagctgggctcgcgcgggtgtggcgacgtcggacgcgtccaagacatcggcgtggcccgtggccaccacccccaccggcgggccccgccgtcgccgccgccgccgtctccctcctccctctcc

SEQ ID NO: 13419 - DNA, 1501 bp, Oryza sativa
acacttcttctcatcttcgtcgtaggggccaccatggccaaggaggccatggcgcagtcatccccatcgatttgctccctctgcttgctcacctgccgccaccaatcgagttggaagaccttgaggagaaggcagggaaaccaagagaaagagggtgtggaggcggagggatatggccgcgtccgtacccgctcgctctccaatatcggttgccgatggtttcggtattcacccgcatcgccactcttgccaaaccaagcttgcaccggagttcccactctggtttctagtgccccggtgccacattggagcggagcgccccatcccctccattgcttcctcattgacgcgtctacctgctgacaaaagatgggagagagggacaaggtagaagaggaaaagcctgcgaacagagaggatgggatcatgggacaaagggagaggatagaagaggaagaagttgatgccaatgatatgtgggtcctacttttttattttttaaaattgtgatgccacataataagcaccacataaaaaaacgactgggtcaacacgccatgtcaaccaaaaccaccatccaaaaccaccaagggacgtagtttacactacttttagaagttgaggatagtctatattttgttttatggttgagacacatgattctaactgatcccctatggagggatacaaagtgaactttctccactgcagaaacagtgtgagatggagcccataaatagttagttacccattaggcccatgtttattattttatatatagtttttccttggaatcagattcggaaatgtgtatttctttgtatcttaaattagtaaatattaaatctagggaggcaattagagtgttaaaaaagtacatcaaggaaaaatttatgcaatattacttgtgggctcgtaaaatagtgattaatcaatcttttattatgtttgtagatgaattttataatatgttttcatatacgtttgataatatgggacatacggaaggttataatttttcccgtatcctaaccttttatttttgcatattcgaattcgaatattactggatatccatttttctctccaatatctatcctttctacaggccttgggttgggtggtcagaaatacacgtcctatttcaccccttgttaccgcgcccttagctttcatgattttaggattaaatttattgtgaaaatcacataataagtaaatattttttttagtttatttttgagtgacgataggaaagggagtcttgcagattggaaagcatgcatctgtcttcactgaagcagtctttgataaggacatcgttcctttgcatacatacaatacttctcaaattgctatgcaagattacatagcatatactacaacttattttttaggaaatcctacggtttgttaacatcatattgttgtagatatagtctcaaatcagagagtggttttggatggcgtggaactcatgtggagcctatatagatggcca

SEQ ID NO: 13420 - DNA, 1000 bp, Oryza sativa
gaattgccacgtaagcgccgcgtcaatgccatgtcgaacgaagactgagtcaaattagccacgtatgcgccacattagccaaaaccgcccttaaaaccgccgagggacctgatctgcatcggttgtgatagttgagggacccgttgtgtctggttttccgatcgagggacgaaaatcggatttggtgtaaagtcaagggacctcagatgaacttattcctatttctggcgttggaccgtaatagtcagatgttatatgggccgattaggcccatagcttgtttcctttatcaattaattccaagagtgcaaataagcaagcaaaatattccatcaaaatattccttggcgggtgttgcagatctgctgcttggagttaacctttctagtttctaatcaagctagatgtgccacatctgatacagagagagcttcttggcagtgtgaagctctggaggtgctttaaaaattcttttttgaaattcatcagggacaatcacgttcttgcacaatatcaattattcttagactaatagctcttgaaactctactgtttctgttgcatcagttatctggtagcattttctaccagctgaacacacgattctacgtacattttaattccaattttcatgacaagagaataattccttttgatgtaacctacccgatctcctctctgaaagcatattatctgtttaaattgtaatcccgaacgatcacaattaacaaatcacatctcatttttttcaaccggcaaacattgcccctatcaataaattgcatgatccacactttttatcagtaaaatcaagtacagaaatcacaaatgccagcaacacttctacaggaagacaagagcatgttcaaccagtgccattggcaatgaaaaggaagcttcttgcattgctccttccagtttacattcacatcaaggaaccaaatagctggtagatcagagtagtaaaacaccagtactggctcatgggttatctgcatga

SEQ ID NO: 13421 - DNA, 308 bp, Oryza sativa
gaattgccacgtaagcgccgcgtcaatgccatgtcgaacgaagactgagtcaaattagccacgtatgcgccacattagccaaaaccgcccttaaaaccgccgagggacctgatctgcatcggttgtgatagttgagggacccgttgtgtctggttttccgatcgagggacgaaaatcggatttggtgtaaagtcaagggacctcagatgaacttattcctatttctggcgttggaccgtaatagtcagatgttatatgggccgattaggcccatagcttgtttcctttatcaattaattccaagagtg

SEQ ID NO: 13422 - DNA, 1501 bp, Oryza sativa
cgtagagcgacgagaacggcagcaggaagaggagccccgcgaggccgagcccgaacgcggcgcccgcgggcgcgccgggcaggcacgccaccgtcgcgccggcgacggccgcgcacgccgcggagaccgccatggcgaagcggatcgccgacctgcgccccgcggcgcggccgcggacgatctccgccaacgtccgccgcgggcgctcgtcccagcgttgttccatcgtttttccgttgtttgggtcaacctcgcagtcgattattcggctatgacatatgtatacgtgcgctacaactacaagcctacaacttgaaagtgtgtccgtatcctggtgcgacacgttacggagtgcaagccgcagtcggatatgttacggagtgcaagccgtagtcggatagtcggatgcgcgatatatacgcgcgcgcgcggcgacgtacggcgtcgcgtcgaatcgcgggagtctgcagggagaaactaaaaacggcgagaagatggtaagcaacaataaagacgacaacgacgacgacgtcgaagctggcctcacggtggcggcggcggcggcgagacggtcgtcaccggatcagccgtcgccatggtgggatgacgaggcgatctggctccgctgggaggagctcaccagcagcgagcagatacggaagctgaggaccacggtgaccgtcctgctgtgcgtctccgtggtaattgggctctgcgcggcggcggcgcaggcgatgttcgtcccggcgacgacgacggcgctgtccagcgccggcgtcggggtgctcttcttcctcgcgccgttctcgctgtacatgcgcctgatgctgcggccgtgcctcgtcgaggacatgcacaggggcacgctcgcttgcctggtggccgcgcccgtgctcctgcacaccgccgcggtggcgtatttacagctgatggggcgcggccaggtggcgttcgccgcgttgggcgtatggctggtggacgtggccgccgcggcggcgctcggctggtgcttctggaatgacaggcgatgaacctaaggtagattaggggaaatctctgggctcgattacgcctttgctgcttagcatctgttattacgtacgcggtacatgttacaccggcacatcggaacgtggtgcggttggtccaattgccggcgactagccaggagtgtgtccttgtgggctacaaagaggttttgggcctatctctgtgatctcctctcttggcccaacatatatttggcccatatggtagctgcctgacatcagaaatcctgaatccggaatcattccgttctccctgtccaattgttacagttgtattgcattcccacaccgtacaccaccaacattaccattactaaatccttgcagcttctcaaaatttaaatacagtgcacacggagaaaacctacagtctttcagcaaacagtaataacatactcgcgtacagcatacagtgtctatcaacagagatatttcacggcgctgggaagata

SEQ ID NO: 13423 - DNA, 1501 bp, Oryza sativa
gaggcgtgcggccacacgctcgggttgattgaagctggaggcgatcggcgttctcgatcggtggatttgaacactctgggcagggtggcccgggcctttcgatgagttgcgttcgacggggagatggctagacgtaacgctcgggtcgttcggcggctgggaagacggcatgtgacttgtcggcttcggctcgcgactagattgatggcgtttcaatcggaagtcggagcgggtggatcctataggctgttttggaggtgttgacgaggtatttgcacgatggaattgcttcaaaggcggcgtattttgtggcatatggctgaacaaagcctagggcgaatagagcagcatctagtagcggttcaatcctggagaggttttggttcaacctgtttttccctctagcagacaagaagtaaaccacatgggctgtagatcaatgacaacagttgttggtggagtcgtcggtggtgcttggcattggtgctagatgttgtcagagatacgaagaagcccaggaggtcagggtcgcggcggtgtgcgcgtcttgcgtcgaagccgagcaggtgacggagatcagggcgatgccgagaaggagctggctagggttttagctaggtcgtgcagggttcggtcttgagggtttgtggtgtggaagacacggacatggagtcgtctccggttcagtcatggcacggacacaatcgaagacaagcagtggataccaagtttcaacatgaaggggaatcggatgaggactacgattcgttcatgaatcggactcgatttttcccaaataaaagcagcagaggaccacgggattgcaacaacgcaatcgaaacaaatcacctagcagagggcgagattcgtacccgattttcacagaggcggaggtggtttgggcggtgaggtcacgggcggctggaggcgcatccttgcaggcggtgcgtggcggcgtggtactcggcggcgtccgtcggagctcgagcaggagcttgcggcggcggctgcagcggttctcggcgaggaaccggtgcaggtcttcagcggcggcgctccaaggcggtgcggcagcctcttgcggggccagcggctccccaaggtccggcggcgcgacggctcctcgcaggtcggcgcaggcactggacggcggcgggaggcggtggtggtgtgcggcggcgcaaggcagcggtgtgcggcggctttggcaacgaggcggcggcgcatcggatagggcggcagcacgtgcggtttctgggaggagcgagaaaggccgaaggaggaaaggggatcggctcgatctgtttccctttaaccgcacgtttgactggtttttttactagaaaagaaaaccgaccggtttttttctggagaaaaaagaaaaaggggttggttttgtccggctggtgactgtgcaagtttagtcggtgggtcaattaatcagggcagatcaatttaatagggcaacagctgttgagttgattatcgtcgatggcggtga

SEQ ID NO: 13424 - DNA, 858 bp, Oryza sativa
gatcatctccaagagtaataagcaccgagatgacagcccacgagatattccaagtactcacccaagatcctagtcttcacacctctccaaatcttcttctctccctctcaatctcactttctcacaagaattaggctctagattgagtggagaaggcaagaaacacttgggagaggctagcaacagctctaggttcgaaaagtgaaagtggaatggccaaagaacgagctggaaacgagctggttatgtataacagctaggtgacgtcatctagccgttactcataattttgaactggaaactagacaggaagttccggatgaactggaaactagacaggaagttccggacctggaagacaggaacttccggactacacttaggaaaatctttttctcaagaccggaacttccggacctggaagacaggaagttccggacttgcatttttggacatattgagtatttgcaaaaataactcctagggaaacttgacacttggttcacactaagagcacttgacatatctaagagtatcacctggaacccctcttaatagtacggtttttcctaaaaactcgattgcaataaataaactatcctatgcacttctcgagttccggtccgctttgattttatacttttgggggggtctccaagcatccatcttccacaccttggactaatacacctgaaagtaactcaatgaactcattagtcccttaaccacatttgtcattaatcaccaaaacccactaggggaattaatgcactttcaaccacaagccagcgtgggcaacggctgggcttgtagtatagcttttctctagctgacgctcctaggcaagggtgggcgtga

SEQ ID NO: 13425 - DNA, 1501 bp, Oryza sativa
atctccccttttatcttttattattagtattagtatttggttttatgtgttttatatcttgtttggtgatcaactttgccaacttgaattgttgtatcccttcctctctttgcttggttgtatgctatctccggagattatctaatagggcatttgatcccctttgtttgatatattttcttgaggccctttgtttgatatatattttcttgatgcagcagcgctttcatgttttgtcaggaagcccaacaccgttcattttttgtgcattctctatccacttctttactcttctccaattgcctttctcgtgcctcattatagtcacacacattgtgaaattgtgttgcattagcacgagtactacaggtgctgcaaggtcacgaatgatcaccagtgtgtgcatcttgttaatatttatctacaatctatttactcgtataagttctataattgcgttttagatacttttggtatgcacatgcatgcattgtacatgtttgttttacttatttttctatgcctagtgatgcaacacattttgctatgcctagggatgcatgaaatccagttttcttatttgtagtaactagctttagactagctgagcttggttctgaattgcctgataagatgactagcaatcagtgggaattatctagagattggatatttttacttgtgatgttggtaattttactttccctgttccatgttcaaattaggattaaggtgtttgcatttgagaataaacttgccaacatcggaaactttttgccaataaaattggttattgctatgaccagcagattttttattgactttggttagtagttgtaatttttcttgacagctttaaggtttctgaacattcattacaaaatttgtcttttgatatattgcttccatgaatgcgcaaaaacaatcaattaccagtttccacttctgatccatccattccatttggtttcgaaaataatatgaaatgtgaagtcagcactgtagttgagttgagtgtaccaccatcctttattgaggggcgttacacttttgttttaggtatatctttgtctcttttaagcgtggatctatagttggtgccttagagtaaatacattgctgcttctgattctagtttacatcgttcttttctttttgtgctttatatttagcagaatgtctttctatccaaagctatgagtcacttatgcagatcatatggtattatggttcccattgaaagtactgtagcttcaagtcacttatgatgttagtactgaaaaaaatgcggcaataatccttttgtagtcattttctcattgactaaagcatttctcatatcccctgcatttcactgtctatgtgctttttattaaccgttaggaacaccttgaaagagtcaccatgacatgtctatcatgtcctcgataaacgaatgtctagcaacctgcaaggttttaatatcaccttctatgttacctttgcacgttttgttatcagt

SEQ ID NO: 13426 - DNA, 485 bp, Oryza sativa
gctgctcgacagcatcttgatgtggtaggcccgcggcggcctttccccttctcccctctagcgctggcgcgacgtccctctccgccacagctcagggagacggccgacgagctcggcggtgcggagaggaggagaacgacgagttcgccagctagggtttgagcaggggcgtcgacgagactctctctggcacggcggcagctgtctccggcgacgatcgccgccgcctcacacagggtgtggggtgtgggcatcgcacagagccacgaagcgcgaagccacgacccccacagtgcaccgcgccgttctccccacgccgcgcagcaacttttctgacgaagaacgcacgcccagttttggctacacgaacctcgttaggtcacgctctaatcccagctggtagagaatctcctacgtggcgtgggttggccaaatgccacgtgtgtgcactgtgaatgccctaacgaagatagtaagtgtcgacg

SEQ ID NO: 13427 - DNA, 334 bp, Oryza sativa
aacccttactacgttttaatcagaaaagaaatgatcttactgacatcgctttagtcgctttactagctagctaatcactttggagtttcagtgctaagtgtcaaaaagcgcttgtactggcagctacagtacattacatgatttacatcttatagcacactagtatatacgcctagtaaaaatttccgtaattttgataaattgaccctttgaaaaaacttattttgatattgagccgtgtcaaaaactaattttaaaaatagaccattttctcgcgccatcgtacttggcgctgagctacaacgtattagcgccactttctttggcgttgaga

SEQ ID NO: 13428 - DNA, 1285 bp, Oryza sativa
catttggattgaagtgatttcaacacaagtttggtggatctcaattgtttgggaaaaaaatcctatcattttatttgaaatgaaggaatatgattaagccattccctaatatccacgtcttttttttctttgaaacgaaggaatatgattgacaaaaaaaactaacaatttgcttctcataccaaactaaacgaattcatacttcatgcttttatttttatatgagaagccccatgcattctctctcgcgcacacactcataaaaaaacaatttcttctaaatttctatatttcatttcctacatatcttccaaacacaaactctttaattcatgtgttttataaaccacacttcaagggagatctaattaattaatgtctttatagtccattggttctcaacccttccaaattccagtatattggcagtaaaattttgcactaccaaatcgttgataggggtaaagttttgttgtcaatgtttggtttgttaacaatattgagccaaatcttataatagagtgaataaagttctaagaccctgtttagatgggactaaaacttttaagaccctatcacatcagatgtttggacactaattaaaaatattaaacgtagattattaataaaacccatccataatcttggactaatttgcgagacgaatctattgagcctaattaatccatgattagcctatgtgatgctacagtaaacattatctaattatgaattaattaggcttaaaaaatttgtctcgcgaattagctttcatttatgtaataagttttgtaagtagtctatatttaatactctaaattagtatctaaatatagagactaaagttaagtccctagattcaaacaccacctaaaaattgtgtcaaataaagcataggcattaccaaataggagtagttgacatcaaaccaaactatcacatttatgatctgagctaccgataaatttatagggtatgttttggcatcaatctaaaacggtcatctgactgactgaacccattttgaaatgtgattttctttccaagtctttcttttttacaaaattcgtgtgattcaaaagaatcctagttttgttggttcatccgatgtactccggagtactaaagaggtggttaggagcaatatgcattatttctgcctacacgaaataccagctagtagatgccaattccacaattcccatttgcattagtcccagaaagggacagtgcagaaatgtcggtggccaggagtactactacttgtactatcaacagtgcagca

SEQ ID NO: 13429 - DNA, 1271 bp, Oryza sativa
gggataagattgacagcgactgatcaagaacgatgcgcgcatatcggggtgaacttattggtttgtataagctaccgggacaaaagatattttagtcccagttgtttataccaaccgggattaaagatattcggagccctgactcatcccaacaactttttaaaccaggactaaaaatgatctttaatctcgattagtgttaccaaccgggatgaaagatcaaaaagtttttaatcgggattaaaaatcatctttagtcccggttcctattcaaatcgggactattatggattttggacgatggtttctctagtagtgaaatactaaaatatgtccacacttgcagtgtgaatactaacgtgtatacatacgtacgtataggctcgtgtttatatataatacgacgcattcatcataagcatgcatgtaaacatacttgccgaaccagcacctctagctatggctcggaagatgtatagtccgatcgatctcgctggcaaatagcaatgcggtaaaaaagattaaaatatatgtcgcgacgaatagtctgagctctagaacatgtcacgttccaccgatcgagtttgttagaactctagaatttgttatttagacgtctccgtaactcatactctatctgttttatatattataagacattttcaattttttattttcaaatttaatcaggtttgaagaaaatatagaaatattttcgacgtaaaataaatatatcataaaaatatacttaatattttatttaatataaaactaatttgatggtggagatgttgttatactttcgtattaacttagaatgattcttcatactccctctgttccttgtttctttctgtttgacacgttgcaacaactataaaggtattttttcggacacctctctttattttgaaaggtgatccatatgaaaaattcattgatgatgttcgatcaaggcctgtttgtcaaaaccgattttcgcagacgagtttcttactaggctcctttgagaaaatagctattttgatagacagatctcttgattaagagatatgtctacgaaattgattttcacaagggggtttctcttctcctcctacctgttgcacgctcccccatcctaatatctttgttcttttcctctcccctttgcattccctctcttcctctcttttatttcctccttcgcactcccactcccactctcactcccctcactcactgctacttttcctctctactcttctctctctcccaatgggtcgactagc

SEQ ID NO: 13430 - DNA, 1501 bp, Oryza sativa
ggaggcggagctcctgtacgagcggcgcgaccagcggtcactgccgcaccgacggcccagccaccgcagctgccttctgctccgcctcttctgcgtcggcaggttgctgttgccgtcggtgacgatggcgccatggagttctgcttggaggtaattgtggcgccatggattagcctacgccgcgcgaggaagacgattggttcgtcgaggtcagcatccttgttggtggtcaatggattgaaatgggtttgagtggtttggaaaggtggattgaatccatatgaggggaatggattggtttggtttggactgaggtagaaaatgggttggattggtttgggttctaaaagttgatttgtggactggattggtttaggctactttaactggttgtcatggtttggactgggaatggtgcgggttttgatccattggcaggcttatgcacacatctcgtgctatttgccacatgttttaacaagaagaagaatgtaaagttccatgtaaatcggtagcactgtcttggataccgactgtttcacatgttctagaataatagagtacatttatgactccgcgttatagatatgttttttttggtaattttataataatggttagcgctatttctttagctaaaattaggtaacttatgtgataaagttctgcagcacatgaatatattgttccttgataaatgtttgtattggcgtgtataaaagaaatagtgatacaacaacttcatgttatttcctatgaatataagttggatggattcactagtcactactattgttatttaagagagcaattcgatattttacaatatattaaaaaatgtaacacacttttatatatatattgaattttcgaggagatacaagcatgctttttctgtgagtgatatcaggagttaataaagtatgttggttttttttttattatttttacttccataacgggggatggaaaaaagctaccgaaaatgtgccacacattaacaatgatggtatcatgaatcactttaaacacaaaaatacaccataatagacaaaaacatgccatgcatattggactaattaagtttcaccaaatctttaaaaacaggagtacaataatagttacttgttataaatctagtattctaaagccagtgagtattcttgcaaatcaaaagagtacttgacgcgtggcacgaaattagtgagacatgaataacccctacataatgcgtaggagtctgcagagctagctaactaggcaggcccctttgtccttttgttgttgttgggccactaactcaggtactgtaagatcaagggggccgactagaggagggtaaataggcggttttaaaacttaatggcacttaaacaaaactaacctaagttgctaggcaaggtaaggtgcaaggttaactaagcaactaagttaagttttgcaaacctaggtgatatgggctcaaatatgtctctatgaatgtaaatagcacaaatgtaaa

SEQ ID NO: 13431 - DNA, 1501 bp, Oryza sativa
gcaccgccgcgatgtcctggatgacgaggagctgcttgtccgtgaaggccagcgtggggcccaccagatgtccctaaagacggtgtgaaactgacatgtggggctcacgtggaccccaccttttttataatttctgtgtgaaactgacatgtgggtcccacaaggtttatttatttttttgggttgaattgccacgtaaacgccacgtcaatgccacgtgggacggagacctagtcaaacaagccacgtaggcgccatgtcagccaaaaccgccttcaaaaccaccgagggacctcgtttgtccggttttcaaaagttgggggactggttttgtggtcaagggacgaaaatcagactgggcgacaaatagaggaacccaaagtgaacttattccacagtattttcttcatttgggccagagactagtggacctttttcttgacttgtctgggccaaagcccatgcctgacttgacttcatggtgtaaggggccgatttttgtggatgcttattctaaacagaataatttgtcttttggagttaaatatgaaaccaaagcatcaaatatggatcattatcagcaaaataatcatttgagaattttgcaattttctcatgattagtaaggtgaccaacatctgtggctactctattcctaaaattaggagcgcctctttgcactaaaatggctattatttggtagagatatttccatcagaaaaatattactcccttaataatactcgttatttcagataagaacatgttttaaaaaggaaactttaacaattattttctatataaaaatatcaacaaatttataattttattatattagtttctaagattaatctatgcctataacctacggttcatatttatgaagtcttgttcggttaacaatcaaactagtgggtttgaaaaagattgaggagcataattccacgttataataggtgtggaataaatcattttaaaatatctcttaactcttttatgagagggattaactgaacaaggtgcaataaagcaaatattttgaaaattattcatagttcaaaactaaaaatatactccctccgtttcgaaatgtttgacgccgttgacttttttaaacatgtttgactgttcgtcttattcaaaaaatttaagtaattattaattcttttcctattatttgattcattgttaaatatatttttatgtaggcatataattttacatatttcaaaaaaaaaattgaataagacgaacggtcaaatatacttaaaaaaatcaacggtgtcaaacatttcaaaacggagggagtataatatgtgactataaaaatggtcaccatatccggattgggcttaaacccgatggcggccgcgggggaggggggcacggcttgcttcccatcgagggcgccgagctcgctgccctgtacgaccacgcagcggcgatgaccggcagagatggcggttgattcttcagtggcgcggctggccgaactgggttg

SEQ ID NO: 13432 - DNA, 1501 bp, Oryza sativa
tcatcgtcagctagctctgcatattaaaaacataatatgagttgtcaagtaaagttagtgcaatgtaataagatgtttttaatttacctatgagattcactattagtatttcctcttgcatcaatttagtggaagatatcaaaaaacaacagaagatattcaaaaaggaactatttggatggaaatatgcatatattgatggattatcaacacccggaagctaatggtaaatacaatttatttttctcgatagcctagcaacataatttcattaggataaaacctttattcgtacctaatatatttccctcttgctaagatttagctcagggtactcttcattcaatggcctagccagatccatgctgcgtgttaattatgacatgggttgtgctgtttcttgttggagaaaatcgttaagtatctcctggcattcatgccgctgccatcaacattctttcttgatggctgtgagcatgtcatattttatctggtgttatcccagctgatgagcatcccattcgattttttttctttgtttacattggttaagcttgatgcatttttcagatttgcttccatggatcggtttggtcaggtagtcttgttgcaatgcagagttttagaaatgaacggttcatatacttcatatcatagttgtacatagtggtttgttctaatcattcccatctgattcttgggagtagccaaattagtacatggtcagatattaggaaggaagagcagtataatatctatgtgcagtttagttctaattgaccggctattctcacacgttggcttttttattgactaagatatcatttttcttctgttttcactgcagtccaaatgtgctggtcaattcataatcgatcatcaggcctggaatttgtctcaaggtatatacatggaatagtgttccaatatgagtagtgactaaagcagattaatttgaattgtgaactcttttaccaagtgaacagagactctgtcaaataatcaggtaagtactaaaatcctattaatcactataaaattacaatctcatttgatgttgccttttccctggtgatcataggagtgacccttttttttcatgcttcaaaggtatatggtttttgtataaaattccatttctcagtatagaagttaaaactctcatttttgtctgaactaataaactattgttcttctccaagatttgttcactaagttgcaattgatagcacatttttacattttcttggcgcgtccatttgtgcctccacagttgcctcgtatgctaccactgacatttcttattattcattcctatttcttagagaattgtatttatctatgcaaaatcgtaactggatgtactgaggattctataagtttttaaagattaccgtgaacgcatagtgtactgtccagagaattactcagattcatttatatctttaatggattggattccatgtaaattcagttgtaatcctttaagatgattttcagt

SEQ ID NO: 13433 - DNA, 1501 bp, Oryza sativa
aaaatattaacagttaaaaattatacttgacttaggtttagacttataataaactaattaaaacgataagtaagttaaaattaaaaatatatttaaaaatgttcagtaggtgtgtgtgacaggtcctgatcgtttccactacagatgaaattttggattttcgtggcatgctttttaaaccgctaaacggtgtatttcgtgcgaaaaatttatatataaaagttattccaaaatatcagattaatccatttttcaagtttgtaataattaaaactcaattaatcacatgttattagtacctcgttttgcgtgaaacacttaatcttcatatacgttttcatcttcatattcaggagattcaaacaccaccttaggtttagactaatactaataaactaaaacgataagtaagttaaaattaaaaaaatattaaaaaaatatcagtaggtgtgtgtgactgtgagagagaaaggggagaacctgagactgatgagagggagagggataaaacaaatcaatatgaggcaaagctcccaactttgactgctgcttagcccaagtccaagtctttcttcctcctccgacctccccccatctccatctccgtgctcatctgccttcttctctcccctttccccgtcgcttcctgcctggatcgcacacacaaagagatccctcgcaggcggagtggtgcttcccctctcggatcatcttcgcctctgcaagattggcaaggtatcatcttttcttttccatctcttttctttttttttttggttgagatgttgtgtatgtatgctaactagggtaggtgataactgtacttgttcttgttgcgttttgcgttcgagagtgttttgactttggaatcgtacatcttgccatgttttttccttcctgatttgttgtcaggaatagcggtagttttggtaggattaaggttggttgatgattcggtttaattaacgctagttgcggtatgtatgactgtatggtttcatcaggcctggtgctatttcgccctcgtcatgctgttttccccaatcttgagcttaggcatgtttgcatttacagaattctctcagcactcaatttctgtccctggggtgtaaaggcccagtttttgtcctacttcctgttgattgttgctgtaattggatcctggaacagtaaaaatgcttgtttttttagatttgatatacttgtcagttcatgataagatcttcccttcacacatgttagctggtgtcattttgcataattcaggctccaaagttttttctgtccttatttcagtactaaaattattgcttgaagcaagggaaagcatttcctagtcaggaaacttaagaaagtaattgatagttttatacctgttctaattcacagtagttagcagccattcctaatggatcttctcggtccaattctctatttgtgtttgtgttgcatggaggaagcatgaattagctcctaatttgttcccactgcattgcagcaa

SEQ ID NO: 13434 - DNA, 1501 bp, Oryza sativa
gatataattattcatctgaacacgtaagtccttgactatagccgtctcgaaattaagttttccagagtacttacactcccagaaggaatggccagacctgtgctctgatacttggctcaatcccctgtcacagaagcacatagaacaaaatcatataactccttaacctacaccgaatcatggaaacataatagtagaatacttcatccgtttcacaatgtaagactttctagcattgccatattcatttagatgttaatgaatctagacatatgtatgtgtttagattcattaacatctatatatatgtaggcaatgctagaaaatcttacattgtgaaatggagggagtataaacgaaaaagcaaaactctcttactccgcttcgaactttcttcagaagcttcactccgccgtccttaagcttcccctccggcgtgaacaagctgacccattcatggggcttaagcgcggccttcctccgccgccgccaccacggcgatttgagcccacctctgcaatcaaagcacccgctagcaactcagcgaaaggaagccaggaagggaacaccacaccaggcctcctagaggatggggagtaagggttgggaggcgacgaacctgcgggaggagacaacgatcacgacgagcacgaggccggcggcggccgtgacaccgacggcgacggcggtgttccatcggccgccgccatgggctccgccgagggggccgaggaggcccgcggcggcgcgctcgacgaggccccacgcccacatcgggcgccgatgcccgacggatcgctccacggctcccgttccggcgcttcccccttcgccgcagctgccgccgccgccgcgatccccctccctctgctctcgcgatggatggattccggccacctgatttcctttttccttttttttttttttacaatttccgagcggtttcgaggaaggggtgcgtgtaacacgtcacacgtcgtgtgtcggtttggtgcctagcaaaccaggccactagggcaccatcaacattaacggcccaacaatagcccaccacctacaacgggctgttcacaccagctacctaggaaaagaataagttcattttaggttcctcttctcgacgtcgaatttcagaaacatcataccatatcctttaacttacaaaatcaggttaaagggggttctaagccagtatagctcctggtttcgtttgacgcttgagccaaaacgacacgtcggacgaaacctatgctaccttgggaccctatctctactattatagaaattgaagatgattttaccggtattttggtacattatccgtgtatgagttggtttttaagtttgtttacttttggaattacatatccgtatttgagtcagtttttaagatcgttcacttttggtaatacagaaggaatcatataagaaatctgtttaaaaaaactcgcacgctaacttgagacgatcggactcctaattacagctcatgattttctaa

SEQ ID NO: 13435 - DNA, 1501 bp, Oryza sativa
tggttgcaggcaagactctgttttcagaagggctacagggacaatttcgacagcgcttgcatgctcatctgttggcaaatttggaaagatcgcaatgctagagtattcgatcagcgagtcagcagaccagaccagcttgcagaggctattaaggaagagattatgatctggaaagaagccagctatttcgcgagtagtagctcataaaaacttctcttccattttttttcgttctgtagctgttcctagcttatgggtgcttgtggctaggccatagcatcatttcgacagcttcctgtcgctgtaaaaaatgttgggttcggtcgtttggtgtgtcgaatgggtttaccaagatgcaatatctaacgtacgtacgcaaggatatcatgctacgccacacaatctcttcacgtgctccttgcctcttgttatgcgtgatgttggtgggagttgaatttaatgggctgttattgtagtgggcctattgaggtggatgtgccattaatgtccctaggtgaaataagttcacttttgctcctttgacatagagtttcagaaacgttcttaaaccgcaataacatatatagcgtgtcctttaacttgcaaaattggtttaactggaaaaaaaatacccgtgagttgcaacgggtgaagtctattttaatcttattattgttatttaatttagttaaaatgaaattcacggtgggagtccacttggatatatatatttttagaaaatcatgagctgtaattaggagtccgatcgtctcaagttagcgtgcgagtttttttaaacagatttcttatatgattccttctgtattaccaaaagtgaacgatcttaaaaactgactcaaatacggatatgtaattccaaaagtaaacaaacttaaaaaccaactcatacacggataatgtaccaaaataccggtaaaatcatcttcaatttctataatagtagagatagggtcccaaggtagcataggtttcgtccgacgtgtcgttttggctcaagcgtcaaacgaaaccaggagctatactggcttagaaccccctttaacctgattttgtaagttaaaggatatggtatgatgtttctgaaattcgacgtcgagaagaggaacctaaaatgaacttattcttttcctaggtagctggtgtgaacagcccgttgtaggtggtgggctattgttgggccgttaatgttgatggtgccctagtggcctggtttgctaggcaccaaaccgacacacgacgtgtgacgtgttacacgcaccccttcctcgaaaccgctcggaaattgtaaaaaaaaaaaaaaggaaaaaggaaatcaggtggccggaatccatccatcgcgagagcagagggagggggatcgcggcggcggcggcagctgcggcgaagggggaagcgccggaacgggagccgtggagcgatccgtcgggcatcggcgcccgatgtgggcgtggggcctcgtcgagcgcgccgccgcgggcct

SEQ ID NO: 13436 - DNA, 1501 bp, Oryza sativa
atttacgcgcaatctctgtaattagtttttttatctatatttaatactccatacatatggcaaaacatacgatgtgacccagtaaaaactaaaaagtttttgtttcggaactaaattgtctagttctccttagcgactgttaaagaagataaagtaaaaacttatagctaatctattgttaaaactcaaactttaaattcaaattcactttgagtgaaatgccagcgaaagtccattggaaagatcgtgcttgaattcataggcggaccttagttaccctggcttgttgacctaccagtgctaccacagtacaaagtataacacgttgaggccaagtttagatctgaagtttttcttcaaacatccaacttttccatcatataaaaattttcctacacacaaacttctaacttttctatcacatcgtttcaatttcaaccaaacttttaattttaacgtggactaaacacaccctgaatctgatcgtttgagctttattttttcaggggaatcgagctttggttaataggccgtcgagaaaaggaatgataaaactaaagtaatgtatggttatatttgtattatcaatggtttaacatgcaaatctgcagaataaaccacgatgaagaaagtacaaatcaatcaattataaagttttaaaatttaattttaaattttggctgaaatgaagagaggctaatgcgtaattaaggtcaaattcatcttaaatacagaagtaactgaaattactattttccatacaccatcatctattttttttaaacaccacagaaggtattgcaatttgcacatgccaaagtacagaaaacaagctgctactggagtaccgtatttttttttctaaaaaagcatcaagttatatgtaactaaggcctggtttagtccccaacttttccttcaaatttccaacttttccatcacatcaaaattttcctacacacaaactttcaatttttctatcacatcgttttaatttcaatcaaacttccaattttagcgtgaagtaaacacactcactctaagagtgaaccaatcactcttaaaaacttatcctctccatccaaaaactctaatctaattcaagatagaatatatactactacctaatcctatgaatacgtccagattcattagatgaggtaatatctcatttcaactatagattgagtttttttttacggagtatataccccacctgtcagatgccataccgccatgtcagactgcatgcggataagaacgtccacgtcggatgccacgatgccattcctgccacgtcagcgtcccccgctcctatactcctttaaaacccggtcccttctcctcgtcctcttcccccaaaattccacaacaaaaaaacacccccaaaaaagatcaaaaaaccctaacctccgatcgaatcatcgccaccctccgccgccgccgccgcccgccgtctccggccatgtccccgtcaatcgccgcctcccaggatcgcgtc

SEQ ID NO: 13437 - DNA, 791 bp, Oryza sativa
atatctttagtcccggttgttgtcatcaaccgggactaaagatattttcccgctattttcaaattctttttaaacccggttagggttaagaaccgagactactgataagcgcactaaatattattatccattacatatgtgtttctaaaatagaagataatgcattacaattatttaaagtacaaagattaatgacaattacttcgaaaaattattgttgtctgtaataaattaagtggataaaacgtaataagcaaatatatgatttaaaattattaaaaattctaataatcatatatacttagcatatgaatgatattattaaattggtaaaaactctaattaacatatgtatatacatacggtatgatttaaaattaataaaaattgtaatcatcatatatacttagcatagcaattatattaaattaaattgtgaaaaactctaattaacatatgtaaatgccacatgcatgatttaaaaattttaaaaattcgaatagtcatatataattagcatatgaatgatagtaaattaaattgtgaaaaactctaattaacatatgtaaatgccacatgcatgatttgaaactttaaaaaattctctagtcaattataattagcatatgaatgatagtaaattaaatgttaaaaactctaattaacatatgaaattgccacctgcgtgatttaaaacttttaaaaattgtaagtatcgcatataactagcatatacatgatttaaacttgttaaaacctctaataatcatgcgtaattaacatatgccata

SEQ ID NO: 13438 - DNA, 650 bp, Oryza sativa
tttttcatctcctcatctccattttttttatcatcttttttcagacaacgatttgttgttatcttcttgcagagtaggcatgccaactaggctcgccagcgagtcgcgccactgtgatatatggcctgtatttttccgggcttcattatctaacactatccgtaaaccggaatccgcgtgtagtatttgtctaggctctagaaaattcctggatccgccacgcggagagtcgcgtggctggatttatatgcatgtagttgtagttcaggtgccatggtgaaagctagaggtatggaagggagctaggttggaacacttgtaaggaggaggtgcaaccatgtgtaaggcaagatggatatgggtgaaaaaccggatatatgatgatttctttgcaggttaatcttcgctttctgatctttactgaacctcatctggaaccaaccaatccgggcctgaatatatatataaaccttttaaaaaaatccacaatatggcactcgtacaaacgtgcaattaattactccctggaaaagatcatagtctcctaccattagtagcaagtagtagtagctatcccgtttttcgcatgaaggtgtttgtgccggattgggaatttggattgctgcttggtttcatggtgtgacaccaca

SEQ ID NO: 13439 - DNA, 599 bp, Oryza sativa
agttccatttgtatgcatacactgttttctttctgccactgataagcactgctcgttgaaaagtacatcccaaattataagaatcttttttatacgtcttcaattatatattttgattattaatttattttattttatgctctccacgaatatgaaattagtatcacatgaaaatattttaaaatatgaatatagtgatataacattcataatacttagcctatatatgattagtatgcttactagttaaaagttgtcaaaaattatcaagtttgattttccttaaaaagagtgtcttataatttgggatggatggagtagtagtattgtgcagtactccctacatactcgtaaaagaagtcgtttaggacagcgacacgagtctccaaaacataactttgacttcttttttctataaaaatatttattgaaaagtgatatatgtatacttttatgaaagtatttttcaagacaaatctattcatataatttttatattttcaaactcaacaactttattcatgatttatattccaaggtttgacttaaacattgtcctaaacggctttatttatgagtatgctttagagcacccgcaa

SEQ ID NO: 13440 - DNA, 1501 bp, Oryza sativa
  unsure (1)..(1501): unsure at all n locations
acctaccttgcttgatatcttgagcttcttcctcgtattccgcgcactaggactcttctggctccgaagctacacgtggaacgagataactcaacaaaacgaccaaggaaaagctcgtattagtgagtactaagtgtgccactgaatagatctcgatttttgaggaattttagaagttgaacagagtcaatcgaacagacagttgaagagatatggattttctaagattaattgattctctgtctaaagaaaaaaagtattattgaattaaatggaaaaagaaaaaggaaaaaggggatggcttctgcctttttgggctgaaggcggcgtgtggcccagcgtgctgcgtgggcacagccgagcgaacacacgacggagcagctacgacgaacgggggaccgagtggaccggacgaggatgtggcctaggacgagtgcacaaggctagtgtactcggtcccccgcgcggtatcccgagtgggtccactcgtctgcaaacacgattcacatagagcgggagcacgcggggagccgtcctaggtgcacgggaagcaatccgtgcgcctgggtggatttgagtgacacgggcccacgtgtagcctcacagctctccgtggtcagatgtgtaaaattatcataatatgtgtttttcaaatagttaaataatatatataggcaagttatatgggtcaataagcagtaaaaaggcttatgacatggtaaaattacttacaccaatatgccttactgtctgatatattttacatgacaacaaagttacaagtacgtcatttacaaatacaagttacttatcaattgtagtgtatcaagtaaatgacaacaaccctacaaatttgctattttgaaggaacacttaaaaaatcaataggcaagttatatagtcaataaactgcaagaaggcttatggatggaaaaattacatacaccaatatgctttattgtccggtatattttacaagacaacanagttataagtatgtcatttaaaaatacaagttacttatcaattgtcaagtaaatgaaaacaaacctacaaatttgttattttgaaggaacacctaaattatcaaatatagcttgctacgcaaaaatgacaacatgcttacaagttattatcatcttaaagttagactcatcttctcaagcataagagctttatggtgcaaaaacaaatataatgacaaggcaaagatacatattaagagtatggatagacatttctttaacaaactccatttgtattactccaaaagcaccagaagtttgtcatggctgagtcatgaaatgtatagttcaatcttgcaaagttacctttccttttgtactgttttaacactacaagccatatattgtctgtacgtgcaacaaactatatcaccatgtatcccaagatgcttttttattgctatataaactagcttggtctgtctttgaactcacatcaattagcttaagtttccataagcaagtacaaatagcta

SEQ ID NO: 13441 - DNA, 1501 bp, Oryza sativa
agataaaattgaactatcaggtaggcaaatatcttaaccgaaccagagcaatccaagaggtcgaaccgatgcagtcttgaacaacaccgatgtagccgatacattcactaaggccaatagaacgtagggtttaccccttcgccggagatcaaagccgatgcagccccgtgtcaggtgccaagttccgccgataataagaaaaatactgaaaaagagggtggcaatgcgtcgagattagttgtattgatccgtgagataaattacaagggctcgagtatacatatttatacctatgtgtagatactagtccttattggataaaactcaaactttcctaaagataaaaggagaaacacaagtccagatcgggcattaaacacactttcttaaaaataaaagaaactatttaactctgactaattaatagataaattgtcatgccgcatcctccttcaactctcttctagataaactttctttaattgattaattttcttaaacgaatccatcaagaatccaactactagaagttgataatttccattagccaattccagaactcgaagccgatactgactttaggccgatgatgacttcggggcttaccaaattttgacgttaacacacaaaaaccacgccaccatgtcatcagtctcccgcgacatgcactcgtacagccatgtcttccctgtcgacctataggttgcagttcccgatttttcccaaattattccctaactcccgaacattcgttagagttttccattgccggcgcggcgcgccatgaccctaggaccaaatcagtgtgcggcacgctcctcgtgttagctcatggaggacaacagtgagcgggctcatctgcgaggaggtcgtcactcgggacatgactgccgaagggggagaggaggaaggggaaggggtgaggaggtaatgggattgacaaggaggaggaggaaggggaaggggtctaaattattccctaactcccgaacattcgttagagtttttcatttgccggcgcggcgcgccatggccctaggaccaaatcagcgtgcggcacgctcctcgtgttagttcatggaggacaacagtgagcgggctcatctatgaggaggtcgtcactcgagacatgactgccgaagggggagaggaggaaggggaaggggtgaggaggcaatgggattgacaaggaggaggtcgcagccggagccagaactagggaacacgtctgtgtaacaacccttcctccagaactgtgtagctagcccatccgatgggcaggcccacttccacataccactccacttacactagcccatccgatgggcaggctcacttccacataccactccacttacactttcgtccccgcttaatgtaagagggttaacccgggagtggtatggttggagggacaagcccttgtaagtgaaagtggtatggttggagagacaagcccttgtaagttggttccactcttgctaaactagcaaggtggtac

SEQ ID NO: 13442 - DNA, 1331 bp, Oryza sativa
cagggtctgcgccaacgccgcgggcaaagacaaagagcagcttctctgggtgggtgatgcccgtgtggagcccgtcccaagcgctccaaccgccgacgccctaccctccatgtcgtcgtcgttgccatcgcccgccgcctccactggacctccccgagatgctgtggcgcctagaaagaggaaagggagagagatggagagaggggagatagggagagaggaggaaaaagaggaggggtgagaatgatacgtggggccatttgggtcccaccattttctaattcattcttttggtataacagacatgtggggtcacaatttttattattttccatatcaaattgccacgtcagatgaagaccgagtcaatttagccatgtaggcgtcacgtcagctaaaaccgtcgtccaaaccgttatgggacttatattgcaccggttttagcaataaaggtaccgttgtatctggttttcggttgaaggacgaaaatcgggttcatcgataagttaagttaagggagcacaggtgaactattccttctgtggttgaagggcgttttacagcgaaatgtaccgtgcgtacgcaagcagctccatcctggactggactggattcttcttcccttccccagcgaatgaagatcacctttattcgccgttccagtcacggattcgcagtaatggaatggatcacattcggtactgtattcgggtggagccgacgtctgtgcaaccaaccggcaaccaccaacaccttcaccttccgaatcctgaactgacgtctgcaagactgcagccaaccacgagcaccttttcttttcaccttcagaatcctccagaaggttaatgttgttcgtagaaggcactactcattatcaccgccttttacgtaccggctctttcacctagctagctagccagacgagccatccagaactcgatctctccagctcttctctgtgcaccacacgaacagcacgtgtgtgttgtgcccaacatggtaaacaccacacactagtgctccagtccagtggtaacactagtgctctttcgttaggctttatgctcttctttgcgccacaagaattggtcgcaaatctatctttgcgcccaacagggtcgaacgcccacgcaccacaccaaccactgcaattttttctctcaagaaatcaccgctagcttataaaagccggcctcgcgcaccgcatgctaaagctaccaccaggcacgtacaacacacaccagctaagctccaattaaagactcctccttgtttgcgcacgctcactcgcgcagccgaccagtggccgtgagctcggatagctgagaaga

SEQ ID NO: 13443 - DNA, 489 bp, Oryza sativa
cagctagttgaatccgcatcgcaattcgcaaatgagtacggttctcatttccctcttcgcgagggaaagtatgagacactgactgggttctaccgcaagttgcataattttttctccattttttttccttatgaacggtagcacctccgaagaacagtacggagtacattagtacgaggcaaacatcctgtgatccgtattgtacggccgtgcggctggtacgtacataaataggagccgtgctgcgtgtgacgacgctacgtacgtagtacgtgtgtacctagctgtgtgtctcgcggaacgtttgtcccgtcttaccaaaaacctgagagcccaacgaacgtgacgcgacttgtgaggcccaaacaggaggcgtcgacgttcatgtgctcccgtttttctggacagctctgctacctactattccatactcggttgtggatgatcgagtctggactcgtgactcgagagctataagctagcccccca

SEQ ID NO: 13444 - DNA, 1501 bp, Oryza sativa
gtcactctacaaatagtaaggtgatactaaaggttcatattcaacccttactattaggggggtctttataatatttctctaaaaattatttggccaaacctcatataataattgcaacagaccggagatatcaacatataattaagctaacctcactttgtataaatgtcattctctacgagactgcgaccacggtcaaaattgttacggttattgtcgacagtttgctcaatgcaatttgttagacaccaaaagatggcttctgttatgtaacaagcgtatactatgactcacctttgtaatcttctacatttcacaagctcacaaagatagtcatgtattcactttgtaatcttccacatttcgcaagcttataaagataatcatggaataggaaatcagctggttcaaaattttaccaactagttactcaccttaatagatgtggaacacgttacgaaagggattaaccgaacaacacctaacaacaaccttgatttatccccacaaaaaaaacaaccttgatttatgctcctgtagctgaatttccttttagcgaatttcagaaaactacatatacttcgagcaaatagtcacataactaaaaatataagatatcatgtcactatagagtatcaaatttatcacaaattaaactacatatttaagataaattatcataaaactaaggatttattattgaagctgttacaaaactgcaagtttagagtttaaatccctaatccaaattgttctgtggaagctataaacgttatagttgtctgatcaaattggtgcaatatcattagttctataattttgttttactaaaatgttacttaaagaatattaagaaaatgtagttttgatactccacaattccatcttaaacattgtagctctgtgataaatttggttatatatggtttcgtgacacagcgatttaaatacgtaattttgagatagtttggcaaaagtatttacagctttacttaatttacatttccttttcttttggagatctgcgattctgcagtggcagcagaactaactgcgcggcttcctccaatctcagccgtccaaccaaccaaaaccaacggtacagattttcgtagcccaaaccccaaaccgcttcaccacgctcctccatccaccaactccggccacgccgccgccgcctgccatgccgcgccatctccccgccgccgccgccagccgccgcctcctctgtaccacgacccacctcctcgccctgccgcccgtcgagccgtccccggccgccgacgagctcgcccgcctcctccttgcgcaccacaaccccttccacccggccgagtcgccgctccagctcctctccggcgggggggtctccctcacgggggacctcctcgtccagctcctcctccgcctccgcggcgcctccaagctcgcgctgtcgctcctccacgccgcgcgcctccaccctccccccgccgcctcttcccgcgccgccgacgcctac

SEQ ID NO: 13445 - DNA, 774 bp, Oryza sativa
tataattcagctagctgcttctccagatgtttctagcttgtggtaggccggtctatctgaatttcgtacgctgcaggacaccaaacagagatcaacatttatgaaacagcaaagatctcgtacatgcccccatctccaagattatattgggtcatctggtgaaattaatctcctggcaaattaagtcaagatgcaccgtctgcaacacgaaatgtaatgttgacacgcaaatgctagaaaatgatttcagatatggtttatattaggacttgggagttgggacacgtatgttttatgttcagatagggtctattcagtcgtagagaagaaagtgaaattgcgagcagatctgcaaacatacattaaatgatgcatccagaagagttagaagtcatgacactactataagtcagattaagcttggattatttccagcgtttccttgcggtcgctgcacttgttttatccaagactaatactgtaaacaacttctggtttgattggaataaataaataaatattaggtatgacacgtatgtccacatcaaatcttcacgggccagcttccttccatcagatttgagaaaaaacataaccaatctggactaattccaagtcaatcgatttgactatagattaaaaaaacaatcacctagctgatcacacttatcctcgaatttcgaaaacacatttttctctaacctatataaaccctaccatggttagcaaaattccgtaacaaacatcgataatacaagatcataaaaagaaaaa

SEQ ID NO: 13446 - DNA, 1501 bp, Oryza sativa
  unsure (1)..(1501): unsure at all n locations
cggtgcacgatcgattaggagcgagcgtgacgcccaacttgtgagcgattttcacgggaaagggaacttcttgagtagatgtgatgcttaaattgtgaaatagcgatttttacaggaaaggaaattctaattcttgagtagacgattaggagaactgttggaattactttgtaaaatgaaattccttaattttaagatgaggaggacttaagaaaaattgttggcgatgctctcacatcgatcggcatgtgccctccatcgattcggagaggctacatttttttcgttttctggtgcaataccatgtagctgtaagccctactctctccgtcccataaaaaactaatttagaactggatgtgacacattctattactatcccataaaaaactaatctagtactgggtgtgacacatcttaatacatgaatctgaatatacatctgttcagatttattgtcctataatatatatacggtttttttagacggagggtgtatacttctccgtacgtctgttactgaagtccgtgaatgtttttactagtctgtaactgaaatccaggtgaatgttttttgactcggtgattggcgtagacgagagggttgaatgagttctggcaaaacgggtatagttgcattaccgctttcctcagtgcgtcattaccgataaccagaatggaataatcacgtttcgtcagagtcagataacccgccaaggactcgacgggataccggcatatcgcactagctgcaacaaatcataacaaaatcagatatcgcactagctctgcaacaacgaactataccaaaatcgaaggggaagaaggctcatcaccaccgtcgaaaacgacctgcacccaccgtcaccgtcaccgccgccgccgncgncggccggccaaggccaaccacgcaacccgccgtggccgcgacgctccacttcccccctgactccgtcctcccacccgcccaaccaaccgaccgaccaaccgagtgaacaagtgaccaaccaccaccaccaccaccatcggcaccaccgtcttcgatctctctccgcctctccggcatctcttcacggcggcggaggaggagggagcagcgacgatggccgtgcccacctccgaccagcgcaagcggcggcccttcctcctctcgctgtcgctcttcctcctcgtatccgcgctcctcgccctcgcctttctcttcctcgacccctccgcgcaatccctctccgtcctctcctcccgcctcaccgccctactaggacgctcgcgcctcccgcggtcgtcgccggcggcgccgaagccggggagagcgccgacgcaaccgaaaaagccgaagagaccgcatcgcgaccagacgacaccgccgccgccgtcaacgccgacgctgcagcaggggaaggtggtggaagtagcgagtcgccacggctcgatgcggataagggcgccgccgccacggagggagtggcggatgacgacggcggcggtggcggggacgagc

SEQ ID NO: 13447 - DNA, 591 bp, Oryza sativa
cccatgtgttccttctctcaattaattgtaaaagttaattctccactgctctcaatttttctcctttcaattccgttttaattcaccgaatttaatctctattcaccttttttttatcctgagttttatggattcacttcgattttgataaaaacagaaagagaagatcgagtgtatcaaaaatcatcaaccaatcttaattagaagattgataaagattcgaccggatttgatggtgagaatcgattttgacatgggacacgagactgagacgaccgtcggctatgcgagctagaactatagctgcacttgtaggttagatataagagaggtaggccaaacagagcaagctagctagtaattgtgacaaactagtaaaataatggtttgtacgcgctgagaaaacggtacgcatgcaggtggatccagcgcggcgatagatcgatcacgtacgcgcgtatacgttacgtaatacacgtacggtgggcaactcgcgcaactgtacgtactctcgcacggtcgttatacatacaggcatgtatatatgtacagatcgatcgttacttaaatcgtcccgtgacagtgagtgtt

SEQ ID NO: 13448 - DNA, 1501 bp, Oryza sativa
tatcttgtgtattttcatgtgtattactcttgtttgagacatgttgtacctctctatggtttaggcttccttgtgatttaatttacttgttgtgaggtgcttgaaatagcaattcacaactgctaggaagttcctaggaagaactccggaagttccgggcagctttctctgcttgtgagaaaaagctgcaaggaagttccggaccttttgccagaaagttccgggctctgattttaaccgctgcgatttgaagtaaattttaggaacgcctattcacccccccctctaggcgacatcaaggccctttcaattggtatcaaagcctaatctctggattggcttaaccgcttggagagaagatgtcgggggatggcgagaaaagtgtgaaggggtaatatggttgatactcaagatgctacaatgtcaacaagaggtgaaaatttccttgaacttctcatgctaaatggttcaaattacatgtcttggagtactcgcattctttatgtgtttagggccatgggtcctcaaatagagcaagttatagttgtgagcatttctcctcctagtgatcaaatgctatcatttgaagaggaagagaaatgcatacatctcaatgctcaagctactaatgttttgtttagtgctttgagtgaagatgtgtttgaatccatcatgccacttgaggatgctcatctcatttggaacacactcaaggagagatatgacaagtccgagtgtgatgaggtaaagctcgctatagaagaaccacttgtggagtactcaaattcatcgacaatttgtaaagagcctcaagtgattctatccaatggtcaagattgcctcaccacattcacctcctcatagacacatgtcttcattgaaggtaatgaaatggtgagtagcgtcaatgtggatacttctacctcctacagtgcttgtgaaactaatcttttgaaggaagaagtatgtggaaaaaaatggccaagtgaagaatttacatctccaagatgctcatctccacgctccgatgaatattcttgcatcatggagaaatcatctttggagaaagaaaatctagagcttaaagctcaacttgtagagctcactagcaagcatgtggacctacaagaaaagtatgatgaacttttgtgctctcatggaaatattgtagattcacatgccatgctagaagtaactcatgaggtgatcataacaacggtaaaatcctatgtgcctcatattcaagttgactttacttgtgctaactcttattgctctcaagcaaatatttttccgagcactatatgtgacctggattatgtagagaaaaaggataagcgcatcgatcatggacttgttggcaatgctcaaccttctcaagataaccgtgagagcatggtgaagaagcttgagaagggaacaaccgtagcttgcaacaagttctatcaagaagatatcaagtccaacaacaagatcaaggggcaagatcaaaggaagaaca

SEQ ID NO: 13449 - DNA, 1501 bp, Oryza sativa
ataccctactcatgtgtgagggatcatggttgagtgttacaagggtcctaagctccggagaacgctctcgtctctttttccctagagctcaggtctgcttggagtcatcctatttctcggtgggcaaggtcctccttttatagctcaaagggataccacatacaccggctctacctactcttctaccgggtatgggacccaccctaccttgactggaccttgatccgtgccttcggctggaagctaagccacagctcgttcttgagtgggacccagcgcttgtccccggctgatacaggggacagtcctgtcattccctcataaatgggtgaagacttgtgacgaccgtccttctcgtggagggagctccgaatcatgctctgacgggacgggtcatacctacctccactccgccgggaacagaagcgacgtgagggcatggtcgcccgtccagtcagatgcgaccggcgacaggccggtcacagaccggtcattcctgactgacgcgcgtcagtcgggtggcaccgcacgtctgcccctaccgcatttaatgcggcgaggggcagttggggcgtcgcacgcattgaaagcggtacagcctgggtcccttccctgcttgctcctcccgccacattgcagccgggcgggggcctcggggcaaaacgtcgcgagggcccaaggggcatgacgtggcaccccgaggccccccggctacttctgcgatccacgaggtgcgggggtaggtcaagccgtagggccacgcggtaggatgggaaggtaaattcccctcactccgcataccccgggcccatatctctgacagtagcccccgacaccacgtcgggcattggccccttgaggacagtctgacgtggcgcctcacgacttcccaagctgtggttgtgggcccggtggggaatctaaacagatgccgccgagctgtcaggctggtgcattagccataatggcgatttgaccgccactaaccgcgctgacgacgggggcgcttggggcgcgaaaatcggggggtcggcaagaccacgcctcgactccctcgcccgccttgcacgcgatggaactgacggcgagcctgcctagtttgcacccgtgaacattgcacgccctgcgccgagtgtgccgctgacaggcgcactaaacgcggggcgcggattcagtgggcgacgtgatgagtggatgcaggaaacgatgaggcaaccacatgcgcgagaatcgtgggggcaatagtgggggcgtgaaacgaggaggcaagcgcgggtgaggcagggataaaaggataggaggtggaaattttgcctacttcctctcgccgactgctcactcgcacactcgctccccaagccctaacactcttgccgctcctcgctactccgcacaccgagctcctcatcaccagtcatcatcgcccaagacgctggtgacgctgtgctcccggcgtcgcgcatcacggcggagaggcaccttagcctcccccgcaagatca

SEQ ID NO: 13450 - DNA, 868 bp, Oryza sativa
accctcactccccggcacagaaaatgaagtagcgattagcacgtgattaattaagtatttgctattttttttaaaaatagattaatatgatttttttaagcaacttttgtatagaaactttttaaaaaaagcacaccgtttagcagtttgaaaagcgtgcgcaaggaaaacgaggaggatgagttgggaacatcttctgccgaacgcagccttaatctttatcttcatctgtatttcagtagattcaaacaccaaaaaaaaagtccatgaattgcattgaaattttagagagcatggtgttagcctcggggatgtaggtgcactttggttttatgcggaaccatgcagagtttttaataaattttctacatataaaaaatgcagcttgcgaaaaccacataagcaatggtaacagtcatcatgttgtactccaaataaatacaccaaatactacctccatattttaatgtatgatgccgttgactttttatctaacgtttgaccattcgtcttattaaaaaaattatgtaattatcatttattttattgtgacttgattaatcatcaaatgttctttaagcataacgtaaatattttcatatttgcataaaaaatttgaataaaacgaatgatcaaacgttagttaaaaagtgaacggcgtcatacataaatacggagggagtacgtgttatatatgaataataataacacaaaaatggaaacacaggcaggagtagtaagatggatcactgcatgctccatcccgccagtagacataatcatgcattacggttgtattaatttgtaagcaaatacacagatacataacatggaaaatggaacacgtacactgaggcaaccgcgatag

SEQ ID NO: 13451 - DNA, 630 bp, Oryza sativa
ttcggatccgtcacctgtgaacagaacaaacaagcgatttaggttgcgccgtcgctttcccattgcagatttgcagcgcccacgccggatttctgccgagcctgcgtcgaacagattcggatcgatccggctgcgtgattttgatttctcggacatgcgatgcacgaacccaacgcaatgtttggccgcatcagagtagccaccacttaattgtacttgcaatctttttttttctgaaaaaataaagagagcgagatagggcctcttcggttcattaaaaaaaaacttaccatttgttggtaagccaaaaactgataaagctaaaattttggttaaatgaagatgtgaaagcggtgtttagtttgacaccttgctaaattttgatatagttttgtgaaaatgttggtagggattgaaaaggtttgtgatgagaaggtgccaaacttcgatatggttggttttggcattgaactgaacaggcctataatttgtatcaccgagttgggccttttccggcccacaacattacaggccagtgccacgatcgctcgtctggtttgtgggctcaaaaaaaatcaacggcccagatccgaatattaagcctccgcctttgaccaggcccacgctcta

SEQ ID NO: 13452 - DNA, 1501 bp, Oryza sativa
atatttacgagatctgatagccgagagaattaggagaaaaatataaaattgtgcatataattttataattcacacttgttaatcatgactatcttacaaataaatttcattaagcttcaggtcattcaaagtatatgatgaggatgttaggtcccgatcttccaataggtactgataaacagtcgatttgggcgaagtcgcgatacaactcaatccggcttctgaactaacacactacttaggcccgcaatcacagcactacgtctcctctggttatcaaccgtgttgaaacccgattgacctaaccaagaaggctaatccctgcatgcgaatcgaagagcacaagcaacaacaaaatgcatatgaatgattaagcacacgaatttggggttccacaaaccgatctagcggcgaaactgttattgacagaataatctaagcaaaacccgactctaaacgatgacgaccactgattaagtatgattagggacgttctagggttgccctaggatgcacacccccttgggctaagccacgacacaattataaggcccaaaacctaaatcagattcggactggatgagatacgcggcctgctttgtagattcccagcagctcggtaggaattttgacgtgggaccaaaaccatctgtaagtagacttcataagcattccaacaagtactcatgggccccgaaattccttctagatcagtggctaggtccgtttgaagttgatgctgttaggaggcccgaatccgaatccaaaatgtatagaacttgatctcttgtcttctatggaccaaaaatgacgtggtgaggtagaagtagacttgtagaaggttttgatttggtccccaatcaacttctttaatcatccatacattccttatgcccagtcttttttctttcgcccaagcaaatacctctacaaagaaaaacacaggaacttattgtgtagcaacgtttgttcaaatatataacaattaaatctaatatagaacatatgcacctttggttgattaatacataaggtagtcatagttatatccgagctagttgtgccctcatcatcctccccttcttgattggaaaccgtcatcggtttcactttgtcatggagcgtagtgaacttatctttatttatcacaacatctagtgaggaacatttcttgatggctatatggttggatcctgaaatctttatagtcgaagaaccacgtcactccccttcttgcaaaccaacatgtaactcatttaaacaattagaggaacaagatagagaattacttatacgcatgcggtcctctagacaatacatttcatcatgaaaaggaggtatagataaattcgaacaaatatatactcgatgcacattatatactcgtttactatcataattgccaataatatgaaaaatcacatcagaagggcatggcaattcaaatcatcaaatttgaatataaccccaagtatttaaagaagatagcaatttaaattct

SEQ ID NO: 13453 - DNA, 635 bp, Oryza sativa
cgttgttttggcatccctagggggcgatcttgtatgtgttcatttgttggtctaacggcggtcggtcacgcttagcggcggccggttcggtgctagccttcttccggattgtgtgttggcgctatcggtgtgtgggtggtggtattcagggttgtaatcttgtactccctccgtttcaaaatgtttgacaccgttaactttttagcacatgtttaaccgttcgtcttattaaaaaattttgtgaaatatgtaaaactatatgtgtacatgaaagtatatttaacaatgagggcctcatcgtttggcatattcatatgcttatgagccaaaatttgaattttcaacgttaaatttgaagctaattttggggttttttcatcgaagtttatttttcagcctttgcttttagatcgctaagaacacatatataaaagttttattcacaaattgattttcgtttgcaaaatatgtcatttgacatattcagaaaatatgccaaacgatgaggctttaaatcaaatgatatgaataaataattgttttttttaataagacgaatgggcaaacacgtactaaaaggtcaacggtgccaaatattttgaaacggagggagtaattttttcctgctcaataga

SEQ ID NO: 13454 - DNA, 1381 bp, Oryza sativa
gcactggttgatattattttaggagaactaagcagagtccactaaataatgacaaatacaggtattatatactatacattattacatggtagacgcatggtgttatgattgctttgttgtttatgtatatatatgagtgtattcgaaataatcaaattgactttgaggaaagacttccattacagctgttgataaaatttaagcacgcacctgcacggtttctcgtggagcaatgaaatgcatttcttgaagtaagaaactttgatgaaacgtactaaaagattataaagaacaatcagtactagaagcaaaggcagctagtaggtagtaaggagattttgtttatccctattaatctatccactactattacactacagatgaagcgtttacttgcaaggaaggaggagcgcgaggcggcgtcgcgttcgtttcacacgcacgctgacatgcgtcgccattgactttcgccgccgccgccgcggtggcgcgcgcgcgcacgcacgctgggcgacacgccacgccgccgacgcgacgcgcgccgtgcgcacgagcaacacgtacgcaagggagaaggagagatcgctatagcttccacgcgcaaagcgcagggccacacgtgcgtgttcgacgtagacatgacacggcggacaggcgaggcggcgcggcgcggcgcgggcgggggcgacggcgccgaccagcggacggcgtggtgggcggtgggcgcgtcgcgtcgcgtcgtgcgtgggcgaagttggtcggcgtggcagcgcgcgaccgcgtctcggtctcggcctcgttgctcacggcatacgaagccctgggcttttacgcacgggagaagcccacatatactgattcttttgggccgtcaatctgaggcccaatcaggctcgaacatggcatatatgctgcgtggttttatattagtcccacctcgcgccctagacctgattggagaggagacatgggtatatgagatgacccagggtttgtaaccaaatcatacctttctcggccttttggctaagatcaagtgtagtatctgttcttatcagtttaatatctgatatgtgtaccatgtgttcactttgatattaaatttattttagccaaccatgtcctcggcgcctagggttcctaggcgactcaaggtgggttctgcgtgggtagggtttcaatcttctctcaaccccatcggtctcatgcctgatcggatcgatctcttcggtctagatcctgagtcggatcgatctcttcggtctagatcctgagtccacatcccatccttcctctgtgtccacggttagattctctgttttggagccgagccaaaccttgctagccggggaggggtagttttagggttcggagggcacca

SEQ ID NO: 13455 - DNA, 1501 bp, Oryza sativa
tttttaaggtggttttagaagatacaattatagctaatttgcgaacagaagcaaaaaagacgctttggccgagtggttaaggcgtgtgcctgctaagtacatggggtctccccgcgagagttcgaatctctcaggcgtcgttaattttttttcctttttttattttctcctgtttatatttttgtgttagccttttcctgtttgcattttttttggggtgagatttcagaggttaatgctcgtctagacgtctactctgtcgatgtgagactgacttgtgatcatctgttaaattgttgatccttgtgggatgtcaatgtgacgattttttgtgatcatctattaaactgtcaatccttgtgggatgtctgctatttctgtgaagtgctcccgaccccaatagatgattgatcggtgttcggtggtgggggttgggaatcatcacccacgcacgaaaaatggagtgatttattagcgcgtggttaattaagtattagctattttttttttaaaaaaattgatcaatatactccatccattccaaattaatctacatatttcataggtataccaagaccaagaaaagctaataactctctcatactatatttactctagcaacaaactcaatgcatgcaccatccccaatatttcctagccaataataaatcaaggtattgtatatgtgttataaatacttgtgtgcatggaatgcatgcatcaatgtccatttactccaatgcacaaataacgaatagactctaataaataaacacaaatgtgtagatcatttaggaataacctcaaaaaaaactatatgtagatcgatggaatggagggagtaatattttaagcaactttcgtatataattttttttgcaaaacacacgacatttagtagtttgaaaagcgtgcgcacgaaaaacgagaggggagttgggaacggctggtatcgaaaacagcgagtcatttatcgtaactcacgaacttaaatcaaacggttaagattttcctttaaaacatctctagcacttctcacttcatatggttctcacagaagaagaaacaaagagtagaaaataaaagagtcatttatcgtaactcccacgaacttaaatcaaacggttaagattttcctttaaagcatctctagcacttctcacttcatatggttctcacagaagaagaaacaaagagtagaaaataaaaaaagaaaacaaaaattaacgacgcctgagagattcgaactctcgcggggaaaccccatgtacttagcaggcacacgccttaaccactcggccaaagcgtcgcttgtgaatgcggaaagcaacaaattttacttgtttccatccaaccatgcatatacccgagcctcgaatttcatttttacctctcccgctcaaggggacgggagtttgatccgtcactctagatcctgacctaatggacaccggcgccgaccaggcaccacctcctcctcctcctccccctgtggcggccg

SEQ ID NO: 13456 - DNA, 1501 bp, Oryza sativa
cgatatctcgtgaggcccgcttgctagatcaatccaagccatccaatcttggtcgactcggtcaagattaatctcagccgtccaaaattgatataaatccgttctctcttttcagtgacattatttctttttaatatatgtcatctaccaaatatgatctaatcttttccggaggttgttttaatcttttgtctcagttataaatcatttgtaaatgatttaattaatttggaataatcttttctttaataggctttaattctaattaatcttgtaaaattcataattaattcatatgaaatcgaatgaggccgttcaagtctcataattcatctaaaattatgatctacatgtttgtttaatttatatgtattgtttatttggtttttattagtctttttcctcgttttgcgttttagcttgtcgtttccatcgtttcgaaggtttgcgagtgcgccgtaagtattcaagaagattaattggagcccattattgcaaggcaagtcacacagatcccaaacacaattcctttgagcatgttgatcctatatttaaattctctatttatttcaactgtgcatttattttggaatgtcaccgggtggtgtgaacctattcttttgttatgaccactttgcattgcttactctattctttgatacattgggtgataatttgactagttggacttatatattggttcagctagatattagatatattgcttagccatgcttagaaacattagcacacgattgggataactaatgtttcactactacttaatgatggacatgataatggtagctcatgatggctaatcgtgattggttaattaattaatgtgcctactaaaacttgataatggtgggttgtgagcacatggttttgatggtcgtgctcatgacaattaaggaccggttcacgagtttcggttgtgaaacattaatcgtgccaaccacaagccatcatgggcaacagctttaccttttgtatagcatggttcattgcgggacaccagactgagaagtggcggagataagcccacgggggtcgctggggagtccatgccttatttgtaagggggtgattatgatccaggaatggtgcactgctttgagttgtgttgtgcgaggggtactgtcacagctcctttccgaggtaccgtgatggtattgaggcgcatggtgacatgttctagggctgtgtcttgtgggtacagtggtacatctctggccagagtaaaactattcgaatagccgtgcccgcggttatgggtgggtcgaacaatgtctttcatgattagtcccacactactcattaacaataatgtggtaattgatggtaattaatttacaattctcgaatgtttgctaaatgctacttttgcaaatgagctctatattatgccattctttggtatccttgtgcacttgcatatttgctgtgtggcttgcggagtattccatgtactcaccttgcaataatcaatcaaacctta

SEQ ID NO: 13457 - DNA, 438 bp, Oryza sativa
tggtggggccggtgggaggtttttggtttttaaaatagatctaacgatgtaaaataatgggtgcaccgatttaaatgaaaatcgatggtcagatttctctattatattagagtgccacgtggcaatatgagagcattttgagggagccacgtggcagcttgagagcgtttatagggagtttaatggacttttagtatataatagatagatagatagatagatagatagatagatgtactataaacaaactgcctacgaagggtggtttatatatagattcaggaggagaggagggagagaaaggcggcaagccctgttcttatgtgtgcgtataagtaccccctaattagcagtaccactcaaagccccagctatagagcacatcgttaaagttcatagagtcatggacaacatgtgaattctaggatgcatcccaca

SEQ ID NO: 13458 - DNA, 1398 bp, Oryza sativa
tttgaaacggagggagtaatatgcaactttttttatttaatacatattacttttatagattttgttggtcaaagtagcatcccaaagatcgtgtcgaagttaaaaaatgtttatattttgggacggagcgagtatttgttttgacataatctttgaaatgctagtttgaccaataatatatctaaaagtaagatgttttaaataaaaagagttatattatgatagtttgtttaatgataaatattgtaataccaattttacatgattgattttttttatttttttactataatattcaaagtttaaaatgtttgactagacgctattctaaaaatgatttggtgaatagccaatatagtctctggagtttcgcttcgggctcagtttagttctcgatgtttcaaatcgtccaaacaagtcctccaaattaaccattaatatagtccttggacccaaaaaataccatgtgagcataccaagtcatcctcgcatgcagcggtatgaatgaaatgatcattctacccttatataccatatagaaaagaaggaaaagacaaacaaaaaaaataacatgccagcccaggcccagcattgttgcggataggtggccgacaaaggaatttacgcgatcagtgcttggctgcagcaatcgtaagtggcaattctgaaacgatcatacacatgtgaaccatttatcttcttttttttctttcatttgtactacatccgtttcaggttataagactttctagcattacccatattcatatagatgttaatgaatataggcacacatatatgtctagattcattaacaatgaatgtgagtaatgctagaaagtcttgtaatatgaaatggatgaagtatatggtatataagggtagaatggccatttcatctataccactatatgcgatgatgacttgcatgctcacgtggcattttttgcggttccaaagaccatattaacccaaataactaatttggaggacttgtttagacgatttgaaacccaaaagactaaattgagtctaaagcgaaactccaggaactgtatcagctatttacctaaaatgatatttacctaaaatgatatgattatattttagaacaaaaggagagcccacaactatacaagatgtgcaccacgtacatactgtacatgggagtatcgagtacgtatacatttccggtgcagtacgtacgtacgtatagtgcagtgcaggtcgagcgaatcgagcgcaccaggcaggggcagcccagccgttgtgtcgaaacatgatttcggcaataataaaacggggtagcgcacgagacctaaaagtggatggatgcggagacaaaggatttagacaggttcaggccctctcaatgagaggtaataccctactcctgtt

SEQ ID NO: 13459 - DNA, 443 bp, Oryza sativa
ttaggaggatgacatgtggggcccacgtgggtcccaccatttttattattttgtatgtgaaacagacatgtgggtcccacatggtttattattttttcggatcaaattgccacgtaagcgccacgtcagatgaagaccaagtcgaatttgcgacgtaggcgccacgtcagccaaaaccaccatctaaaccgtcgagagatcttatctacatcagttttaatagttgagggacctgttgcatctggtttttttggttgaaggaccgcgcggaaacgtcgccggtagaggcgtagagccggtagatttgtgacgacgtcttccgcgccgccagatcggcccacttctcatcttctttattgtgaggccggctccatatatatcatatttatggccggctattacatcttcgattcctcctccccaaacgcaaggcactttccttc

SEQ ID NO: 13460 - DNA, 1300 bp, Oryza sativa
actccatcgaacatacttgatgagttgagggtttccctgtaataataactttgtattattatatattttcataaaattatgtattgttaatttcttctcccaccagtacgtgcgtaaaaaatttattgctagctaatcattagccccatttgcaatgatagaattctaaagggggaaaaatcattcgatttaaataatagagaattaccgatgtcatagttgtccaaaacacgatttttcttcctacgtacgtgaaagtaacttagtcacgaagaatttgagaaaaataatttacaccgacgcaatcgcttgctcatcgacgacaacctacaagtaacaatataacaaatagtgaggaaaggaaaaatataaagcagcattcaatcagtcaacacaggtgttctagccatatatatgcaacccatcaacatggggaatgcaacaatatatatagcagcctagctagtcttcaaaatgatgaagcccacagaaaatgcacacaagcaaacaaacgatatctcaaaatataaaatcaccagatataagacagacgctcccatacctgaatttttgtttcttgcaagaaatcaatgcatgatataactgtaacacatcaagttgtctgaccatatcatatatcatcatgcatgcacagcctaattaaatcttacacacaaagaaaccaaaattggagaaatcaaattcctcctctcccaggggcaaaataggaagagagatatttctttttgcaagaagaagaaacagttacaaaatctcatggaaacttacacctgtcccttggccattttgatcaccatgtgatgtgagtccccccacttacattaatctcatgctaaaaaacaaacagataaataaataattgccattgccatgctgccacgtgtcatgggacacgtcacctcctcttcctctcccgcgagtatataaacccctcgctcccctctccttcctcccgccatctatctccctctcttttgaggagggcaccgccatttagttaattagtagttgttaattatcttcactaaccttaattaccctcacgcaaagcactctctaatcctcctcggcgctcgcataatcttgtatccctcatctcagattatcatcacctcgccgtgttagaaaaaaggtactatgtttggttgatttgtaataattttcttggttggtggtttggttgatttcttgattagtgtgatgctaattgttttcgtttgaagggagtaagttcgttttatcgtcggatttggtgagagttcgccggagtagaagaaga

SEQ ID NO: 13461 - DNA, 1501 bp, Oryza sativa
cctctgcttatgccgccaatatacaatcttggccaggacaggccagagagaaatttgcaagatctacctgaatacctgatcatttgcaccggtcaaaaatcgtttttaggtcaaccaaatacaccaagatgatacaaaagcactgaacacacttccggcatttgcatatcggtatttgtataattaggatgcacacagccaaaccggtaaaaaaatcgtggatatataccatgcattcatgggattatttgtgttgttttcgtgtccggccttgtgatccaatcatgctcatgcagaactaatgtcaggtcgatatcaggtttgtagtagtaggcatatggttcgatcgggtgtaacgtacgtgcgagtcccgtgatagagcatggtcctgtatattatgtacagatgtgtaaacaaaagttagtggtgcccaagtatctggataagatttgtgtccgtttgttggctcacgtacatgacaaaactgataggttcagacaaaatagtgcacgaatacaatgttggtcgatcaatgaaaggacggcgcgtgtcgtggaaaacaactgtgcataacgccaaataaaccaagttaatatccatgtgtggtgtgtgtgatccaaacgtgcgtgcatctaggctcgtcccttttttttcctcactagcttgatgtctcaccaagatctggtccacaactctagcctaacgaagctagctgttgcatcctacgagtgctttttggaacgtggaaattttataggattttcatgtgaattagtttgatttcttaaaacctctaaagttccatttttgcaaaatgaaaaagaaaaagaaaaggcccaagggttattcttttacgtttattctataaaatatcagaatgtaccgtgttttctgctgcctacaattacaagacaacaacgtagtgaaccattttttcctcttatgcaagtaaagcaagatagaatttgttcctcgtagagttagccattgggtcagaccgagcgatatgatctcggtcttcactctttagggaaattttggccatctaaaacttaagaccgaaacgcgttacgaattacaaaaatcaatatccgttatgaccaaaatcgtcaacaatgttagagatgaaaaaaattacagaaaccatcaacaatttcaaagatgcaaaagaacttacataaataatcaaataacaaaaaaccgttagcatccgctctagatctccacctcgcaaccctccacatgtcgccagcaccagcgcccttctccatcaaagttgcttgctgcctgacccctcagtgtaggaggttgatggagagcatgttggcggtggaagggtgcacccctcacccatggggggtttataacctgaaatgaagcatgttggagaggaagtgtgcccgatgtgcggcctacgccaaaggtggagaggaatgtgtcgagccagaaagggcatcctcttcactgagccggcggtcgaggcatcaccggatcttggaga

SEQ ID NO: 13462 - DNA, 814 bp, Oryza sativa
cactccgctgaagacagaggcgaacgtgggggcacgaccacccatccaatcggacgtgaccggtgacaggcctgtcacagtctggtcacactcgattgacgtgggttagtcggacggcaccacacgtctgcccttacagcattaaacgcggtgagggacagttggggcgccgcgcgcattgatggcggttcagcctaggtctccttcccgcacgctccccccgccacatgacagttgggcgagggccttggggcgaggcagcgcgagggcccgaagggcgtgacgtggcaccccgaggccccccggctgcttctgcgactcgcgaggcgcggggggagggccaggctatagagtcacgtggctggatgggaaggtaacatcccctcactttgcatacccccaggcccatatctccgacagatatagtagtgatgaccccgtattgaagtaaagggagcagggccccaaacatcagaataaccaagaacaaaaggatgcttgtacacaaactcactaggatgatagggaagttgtatctgtttaccaagtttacaaccatgacattgatttaaggatatatctccagtcatagaccctaataaactttgacaaactaaaggtgacagacgagagccacaaagatggccccaacaatgatgccactgagtgaaggatgctatagcagaagcaaggaaagaaaacagtcagtcaagctcccaaagatgctgtgaataatggaagcgagggccaataccaaccaggagacccgtgctatgatccctgaacacaacgcgagtcaagagcaagaataaca

SEQ ID NO: 13463 - DNA, 656 bp, Oryza sativa
gccctgttccatcggccggaaagagaagggatagagagaagaggggagagaggatagagagaagaagaagtgaggatgacatgtggggcccacgtgggtcccaccatttttcctctatttgggtgtgaaactgatatgtgggtcccactggttttattttttttcggatcaacttgccacgtaagcgccacgtcagtgtcacgtcagatgaagactgagtcaaattagccacgtaggcgacacgtcagctaaaaccgctatcaaaaccgccgagagaccttgtttgcctggttttcataagttgggggatgggtcgtacccagtttcgccgggccgaatgggcttgtatttgtaataaactcaaatgtgtcctatctaaggaataagttcatccgaggtcccttaacttgtcaacgaatccgattttcgtccttgaattttagaaatagaatcgaatagcaactgcagcaagcagtttccaatccctgtgaagtcgtggagactggagaggggggaaggagaaaatggcgacgtgctaaccgttcgcttccggaagctggcggccgaccagatcaagggcgcccgacgccgatgacgccctcctctatggcgccgcttacgtcccgccgccccgctcctgcgccaccgccgccagt

SEQ ID NO: 13464 - DNA, 1264 bp, Oryza sativa
ggtccactgacatatcggcatcatttctcctttcccttctttctcctccctcactcctgtttctctttctctttcactttcactttcagtctctctctccttcgtcggtttgcaggggccgggagctggaccaatggcagcggagcccgagggagtggtcggtggcgggctggagcggtgacagtaggcgaaagagcggcgatggagcagacggtggccaccatcgtcatcagcgccatgacgcatgctgcagagccgtggaccggatctctaccgcaccatcaccgtctctaccgccgaaatcatgctccgcgaccgcacctcgtcgccgcaccacttggagaaggaaggagagggagagataaggggtcaccgccaccgcctttctagtgcccaccccccaccaccacctgtgccagtaaaccgttgtagctgagatgtgcgcgtcgttcttcaccaacccgcatgttcctgaagcccaaagtagttcgacggatggggtggcctccctttcgtcttcaacaaggtttgcgtcggcgactacggcgccgcccaccccagccgaggccttcatcgacatcttcgcgagcgagtggtgccgcatggtgccatggtggagacgactgccgccgtggatttcatcgctgcaacctgagaccaccgcccagccgccgcacgtggtcgaatcggcctccgtgtatgcacaacgcagcagcagcagcagctactcgagaaagaaatagaagaggggaagaagagatggagaagtgggctgacaaataggcttcacctttttttatttttacctttattacttacatgtgggagccacttctatttttagttccttcaatgtctgggctgccacgtcagcacacttgtaccaagtcgacctgccacgtcagcaaaaaaaccgcttcccaaaccactaaagaagtcaatttgtaccggtttttaaagttaggggaggtgttatacccagttttatgtttgagggatgtaattcgaccagagagaagacaagagaggtaaaatagacttattcctatataccagggacacatggctgacggcccaaaccatcagactcaaccatggcccggcccaaccagccgacaaccactagacttacacggtaccaccaggagtccaggagggcagcagtgtgacgtcgccggcccattctctccgggaaaaagaggacgaaaaaaccctaaccagccgccgattctagcgatggcgtcgcggggcggcggcgcgcggc

SEQ ID NO: 13465 - DNA, 576 bp, Oryza sativa
tcttgttttttgcttaaaattagatgagagatcaactttaatctcctggttaaaccaattgtaatactattttttatatcttaataatatcctttaactgtgggggcttcccctacagttctttcctaaaaaaaaaggtgtaaaccaatggatttcatggcgatagtccaaagcatgtaaagatatttagagaagaagacaaacttttttaagtgtgtgccatattggcatatcacatcctatgtatcaccaaaccatccgtttttagagtactacaatttagtgcacacccaacactgcgtaagcatatgcatgttctttacataagcttgaagtatcatcggaggcatcaaaatcttgtagagctcaggcatatgcatatccacttagcatgtatttggtttaagggttgagatggatcggattgggttgaacttatgtttcagcatatttgactagagaacatgtgggatgggatggtctctgatagggaatattcctctggtgaaccaatccaacccattattttttcttgctgacatgttgaccatctcttagcatgtgtttggtttaagg

SEQ ID NO: 13466 - DNA, 1501 bp, Oryza sativa
gaagatgatgatcgtaatcagagactgaccagtaggagacagtggagaggctactgggaagatcaagagctggctgatctggcttcttcatcgccattgacgagctgatcgagctcagctgctgcttcttcttcttcttcttcttcttcttcttcttcttccaagtcgtagttagcacactactccttaattaactaactagattctgctggatgggttggtagttgatgatgttgtgttcaccaatcgacgagctcatcgagaaatgggggagtttatatatggttcaatgcgtgtggaattcagaggaaagctggggcggctaatgattttgcgaggaaattgggcgggagaacgtgtgggtcaggaccgaccacggcaggtacgacgagccaagattgatactcctaccatatcatatgcactatgcagagctcctaactaattgtactgattagtgatattaatgcaggttagtacagtatgattcattgatgtggccggtgctcccagcgccacggcgtcgatcgatcgatcattccatcgcacgttccaaccaacccaatcaatcatcgaccctggaatctggataagcactaataatagtattatcatcgactcttttttttttcttatcttgatgatacaaaactgagagaatcacagtgcacatgtaggagtgctacaacttttaaagtaaacaacaatgatttaattaagtatttgttttgtgtactctagccaagagaaaagaaatagtaaaggaaaagggagaagtcaacgcctaaagaagtctccatttcagtaatatgatttcagtacagtactactgattactagtactgtacgtagttcattagttctgaccttccaaaatgggcgttgaactaaactgggctggaagcttgaaagcctaacagactaaatgaggcccaatttcaatttcaaagagactgatcgatctgggctaagaggccggtgaataagtttgtgtccggcctctctttgtatatcttgataatataggaataagttcacttcgtgaccctcaaagtgatcgagatctaacccgtgaccctaaaccacaaaaccggatatctcgacccccaactcttaaaaccagtgcaatttgactccctcggcggttttggagggcggtttcgctgacgtggcgcatacgtgacaatattgactcggtcttctgtccacgtggcgttgacgtggcacttacgtgtcattagaaataaaaaatatgggtgggacccatttgtcattcaccaaaagtacaggtgggacccactgacatgtggggcctacataaatcatatcctccccctctctttctcttcgtgagcgttggacgggagctagcggcggtggccggcgcctcctccaactccatccacagcctcctcctcccctttcccgcggcgtcgttgctggcggcggcggtgcatcagcccgcaagcggcggagacccgggagtggcactggagcggcg

SEQ ID NO: 13467 - DNA, 1103 bp, Oryza sativa
acaaattgaggctaatgtggcttaaggtgtagttgtagttggtgggtttactgccctgttctttgtgatgtaattgaggccatgtgtgccaagctgtagttgatggggtttgtaccgtccacattagaaatttagctggatgagggtcaacttataagcattggctctccaaccatagcacctgctggtcagtctttttacatgaagcaagcacgaaagtgtaagtaaggtgttgtgtatgtgggcccgctcctcgaagagctcagctaacgtggattttggaattagggtgtgacaagaagcccccgtattaatactattgactagaaattactgtattaattgaaaatagctagaaattatgacattaatcaatagaaaataaccatctgagccattcacataacaaaggcatgttgattgttgagacactatagaaacacatatattcattagaaacaagtagtgtttgcataacaggaatctgcattcatgtctgattcagttagcttgatttatatttttagccatgcatgactctactcatacatgcaggcctgtttctttccccaattttctttccttcccttctgactgcaattgatgaatgtgtatagattacgacaatacttgcttcttttgcatttacttggcacttctgaccagtgcacatataattaagcttgatcttcttgataagtgaatgcccaaaatatcccttgtaacaacctctggtaatagcgacagatctagatgcaacatttggcagccattagcatgagtttaaattttgagttgaataaatgtttggcacccaggatggacagattattctctagacaaccagaatggtaaaatgagaaagtgcattaggaatagtatagtgccaagcatttatggaagaaaattttagtcaaaagtgccaagaatatgcaaataggagtatcaaacatgtcaagaccatgcaggtgaatgagttaatttgcttgaacatatcatgagcttttaaacatgcaagtatttaatggacacataattaaaatttgggttgttgcctgctctttgagttataaaattagataatgtttttatctttttgcaga

SEQ ID NO: 13468 - DNA, 1501 bp, Oryza sativa
gattattactccatcaaaggatggatcagtccatggcagcccatatgccatatgcaatccaatccatccaaccatgcataataccatcgtcgcagaactcgtgtacatcgcacaacgtgctacctagcacctctcacgctcttcctcctggtaccaatgagcaacggccgacctctttttcctccaccaactcgagcaaggagatggcccagcaattggcgatgttcttgacccctaaatgcccaacgattgcaatcatccctaacatgctgatcaggtctgctaattctctttattactccaccattgtgttctgcatgcaggctttgtcaagccatcgaccatcatccttcctccttgtcgcatcaactctcgtcccatgccttgcagggccctggttaggggtacgggaactcgcttaagatgagatgagagcatattttgccccgaagtagacgttgaggattggggaaggggacgtttcaggttcacccgctctattgtcacccctaaccaacatggttcgacactgttgttatgtcttagagtggacatggcacggccgggctaggtagatcgatctagccatctcagcacttaacccgagagctcttaaatatatagtttagcttgaaaaagcaatggtgatgttggggtcgtaggtgcatacctccacttatcaaggctcaaatcacggcgaccacgttgttaggagatcgatagaaatttaatgagattaagtatttatcaccgaatttcttctttttaagcgtgtgttaaaggaacaaattcacggatgtgtgagtggtttgtatgtgcataaaggtgtttatggatatgggtctaccttgtaatgaaatgaaaatggttgggcctatctctctttttctactgttttatagtagcaccatttgcaccaatacgaggacactcctatccttgttcgatccgaggaattgactgacgagggatccctgtaaagatggccggttaatcgcttatgtacactattgcagtgatgatgctgtactcgtaccgtatgtgcccctgctgctactgtacattcagctgcacagtgcaacatcagcctgtacgtgagacatggcagtatggcactactagcagtagcagcttgtatagcatgttcttttcacaagctataccggcgaatttcagaattcagatgatactaccacagcactcgacagagcttggtcgttgcgtaattattccgcgcaaccagggacaggcagtgagtacccaaagctagcctatcaggtgcgccgctgtaagtacgtgacactgtgactgtcactgtagccacagtactgcagacaaacgtcccaggatctgatgggctggaagatggggttcctgtacactcaggccggctgcatcatcagaccttcagttcaacacatcgaaaccgcacagactgtaactctggccggcccccgcactgtcgcattgggctcagcccatctgatctgtagtctacagg

SEQ ID NO: 13469 - DNA, 666 bp, Oryza sativa
ggactaaagatcatctttagccccggtttttattgcatccgggactattgtggaaatcggccgaccgacgaaagatggtttctccaccagtgttacttcctctaattaacgtgtcagcggtctaggtcacgtaagagatttctaatataatgtatgcgtttgttcggagaacaaagggagtttgtttgtttcgttttccacacgcacgtttcccaaactactaaacgatgcgtttttttaaaaaaaatatatatgaaagttgctttaaaaaatcatattaatctatttttaaagtctaaaataattaatactcaattaataatacgctaatagcccacctcgttttgcgtatctttccaatcttctctatctccttctcctcaaagtctcaaacacagctacacaagatttctctggtatactgtactctaacatacgtgtgtacaaacatgtcagcttcacaaaatcggagagagagagagagatcgacgtcgacgtcgctgcgaggctagtgcgtgctgtgccccgcaagctccggtacgtacttcggtacttactctatatctacacacgtacgtgtgctatagctagcagctgagcttgcgcgagctgcagggaattggttaatggcgtcgccgccgcgggaggaggccatggatcagaagg

SEQ ID NO: 13470 - DNA, 867 bp, Oryza sativa
ccattggctgtcatctgctttctccctcgttaattaagaatccaaacacccaactcatcttaaggcgtgctaagtactcactgtcagggttatggataccacatacctaatagtagttgactaaatctcggcaggatccattacataccatgtcttatacggaaactgacctcgagggagttctggataaggaaagacaatcagagttctacatggaaacgacaacaactactcggattgtatccatattggtttccctagttctacttggacaaggggacacctatgggtataaatacaggaccccctaggaggagaggggggacaagacaatcaacacccaacgggatcaacactcgacaggatcaacacccaacacaatcaacatagaagcctacatacgccaagacacgccgccggatatcgacttcagggataagcacggctaataccctacggtgtctccgaatactgtcgggagaaacgaaagcgctatctctgatctcgccgggcacggattcgaggaggaaggctaccttgttgtcgactacgagtcagatcgtcagaccgccatgtcgacaacagttagattggctaccccaaatattgtactcgtgtgattatggtgaataagagcaataccggcttcggccaacagaatgtagggttattacctgacaactcaggggcccgaacctgtataaaaatccctgtctccatctcttttacctcagtcttgcgtatatcctagcatcgacgatccccataccatgcaaataccagaattgcgacatcaaacgtcgacagtggcgcgccaggtagggggattttggtgcttcaggatttcgacgagatgggtttaagaga

SEQ ID NO: 13471 - DNA, 1501 bp, Oryza sativa
tgtcgacatggcggtctgacgatctgactcatagttgacaacagggtagccttcctcctcgaatccgtacctggcgagatcagagatagcgctttcgtttctcctgatagtatgcggagacaccgtagggtattagccatgcttatccctgaagtcgatatccggcagcgtgtcttggtgtatgtaggcttctatgttgattgtgttgggtgttgatcctgtcgggtgttgatcccgttgggtgttgattgtcttatcccccctctcctcctaggaggtcctgtatttatacccataggtgtccccttgtccaagtagaactaggaaaaccaatatagatacaatccgagtagtccttgtcgtatccatgtagaactctggttgtctttcctaacccggaactccctcgaggtcagtttccatataagacatggtatgtagtggatcctgccgaaatttagtcaactaatattaggtatgtggtatccataactctgacagtagcccccgacttcgatgcaaatgaacgagttcatattctcaaccgcagactttggaggaactgttatcgagctcacatgaccgttctcggtgagtttagagataacgttagacttcctttattagcctcatgcgggcaccgaaagggtttgtctaagtcaatctctgatgtcgaccgagaaagtacagagcgtacgactaagtctcccgtcttgctgtaatcgagaatttggattgaagtcaagaaactttatctcggcgggtacaccatctcttcattccgtattctttgtcgagatccagcaaccgttctcgagtgatcgagaaggcgtagagtctgcgacggagccttgtcgacatttgtcgtactcgccttagtcgatcttggtgtagaaccatagagacatggagtcttcgataatgtcgaatagaattttcctgaaatcaatactcagaaaagaatattagatagaaatagcccccgagcgaattctcaaagggtgacatgttataatatggcagactagtgaattgaatgtacagaccagtgctttgtatatgagcgtcttctctcttaccgactccgatcagtcagtttgtagagtcatacactctccctagcccccagccttgtcgtcggagaatcgttctcagaagataaggctcttggacctttgacctgcctcggttgaacaagcactgatcctagcccccagctgtgaagttggaaaatccatttccgattacacagcttggttaatacgcacggcgagaactcttacatgaccagatcttacatggtctttcgtctctgaaggatccgacaaggccttatcggctctgggcgtccccaaccgaagttcccttaggttcctcggaggccttgtcaagacggcgtaaagggacagtaggataggtttcaacgctaggtgtcatctgggtaagggatctctgggtaaaacacttggcgatcttatgcacctgatatcaactttgttga

SEQ ID NO: 13472 - DNA, 1474 bp, Oryza sativa
ctggaaattggacactggacactggcactgcaatttgtgatttggttgtatcagcgagatattttaggctatcttagggcctgtttagttggtgaaatgaaaattttcggatgtcacatcggacgtttgaccggatgtcgaaaggggtttttggacacgaataaaaaaactaatttcatgactcgcctgaaaaccgtgaaacgaatctcttaagcctaattaatccgtcattagaacatgtgggttactgtagcacgtatggctaatcatggcctaattaaacttaaaagattcgtctcgcgatttacatgcaaactgtgcaattagtttttctttttatctatatttaatgtttaatatatatattcaaagattcgacgtgatgtttttaaggaactaaacatgcccttagcctattacttcactgatttgtgcatgtgcagctgattcaaatgtctaccatttgtcgtccagccgaaccctgctagtatggacctccccgggatatttagggcccatcctagtagggactcggtccatccataaaatggtccgtgctctagaaatcactgttgccaaatcagctgatcggtctgcaactgcgctacgataattcagtctccacatggccccacatgtcagccctaaggattagagcatgtacaatagcagactattagctagctacaaacatattttaatgagataaatgatgagagagaagagcagcgtgctataaaactatagccagctgcagcacagactctaagacacaatatatataggataggtgggaccatgtattaataatatagtaagtaattattgtatgaattggatattagattggctatagatgaattggagttagtagtgggctatactattaaacttgctcttaggctgtgtttagtttcacgccaaaattagaaatttgaagaaattaaaacgatgcgatagaaaagtcgaaaatttatgtgtgtaaaaaagttcaatataaaagacaagtttgaagtttgaagaaaaaaaattggaaactaaacgggcccttacacgcccacgcgcccccacaagccgaaaccgcctcaacccaacgtccccaccgcaacctcccccacatgtcagcgtacgtggactggggtccccgtctcaataaacccccgcgcccacgcccaccttggcttcttcgaccaatccgcgcctctgccagcttgtcgcgacgcgcgctcccccgcctttctatttcacccccctcctccggcttcgcgccactccaacccaatcccagccatcaatacctgcctccgcttcgccatctctcccgaagcctcctctctctctctctctccccccgattccaccacacgcaatccaattccaacctcgtgtgcttccacttgtgcgtttcgcccgctgctgtgaacgtactgcgagatggcagcggcggcggcggcggcggaggcgaagcaccgga

SEQ ID NO: 13473 - DNA, 207 bp, Oryza sativa
tccgtggtagaacggtcacgtacgtaatgaaatgcgtgatgagccttggcgtgtggtgtattgtaccgtgtacatgtccgtcgcctcgttttttaaaagatatatatatatatacgatttaaatcttacaatttttggcgttccttccggtacgtcctccgcgccttgttattacaggctctgcctgtacatacgtacgtgttggta

SEQ ID NO: 13474 - DNA, 1025 bp, Oryza sativa
acttgcatgtgcgtaatatttgcggacattaagatttaaaccctggtgtatggagtcatatatccacgactccagcgccgccacaccacttatgcttccccttggggtcaactattatggttagcagccgacttgcaaatgatcattgccgatttagttacgtaacagccatgtagtttaatgagattcccagtaacatctacaagaatctcgtccatgctcacatagatagagatgcatttttcaacccgtgtgaaacaaaggtctttgtttggaaggtgaaagtttcaaacataaaaatgtagaattgttttttctaacatgcacagtcctgcttataagaaacatatgcgctgctctcattaaatatgtgatcctcactaaatacgtggccacttattggatttgacaataagccccgtgcaaaggtttgaacacaaagataggatgcaacatgcatgtcatgagtttgaaaacaacggtcatgcaaatttttatcgactatgattaaagtttaacaataggatatgtggcgaaacaatgtgtctctatctattggtgtctggttttattttctcatatctattttttaatatataacaccgttgatttttaattgaccattcatcttatttattttttttgcaaatataaaaatatttgataataaattaagtcacaataaaataaataataattacattttttgaataagacgaatagtcaaatataatgtatttaaaaaatcaacgacgtcacacattaaaaaacagagtgaatactttaaaactacatactttgtaataatttattagctctttaaagtaaaggatggatttctcattatattttaaaaagtattctaccgcaataatgcacccacaaatttaccactatcaagtgtgttgtttctaaaatgtaatatttttttaatcaccaatcaatttagtctttgtactatgaattagggaaaaggagacccgaagtgcgggaaaaagtacattaacatgttacagcgatacgtc

SEQ ID NO: 13475 - DNA, 236 bp, Oryza sativa
ggggcccacgtgggtcccatatttttaataattttctatgtgagactgacatgtgggtcccactggttttattattttttcaaattgaattgctacataagcgccacgtcaatgccacgttagattaagacccgagttaaattagctacgtgggcgccacgtcagccaaaaccgccgagagacctaatctgcactggttttgatagttgagggactcgttgtgtctggttttcagg

SEQ ID NO: 13476 - DNA, 1501 bp, Oryza sativa
cctagaagttggaggcttgcaaaaagacatgtatgcccttgtacatacctatttgtaaggggttgggatataaaattacctatgtaccataccctagccctatacaatactgggtttcaagggaaatgcaatgaacatattttttaagaattaagaagattagggtttgagcgtacatcacatcaagggcattggaacttctctaaggctgtatttggaaccctaagttcccaacccctctacctcgtattccacgtgcacattcaaactgctaaatggtgcatttttttgcaaaaggtttctaaatgaaagttgcttaaaaaaatcattttgatccattttttttaaaaaaactaatacttaattaatcacacaccaatggaccactccgttttccgtgcacactgtgcgtgttgggaacatatgcttccgaatacagcctaagttcttgccctaacaaattgttgcctttgataacactacctttttatttgttatacataggatgatataaattcgtcaatcatacagtaattagcatttacttccccctctcaaatatatgactagcctaaaattgcaccaaaagaaacacaaacaataattaaaaggctagcatatctatcttctccatttctcatactcaaaactagttggtggtctaccctaagccttagattttgttacctagactctcgttgtaatatacagatttatgtctagatgaaaaaacaggtcttttatcctagtatgagaaagttttttttttcttattttctttttcaaaaatatattgtagggtcataaccggatttagttactcgtgatcaatctccacaaaactatatttgttgaaatgagctacataaacacgacatgtttttcacatgcaaaatttagacacttcttagataattcgttcgtgagcataatagcctttgcccacgatttcttgaaataaacacccacttaacacaaactaaacatcttccctagctaaggctaacttatgccttttatcattttgttggtcatgatgtctctataacaagctataattggcctcgaaactaaaccttggtgaggtcagcttttaagcaaatgacccccataggatcatagtctctcatgctatgtactgtagatgacagcaacaaattatatgagcgtgtgctttcaatagaattttagcaaaggttaaggagctgctgctagtctccatctatttgaccttatgttcgggcacatattcccggagcgcgagtatagtgatatatgtgccttcactcttatcttgaaaaaaaaagagacaaaatttaagactttatttaaaaaggatggtcatttataaaatttgaaaagtataaaaaaactacttctgccttactttcactacacgaaacaaatgaaggatcatgctgcatgaaataccacattccacaggcacctcccgcaaaaacaccgaaggtccccgtatgaggaggcagctcgtgctcgggcg

SEQ ID NO: 13477 - DNA, 1501 bp, Oryza sativa
cgggcactgtctcaagcctcctctgcctcaccgcccacgaggctacttgatggatctgaccaaggagagcctggaattgggtgatatcatctcggcagcccaagccttcccttaataattgattgttgccttcactataccaatggagctccctatagaaagaggggcagagctcctcaaagggagagggtgctaagccgatgggaagtctgatgctcgttggtcttccaacaggctgctttggatagcggagtaggaagagggatggagaaacgacggtggtagaggttagggagctgggtgccacccatgctgcccctatctctcatccatttcgcgtgttttttctatggtctaatcaaacgtgtttttcctgtgttctataatcttctgctttgtacttgcattcctatcaaaatcctacattttttatatttctctatttttttcattcctgcaattcaaaatggcccttaaattttctaataccataacttgtgtaacgtgcgtaggccacacagctcccgattcataatattttgatgaatcattttgttcttattttagataaatatgaaactaatgtttaggtgcttcaataccataacctgtgtgtacatgcgtgaatctcggatgcaaagtgctgcgggacttatgtggtgtttgcatctatggactaaattttagtccatatcacatcggatgtttgtacactaattagaagcactaaacgtagactaataataaaacttattgcataaatgagagctagttcacgagacatattttttaagcctaattaatccataattagcacatatttattgtagcatcacataggctaatcatggattaattaggctcaattgatttgtcttacgaattagttcagagttatggaatgggtttattattagtctatgtttaatacttctaataactaattagtgtccaaatattcgatgtccagggattaaaatttagtccctgaatcccaacaccaccttactaatctttgcttcttcttttttcagaacttactaattagtcctgctatgacgacatttctgcgaggctgcatatgtatgtttcagctgggtgtagtggacctatggttggtagtgtggaagatgcatatcgcttatatacaaacctgccgagatttgcggctcctggagatttttgagctggcgtggccacctgcgcgtgccgacgcgtcagcgaggcgctggatggcgggtggttttcgtgagctctcgcacgtccgtgtcgtcgttggtgattttgcaaaaacacccttcatttacttgataatttgttatagatccctggtccttagttctaacgttgtgcgctcttacttagaggacctcttaagaaaacaatattctatatgaagaagcgaaaaaacggaaaattgaaccgcgctctgaaaactagaagtttaggggttgtttttgcaaccctcacccctttccccaaaccctagccgccaccattc

SEQ ID NO: 13478 - DNA, 1501 bp, Oryza sativa
agatccgatttactctggtttaatagatgggggatactctctatccggttttgtggttgggaggctctgcactcagataaaagccgatcgatagtttttgaagacaaaataattgaacttcgtccaaaactcatgttcctcatctgcatgcatggatcacgttgacacgtaaatctgagcttttttggaattttttttcatttttaaatttttattttttaatatttacagaaatattataccggcgaaaagttgtacagaagtagatcctgccgccctacctgagggcggtagggtgacgcgaggaacggacaagatgaaaataaaaactagaaaaatacattttttggcagggtaaaaattgcatttgcccacttgcaacctttgcagagggcagcaaaggacctcaatgcaaaatacgcataccttgtcaccctccacttgggtggcaggggccatttctgtaaatattttggatgatataatatttctgtaaatattaaaaaatacaaattttaaaatgaaaaaaaatcagcattttcatcgatcgcgctgggccaaaaaggatttaagcccatccggcgaggtgaattattgagaaacgggtaattaacctgttggactgggctgatatattctcgaatgcgcctttattttgtgaaataagtccattttacctccctcatctcttgcgcttgtgtgaataacatctctcaaccggaaaaccgggtataacgcctcctccatctccgaaaaccagaacaaatcacctccctcggttgttttgctggtggtttcgtctgacgtggcgttgttgacccggctgacaagctgactcagcgtggtgggacccacatgtcagtgtgtagctatctctctctcccctggcctttctcttcaccccggtgcggctcgtcgacgtgagtcgggcgcaaggcggccgggcggtgtgttgcgacgcagagaggtagccgtgtggcggcggtgatgcgggagagcgcacggcggcgagcggcgcgtacggtgtgctggtcggctacgggcggcggggcacgcggcgacctggcacgggtaaggcagatggcagcagatggcgaggccgggcacggcacgtggcgacctggcacggcctgatgacggcggcacgacgcggttggccggcggggctcagcaacgggcggcgggggaggggtgcagccggcgacgggcgaagatgttaaatgacatgataagggttcggttgattcagctgaagataggccttgcgccacatgtgatattgatccggtagttagaatagataagatttgttttgattgttatcacatgcagtttgtttcctagatttgagggatctgtttccttgaagcgatatatgtaaaagccacgatgggggctattcccatctgatcaacacgcatccagcgcacagcatgagtgctgctgtttctcccagaaactttccacatggtatcagagctctgatccgttccttgcgatc

SEQ ID NO: 13479 - DNA, 1501 bp, Oryza sativa
gtcttgtttgtggcgccatctaccgtgacgctgatcttcgccggtggcttcttcgtcgcaccagtcagatggccttgaagccgtgctcctctgacggcagcactgatttgtaccttccagagggcatgatttgccttcccgagcttctctgtgatcaggtggccttgaagtggattggagttcgtcgagctagacgacaacgccattggagactgatcgcaaggaacggatcagagctctgataccatgtggaaagtttctgggagaaacagcagcactcatgctgtgcgctggatgcgtgttgatcagatgggaatagcccccatcgtggcttttacatatatcgcttcaaggaaacagatccctcaaatctaggaaacaaactgcatgtgataacaatcaaaacaaatcttatctattctaactaccggatcaatatcacatgtggcgcaaggcctatcttcagctgaatcaaccgaacccttatcatgtcatttaacatcttcgcccgtcgccggctgcacccctcccccgccgcccgttgctgagccccgccggccaaccgcgtcgtgccgccgtcatcaggccgtgccaggtcgccacgtgccgtgcccggcctcgccatctgctgccatctgccttacccgtgccaggtcgccgcgtgccccgccgcccgtagccgaccagcacaccgtacgcgccgctcgccgccgtgcgctctcccgcatcaccgccgccacacggctacctctctgcgtcgcaacacaccgcccggccgccttgcgcccgactcacgtcgacgagccgcaccggggtgaagagaaaggccaggggagagagagatagctacacactgacatgtgggtcccaccacgctgagtcagcttgtcagccgggtcaacaacgccacgtcagacgaaaccaccagcaaaacaaccgagggaggtgatttgttctggttttcggagatggaggaggcgttatacccggttttccggttgagagatgttattcacacaagcgcaagagatgagggaggtaaaatggacttatttcacaaaataaaggcgcattcgagaatatatcagcccagtccaacaggttaattacccgtttctcaataattcacctcgccggatgggcttaaatcctttttggcccagcgcgatcgatgaaaatgctgattttttttcattttaaaatttgtattttttaatatttacagaaatattatatcatccaaaatatttacagaaatggcccctgccacccaagtggagggtgacaaggtatgcgtattttgcattgaggtcctttgctgccctctgcaaaggttgcaagtgggcaaatgcaatttttaccctgccaaaaaatgtatttttctagtttttattttcatcttgtccgttcctcgcgtcaccctaccgccctcaggtagggcggcaggatctacttctgtacaacttttcgccggtataatatttctgtaaatattaaaaaa

SEQ ID NO: 13480 - DNA, 1501 bp, Oryza sativa
cccgcagcaacgccgtgggatattcatctagtttatctttagaggatgtttgtaatagtttaatactcctatcgtttaccatttagcttataagcagcatctaaaatttaaatttaaaacttatttgaagtagtatatttttcaacatttattttagactgctaagaacacacatatatatacaaattgtttttttttccgataagctgttacgacttacaaccagcacaagcaaaatgatcacggtgtaattcgatatttggtcaaggatgatgggtttaatatctcgagtgtgatacatcgccatcagtagagtcattgtgttgaggtttgcgtaattaagcgtccatgtaaaaaaatgagagaaataccatgcgtcaaatttggtgtaatgaatttcataaaactattgggcaaaacagatcactcattatggctatatatgagcatcttacacaataactgatccaatatttattattgaggtggcctttaactttgtttaatcactacttcatttgtcctaaaataaacaaacttagtactctatccgtcccaaattatatggtgtcttttttaaggaaaattaaactcggtaacttttgactaataatcatactaactatatatatatatatatatatatatatatatatatatatatatatatatatatatgctaagtattatatatgttacataactagattcatattttaaagtactttaatatgatgtatttgtaactagaacataacatgaaataaatcaatgatcaaagtatgtcattgaaaaccgtgtaaaaaaaatatagaccttataatttgggatagagggagtacgagatataacacatcgtagtatctagatagagacatctagattagtagtactagattgtgtcatattccgtattagatttgtttattttgagatgaacgaagtaatcgcttagcttggctaaaaagtaagacaaataatctagtctaattttgctttggccgttgcttcttcctattgttgctgcggtgtacaaacttaaactatctaacaaagagtttgttgcaagacacataaatttattttaaaaattaatcgagagatagatgcatacaaaaacgacataattatatgatatataatacctctgttttttaatagatgacgccattgactttatcatatgttcgaccattcgttttattaaaaaaaatttacgtaattatatatttttttggttgtgagttgttttaccagttaaagtactttaagcatgatttatatattatatatttacatttacataaaatttttttgaattagacgaataataaaaacatgtgtttaaaagtcaacgcgtattctattaaaatagggaaggagtataatccaagcaagacagcaccaatcggtgtgaaaacatcaaacacagtcacagcacaggtgacacactgtgtgacaactgacaaatgacaaaaatccggtaggggagcaatcgtac

SEQ ID NO: 13481 - DNA, 937 bp, Oryza sativa
tgtgggtcccatcttttttattattattttatgtgactgacatgtgggtcccacagattttattatttttctagatcggattgccacgtaagcaccacgtcagtaccacatcaaatgaagaccgagtcaaaatggacacgtaggcgttacgtcagccaaaaccacccttaaaatcgtcaaggtacctcgtttgtccggttttcgtaagttggggacgggtcgtaccggttttgcagttcagggacgaaaatcagactgggcgacaaatagagggacctaaaatgaacttattccttcaacgtttgtgtgctgacagagtgacgagcctcgattttctaaaaaagaaaaggttacaggcctcgaacaagatgctgttaccaaagttagccacgaatttggactagaaaatagctaaacatgacggcttgatcgaagattacgcaaagttttagttcgactttcgaacttataatagttcaaaataatcatctgctgtcatcatctactcaataaaaaccgaaatcctctgtcaccatcaaaacatagcaaaaatcaaatgccattaaaaagtgccaaatgacagttgacagcccaaaataaaaaagaagaaaaaaaaaggaacactattatattccagatttccagctgcaatatcaagctaccaaatggatccccaaaaaaattgcaatccattccatgaactgagcccaccatgcaccacacaacccccgctcctccacgcttctcgggctcccgtagaccgggtccacccgccaatccccccacacgtcgatatctccagcacccaccgcacccactctcctcctcactccgctcccctcctctcctcctcccttctcgcggaggccgccgcaaccaaaaaaaaaaaagtctaaccctagatccaggccccgcgtctccggcgatctcccggcca

SEQ ID NO: 13482 - DNA, 1501 bp, Oryza sativa
aggcgggcatccggctcttcatgctgatcctcccgagtcggaggcgccgacgagggagtggtagccgaatggcgtgcagcagccgccgctcgccgcgcccttcgccttgatgacacagagccggaggtggcggcgccggaggtcctggtggtggcggaccgtccaccagcacccaggcgctgctgtgccgtcatgaccaagttggccacgtcgtccagccatcgctgggctggagactccgggtcagggacgacgggcgggtgacgtaggagcgcgccagcagcctgaagcgctccctggggcgtgctgccgtcaccgtagacgaggaggcgacgctccccgtctcgccgctctcctgcatcacctgcgactggtgatgctgtgggtttttcaaccctctcgagcgcctccccccgcttaggactttggcgcggagaaggtgggggagtacgagctcgatggcgcgggtttggctccccgtcgtcgccgctcacactcggagagaggtcgtgcgcctttgcttgctcggccattaggctgaacaagggaaacttggcgcacacggaagagtatgagagctcagaaaacacacgctgagccccctacctggcgcgccagatgacggagctcgtggctcctcaccgggagaccgcgcaggcccccctttgccagttcggccgggggcttagggtgagatctcaagctctctctgtatgtggaaagatcgcgtgccaggaagaaacgcgagacacggacgatgtatacaggttcgggccgctgggaagcgtaataccctactcctgtgttttttgtggatctgtgtaagagcaagttacaaaatatcaaccagccctctcctctcccgggaaaatccagtcccctctctttgtgggcatggtcctccttttatatcttaaggggataccacatgtaccctctcccttccaaactggacttttcttctctttatggacggaggttggtatggttgccgcccgaatgacacttcgatgggacagcccacacctacctccactcccggcggagacaggcgcaacgtgggatcgtggctgtctgttgctgacgcgaccagtgtcagaccggtcacagatcggtcattcttgtcctctatgcgtcagttcagcgatctgcatgatcacccttctttttgtagcatcttgcctgtaatggttgggatgaagcctggtattcatctaaccagggctaacgtgccatctctaagaggtaacacgctagctccggctggagacgtgtgcctagaggctctcgtcttgacgggacggggcgaggcgtgcgtcagaccgccagtcgccacctaaccgttgatccgaccggtctgtgactggtcacagaccggataaaagagcgcgctgcattgcgctgcatgcagcgtgacacgcttgaccagaccgcaataaatgcggttaggtgagccctaccgtgttcacccaacctatgtacatagtgcaaaccccacagg

SEQ ID NO: 13483 - DNA, 1501 bp, Oryza sativa
tatactattaacatatggtcccacctgtcatacacacattacatcttggagtccgtgctgtagctggctacagatctgtagcccgctgctcttctctctcatcttttatctcattaaaatatgtttataactggctagtagcccgctattgtacgtgctctaaaaagactcttcacagtagcaagctagcatagacatcttgtgtcgttcttctccaatcctaggttatacatacctttggttcgtcttcaaggctcttaattggtcgttggttccgcgcgtctttgagacaaagttaggtaaaatttttcacactttgcatccaaattagtttgtttatatagtaatgtgtcggtgatatgggaccgggagtattgcgcccggaggcttgaggcagatggaatcgcccacgtggcctggcaccttcggggacgtcgggcccgagggtgaggtgtccgccctcctcctgatttccccaagggggggtcgggttgctcctgccccggccccgagggacgaggtgccccgaccccctgtggggtttgcactatgtacataggttgggtgaacacggtagggctcacctaaccgcatttattgcggtctggtcaagcgtgtcacgctgcatgcagcgcaatgcagcgcgctcttttatccggtctgtgaccagtcacagaccggtcggatcaacggttaggtggcgactggcggtctgacgcacgcctcgccccgtcccgtcaagacgagagcctctaggcacacgtctccagccggagctagcgtgttacctcttagagatggcacgttagccctggttagatgaataccaggcttcatcccaaccattacaggcaagatgctacaaaaagaagggtgatcatgcagatcgctgaactgacgcatagaggacaagaatgaccgatctgtgaccggtctgacactggtcgcgtcagcaacagacagccacgatcccacgttgcgcctgtctccgccgggagtggaggtaggtgtgggctgtcccatcgaagtgtcattcgggcggcaaccataccaacctccgtccataaagagaagaaaagtccagtttggaagggagagggtacatgtggtatccccttaagatataaaaggaggaccatgcccacaaagagaggggactggattttcccgggagaggagagggctggttgatattttgtaacttgctcttacacagatccacaaaaaacacaggagtagggtattacgcttcccagcggcccgaacctgtatacatcgtccgtgtctcgcgtttcttcctggcacgcgatctttccacatacagagagagcttgagatctcaccctaagcccccggccgaactggcaaaggggggcctgcgcggtctcccggtgaggagccacgagctccgtcatctggcgcgccaggtagggggctcagcgtgtgttttctgagctctcatactcttccgtgtgcgccaagtttcccttgttcagcctaa

SEQ ID NO: 13484 - DNA, 1501 bp, Oryza sativa
attaaatgcaagtacaaacaagtacatgtgacaatagtttagagatctacatgaccatatcgatcgtaatacgtccatcgattttgaaacctacagtatatatatatctgcaactaacacaaatcgatagatctgatccttaattacccagttaaattaacctgcagttacgtgtgcacgttttaggctgttcccggccaagagtttttatttcatgcatgatgctggtagtgaactgccaaaactgatcgtcaattccgtgcatgattccatcatccatgctagtagtagatgactatgtataaataggcatggattcacacgtacgaatgcggagaaacgcatctatatatccatctctggaatgcttgcttacgtggaaaattaattttaattattaattcccggaactcgatcggccattagatttcgggtgaaacatgaggaacatgatcatcatgcatgcatgtacttatctacagcgtatttatcagagatctgaggtgtgcaccggtgacaaggaatatctctctagtcaagcataaaattaagatggtaagaaaatttcaaaggggagggggccgggtagatcgttgccggtttttcttttccattatgcgcccgcacatgctgctacccgttaattatgatcaatgatttgtgctttgttcatttcccttaatgttactcctatttaatttagttttttgtcggctggcacgtcctatacatacgtctatgatgcatgatataacgaattaaagattggttagttaactagcacggtgatctctacagattgtgccgctagcattgttacaaaattttatcagataatagcatatatactttcacgcttggttctgaaaggaaaattatgattttgaattagggttaaacttgatcaaaagtatatcgtatgatattccaactaattaatataataatttctatgtctagcatagccaatatgataaatcctttagcatctatctatctattatctactaaaagtccattaaactccctagaaacgctcctaagctgtcacgtggcgttcctacaaacgctcctaaatcgccacattattttcagttaaactggtaggcccattattttagaccgttagattggatctattttaaaatccctggttcatcttaatgtccgggtaggcccattatctaatcacagctgcttcttaatgtccgatatatagaagagaaattttcacgagaaaagttaacgtacactataattggatattacccatatgtattgttcacttcaaaaaaccaaacaaacatacgtatctacagctataaagccagaaaaaaaacatactatgctgtatgctaatagaacagcggttttaaagtagaattttctatattataaaataaaatttattactccgcatatatccatgtatatgcacagtttaaacaagattaatataaagtatcaaatcaactgtctttaaatgttcatcttttaaatt

SEQ ID NO: 13485 - DNA, 800 bp, Oryza sativa
agtgttggtagaatgacatgagcgggaagatatggcgagcaaaaaaaaatatggaagaaaatgacaccattatctggcgctagatagcattcgccgccctcgtgtttggtgttgctgaagcaaccaccttaagcaaggataatagtaaactataagtttatatggagaaggaagacaagaaaagtacaaagctctagtcatatgcttcaaggtacatgcactaaatacataagcaagaaaaggtgaagacaaatgttatagccaatcttatacttgtaatatgagtttataagtagttagctctaccattcaacttgagtaaagtgcattggcggtccttcatcttatagggttgtgttatataggcctctaaactctcaaaatacatatctgagtcacgtaacttatcaaagtgtatcatctagattctaaattgacacatcacctctaggatcctacgtggcgttgatgtagcatgccacatggacatgatgtgtccttttcttttttttcttcttttatttttctttttattttccattttcttctcattcttctttttttccttttaaatttgtagccagctgcagcacgaactctaagacgcaatgtgtatatgacaagtgagatcatatattaatagtgtagtatatgtttataggtaactattgtatatattggctattaaagtaactatagataatttggagctagtagttggttatactaatcttgctcttagagcaggtacaatagcaggctattagccagctataaacatattttaatgagataaaaga

SEQ ID NO: 13486 - DNA, 1501 bp, Oryza sativa
gaaacgggaaaggaaaaatcaagaagcggaggcgaggcgatagaatcgagcagcaagatcaacggcaagacaagtagcacatggtggttgccgaattcagagaagacaccggcgatcacatgaaacaagaaaggggaacgaacagaacaaatcagagaccacgaaatcgtcgaagaacacgagcaaacagcaaacaagctagcggagttcttctaacgtgcgcgcaacgcggagcgggtgtccgccatgcacagctgcgggcaatgccgccgtcgtccccgtgccagagcctctccgtcctcatgctgcagtacaacccgacgctcggcgacatccccagtggcttccttctcggatggccggcgagctcctcccccgcgcgcggccggccgacgagatcctccccgcacgcggacggccggcgtgctcctccccgcgcgaggactgccggcgagatcctccacacgcgcggatggccggcgacttggaggggctgcctcgtcctcacgaccccctctcagatgatgccccggcgccctcccgcctcctctgcgtgctcgagccgagtcgctcccccgcacgctgcgtggccagccgacgagttcatcccccgtgcgccgtcgtcgccgccctgctgatagaaggtcaaaaggtgaggtgaggaagatatgaaagagaaaggggaacagatgagggagaagatgagatgaggtggagactgctgacatgtgggtcccatttgatgactcagcaagtcaactgccacgtaagcaagtcaattgccatgtaggataaaaccgcctccaaaaccgtccggggagttgatttgtaacggttttcggagttgggggatgggttatacccggttttgcggttgagggatgctaatcatacacggccatgagttgagggagagaaaatggacttattcctgctcaacctattagtggtcgttagtggtctggattgatttactgggatgggccaaattcatccgtaggcctaattcgttgacaagattaggcaggacaaatttattcttcctctttggtgggctgaaatggttgatgggaattcggtgggccgaattcgttatcatttattgagcaggctgaattcgttgacaagatttaagtgggcctaatttgtagtatggaagtcggtgggcccaattttttagttgacgagaaataaatgggctgaattcattcatggccgtgggagtcgagtacctcgcattacctgagcatgacatgtgggccccacttatctaccccacctgtcagtggcacagcctcccaccttctcgacccctcgaattacccgtcacaaaaaaaattaaaaaaaaggcgagagaaatgttactacacgagacgaggacgagactcgccgtcgccgtccctttcaccgtctccacttttccctctcagatctccactcttctctctctctctctctctctctctctctctctctatccagccatggccgacgagcccct

SEQ ID NO: 13487 - DNA, 625 bp, Oryza sativa
tactaccacggggtttcatgctagcaaacaatcatccgggaggaatcttgtcaagagacgataagcaattataggattggagggtgaacatacagaggataaaagaagaaagatagaagtagggtaagaagatatatacatgtaggcatagtatattggttttggtaatggattgtttgttgttttatttggttgtttgttgttttatttggccttcggctgtttatatttatcagagagatcatcttgcatgaacaaagctcctcaaaatatcttattaggcttagagatgtattaggactctacaaaccctaaccctaagcaaggaaacataaaaaacgtaagtaaatttgactttgacttaggattatcgtttagatcgatcggtcatgacctccagtagagtctccgatcagaataaccagggttttattagaccgacaagaggcctaatcatacgcgtttgctaattggcatgtatgtgttgaattttttttatttttaattcttctattaaaagttttacaaaaataattttctatttcgaaaattgacagaagtagtcacccgccgtctcccaaagggcggcgaatgtgacgtggcagacggccgttcgctctcgggt

SEQ ID NO: 13488 - DNA, 1501 bp, Oryza sativa
ccaccagcacctcctccttgttctcgaacaccagctcgcatctcctgccgccccccaccaggcacgccttcttctccggccatttctcctcgtcccagattatcacgctgctcatgtagttcccctcgtatctgcgagtcacatgatactccctccgtcgttttagatccaactattcttggttcgactaagtttgttcataaatatagaaaataaatatagaaataaggtttgattaactttgtagataaatatagtaatatttttagcttcgtaaattcaccgatttgaatatatgagtatattgataatatttgaatgaatcattttgtttttacttcagaaggaatataaaatttaaatcaatttaatttaacttataaggtctaaattcagtgtgaatttaagatctagagttgtgccaaacgaaatcttaaataagattgtttggtagagatttgaatctgaaatagatttggagttatagttagaaaccataatttggattttaagttaaaaatactactttcataacataaataaaacttttggccaaactaagtgacatcccgaaaaccatgaagagatataaaataatatagcactctaccaacatcaattactttcgaagaaccacggatcgtccctcaaaagattttattgtaatgatcgatcaagtaattaatgtaagttggagtagccgtgtctatatctaatactatctccattttaaaataaataaacaaatctagttacacattatactactacgaatttaaataatctaactacattatttctgtcaataatctaactacattattttattttatgacagatggagagcatctacttacgaccatatgcaggagaccctgggggtgaggtagtcgtagccggggcggtcggcggtctcgtaggtgacgttcatgtcgccgccattcgccctcagctcaaaatcgtcgggccactcgtcgcagtcgaactccatcttcctctccatccggttcaccatccgcaccaggtacgtgtccagtctcgccggcgccgccgctgccgccacgggcaccgggacgacgatcaccgctgccacggcgaaggcgacggcgaggacgtcgatgctaccggagatcatggccgccggcggtggtggtgttctgccgccgccgttggtgtgctcgatcgtgtggtgtgttgatccaatgtatatatgtatggtgtcaagtacctgggtgttattaactacagtaattaaactagcttaagtaggtaaaagagagctgatcgataacagctaacaactgaacggaacggatgaatattattaatgcgttttagcgtttacgtgcttaattactgactgctctcgtgtcaatcctacaaaacaaacgtcagtttgggcacgagatttcggtgcagcatactagctacatccattcgttcatcgagttacctgcatgctgacaagtaggcaaactaccattgatattattaatcttgg

SEQ ID NO: 13489 - DNA, 1501 bp, Oryza sativa
ggattcgtttggaaactcctcccctaacctcgccggcgcatcaatggcggccggatcttccgcggccgtttccccctcatccggccgctctctccccctcccaaccctatataaacgctccccgtgcctccctccaccgtttccgccactcgtcgctctctctccccgccggaatcgagctcgcgccgtcgctctctctctgcgccgtcgccgccgagctccggtccgccgccgtcgtcgccccagaccttctcccgtttcggcgtcgccttcttcgggttcgccgcgacctcgccgacctcgtccacctctccgtttcggtcgccgaccgccggaacgccgccgtccccgtctacccgagccgcgccgccgccttcctccgctccggtcgccgttcccgtcgccgccgtcgacccggggtgagccgtggaccgccgtttcgcttcccccttccctcccctctctcgggcgccgctccgccgcgccggtggtcaccggcggcgaccatcggggcgcgggtgcgccgcctcccgtcggctgtgccggcgtggccgccttcgggcgcgccccgcggctgccatgtggggcccggtcgtcagccgcccgcgccctcgggtgcggctgacgcatgggacccacggcgccggccggtgtgagccgcgtgcacccggtccaccgtggaccgtggggctgccgcgtgggccccactcccgtggacccggtccgcgcgcccctcccctcggctgacgcaataaatccgattttaaattaaaatttaaatgaagaaattcgcaaatatccatttaaagagcatataaacttcaaatggcaataacttggccatttgaactcggaattggaccgttcaagtctctaatttttccttaagaagtcaagaacccatttttgtgttttgtttctacttgttatatggagtttagtagagtaaaagccgtttctttcccgttggtcgtgtagacgctgcagcttcggaagatccgctcttcgtggaagttgaagccgacgtttgggaaagcgagcaaggcaagtcacatcatctttgaacatattgaatcccagtttgtaaaattatgttgatttaaattattgcattatcgctttatttaaattcccgcgttatcactgttttatctagccatgcctatttacctttgttatgaccttaatatttttattgttattatttccttgttcaccctagaataaacaaaaccccaactagtggacactctactcatgggaccactagtatgaatttaggtagatgcttcgctgattaaataggacaacattaggtggtttttataactttagactttgggaattctcatatcatttggacactatggaatggttggcttatggtggaattggacatacacctctcttcctctttcaaaacccctaaaacctgttttccggtggggtttgagtgcatgccagttgtgggaagtagcaccccggccactataaggattaa

SEQ ID NO: 13490 - DNA, 527 bp, Oryza sativa
ttgacagccctacttcgaaccacaattcgcactgtcatttagcactgtctagcgcttatgcgcgtgattaacggctcgacttgcatccaccccttgtgcatgtgaatctggtggaagcgtggatgtttccctttgttggtagtatgcttgaatctgtccgacatgtgaagcttgcatttttaataagcatgcatgaacacgaagggtttcctacctttcagtgtcctttttttctaaaaaaaaatgcacgtaaaaactttgcatgaataaactttacagatataaacttcgcatgttgaaactttgcacatagaaacttctgtgtatacaagctttacacatacaaactctgtacatataatctttatacagagaaacattctgcatatgaaatttcaaacaaattcaaacataaactccaaaactcaaaatcaccaactatcaattaaatatgtaaatatttctaccaaaaatcaataactcttagctaaaaaatgcaagaaactggtcttacaagaaattagata

SEQ ID NO: 13491 - DNA, 1501 bp, Oryza sativa
cggttctcgcggcggaacgtggcgccccgggtggcgctccggacggcgtacgtcgcggcgtgcgcgttcgtggccgcgatgctgcccttcttcggcgacatcgtcggcgtcgtcggcgccgtcggcttcatcccgctcgacttcgtgctccccgtcgtcatgtacaacatggcgctcgcaccgccgaggcggtcgccggtgtacctcgccaacgtcgccatcatggtcgtcttcaccggcgtcggcctcatcggcgccgtcgcctccgtacggaagctcgtgctcgacgccggccagttcaagctcttcagcggcaacgtcgtggactgaaatggacctaacgaatagcgatagtgcttggtttttggcgcctttttgactattgacatttgtattcattaggtttcacaaaaaaaaaacattgtaaaagagaaagaggaaaaatcatcgattcatgaagaaaaagaaaaggccaaaaaacgtaaagacgcgtgtgctgaagaaagttcactaaggtgttgtgttgtaaatttcatgaacactggtgaaaattccagattcgaacaaattatgttcttcccttcttttttctcttttttgcgtagtgcaaacttggtggacaccgtagatttccgtaggcgagtcgtacaagatgaccattcagcgagaaaaaacggccgaattaggcccacgtaaactcacaatcttgtggacctcagaaattgcagaagaatttgtgctaatataattccaaaaaaaaaatcatgtggccacaaattcagcccaaatatttacaggcccactgaattacagcggaacaccaacccatgcagactttcccgatttctccgcctccacgtgtcactgatcggtgggcccagggacccgaagccgaagcgagagatcccgaaaatatcacgcggcttatggccatcgcccacgtggcgcgagcctcatccacgcatatctcccgccaacctcgtgcgcccctccgcgccacgccgccgcctccctcaccgtccgatccgtcgtcccgtgggttcctggccgtccgattcgccggaggggagctcgtggcggccgttgcgccttcgcctccggccccttatatggcgtggcggggaggagaggagcatcttctcgcctgagattccgtcgacgccattgcttgcttgcttgttgcttccattccattccattccacacacgagtgaacgagcggggaaggttctagaaggttcggttagagttttctggtctgccatggcgtccactgtgacgacgccgagccggccggtatccgccgggtgccaccggcgctcgccgcggcggtcagcgcccgtcgtgctctccctcggcggcgggccgcggcggcgcacgccgtcgtccaccagctgctcggcgctcgcgtcgccggcgaagcagggcacggccaagctccctccgccgcagccgacggcgtcgaggaccgcggcggccgacgcggagcgggagcgggagc

SEQ ID NO: 13492 - DNA, 1501 bp, Oryza sativa
ctaagaaaatcagctgtcatgagcaacggcactgcacctagagaagaaggaatgcatcatagtgcttggcagctataacaatgcagtggcactcgagtagggtcagttgctgaaccccggagtcctccatagattattagttttgacagtactacactgatttattttattgcagagatagctccaatgaagatctaggggcagtcatttatgctttggactgatctattgtaaggacaataatcgttttctatggaaaggtttttcaaagagaaggagctctgcatcatcgtcttcgagcagttctttctttgaattacgagcaagctgctgtagaatacagcaaggaagttcgtaagagatgggacataatctggaagagacaacagatgccaacagagaggtcagaagatatcgcacttcaccctgtctgagaccacagctatcatcttccccaaagcaaacttgttgaatgaaaggtgctgttgataagaactggcaatttcttccatacacaaatctctactcagctcgtgttatctacagttacatcttgatgtcaaatttgcatggttgttttcattttgttggtcagggaattatatgtcaataatggtatcttgatgtcaaattcgcatgattgttttcgttttgttggtcagtgaatgatatgccagtaatagtaacaatgcagttgtttggaatatgatgcaatgattattcagaagtggattatgaatcatgtttaatacctttctagcattcatattttttggaatatgatgcaatgaatcatgtttattcagaagtggattatgaatttggacttcccaaaacttgcatcacactcactaagttagattgttccttccaagctaatgtaattgtagtattgtttgctcccatatgcacgaacctggacctgaagaatccaatccagagaatgatacatggataggataatcgtaacaattatctagacagtgatgttgcattagaagtttagaactctcaagttactgaccctgttcaaatatagtgactgaccggaactgatccatatatttttttgaccattctagcaagttcaacgaagagataagagtcatcctgaagcatcatcattcggctgtatattcatgcatgggagggacctactgaataccgattttgatcacttgtttcaagcatatccaaatgttctctttgcagataatttattcaaggtgcatcttagggatgtttgttttggctatatattcaaggtaaatgtcattttctaatagaaaaaaaacccaaccagaagttctctgcaggataacttcaaaaaagtcaaaaactgcagagaagtattccaaaacgccacaccaaccgcactgtgaatttctgactaaatcagaactgtcattcaagatacattgcaccacatgcaacaaagtagtagtcaagctatgctcatccaatctctgaagctcagaccatctctccaagactgcaacca

SEQ ID NO: 13493 - DNA, 1501 bp, Oryza sativa
tgatggatgagccgatcggctacttccacgagagcgcgttcgcggcgcccttcatcgagagcttccacaacgagatgggagggcacgtgctggacaggaggccgggagggcggcacacgctcaccccaatgggcagtggcatgtacccctccgatggcctccagaacgcagcctgcatccatgcctacctcgccatcgcctacaccggcgccgaccaggtcgacgaccccgtcaacaccattgtcacccaccccaagtgctacgacatcaagggcgatggccccgacctctatcgccccggcatcaatgtcgcctttggtggccctggtggatacgactgtgatcacaattagtaataattaattaactacctcatctctctttcattatgtaacatgaatgaataattcatgaatgtggggtagtgtttgaaaaactaatgaaaaatcaagtgttgttttgggaagatgttcattacacactgacaaaagaagtaaaaaatatacattatttttagaatttttgcagttatatatatgtttttgaaagaattatgaaaatatacacgtaccgtggtacgaggacgcgtgactaattgtttggcgcggtaggggaccaacggctaggacaatcttcccaatcggctaccacgtgccacggcgcgggattgtcccaaccatcggtccggcaccttcgtgccacgccaaataattggtcgtgcgttcacacgtaatggtacgtgtatatatttttctattttttttcaagagtatgtatataactgaaaaagccaaaaacaatgtataattttaatttcttttctctgacgtacaccaagtaatggtccatagctatccggcgaacccgccatggcggactggccgacggcagagccgaggcgaatcagcggcagacaggagaagctccccaatacgctctccttttccagtttccccaactctagctagaagccaatcagaagcgccagccaggggaaagcagagagtcgtcgatccctctcgtcgccgttgttctcgtcggcatcacctacattattgtccgtacgtgtgcgttcgacggccttcctccatccggtagagtttgcttcctccaccttgaccacatgatgttcgacgaaatgcctagcaaggttaaggttctgtcactttcttcttccaaaactgattgtcatcctgcgtttctttgctattttgcacaaccttgtggaacaataataaaagaaaattaattagtcctccatatttggttgtttctacagatgacaagttagtttaccttgttggtattacagataacaatgcatccaatttctttgttgcagattgacaaatcgacattgattcacatatccatttttgcatgccgatggtgttttgtgagctctaagtaaggcctgattctgaatatacaactgaatggcatctatagcgtttggtcaaagaaatctgcgtgtctttcccctcagaaggcacatatggga

SEQ ID NO: 13494 - DNA, 1501 bp, Oryza sativa
cctcttgctaagctcctacttcttttcagcccctgcaacgatttgcatatgtgagcaactgacccggtatcaaatacctaagaatcagtagaggaagtagcaagattaatttctataacattaatacctgaggtggaactctttccatcctgctgcttctgcttgaactgctctaggtatttcttacagtttctcttccaatgacctgtctccttgcaaaagaagcactctgcatccttagcgggccctgtcttttgaaccttggtcttagagttgctagtactcgtgatctcatcagagtttagctttctcttttgacaacttttcttgttgttgggcttgcgcttatgcacaactatcacatggttggagtttttcttaatgctttcctcagcagtctttagcatcccatgcaattctgccaaggtcctgttcaggttgttcatattgaaattcattatgaacggctcaaagctgggaggtagcgactggagaatcaaatcagtaaccaactctcggctaaggggaaaaccaagcttatccagactctcggcgtaaccaatcattttgatcacatgtgggctcattggattaccttctgctagcctgcacgcaaccaaggactttgaggtattaaacctctcagctcttgcttggtcctcaaacatgttacgtagtctcgtgattatcgtatgagcatccaatgcatcatatttcctttgaagctcaggggacatagtagcaagcatgagatagcttgtatcaagataatcattgcatcgcttttcatgctccctacgttgagcagcaggagcattgttgggcaagttagctggaaaaggctctgtaagcacaaactctttgtgctcttgcctgagaacagttctcaggttgcgataccaatccatgaagtttattccagtcaacttctctttctcaagaatagaccgcaagttaaaattggatgatgcaggagctgccatgatctacaatagaaatatatgtatgcaaaatcagcatcatgtttacatttaacctttcattaaacaatttaacaaaagatacttccactatgtattgtgaaacaaaattccctctagtaacatagtgagtcaagatcctcattttattagtgtctagtgagctttggcatcatagctagacaactatcaaaataggtaagcaacaccttgctaatcacatcatatgtgactcttgtgctgttggggtgacatctccatgtccaacccaacctatgccccaaggtccaaaactgttttaataaccttgtcaagtaaaccaataatctccgcacatagatgtccgacatctatcctattttatcatgataaaaagtgacactttgctatgacaaacccatcacttatgatcacaaccgtattaggtgcaattactggaagagcataaatcacacttaatttttctgagggaatctatcctaccatgtcatatcaaatatacaacagcagtaaagtaagat

SEQ ID NO: 13495 - DNA, 609 bp, Oryza sativa
  unsure (1)..(609): unsure at all n locations
cggcttggnccggcatggnccgcgcgcgggaagagagaggaaagaaagagttgggccgaaatcggcccaacggcctaagagggggatttttgaactttttaaacaaaaacaatttgtgaattgatgtttcaattattaaaaatacttcccttgctcaaataattcccagaaaaatctagaaaatagaggagcaagcatagtatttaatagaattttatctagctcatttttatgttgaaaattttcctagaaaattagggtttagcttgtaggcttttaaaataatttctaaaaattccaattaaacaacaatttatatatttaagatttttagggtgtgacacttctcccaagaggatgagtacaacagccattagtaaggtggtgtttggatccagggacttaactttagtctctgtatttaaacattaatttagagtattaaatataggctacttataaaactaattacataaatgaaagctaatttgcgagacaaattttttaagcctaattaatccataattagagaatgtttactgtagcatcacatagtctaatcatggattaattaggctcaatagattcgtctcacaaattagtccaaga

SEQ ID NO: 13496 - DNA, 473 bp, Oryza sativa
cctccccggcacgcaaaacgaagtatctattattgcatgattaattgagtatttgctaattttttttgaaaaatggattaatatgaatttttaaagcaactttcgtatagaaactttttttaaaaaacacaccgtttagcagtttgaaaagcgtgcgcacggaaaacgagagagatgggttgggaactacttctaccgaacgcagccatagatatttcactctcatctctctcaaggaaaacttcttgtgtttctgaatctatcatgatgctgtgagcatgatttgtggaattttggatgtcatgtgtttatgatgctgtgagcatgatttgtggaattttggatgaacctatgacagacgtgttgggctggaacggcataacggtgtggaaaaagtatgatgctgtgagcatgatttgtggaattttggatgaacctatgacagacgtgttgggctggaacggcataacggt

SEQ ID NO: 13497 - DNA, 1501 bp, Oryza sativa
atatgcgatgggtgcttgcgggcgacacctaaccgtataggagatcatcttcaagagtcacaagcaccgagatgacagcccatgtgatattccaagtgctcacccaagatcctagtcttgacacctgtccaaatcttcttctctcccttttaatctgtctttctcacaaaaattacgctttagattgagtggagaaggcaagaaacacttgggagaggctagcaacagttctaggtttgaaaagtgaaagtggaatggccaaagaacgagctggaaacgagctgtatatgtataacggctaggtgacgtcatctagccgttactcacaattttgaactggaaactagacaggaagttccggacctggaagacaggaacttccggataacacttaggaaaatttctttcatcagaccggaacttccggacctggaagataggaagttctggacttgcatttttggacagatggagtatttgcaaaaataactcatagggaaactttgacacttggttcacactaagagcacttgacatatctcagagcaccacctggaacccctcttaatagtacggtttttcctaaaactcaattgcaattaaataaactatccaatgcacttctcgagttccggtccgctttgattctatacttttgggggggggggtctccaagcatccatcttccacgccttggactaatgcacctgaaagtagctcaataaactcattagtcccttaaccacatttgtcattaatcaccaaaacccactagggggattaatgcactttcaatctccccctttttggtgattgatgacaacatggttaaagcttacaaaagattgaaataaattttgttttgaatggttagaggtgaatgaaactcccccttaatgtatgcatatagaagatatgagtgatgctcatatgcatatatataagggagaaaacgaagagagtttccttcatctctactcattcgtgggatgcaaataagcagtaagaatagatataatatgcaaaagatccgacatggtgagcattcaaaaggataaaatcaacgtcacatcacaatcaacaaataagacattcatagcataaatgaagtgcagcatatataaagagcagctaagagcatctaacagtcattacatccatacaattagagaattactacatgtccataagtccaaacgagtagaggccaaaggactgccaggtctggaacctccggataaaatacccggaacttctggacaagctaacaggaatatatagcgagggagctgccaagttcggaacttccggataagaggatccgaaacttccggataaatagacagagcaggcagcaagcagcgaaaacaaaattttgacccccttcgattgcaattttctccccctttggcataaaggcaccaaaaagagacaaaatcacaagggaagaagaggatcaagcctcatcatcatcgccatcagaaggaatgatctcggtgtc

SEQ ID NO: 13498 - DNA, 1501 bp, Oryza sativa
tgggtaggcaagcgatcatgtttttggggagcactttaagtgcgactgctcctgttcttcgcgactactgctgctgcagcatcgacgccttcgctaacatgtcaacagagattggagacaaggaggtgaacgacatcaacggaggcaatactgcctcaaaatccagtggtgggacgttctcggggtatatttctattctccatattccgttagatgtttgtttgttaatattcttcgtaatggcatcattgtgttactctgtaaatgttgatgcttattttaccttatgtatgctcatattgtatacaactagcactatcactgatcaactcatattgcaaatgctatgtttattgtcttaatattttggattaaaatatgctgaattatgaccaaatttccaacaatccaaaaatttcatgggcctttattggtagttggctttgctacatcactaaaaccacacgctttcgatggttcaaattataaaatatgaaaagcatgtgcactactgtagttgacggcgatgcaatgtttctttatttcatggggcaaaccgagtgaaccacctctccctcctgaggaagaggttaagtttgaggctgcgacgacgtataaggtcctaaccataagtttgatgctataattaattttttttggtttgataattaattaataatggcgctataattgcgatgagaagttcgtgcgtggccataagtgtgcacatctgttctacatcgaatcatttgttattacttagcacatccacaatgttgcatgtaaaataaccttaacggataaagtaatatatttgttttatctctatcattgggaaagtagctaagaagagaatattgctaagggtaaccttgagcttaaagttagaccataagaaataaaaaagtattttatgcatttgcaatatatatagcagcttttgaaattgtaggtgaatagagttttttttagtgggctccaccttaaggtcgagaagaaaccatacatattgtagcatctattatagacaaaaagaacacaatattgcggatcccatcttatggacatgctcttattactaggctagcccatgcccgctgtggtttcgttgctttattgaaattcatgttgtaattagcaaaacaataaataacgtggatgtgactgcagctcaagcactttctcgtcctttgtactacgtgtagcttttgattggatccttatattttttttaaccattttatttgtttcagaagagactttatatttgaagaaaaatcattgtattacagtttgcgaaattagtacataaatgcattggtatttattatggtgggggataattgcatatgaatttattaaaatgttgtaattgcattggaatttgctaaaatagagggcattcgagtctttctgattttgtattggtacgtgtgggataggttaaaaatgatgtttttattttgggacggaagtatcacaagtgagccatcacttgctt

SEQ ID NO: 13499 - DNA, 942 bp, Oryza sativa
tgctctaaaagagctttttccagattattgagtggataaagatccactacccctagataattgaaaaaattacccacctatgccatcaaccgaacagattgccctctcctatctacacgagcgcgcgaactcggctcctcctctcccggtcgcgccgccatctcctctcccaatcgcgcgcatccgacctccttctttcccaatcgcgccgccttctccacccccggcgcgcgagcagccttctccacccccggccgcgccgccgcgttcccaactccatgtcccgtcttcttccctgaaccgcgccaccgccgtccctgccctcactccgtaccccgcctttgtctccaggctgcggcgacgcggccccaactcctggatgcagtactctctctctttctctctctcaacactaattgatttgtttgattttcacactcagaaatttgtcccatgccatggaactgaagaaattgaatttccctttatgttgcttttcatcacatgattttacatatgtgtgtatcacctgagagcacattcatttgtaggttgctatatgtgaaatttcttaaacactgaatggatgatattttctactgtactgaatgaatgaatggatgaaattgatcaaacactgaattttcttaatgtactgcacgcaggtgtctcacagctgatgatgtaatcaggaaaattactgaattttttcaatccactgggacccgacgatttgtcacacaacggcaggtgcgtttcaacgggattgaacggcgaagttacatgcaaatcagcattttatttgggcagacaggagcataggaagtgctagttgagattaggtagatttatcagttagatttgctttggattaggtgcttatctattgctagctcttgctcaaattacagaacgacacaatgctttttttttccatgcagt

SEQ ID NO: 13500 - DNA, 1501 bp, Oryza sativa
aaatcgaacaaacttatgcatatcaaacttagagaaggagttgcttggattaagataagacatgcacaccaataaataaaaagaaacttaatgaaatctatgattaatatctcccataattacatctagagcaacattgaaaatatcaactcgataataatgaaggtaagtcaccttatgcttccaacgtgcagatttaccgttaactccgatgagatcatccatatttggcactccaattccatttgcctcacaaaagttttttacttggttgaaaagtagtgcccaaccattatccctcatgtcttagtagtcgtgctttcacatccacaatcagacccatagcttcaacaatgttttgatctctattttgcaaaagcaagtgatggctcacttgtgatacttccgtcccaaaataaaaacatcatttttaacctatcccacacgtaccaatacaaaatcagaaagactcgaatgccctctattttagcaaattccaatgcaattacaacattttaataaattcatatgcaattatcccccaccataataaataccaatgcatttatgtactaatttcgcaaactgtaatacaatgatttttcttcaaatataaagtctcttctgaaacaaataaaatggttaaaaaaaatataaggatccaatcaaaagctacacgtagtacaaaggacgagaaagtgcttgagctgcagtcacatccacgttatttattgttttgctaattacaacatgaatttcaataaagcaacgaaaccacagcgggcatgggctagcctagtaataagagcatgtccataagatgggatccgcaatattgtgttctttttgtctataatagatgctacaatatgtatggtttcttctcgaccttaaggtggagcccactaaaaaaaactctattcacctacaatttcaaaagctgctatatatattgcaaatgcataaaatacttttttatttcttatggtctaactttaagctcaaggttacccttagcaatattctcttcttagctactttcccaatgatagagataaaacaaatatattactttatccgttaaggttattttacatgcaacattgtggatgtgctaagtaataacaaatgattcgatgtagaacagatgtgcacacttatggccacgcacgaacttctcatcgcaattatagcgccattattaattaattatcaaaccaaaaaaaattaattatagcatcaaacttatggttaggaccttatacgtcgtcgcagcctcaaacttaacctcttcctcaggagggagaggtggttcactcggtttgccccatgaaataaagaaacattgcatcgccgtcaactacagtagtgcacatgcttttcatattttataatttgaaccatcgaaagcgtgtggttttagtgatgtagcaaagccaactaccaataaaggcccatgaaatttttggattgttggaaatttggtcataattcagcatat

SEQ ID NO: 13501 - DNA, 1501 bp, Oryza sativa
ggggggtattcatgggttcggtgggtgtaggggggactcaaatccccctgcacccacgttgaatccgcccctactcctacgtgatggtatttatcacgagatgatgcatgatttgggtctaaaataatcgtcaaatcacctagattcacacatcactatggccttgtttagttccaacgcaaaaacttttcaccttgtcacgtcgaatgtttggacacatgcatagaatattaaatatagacaaaaaactaattacacagattgcgtgtaaattgcgagacgaatctttaagcctaattgtgccatgatttgacaatgtggtgctacattaaacatttgctaattatagattaattaggcttaataaatttgtgtcacagtttacatgcagaatctgtaatttgttttgttattagactatgtttaatacttcaaatgtgtatccgtatatccgatgtgacacgccaaaaattttcaccattggaactaaacagggcctacatgaggcgtgtacagatttttgagcaaagatcaaatcggtaagaaattcggttgttgtatactactactaccgccgtctaataatattgcaacataatactccatccgtcccaaaatataagggattttagagggacgtgacactttctaatgctatgaatctaaacaatagacaagattcgtagtcgtattaggaagtgtcacatcactccaaaatcctttgtattatgggacagagggagtatgagacaagacgtattctaatgctatgaatctgaataaggtatattcatattcatactattaagatgtgttacatttgatactagattgttatattataggacgaaggcactggcatatagagaaagttgttcgttaagtgtgatgagcaatacttttttcccgaaatattgcgtcctgacagcaaatcaaatactcctatatgcaaatcggacatatgttattgcagaaaaaccatcaaccactctaagggaaatatggttatttgaagacaaaatcatctagactttgccacaaaactttttgcatagtgtgtggcctaacaaaaaggaaaaaaaagaggcttgccgaactttagcccatagtattggtgtactagcagcaaagtgtccactgacttataccgttatacacaatgctcaagacacactgagagaaatatgatatttaaattagcatattgaattagtagtatgtgtatattttataagttgagttttactagtggtttttaaagagacgtcggagatatagatgcttaacactagttaacataagaatatagtagtgtcttacactctggattatccttagctccggcatttcgtcctagactcctggttttcatcaagcatgccaaggagctcgctaaattcagctgctgcttctctagcctagtaagagcatctccaaccgactctctatttgactctctaagttaaagaaaaaacgagctccagcaaactctccatccaga

SEQ ID NO: 13502 - DNA, 1278 bp, Oryza sativa
taaacacctaaattcccgtgacttgctgagtacgaaagtactcacccttgctctatataaatatatatagttcctctgccttgaagtgaagatgaagtgaagtgaagattagggtttcgtcctggttcccagccgtcgcctgtggtgttgggtgttagttcgttggttccgctgccgctgttgctgttggtgtttcctcgtccgcgtcgtcggttgcattctcgggccgttctaagctgcaacctaagttaaggtaaataagtcctctatttattttaaggattgcaatgattcatatttgtcaccatgggtaccagcactatgtcctgggactggtactgagatcacggtttcgtaggaagcggttcacgtcgtttttcctacgacacgctcctgtcaggtgccgttgtacggcggtgccggattggggtgtgacaagaacactttcggttcaattggatcgataaatttctaagaaagataataatgcccctaaaaccacatgcttcaaactgcatgatgctatagtaaaaatttagaaattatacaactctaaatttaccatcacattatattccatcttagctctagtttcagctcaaaatattttgaccatagaggcatccttgtttttttgaaaaatttctctctccaattgagtcgaaagtgtcatccaacaaattatcaatttttaagtatcttttagccgtgacatgtttttataatgtctactagtaaattgtacattttttaagtgtctgtagcaaattttgccataaaattatgtattgtatcgggacgaaagacatagagagagtagtgtgttagcaagctctgttgctgtctgatttactatgtttttcattttgctttttctgtcacccttagtgattatgtataatttctctggtacttaaaataaaaccagcaacgtttggcttaggtttaaaaatacttgtaaatcaattctaaaaccttaatttagctatgtcttatatgtcaacgagaagctagccaagccaggcaaagcatgtctctctcttttattttttggaatttccatggtagaatttattaagaatccctaatattgaaatatgaatagccgcaagtcccagcgtgtaaaaacagcttagttaggcagcctgaaccagaagaattagtggtgccccgacttaaaacgacgtagaccgccaagaaacgaaccaaccggcaaccgccgccgccgccgccttcgattcgattccgatcgagttggagaaggccgccgctgcccaa

SEQ ID NO: 13503 - DNA, 1501 bp, Oryza sativa
aaactgatcttaccaaaaacggcccggccttctaccgcagcaactacctccgctacaccactgcagctcgctcctttccagttgcttgaggaagaaagaaagaagggttagcggtcgccgtcatcacagccgcagtttccaccccagcggtctgcttagatgatggtgagggagggagatggaagaaggttgcggcgccggcaaaatgagtcatcaccggtggggcagttattttttagagttgtgattgtaaatttgtctaaaatacatgttttgatttttagataatgggcaacactcggcctctgtattcttagatgaatgcacacggccaaaatacaagttctgatagtcttggtttcttggtaagtctatattcaaaagaacacaaacgtacatccggtcatgagaacgaaccttctcaatatcctctatgggacaatggcccttttcttcttatccttgttcttcttctgcccttccaccatttttgcctaggtgcaatagatgtgttaagaggcgcgcgtggcaacactaaacaaagcgtggagacttggacacaagctagctagtaccttctgccgatgcacactgccgttgagctggttggggtcaggaacacccttcaccggaggagcccctctacctgcgccatgatcagccacggcttctcctccatacctcaccaccaccccctcgtactccaccacgaagtcgtcgttctcgtagacacgcacgttctccaggaacagcctgtactcctcttcgatgtcagcgttggcgtcgtacacggcgggcaccgtggacgaggcctccttctcctcttcccccacctgcgccttcttcttcttgcatcctgctgccccgccgccccaggaggaggaggcggaggcgctccgcggtcgacggcggatgccgcggcgtcccttgacgctggtcctccccgcggagcctatctcgccggcggcttcgggaacctggtggttcggcttcggcatcgctggggatagtggggaattcgttcgatcgagaaccaaggtgaaaacgaagcgggttgtgtttggcggtgcggggcgaagagaggcgacgaaattttgggtgatgcgcctgtgaccgtgcgagatggccctagctagctgtcggaaaactgggccaccgtaagttgggccgagatgagcattatcttttttgggcggaataagttcatctgaggtcccttaacttgtcaacgaatccgattttcgtcctccaaccggaaaactagatacaacggatccctcaactatcaaaaccggtgcagattaggtccctcgacggttttaagggtggttttggctgacgtggtgcttacgtggctaatttgactcggtctttatctgacgtggcaatgacatggcgcttacgtggcaattcgatcttaaaaaaataataaaccccgtgggacccacatgtcagtttcacacaaattaataaaaaatggtggggcccacgtggccccaca

SEQ ID NO: 13504 - DNA, 1501 bp, Oryza sativa
  unsure (1)..(1501): unsure at all n locations
ccaaaacaaatcaaataatataatttttttgtttgattgtattttaaaattttatatttatcattctaacagtcctcataaatatatttgaatttttatattaagtatgtgttttaaatgcaacaacaaagtatcaaggtcaatttgtataggtgtgtagccctcatatgtatgttaagagaaattaattcaattggtagaaagttgttagatgcctaacgtgatataagtaatagatggagatccatttgtgttttttcccatatagataattttaattttaattgtctaggagataaaaaaacagagacaaaagaatggcgcacgctgtacactacaggcagggagggagggaggtttggaatgttttttctaaatgattaatataacaacctaaaataatgtgtcagatgttcatgtcgaaaccgatggttggatgctttgttttcttatcagaatttttaggattttcattgatttaagataacgacgtaacatcttaagagcgtttataagatgttttttttaaaaaaaaatagatctagtgacctaaaataatgttttatttgattgaaaataatgtgtccatcgatttatgtctaatcctatggttggatgttgtttcccaaaatttctaagaattttctataatttaagaatttcatataccaacttagagttttttcttattagaaaaactaacaaatcgatagtctaatgctttgttcatttttaatatttgctagtattttatttaatttaatagcatcgtatagcatcttaaaagtgtttgtagcatgtttagaatgacagatcaggacctgctagacctagcgggtggagatatgtggtattttaatgtaaaaataatattgattttaatttctcatgaagaaggcttgttggtatgtacttgagagggaggttgtggatatgtgtgttttaaaagaaaaaacgatctaaccttcgaaaatgaaataatagatccaccatttaattaaaaatcaatgggcaaattatagtatcacttgacgatttagtagcgtttgtaaggtgttacttggcgacttagcaatatttataggctgtttcatggacttttagtatataatagtattttttttctcaaatttctaagattttctttaatttaagaatgtcatatagtagcagcttagaggtgtttataaaatgtttaatggattttaccaccacacggatttttcatttaaaaaatatataacaacctaaatgcatcaatttaagtagaaactggtggtcgattgctttgtattttttttctagtactttctccaatttaatagcanccacatagtgatttaagaggcattcattaggaatttttnaatgtgaccggatgggtagagaatgcctagnaacctagtagttggtcctaattttggctgaatctttctanttttgcttgttaaaagtaatttttattttagtcttcttaaaaagaaaataaggaaggaaaaga

SEQ ID NO: 13505 - DNA, 1501 bp, Oryza sativa
  unsure (1)..(1501): unsure at all n locations
actagtcaaacgttggagagctgcatctctgtgtggcaaagaatcaaacagttgatgcgcagttccattgacgccgcatacccacttcatcctcgaccaaaaccaatccatgaatcgagaagaactcctcaaaagcacaaataatcaagatcgccttctttctcctcgagttgcttccagctaaaaacgagttcataacagcacggaattcttcggaagaagcagagggaaggttccttacaatggcattgaagagtgggacttgnnnnnnnnnnnnnnnnnnnnnnnnnnnnnnnnnnngcgcggaggctcatgctaatccgcgcgttgcggccggacgcgaaccgccgggcgcctacacccgcgctccggcgccaccgcaggagacgcgccggggacgcgcacgaggaaggcaaggtggccgtcggagtcatagctggtgtccgcgtgaatcccgcgaacgcagagccgagtgcgcggcgagacatcgtcgccatagacacgtacgcccgcgcggcggcagcggcggaggcggcggcgcggagcggaaggcgggcggctgtacggttgtcagagagacgacgaggcgggcggaggtgagagatagagtagatgagatggcacgtgagccgctcgtgacgtcacggccttggaacacaaatgcattttaattttaaaaatgaaccattttaaaacttattttcaaactttaaaatctccgactattgttaacctatatggtgtgacaaaatagcgtacccatagtgaaagtgacacgtttgtcacaccatttagaatggagaaatcaaacattataagtttcgctcaaagaccatttttgaaaagagattcaataaaatgtattctcaatcaatggctacacgttagaacacgatttggaactaaattgattatgcacgccttttttttcctcccaacagcatcgtcttctccatgcacatcggctcattcctcgttcctcgtcgaagaacttcgtgggagcaggcggcgctcgacagccgacgcgtacgtgaggagtggctcctccctcgttcctcgttgaagaacttcgcgggagcagacgacgctcgacggtcgatgcgtaagcaaggaggagaccagacgtgcgctgctaaaccagctagatttgaatggtcaaactggcgtgacagtattgttttgacatgtcggcgtgacacgaaggttttaagaaaagtttatttttaaatttaaaattaaagtttaagatatgacatcggtatctcaatgacctgtaggacccacatgagtcaatgacatatgagtcagaatagcatatcttaaattttacaaaattataatggcatggttacaattttcccaaaattcaatggttcggaaagaaaaaaaaaattcgaagcgaagcctcgaaatcaaacgcggcgagtgagtcgccgccgcctcacttcccctcctcggcctcgtcggcggctgccatgcgcttcccactgcgccgcctcct

SEQ ID NO: 13506 - DNA, 1501 bp, Oryza sativa
gatcgcgccaatcgcggcgcaagacttgacgacgtaggggaaggtgtggctgtccgggagcggcgcggaggggtgcgcccacatcttgaggtagaagaggagcgcggagcggtagtcccccgccatggtgagcccgcggatgagccagttccacgggagcgcgcaagcggcggcgccccgtggcagcgaggagaacaccgcgacggcgtcgcggaagcggcgcgcgaggacgtacatgccgacgaggcgggtctggagcgccgtgtcggtggcgtggagccccgcggtgacggcgcgcccgtgcacctgcagtccgagcgagaggtgcgacggggagacgcagccgcggagcacggcgaggaggcggcggtcgggggaggcggcggcggccgtggtggagaaggtggtggtgcgaaggcagcatggccgtggcggcggcgtgagctcgacgcggcggatgaggaggcggcgcagtgggaagcgcatggcagccgccgacgaggccgaggaggggaagtgaggcggcggcgactcactcgccgcgtttgatttcgaggcttcgcttcgaattttttttttctttccgaaccattgaattttgggaaaattgtaaccatgccattataattttgtaaaatttaagatatgctattctgactcatatgtcattgactcatgtgggtcctacaggtcattgagataccgatgtcatatcttaaactttaattttaaatttaaaaataaacttttcttaaaaccttcgtgtcacgccgacatgtcaaaacaatactgtcacgccagtttgaccattcaaatctagctggtttagcagcgcacgtctggtctcctccttgcttacgcatcgaccgtcgagcgtcgtctgctcccgcgaagttcttcaacgaggaacgagggaggagccactcctcacgtacgcgtcggctgtcgagcgccgcctgctcccacgaagttcttcgacgaggaacgaggaatgagccgatgtgcatggagaagacgatgctgttgggaggaaaaaaaaggcgtgcataatcaatttagttccaaatcgtgttctaacgtgtagccattgattgagaatacattttattgaatctcttttcaaaaatggtctttgagcgaaacttataatgtttgatttctccattctaaatggtgtgacaaacgtgtcactttcactatgggtacgctattttgtcacaccatataggttaacaatagtcggagattttaaagtttgaaaataagttttaaaatggttcatttttaaaattaaaatgcatttgtgttccaaggccgtgacgtcacgagcggctcacgtgccatctcatctactctatctctcacctccgcccgcctcgtcgtctctctgacaaccgtacagccgcccgccttccgctccgcgccgccgcctccgccgctgccgccgcgcgggcgtacgtgtctatggcgacgatgtctcgccgcgcactcggctctgcgt

SEQ ID NO: 13507 - DNA, 1501 bp, Oryza sativa; identical to SEQ ID NO: 12411

SEQ ID NO: 13508 - DNA, 383 bp, Oryza sativa
gaggtcgccaagtactgtttttttatataatagaatttttttattgagctttaattacatcaagatgatgatacaattactctgagcatagctaagttgccaagtactgtaacctgtcccttcttcattcagattgtttcactttcacctcagcaaaactgacttgtagtaataggataaactcataaatccatcactcatcaacctctggcaatccaaggtcaaccacactgtcacatcgtagagtggtcagaactcataattagcacattgttagatgatcaactgcattagcaacagcattttgacctgtgacaaactaatcgcgacttgacagcaattgttttgtgctgttctgatgttatctgctactattatcatca

SEQ ID NO: 13509 - DNA, 420 bp, Oryza sativa
attaagttgtgctggtgtattttacgagctccagagttgtatttgttataattttctctacaaacttttggctagcaaaggtattttcttttatgtaggatgtttacggagatactatgcgtgagaattgtcgaaactgttgcgtgttgattcatattggagttgtatctggtgttttttacaagctccaaagttgtatttgttataattttctgtaaaaacttttgaccagcaaaggtattttttcttttatgtaggatgtttacggagatgctatgcgttaaaagcatgagaattgtcgaaactgttgcgtgttgattcagattggtgatttatctcaatgtggaatcattcttgcatgtggtgataagttccgttatattttaacaattgcaaatagtaagctatataatgcttcaa

SEQ ID NO: 13510 - DNA, 564 bp, Oryza sativa
gagtacgtgcctttccatcctcccctgttagcagcagtacgggcaaagcaagtgagagccgcattggccgtgggatggtgtactaggtcagtcacacgtactacgtgtgaccgtgagagccagccagactcgcagacgcagtgtgcaaagtctcacacgtgtatctcatagctttggaccagaagaacacatgtatgtaggggtgatgctaactacactacgcatgaggtgtgagggtagaatagggctgtgggtgtgtttagttctaaattttttctaaacttttaactttctatcacatcaaacatttcatacacacaactttttagttacatcgactctaaatttaatcaaattttaaattttgcgttgaactaaacacagtcagtctagaatggtagagggaagaagaagaggagaaatgtcgtgagaggaggtggggtccacagggaggtaaggtgtgtgatagtgacaactgaaagagaagtttgtcccttcctatggcactaatggtgttaatgtcttcagagacattggctgcctcttctttctctgatggactct

SEQ ID NO: 13511 - DNA, 1501 bp, Oryza sativa
gtcttagaaatccaagcctcccaaggtctattatcgtaaaacatttgattgttgaaatgatcaatctagtggtacttttgtgaatatttttattcagtagatcatataataattagtatttctaggggtgtaaatgcaaagttatcaagaaggttgactctctctcccgcggtaaatctggtcctcttcatcggcatatcaggtttcaccgtaccctccgctcgtctctctctctccatcctatttctctcgttcgctctctgtcttgagatatttttggcattctcttctcttccatccctcgctatgctattgacttctcgtttctctccagcagggctcactgtcccctggtgtcgactccagcaaccgcatgcgctgatgctctccagtctgtcggttaccaatcaactctattcagtggcaatggctagagcttcgatttatctgtcgtaaaaggtccgaatggagctatgagtatatgatatcctactgcagcgacgattgagctcttatgtgactgtgggatacggcgttgagacgagctcaaatggctcgtccacgtggctacagagtaacaaccaccaggaagcagaagatggctattgtgccgagtaggtgaagtagcttacggcatttttctttctacttttccctctttgatccttattattttcttatttttcataatcgaaggagaaggaatttctttggttgcaaagggacagatccaattttcttttgtaacctctggaatctcttgcctttttttttattttgatgatgaaggaaaaaagattttccagaagcctctataatctacaactgcatgctggtgttttatagtttagctcagatttttttctacctaactaaaatatatttatctgaaagttcactgtagattgcacggtaaaatgcacgattaatgatgtagcataatcatagcagaatcagagattgcatagggacacgtggctgattttcaaatgagctaacctaaattctcaataagccacgtggcccaatcatctgcctcatttccatccccgaaaccgtatatagagatttcaaggaaaagctgcagatagatctatctatctatcgattccgttcttcaattccttaatcctctagagctgcaagagaaaagctgaattttcaagtttgtgttctaagaataattttatttttcaagtttgtaattatgatgatcaacataaagaaaaaaaaagggcacgacaaaacactctcatctgtgtagcaaacgcgcaaaaaatatttctatatatgaaatattttatattccttttctcatatatcgttgaataatataatattattgatagattttcttgcaccatttatagtaggatggtcatagtcacacgaatgtgacttcaaacactagttaggatgaattttgggagtatgtacagctactggaaactccctaaaacagggcgcaacgaacatagcaaatccaacacaactcaacttc

SEQ ID NO: 13512 - DNA, 1501 bp, Oryza sativa
gtaaatatagtacttgaggaaaattcaagtatttaaaatgtttataaatatgtatttctcctcttgtcaattttaatttccctgagcagatgactccctacgtttaaacactctactcgactagtcatagcccccaagcaccgggaatcggccaaggcacttcccaaacatgcatatgagtggcatgagttcgtcattaatggaacaaagtttcacgggtctgaatttactacttgggtacttttgcaattgttaagagcagaaaataaattatcttatctctatacttttgatttcttccgagtaatatttagcacattgcgttatacactccatccaacgatcccccaggtgctagcaatcggcccaaaggcaactatccatcgacaaaccaaatggaaagcatagggaaaaagagctccataactcgataggcactttatttttactcggattattttgcaagcaatcaagataaatattatgaaaattattgaaaaaatatgatataacatctgtaacccccgactcactactcaatggagaaccaattgatatagtgaggcagaggaaaagaaaaatatcatataaggaataaatgatgacttagcttttagtattccccttggtaatgccagatgaagccgatgtgaggagaaagtcgtccatcaatgccaatgaaaacaccagtcggcggcgttgtcacgaccggaaataaccaacgggcgttccttacgtgcgtgtattattccttgtccaaggaggcaaggtacaccaaaagttgatacatttcagagtttatcaagcggaagcgtaaatagttactttattacatgggcggcgaaggcccagcacacacaaagacaaacgggaaacagcggaagactagggcgacgaccacaggcgcttgacggtaggcacgagctagacaccaaagacttcatcatccagtggctcctcttctgggtttgggaaaaattgagcaagactgagtacaaccaccgtactcaacaagacacacccataagtgcagaataaatgcaagggagtacaagggggttataatataaggggttagggtttgcagtaaacagcattaaaagacacttagttgctcaaagctattttgtaaatacggtcctagagctatacaatattattaatcaaggccgtgaacccacatgaacctgccttaacccaaggcctatgatgattcagatcgaactgcaacccgaccctgggtcccagcccgtcccaagccaacccaggccaaccattccacattttagttgttaagcaggttttaagaattaaaacactaacttgggtacattgctcggcttgtccataaccgagggcgcggctattcgaataggttatactctgatcagaggtgtacatctttacccacaagacacatcttcctcacgtgtaaccacgtgccacataccaccacggcatacggacggaagacatgacatagtttccaacccatcctagc

SEQ ID NO: 13513 - DNA, 1501 bp, Oryza sativa
tttccttctttttctttattttttcgcgcgcgattacatgaaagacgcgcacacacaccgcactcacgtgacacgtgaatcccgctaacacgtacatgctgaacgagacagagatcggcggtaaatcactgatctcactaaaatcaccgatatcgaaaatgttataataacatgtcaattaggtgttctaatgtagtttaccatagcccatgaggaccgagatgatggagccgatgatggagcacccgacggcgtacttgttcttcctctcgtcattctgcttctcttctcccatggcagctgcgtcgtcttctccttcttctccttgtgtacttctcaatcacacacgagctgaaaaacgcacacaaaaaattgaacacttgagcaagacaagggaagctacaactcttgtgctctcctattatagccgcaaccacaaggaatacagagtgtacaatgtaatgtaagccatgcagagagaaattaaagaagttattataaaattgtagttgtaataacttttgcagatggctggtatttatgttctttcttttctgatctgtcctttactgaaataattgtacactttctttgagactatgtaatggtaggcactaggttgcacaccattgtcgatttcgattagctgatgcaatagtggagtggacaactggacactacagtgaagagtaaacggcaaaaagatcttgggagacttataaactcgtaagatatttatggtccaagactctaaaacagtacagtactactaacaatggtagtagacagtagcataccactatctccaaattggataaaacagtgcaaatgacagtctccaaacactgagcctctctccaaaggtcagacatttctccctgacgaaaatacagaagcagagcacatgctgaagaaataaaatacagtttgtgcatgttttctgtacaggaatacaggggcgtttttggctgtgtgcaatggtgacaaggagttgttaaatttgcaataacaaccatggatacagctcaacggaggagagaagctttgtacgcatcctctgggcttatctccatggatgagctaagtggtcaacacaaagagagcacattttttcttctctgcaattctttgtttatttgcttcagatttcagacttcagatgagaccaaaacaaagtacgtgtaacgtgtactctctatcatgttggtgtggatataaatacattataccagtcacacaataataggtctggtgtctattcatttattcttgtattatactagtgacacaaaaatatgtctggtgtctatttattttgaaaggtatttattgatttgttggtgacaatgcaaggcatgatgtggcttgcagctccttcggttcttgcttgtttcacattttttgggtttttgtgtacgtgtttgttaagtcaaacatgagaggatagatggtcactgcctttttgtagctttgcgttatgatatatgtgctatggtacaac

SEQ ID NO: 13514 - DNA, 1501 bp, Oryza sativa
agaatgcacactataaagggaggaaaaggaggcagctaacatgaaagtatctcacaaagtcacagctaatgtgctagtcaatttgttctctcacacactgagaaagatgttttttttttagaactgagaaagaggtaaagactccctattagggggttgggtacaagtatagtaaaatgaacatggtgaaaggagctcacaaaatggtagttagccaccaaattttttcaaacatttagaccatccatgcatatgtttagaaacttatctggattgttccagatattcttaaaaatattcttttaatactatggttgtaccatagcacatatatcataacgcaaagctacaaaaaggcagtgaccatctatcctctcatgtttgacttaacaaacacgtacacaaaaacccaaaaaatgtgaaacaagcaagaaccgaaggagctgcaagccacatcatgccttgcattgtcaccaacaaatcaataaatacctttcaaaataaatagacaccagacatatttttgtgtcactagtataatacaagaataaatgaatagacaccagacctattattgtgtgactggtataatgtatttatatccacaccaacatgatagagagtacacgttacacgtactttgttttggtctcatctgaagtctgaaatctgaagcaaataaacaaagaattgcagagaagaaaaaatgtgctctctttgtgttgaccacttagctcatccatggagataagcccagaggatgcgtacaaagcttctctcctccgttgagctgtatccatggttgttattgcaaatttaacaactccttgtcaccattgcacacagccaaaaacgcccctgtattcctgtacagaaaacatgcacaaactgtattttatttcttcagcatgtgctctgcttctgtattttcgtcagggagaaatgtctgacctttggagagaggctcagtgtttggagactgtcatttgcactgttttatccaatttggagatagtggtatgctactgtctactaccattgttagtagtactgtactgttttagagtcttggaccataaatatcttacgagtttataagtctcccaagatctttttgccgtttactcttcactgtagtgtccagttgtccactccactattgcatcagctaatcgaaatcgacaatggtgtgcaacctagtgcctaccattacatagtctcaaagaaagtgtacaattatttcagtaaaggacagatcagaaaagaaagaacataaataccagccatctgcaaaagttattacaactacaattttataataacttctttaatttctctctgcatggcttacattacattgtacactctgtattccttgtggttgcggctataataggagagcacaagagttgtagcttcccttgtcttgctcaagtgttcaattttttgtgtgcgtttttcagctcgtgtgtgattgagaagtacacaaggagaagaagga

SEQ ID NO: 13515 - DNA, 684 bp, Oryza sativa
ttggtacaatgcattttaaaaggtgccacgtagtgaagctttatatagctgccccgctgacttttttatatagtcaaggcattgtttggttttataaagcaattgattggatataatatcgttgctttttgccacgtaagtgagcatttgtattgaccaatattatggtttaggctgattatgtattgtggtcattttccaggcggttggtaaatcctttatgagtttatttactcagattttacaccacatatgccatatatttccatgtgcggtgaaaacatgtgtcttttagggactcaagcacatttgttaaagcagtgtgcacatggtatatgtccaatactttgaaaatttctttattcacaacatacaagcttctttatagttgttttgctatgcgaattttccatgatgtagacaactttaggtatatcactcggatcatgttgttcggggattcacaccgcatatgctacatattaatattaagtcacttggttgacgacaattatgaaaaccactcggttgattggattatttactccttgactatatgtttagtttgttcaactaaccaaatagtcggggattacacctattagtcgatgcacctaagtttacatttaattatttttcagccctccacagtcttcagatttggtaaaagtactcgggagacca

SEQ ID NO: 13516 - DNA, 1501 bp, Oryza sativa
cacgtactccctcctaaaaaaaaaaaaagtttccgtgcccaatatttaaccgtacgtcttatttaaaaaaattataaaaaattaaaaaaacaagtcacgcataaaatattaattatgttttatcatgtaacaacaataaaaacacgaattataaaataaaattatatcagatggacagtcaaagttggacacggaaattcagggtttgcttttttttttacggagtaaagcgcaagcctaccaaatgcaaaatttacgacatgagaacctgtgttcgtttaattagttgaacaatcaagtcatgcaaagcaaccgaacttagtacatttttgttgcgtggggaccaatgctttagggcgtaatcatccatactcacgaaggaaatcgttctggacaacgacacgtctctaaaacataacttttaacttcttgtttctataaaaatatttattgaaaagtgatatatatatatatatatatatatatatatatgcttttataaaaatatcttttaagataaatctattcatataacttttacatatattttcaaactcaacaacttaaaagttatttatgatttatatttttaagatttgaattaaatattgtcctaaacgattttcttcgtgagtacggagatactgctaacctaaacaaccgagcgaatcatctttgactaatcatcgccaccagataatggcaaaccttgaatctttagattttgggagtttttgaccgtgagaacacctgagcccggccgctcggaccagcgatctgatctatacaatggttgttaatagtgggttttttagcgttgttaattataaatacttgttgatatggaggaaagagaaaaaggagagacaaaacatcgttgttatgcatgacaacagcttaacaacgactcttagtcactataatatagaaatatggttgcatgaggatataaatataaaaagaatattaataaaagaaatattttttgagttaatgattagagcctttatcgtctcaactattataaaaacatggtctctaaaatcttgtattatttaagagaccatacccgtctctaccattgaacatgccctaatctaccccaacatcccaactttgaccgggcctcgatgctacggcacgtgggcccacccactgacaagtgggccccaccatgacgttatctccttcaccactccccctcgcgatgcgacacgtcgagcccgacacgtctcctctatccgagcaacgacgccgccgacttttccagacttaccgcctattctaatcccccacacctcccacctctcgcccactgacggccgggcccacacgggcggtgggcccacgtgtaagaaaaaatcgcgtgaaggtcacggggggcccggtgtttttaccgcccagcgtttcgaaagcgaaagggacaaaattgggaaaaaaaaagaaagaaagaaagaaagaggagaaaatttcacgccgcggctcacacgcattcctcttc

SEQ ID NO: 13517 - DNA, 1501 bp, Oryza sativa
tgtttcagaaaatttttcaatgcatcagaaattcagtcttgacagttgcttgaatgctccctccctttacaggagcactatcagcttcatcctgggctcttggcaagatgctacatcactgaagctcaagtatggcaaccccccagtcatgatccacgagaatggatggtctgaattatcgagctatttctgaacatacgtaatgtaaatctgatcaatgtgatgtgaatatgattttattttttccctctcgatggctcaggcgacgcagattcaccggagaccccgggcaagatcgactacgacgacgactttagatcggatttcttgcagagctacctggaagttctgcacctgtccatacggtgtgctcactctccctgcttgttactctccattccatattgtaaggtgtttcagtttttattctaagttaaacttcttcgaatatggctaaatttgaagaaaaataaactaatttctataacgtcaaattaatgtccagtctagaaatctttggaacttcagagagagacactctagttaatttagtttcttggttcgcgatgcaggaacggatcgaacacgcggggatacttcgtgtggtcactgctcgacgggttcgagttcctctccggctacggcaaccgctttggcctgtgctgcgtcgacttcaccgcgccggcgaggacgaggtacgtcaggagctcggcacggtggtactccgacttcctcaacggcggcgagctccggccggtgaaacccttcgtcgcattatgaatcgggaagatattaatccggagacgtagactagaagatgagcaacttactactctctccgtcccaaaaaagccaatcctctcccagtacaacgattctgaattatactaggaggggtcacatttttaggttgggttttttttttaaaaaaagtatgcagttaatattttttttctttttactatatacgaaagtggaaggttccaaccctccacgcaatagccaaaaataataaaagcgacatcgtcttctagaaggaggccagagaatgtgtatggatgtaaatggaaaaatcggacagaatcacgaacagaggagatcagaaacacctggaattcagaaaaaatggtgagagttggcgaccaatttgagttgctgtactcctttgtgccacctgcattaccctgtcgctgtcgttatctttccatcaaaatgttcatgtacggacgtgtacagggcacgtaggtgtctgtctactgcatgcctgcatttgatgacccggggccccactcgtgtcgccccacgtcgacttgttaggcgcaggtttaactttgttttgtgggataattagtttgactgtgatttggagagcaattattatgtttgaagttctttagtggagtatatacctacttgagtgacgtatcacgtatctagcaaaagtttgaaccaaacttaaccttaagttctttagggattaggtctgaccttttgcgcttac

SEQ ID NO: 13518 - DNA, 1501 bp, Oryza sativa
tggatgaggtagaaggagatagaatcggtggatttgttggttgttgtcctatcccgtccatcacggttgggacgggattccgtcaaatagcatttctggaaaactattgttggacacatgagatttgtccaagttgcctagaataaaagttttactcctagattcaaccatgactcttggtgacatagacaaatctcatgcgttcattttttttatccaacggtagtttccagatttccactacatatgtggtttgcactacatattttccctatatgccaggaccaagacatgttagaaacagtgataatacataccgctagcaatgaacatcacacactttcagtaaagggtaagctcaatcctagtgcatgtgttaaatagtgccataggatttgtgtactactcagactataggttacatagcagattacaaaacaaatgaaaatgtaacaataataatttaatgcagaagaatctgtaaaaatagtttcattgcataattgaaagattatgcaggaaaagagccactaggagcagaagtagaacaactaaaatatgtacaaggagggcaggaggctcaccttcgtcagctctgcatttctagcctctgcttcagcaatctcttctttaagatgcatagtttgcacttgctccctgttaagtgctgcttctagttcctctttctcagctttaagagctattaaaagttcatttgcgtcatccttcttctgaaaaacaacacagcatcacaggatagaacagctgtgagtgtctttgcaaacaaacaataattttgcgaacaatcagtatgattaacactaaattagcatcaataaagcatagaaaacctattacatgaagcacggtactaagtttagacattgcataattaaactataactacactataatttcctcttttttttttgaaacgcaatgcataatttaactatgtaattttgtaaaattacactgtatgtagtgtatttttaagtagtagagatagggatttattgtgctcccaaaattgacgtaaatttcggggaagaaaatttcgatttttcttggacgtatttattttttgaattttcttcaatggcttctaataatttctattattccatttatcaagtgagtttttcagggcatgatcgacactacgggtaggcagtgatgaaccggcaatgacttcccccttttttactagtgcgaaacactgggataaatattttctgagacggaatgcgacggaaacacggggataggtggggttataattcagactgagcttatcagaacatgcattgttcaatttgcgtggactcttttcatagtgggttgatcaacaggtgctagctgcagcccaactccggccttttccagcccaactgtaccaggtttaaagggtacgtgccggtgttggttgcgctagcggccttgccacatgtgtgctggccgcgttgcctgcccctgcatggctatttttagaatagctgat

SEQ ID NO: 13519 - DNA, 1501 bp, Oryza sativa
tgtcagtcaccatttaaggggtgaagacttctgggctcctattacaccgggaaacgggagccttgctttgaccagagcgggaggaccgactccggctgggataagaggatgagaacctctcaccatcattatttgatgggatatgtcgggctgcacgtcgcctgacatacgcgatggtgcgcctgacatcctgggtcccatcagtcattcgaccggtcacagaccggttgagtgcactgcacactgcattaaatgcggcgtggcgcgaccgttcgggtcgccataaatgcgggtaggtgggcacctggaggcggacacctaacccaccgtacgtggtgacatagagagggggtcggcggagcccgacccctagtcacgggagggggcggccgccgcctgacctcaggggggagctacgtggcgcctggggcggccttctccctctagtctcggccagggagtggccgccgccctacctcgggcccgacccccctcgggggagggccacgtggcattggagggcagcctcctccatccagtctctgggaaggagtggccgccgccctacctcgggctcgactcccctcgggggagggccacgtggcatcgggtggcagcctcctccgactagtctttgggaaggagtggccgccaccccacctcgggcctgactcccctcgggggagggccacgtggcatcggggggcagcctcctccctctaaacctgatacccccgggcccatatcaccgacaaatttatcaatcgtgtgaattatttcagcttgcatggatctttctttttattttgagcaacctttttctggtcaaaacaaactacacaaaaatatgacaaccaaaatatgttgatatatgtgccatgtaggtatgtggtacccataatgtccgcactgcgtgtaagatgaatcccttcatttgtaggagtcaagtccctatctttcttcttgtgatttcttctagcagtcttgctgctccttttcattttctgattccatccagttgtgttaccacacaacatgatatggacctgttctgaaacaatagtttcgctgtataatttaattcaatactcctctctataaaacgattgattaatgggtgcacctattttgcatttcctacacggcctgttgtctttgtgtttgatctaaatgaactaatttgattcctctctatgaactaaataagcatgaaatggtcgtctctgctcatgatgaatgggtttactgtatcttcctacttcccccatcttaatcgaattgcttgacttacggcctctttttgcacctaatccacaatgaatgtataagagagaatgtttctttagaacactcacttctatatatgtatagatcttttaaattttccaattatatgtatagatcttttaaattttccaattatgatatttccaaagagaatgactatatatgcaacgtaatagaaaaaaaaatgtttctgtagcctaccaagtaatgcaaa

SEQ ID NO: 13520 - DNA, 1501 bp, Oryza sativa
ctgttgcgagggtttcgcaagggcccaaagcccaagcccatgggaatcgcatttggtcccttatctaagattagtttaaatcgtaccctctcttaaccttagtttgttcactttgctatcattttcaaacttaccaagttttggtattgccaaattttgataagattgctaagggcctatttactttgatgcaaaaaaaatcttaccaaattttggcagaatttcttatatagttaccaaaatttagcagcaaactaaatgtagccacttttttagcaactttactaaaacttagtaaggttaaaaatggcattaaagtgaacagaccctaaaattttggtaaggttgccaaattttggcaagattttatatgtacttactaaaatttagcaacaaactaaatatagccactttttttggtaactttgccccaaaaaagataatattgaaaatggtagcaaagtgaacaaacccttgaaacctgttacaatgcaatatctcatctcctaaaaggctaaaaccagttccaggacggtttggatttccaaaatccaaatgcctcacattctcacttggtaaggttgaaaatgacatcaaagtgaacaggccctaaaattttggcaagattttatatgtacttactaaaaaaatatagccacttttttttgtaactttgccaaaaaaagataatattgaaaatggtagcaaagtgaacaaacccttgaaacctgtaacaatgcaatatctcatctcctaaaaggcttaaaaccagttccaggaaccagtcccaggacggtttggataaatccaaatgcctcacattctctggagagacgcatgcacagtttcacacacaccttattaggcatacctctaagctctgaaaccggtatctttcggtgctataaaaccaaaaacgttaactttcaatgctatataaccaattttcccaaatttataagcctgaaaaattgcattggtttaaaacttcaagttttatgaaaagaaacaaaataattcatctaaatgccatcatagctctctagcttcaataaatcttggattttaaattgtgccatgaccttggtccttggttttggtcacccatacggtatctcaaatgcactacaattatataatgcttatacgacatactgaaactacaattatatacgaaaatgcacttttgaatattggtctacacgtacaaattacgattggaccaacaaaatggcccaatcctcagctcgtgtgattgcacagtttcttctttctacgcacattttcttagctgagctaggaccaaagatactactccctcagtttcacaatgtaagtcattctagcattttccacattcatattgatgctatcaatagatagattcattaacatcaatatgaatgtgggtaatgctaaaatgactaacattgtgaaacggatggagtagtaaaatagcgtcgtttcagcatttcttcaaaaaaaaaacaaaaaaaggtgc

SEQ ID NO: 13521 - DNA, 1501 bp, Oryza sativa
cctcacgatggtcgaggcgagagcaccctccgccatggctgcgcgctagagtgtctctctctctctctctctctctctcacaactcgctcaaatcacaatggattggaaagtcaaattgggtggacgaagctaacgctgtggagtagctaataatcattcggggaatggcgcctgcctaattccatttcgctctaaataatactccaacaagtattttttttcttaacatccttataaataatatactatatctgtttcatattataactcgttttgacttttttctatgccttcgtacttttaaatttaactaagtttatagcaatgtttttttaacataagacaaacataacatcaaaatatatctaatgatacatttatatatttttatcataaacttaataaaatttaaagaaatttaacttaaaaggtcaaaacaacttatattacagtataatataatgaaacaaggggagtagtactactcgctagagtgtctctctctttctcacaactcgctcaaatcacaatgcattggaaagtcaaattgggtggacgaagctaacgctgtggagtagctaataatcatgagatatttaactattcattgcgggaatggcgcctgcctaattccatctctctaaataatactcctcctctttttcttcctaaacttccctgaaaataatatactacctccgtcccatccctttgagtttttttaatgtttgattatttatcttattaaaaaatagaactattatttattttgtttgtgatttgctttattatcaaacatactttaagtatgacttatcatgttttatatttgcactaatttttcaaacaaaacgaatggtcaaacgttgcaaacaaaaaatcaaaacatctattataggatggaggtagtactcgataactcgttttgactttttttcatgtcttagtacctttgaaatttaacaactttatatgaaaaaatagcaatgttttttttaacataagataaacataacatcaaaatatatctaatggtatatttagtgaggttaatttggtgatgcagatgttgttatatttttttcataaacttaataaaacttaaagaatttaacgacttataatataatgaaacgaggagagagtactgctcctactctacatacaaaataggaagtgcttttataaatatatacatcgttttttttcttaagaaatgcattggtttttaattatatggaagattcgatggagatggagaccggccacaaatgatttggctcactaaactgctattgaaagataactaattatatggaagactcgacggagatggagaccggccataactcatttggctcactaaactgctattgaaagataactcacggccgggcgagaaatgattcattgtgtcgacgtttgatgtctcgactacggtatttggatagtatggggatcgccgatgctaggatatacgcgagactgaggtaaaagaga

SEQ ID NO: 13522 - DNA, 567 bp, Oryza sativa
attcctgcagcccgtatattcgcaatcaaatttgttatttttgttacaacttgtagcagttgaatttgaacttgcatgtttgtgaagtgatatattacatattaacctatcatgtcaaattttttaaaattttttctaaccatttaattgacatgcaagaaacgggtgaacgtacacccgtgtttaaacagtttcccgtcgccaacgtctatattccctcttcctcgcgcgccttatccttcttcccgcgcctcgccagcctgggttatcctgtacgcttttgaatggcttcctgtttcggtgtttctttccaaatcagctgcttgttagggttgccagtttgccacacagccacagctgtggcgcttgcgccgccccattaacctgagccgctagccgctagggtttccgcgctgccacggtggcgccggcgcgcctccccacttaggcttggctctcctcgcgccgccgcctccctatataaggggcattatccaacggtagagaatgcccttttcctcccgtagtctctcagctaggcgcctaggcgcatcgatcccatcgaga

SEQ ID NO: 13523 - DNA, 1217 bp, Oryza sativa
tttataaacttatttaaacttagatacgcttgactagaaaaaaaagtaatatgaaatggagaaaatatttattagagaagtaattcccacgttacaagcaagacttttttctctctctttctggctttctccatgtgacatttaccatggataataaatacagaatggctatgaatcaagttttgcttctgttttcttcaagggattatattccaaggagcatgtatgctttgcgtgcctgcagagcaaatgtgtcaaagccccgagaagcaccacaacttctctttctccagcctgaccaccaatgtcggctgatccatatccatcatatccaatctgcgagtatactacattactactccctccatcccatttgaaaagacagtcatgatttttcatgtacacatttaaccgtccattttatttaaaaagtttttttaaaaaagttaaaaaaacataagatacgtaaaaagtattattcatattttatcatctcataataataaaagtattaatttaaaaaaattaaataagtcgacgattaaagttgggcacgaaaatttattcttgcatttaaaatggaacgagggagaagtagactagtagtagcagagtaatgtaaacatgcatatgcatggttgcatggttggttgttggtgccttgtactgcctgccggtgtgaggtttgcatctgccatccggtgacagaaaactcctttctatcggcattgccctcctgccagtttgattcatcttcttcccaagcgacatatcaccaaactattggttcatcatgcatggttggtgatgcacacctgatcacaagcctgtttcttgctgcatccaaccaacattgatagatacggtgtacatgttcttcttctatccactaacagatttcttttttaaaaaataacccattatatatattgtctaatatatttacttttttggtgcccgtttatcgtttctgaattctgcatgacagttgggtgtccgccatcactatcatcttttatattagtatagatgattttcgattatctacctatatctttttatgtttgttcatggtttcacatcaagaattcaggattgatttggtcttgactcttgagtaagaggcaagcaactctgaagtatgcagtagaatgcatcattcagcaatgcagtgacaaaaggagactgtaaaagctcctgcgtggctagtggatgaa

SEQ ID NO: 13524 - DNA, 757 bp, Oryza sativa
ccgggactaaagatattttctcgctatttccaaattctttttaaacccggttagggttaagaaccgggactactgataagcgcacttaatattaatttccattacatatgtgattctaaaatagagtgtgatgcattaggattatttaaagtcgagcaattaatggcaattacttcgaaacattattgttgtctgtagtgaattaagtggataaaacgtaataagcaaatatatgatttacaattaataagcattctaatgatcatatatacttacatatgaataatattaaattgttaaaaattgtaattaacatatgtatatacatacgacatgtatgatttaaaattaataaaaattataataatcatatataattagcatatgaatgatattagattgttaaaaattgtaattaacatatgtatatacatacgacatgcatgatttaaaattaataaaaattctaataatcatatataattagcatatgaacgatattaaattaattgttaaaaactctaattaacatatgtaaatgccacatgcatgatttaaaacttttaaaaattctaattatcgcatataactagcatatgcatgatttaaaattgttaaaaactctaagtatcatatgtaaatgccacatgcatgatttaaaacttttaaaaattctaattatcgcatataactagcaattacatgatttaaaattgttaaaacctctaataattgtacgtaattaacatatgccata

SEQ ID NO: 13525 - DNA, 1501 bp, Oryza sativa
gctcgagttgtggtttaagggctgttctgattatctgatattgttggccccatagatcgttcaggagcggggcccgcatgccagtaactggagcttgagaaacaccaaacctacaacctcagagaaaaactgcagcaacttttacagctggttccatcccatattttattcaacaaacagagactcgtccgtaaacttatttctaaaatggacctttattaagctaataaaaactttagctcatcgacatcaacgaaagcattgaagtacaagtgcataacatcctcagcaccagatgctttcgctcctaccgtttcgcacctccatttcacctacgggtgattataaaccgtaatttgcgacaaaaaaaaaataatagataaaaattttatatatgtgcaacaccgaaaaacaaactataataaaaggatattaaaaaataagtttcaaaattcaatttttttggcagctgacaaagggtgattaaaccgtaattaacgtttatttgcgacaaaaaataatagataaatattttatatatgtgcaacactgaaaaacaaactataacaaaaagatattaaaaattaagtaaattcaactttttttttttgggcagctgacaagtgacgacgttgagaaatttgctgagtgtggcacgaaatacactaaaaagatccatctgtataatggaaaatgtttatttatataataagagtaccagaaggatctcagtgtaaaagttccagaactgcaaaactgtgaggtttattaggtctatgatattaagaaatactagaaggatcaagatgtacaaattccacaactgcaaaaaccgtgagatttatatatttattgattagaaacatctatagtcagggaccaatctgttaagatgaggacgaacaacagtgacatctgactagttacgtgcctgtgcattacaacggatccagagatatatatacctgtttttcatgcgttttttatgagtgattttttttaaaggggggagggagcagtttttctgggaaaaggagggatgagaacaatggtgcttctaagaaaaagaagggaaaatccgtggtatttgaagataacctcgtgttaattaccccggtgtcactttcagtcaccatcaccactttcgtccagttgcacacgcgcgacgcgatgcttcttccccttttctctttcgaattgtatccaatttgaccacgaaatttactcactcggaattcagaagatgagtagcctgcaagcgtagtagagacgaagaaccttggtgaccaaggcagcagcagcagcagctagctagctgagtcaacgaaaggaaaccacctgagcagttcagtcgtcgtcttcctcctcctaacctccagctataaaaccagctcgccccagatcaatctgatcatagcaaaactagcaagcaagcaagtgagcaacaacgaacacgtacatacatacgattgagaggaggatcaattggagtagtaagtga

SEQ ID NO: 13526 - DNA, 1501 bp, Oryza sativa
tgaatttgaatatgagactttgcacatatgtataatactattaggagtaaatatctaatttgtttatagaatgtttcgtgacattttttaattggtgtacgcatagtgtaattaagcttggagtgctagtgtttaggcaccgttcttagtcgtcggtgcgtctaatgttattcaattcaattcaattgaatcagggtggttggttgttagggctggtttagctagctagtcacacagtgttagtattagtgatgagaaaatgattagcagcggcctaacggagctagtcgtttgtagcagctagcatgcatgttgtacatttggaacatgcaagtagttgagcgcattcatgatgtttggatccaagtgtccatcatatcagcagtaacatccaacgatccttccagtattcttctttcaaccacaaggacaacttatgcacacgcgtacgcttcacctggttacactatagcccaataatgcgctcggctattgctaagaaatataagaatcttacaagctaaaaagactaattaaaattgctcagctgctacaaaataaactatgaatgccaaccaacaacgacgatatgatgagtattttcaggagttggtacaaacacagtgaaatatctcaatagcacatcacattttagtacacaagagattgatatataattgggataaaagaataaaagtcatattaagaaactaatccaaatatattactatatgataaaattcggataacgtatttaatagtatttattcatgttcaggacgtgtattgtatcaaccatgcatgcatgtatttaagaggttaaaccgaaacttcatgtttcttatcacaagaatgtactagctggcctggcatgtgctccacaatgcaaagctctcagcagatcgatcaattaaatctaagaattttcagttactaaggtggtgtttgaaggtggtgtttggttggagggactaaagtggactaaagggacttatatttttgtgagagggactaaatttagtcctaatttctaaacacctcctaagtttaacgtagtttttaatcaatcagctgtatgctattttgcaatccaattaagctctagataagaccacgtacactatggagtagtagaattttatctttctttttcacaagaccaagctgctagctactccagttagtaggagtatttatttatcgttgacgtaggttatccctcccggccgggacggctgtcggtcgccagcaggtggcttccaaattgaagccgacgatccattatgttcatgtcattctcgtatcgatctacctgccaaccgttactcctcctcctaggtattaatgcatatcatgatgccacgtacagcaacccgtggccaactttctatgtagacgttagacaaattaaagagggctacgatcggttcatcttggcccgtgttagtttcaaaatatttcttcaaatttttaattttttcatcacatcaaaattttcctg

SEQ ID NO: 13527 - DNA, 447 bp, Oryza sativa
atgtttgaccgttcgtcttattaaaaaaattaaaccattattaattcttttcttaccatttaattcattgttaaatatacttttatgtatacatatagttttacatatttcacaaaagtttttaaataagacgaacagtcaaacatgtttaaaaaagtcaacggcgtcaaacattttaggacggaggtagtactggagaacacggaacacatgtgatgtagtacgtacatcattcagactctagtagagtacctaggtcgatctgagtccaactcccaacgacctagcagcgactgccatcaatggatgtatgattccatcgtccgcatctcagctcgttgccagcagcttcctatttataccctccacccatcgaccgacgatccatcaccggcggcgacgattagctatctagcttagctactcgatcatcagatcatcgatcat

SEQ ID NO: 13528 - DNA, 420 bp, Oryza sativa
tcactcgtgcatagtggtcaatggtgtgatacctaggctataggtatctgccatgatgccacaagtgtaactggaatgctggattgctagtcctacatgggttgtgaatattcaaatatacatagtaactaggaaaattttcatttcaaatgttcctaacttcaaagatggggggaaaaaatctgcagccaagattttggcactgcataagaaacttgcaatgttgtgaaacaacaaattgggagtttggtttacagaaagaatgctgaactataaacctcaaaattcaaatatcaatgtacctacacatgtttaaagttcgtttcgggatagatgccagtatcaacaaacttgatgtatcaacccattttgggtagtggccatatggattttactgttttatttcttctttttactagt

SEQ ID NO: 13529 - DNA, 1501 bp, Oryza sativa
ccagagcaaaaaccatcattggatggtaactacctttttttttaatatttcacctttctctaattgtgttgctcactaatgaatgtattgagatttttacagtaccactcttgattgcaaaactaagagcggatcaactgtgatcttttgtcctgatcctgattcagaaaagttgctggttgcacgggaagattcaccgtctgtaaaggtaattttctgtttttttccgttgcatatgaatatgcttggaaagacaggaacatcaacttgttaactaaacttgagcaagtataattaatttaactggataatttaatctgtttcagattttgaacatgggaaacacggatcataatcctgctggtgaaatccccttcagtaactcagaaggtagtccgtgttactcggttttatttatgctgtaccatcatgttacaatctttgctggtagtctcttaatttgactcgctagtgtatgtagtagtggattgtaacatcatgttactatatgtgctaggtatcgttgctatgtcttggtgcccacacaatcccaacttactgcttgcgtgtaccaagaacaacaagattttggtctggaacaagaaaactaacaaggttctcccgaatccattatctttaggagtacctacttagtgttgcaaacacaactgttggattgcacgattaatagtcagtccgtttacaggtaattagcgaggcaaccgctgcaagatgtctttatgctcaatggagtagaacaacgccaggccaattagcagtcatccaagaaggcaagctgaggctttgtaaggtgacccccttacttatatttgtcactaaacatggcacactttatatggaagaatgcatgttatatgttataaaaataatatatgtatatatttagataatataaaaatgatgtgtagatggtgatttgacattgcttgcatgttaacttctaaaaatacaacaaaattacaaatgatatgtcatatttgcatgagatgtaaaatattcgagataataattgctagtggatgatgatgtggcacacttacatgttgaactttacgagttagtgggtacaaatatatagaaaaaatatatagatttgtcatcacaatggtagtcattaacacttctccttttcttcgatgcagttggatggagctgatgtagctgagtgaaggctaataggagtgttactgctagttctagatggcgactagattggatatatagttggatggagctggtgtattttcttcgatgcagttggatgaagctgatgtagctgagtgaaggctgagaggactgttgctagttctagatggcgactagattggatagttggatggagctggtgcagctgactagctgagtgaaggtgtttctccagttttaaatgacgactagattggatagagaagttagtgtagctgagtgaaggccacgtgtagctttagataaccacacttgaatcaactatagatggcca

SEQ ID NO: 13530 - DNA, 1091 bp, Oryza sativa
ccccccccccccccccaccaattccctccccttccccgtttcatctgctgcggccggactccctccacgaatcctcctccgccgccgtcgccgccgccgccgccgcaaggtacggtgtatgctgggtgccctctcctccgctctcctcctacggatctgctcgcttccgccttctctctgctcgttctgggaggacgtgtgatctgatggatgtttatggatggttgggagccgagggcgatctgttcttgccatgttagatctctgacgcgtggtgcgtagcgacgtgttatgttagatcccgagccttttttttttgttttttttggtctgagatttatgggggcggtgatcttccttccgcctcgttcatgaacggtttggatctctgatctgttcgttcttgttgttactacttgaattcctgatccgcgttactgcgtgcgtatcgtatccccgcgataattcagctcttcttctttgtctctgtgatctcttgcatatggtgctacaactacaagtgaagcatcgcataaggctcatttgtagatttgttcatgtctctgttgcctgttgatagtgtcatccaagtggtgttcgtttctaatgaagatgaagatgaagatgaagttgagttttaattatgacaaacttaaaagttggatttgtttgatattacaaagcaacttatatgtacgtacgaaacgtgttgtttagtagtttgaaagacgtgatgatggggattgaggtaaaatagaaacgaaaaccacctaagtctcacagtgtcgattcaattagaagatgcagtttagctagtctattagaaaactgtttattggtctcatgtcctttggggactgagtagattctacttcttatattcagccttttgccattgttatcctttcctatctgtcgtctgcaatttgtgcttccatcatatgatgggtgcctgtacttctgaatttcttgttgaacttattgatgcaacatgtttgattattgaactttgcattgtgtgtataccactagtgctgtcattctaatctttgaagcctgtattgcccttgcagagagctaaaacaagatgc

SEQ ID NO: 13531 - DNA, 633 bp, Oryza sativa
cccattgctcccgccgtcccgaccgcctctctccccctctcccgcagccactgccgcgcccgtgctcgcctcctctccccctctccccattcttccccacgcgtcgccatgcccgcattagcccgtctgctggtgacaagcaatgagagccggcctcctctccctatctcccacttcttccccgcgcgtctccacacccgcatccacccgcctaccgcgctcgcttgccacccgcagcaagcctccctccctgaagaagagaagagagaagagagaaaagagaagagaaggagaagaaaagagaatgtgtagctgacatgtgggccccacgtactttttaaatttttttgctgactaggatgccacgtcaactaaaccacccatatatattgccataggaccgtgagtgcacggtttgtgtgagtttaggggtacacatttctgattttgtggttaagggaccttaaaaaatctcactgttaagttgagggacccccggtgaacttattccttaccgatttggaatgttatgagtataattcagggcttttttactttgtttccaaaacaacaaactaaatgagactttattgttacaatcttgtcaatccctacaaactttataattctaga

SEQ ID NO: 13532 - DNA, 1501 bp, Oryza sativa
cggtgccctctccaggagtagaatggagtaccagaactagtagctagtggaggtgcactggaaaaagggcatcagcatgtgccgccgatctagtggacgtaaactacggagtactattacttatagtatatgacccactcaccgatttaatctagacttggagtagcatctcaccacctcgtcgtgttatttttttgttaagaacagttacaatagcagactattagccagctataaacatattttaatgagataaaatatgagagaagagtagtgggctacagacctgtaatcagctgtagcacggactctaaaacgcaatgtgtatatgacagatgggatcatatattaataaaataataaacaactattgtatgatttatctattaaattgactatagataaattgtagttagtagtaggctataatattaaacttgctcttacatctcctcgggttcgtttgattcccggtattagagcaggtacaatagcaggctataagccagctgtaaacatattttaaaaagataaaggaagagagagaagagcagcgggctacagatttgtagccagctgtagcacggactccaagactgtgttatggtaggtgggatcagatattaatagtatagtaaacaactattatatgaattgactataaatgaattggagctagcaatgggctatgctattaaactggctcttagagtaggtacaatagcaggctataagccagctgcaaacatattttaaggagataaatgaggagagagaaggacagcgagctacagatttatagctagctgtagcacggactccaagacacggtgtgtgtatgacaggtgggaccaggtattaatagtgtagtatgtaactattgtataaatgaactattagattagctatagatgaattggagctagcagttagctatactattgaacttgctcttagtcgttacctcgaaactcgaattgcccgcccaaagctacccaaaaggagtatcgtactggtccaccacggccggtgaaaacctctactactacctgtactggaactattaatgcagagtggttttttgatgtttttcatctgttcccgccaccaccaacaccagcacgacgcaataatggacagagcgagagcggtgcgtttccaatgcccactatgccagtgctacggcccagctgcgcgcctgcgcccatcgaccggttcacgcgtccactgtggcgcgtcacatgccccaaccccaaccccatcaccaaacaccgcacctgcacgcacaaatctttactcctccacggctccacaccaatctcgccgtcctcccctcctcctcctcctctatataaacaccaccctaagtccctaacccacccaaacaccaccgcacccaccaatggcgtcctccaccaagatccccttcctcctcctcgccgtcctcctcctcctttccatcgccttcccatcggtaacctcacaatctctctaacctctc

SEQ ID NO: 13533 - DNA, 1501 bp, Oryza sativa
acaattattttttagataatttttttggagaaaaggcgcaaagcgcccaactttttactagaaatcatatgagttcatacaacaataaacaaaataaacgcgaaaaggctggggattttccagcttatatgaggcgcaaacatgcaacacgcatagcacttagacagcgcaaagtctacacacaattaacaagtctggcaccgcggacaattctgaaggattaagacaatttttttaggctgtgtttagattggcccaaagtttagaatttggttgaaattagagacgatgtgactgaaaagttgtgtgtgtatgaaatgtttgatgtgatggaaagttggaagtttgaaaaaaaaaactttgcaactaaacacacccttagataaattttaattctaaaaatataattactatgagatcggatgtgctgtattttaggacggaaaaccgaggcggctacactggaaggccgctgaaacctcggctggtttttgcggtcccctcgcgcggtccagccgctgctcggcgttgctccgacctacctgagctcccgaacccagtccaagccgggttgtacgggaaccaccgacactttctctgtcaaaactagctggaactattacatggcgctcacaccaacacaatgacaggtagcgacccgtgatttgggtggtggtgatcgcaccaacccaagtgtactccaccgagaaccagctccgtaaatgggacaaaacccaaccccactcactaaggctcatgagtggaatcactccaaaggtggggttaattgcatttggtcttgtggatatgcacgtgatttgtccctactgtttactaccactctttctgatctatgtagataagaccagaaacaactttgtaacagaattatcctatctaggaatacatttatatcgctctcttttatattataggtcatgctttaattttttttatagctaaactttttatagtttgattgaatttataaaaaaaaaatgtaacaacattttcaacacaaaacatacatattatcaaaataattaaaactactaatttgatattgtagatattattaaaatttcctataaatttaattaaacttgaaaaaatcataaaaaaatcaaagagatatgtaatataaagtagttaatacactagtaagagacatgagaaaaaactacgttcaccatatacaatatgcctcaaatcaaaatataaagattacaacttagtgtagtaccggagtcatggatgcatgaccctattcaacaggatacaaatttttaatatccacgaatataagttcggtgttacgtgtgcagtggtgtagtggtgcgcagtatccgcatatgcgtttgctgtgtgcccgcgaaaaaaaacagagtactgtttaccctgacacgtacaaagcctgtaaacaaacgtgccacgtcatatcgtgcggcgcggaggaataaatacaggaggtgcaagcggcacgctggggcagaaggcaggc

SEQ ID NO: 13534 - DNA, 658 bp, Oryza sativa
catgaatgcaagatgagctaatattgtcgggttaaatatatttgggccttttctagaaaaagaaaaggtatatgtggacctcaacgcgcaggcacattgaatagtgggccaaagataattggaccgaaaggcccatgggcttcccttaggcaaaaggtaattggagctgacgattgccttgattgtcctttagccatatttatgtggttttacttttatataagttaaccacctccaaaaaattttctagatagaaaacatcaattttaaccgtcaacagatatctacatcacaagtatcacaaaatactattacatcataggggtagaatgtacgtgtgtgtttacatagataagtgtgtggatgttatgagcgtatgagtttctacgtgtttcttaaaaaaaaaagatgaacaaaaaagcttgcatcatgggtgcatgttggtgagccaacagccaagtagcacaactgcaaaagattccccttttagatggacaaatgacaaacatcaacaggttgaatgaagttcagcggatatgatttcattttcgtctcaaccttcaaccaaagttatattgttcatacatccatgagccgtctgttgcagcgccgaaaaggcataaaaatctgatcataatatcgctgaaatgaaagaaaa

SEQ ID NO: 13535 - DNA, 1501 bp, Oryza sativa
cattcaccttgttcttgttcacgttcattcaccttgttcttgttcacgttcgttctctcgttctcattcacgttcgttggctcgttcacgttcgttcgctcgttctcgttcacgttcattcaccttgttctcattcacgttcgttcgctcgttctcattcatgttcgttggctcgttcacgttcgttcgctcgttctcgttcacgttcattcaccttgttctcgttcatgttcgttcgctcattcgctcgttcacgttctcggtgtggcggcagcgggacggcggtgtggtggcagcggagcggcggcggcgtggcgccgcgcgcggcatcggcgtggcgcggcggcggcgtgcggcgtcgcggtgtctcgtggcgcggcgtcgtgtcgtgacgaggtcggcgtcggcgtctgaaactcggcggccggcggcaaccgagagggagagatagagatcgagatcggagagagagatcgagagggaggcggcgcgcggtggctctcaccccagagatgcggcggcggagaaggaggcagaggcggcggcgacgacgacgagcgcgagacgacggcgagatacggcggcggtgtcggcgcggggatgccctaggcagtggcggcgaaggagaagccgagagagatcgatcgggtaaaaacttctaagtgttggtggagaagacgagggcgcgcatcgggaatatatatagccctagatctttagtcccggttcatgtccccaaccgggactaaagatcttttcccgctatttccaaattctttttaaacccggttagggttaagaaccaggactactgataagcgcattgaatattattttccattacatatgtgtttctaaaatagaagataatgcattacaattatttaaagtacaaagattaatgacaattacttcgaaaaattattgttgtctgtaataaattaagtggataaaacgtaataagcaaatatatgatttaaaattaataaaaattctaataatcatatatacttagcatatgaatgatattattaaattggtaaaaactctaattaacatatgtatatacatacggcatgatttaaaattaataaaaattgtaatcatcatatatacttagcataggaattatattaaattaaattgttaaaaactctaattaacatatgtaaatgccacatgcatgatttaaaaattttaaaaattcgaatagtcatatataattagcatatgcaatgatagtaaattaaattgtgaaaaactctaattaacatatgtaaatgccacatgcatgatttgaaacttttaaaaattctctagtagttataattagcatatgaatgatagtaaattaaatgttaaaaactctaattaacatatgaaattgccacctgcgtgatttaaaacttttaaaaattgtaagtatcgcatataactagcatatacatgatttaaacttgttaaaacctctaataatcgtgcgtaattaacatatgccata

SEQ ID NO: 13536 - DNA, 1501 bp, Oryza sativa
acttgaagaaatacttcccgagcgtttggcaagccgcttaagaggtactatggctggtaattggattatcgtcctaagagcaaaaacatgctctatgcttttagattcacgttgttcatcaaaaaggcaggggggcatgtgtttacacccaaatttagcacctaggattaaaataggaaagattgccaaaatttggaaatctaccggtttcctccgagtaggccggtctgaccgccatgtgttgggtggtcagaccgccggttgtaagccggtcataccgacggtgtgtggccggtctgaccggcgggtccgagtccgaccctatttcgtcgggtctcgaggtttccttgctcgggaaggcatgtttagggtttcctttggtttctaccccgagttggacgtggaggagggcctgtagagggcaagaccaacccctatataagtgacaaggccgggttcattgtaaagatcaatctacaatcaatcaatcgaatcgttcttttcatattacttttagttttctcttagtttgtccatctttgtcggtttgcgccgtaaaccgtccgccgccgctgcgaaagtgcgacacctctttgtaggtttgtcttgaaaaccttccgttttgcccacgagacgggtagttatctagaaatcggctccgctagccggtttagttattaaaacccatctaggtttagctctttgctagatcgaggtggttgacgactctaggatcaccgcaagacttaaggtgctacgatcgtgcttgtcaacttatcaaaaaagttgccaacaagtatatgattgcgacatttgtacggtgacaacaaaatgcttaagcgattgaagtgctcaaaaatctcgtttcaaaaaaaaaatgctcaacaaacacctaccatatctgcctaattcaaaatttccctacatatctaaatcttaatttgaatattcaattttacccatgatagaaaactaaatttaaagcggggtttggatcctgggactaaattgtcacatcgggtgtttggatattaattagaagtattaaatatagactaataataaaactaattgcataaatgaaagctaattcgtgagataatttttaagcctaattaatacataattagcacatgtttactgtagcattaatccataatagattcgtcttgtgaattagtacatggttatggaataggttttataattagcctatatctaatacttttagttagtgtctaaatatctgatgtgacagggatcttaattttagtccctgatccaaactgggcataaatcctgttcaaatgaaatccactcaaatttcaaattccattcgaattcagattctaaaaaccaacctactactctctcctctacaactaccaaagaggcaaagcgaaaggctcaagaaagcggagtccacccatccatctcctccaaccccaagatccccacccaaatccacctccggcggcggcggcgatggccggcggcgagt

SEQ ID NO: 13537 - DNA, 1501 bp, Oryza sativa
gttttgcggtttaaagtcatggattagattgggttcacttttaagggagtgaaagtgaacttattcctttgtctaaacaccaaaccgcaccgaaatgggcgaatttcggaaaaattccagggttctgggattcaattacagaaaaatttcgggcctcaccgaaatgggcgaatttcggaaatttcggacaaaatttaaccgaatttgttgcaaaatttaaacaaacatttgtaaatttgaggcaatttgttaacaaacatcagcaaatataggtaaaatgtttaggcaatcatataagcatcagcacacaaggagaattacagcattggcacatcccaagcactagcgaagaatacacgcgttgcagctccggtcggagcatagcatcagcaatgctaggcagttgcattacccctattactcactgacgcagttgccttcaccgccggcgcctgtgttgcgcacacggccgccgccgatttggccacatgagagcatcaccaagaatgagtattgtggaccaggggagaagatggtggaggggggagatagatgcctaggattcaggtgttgcggaatggaggaggaggacggcgacgcactgctccgacgctggtggcggcttgcatctcgcagctccatctaacagctgccgccaagggaggggacaaggagtcaaggaggagaaaagtgaatgaattctagagtggactttgaacttttatacccaggaacgatatttgttggcttgtttggtgtttgggctggcctgaaaatttaaattaggccgaaataatttggccggtttagtattgtctcgggctgcaccgatatggacgaaattcaccgaatttcggcccactcggtccgaatcccagaacctaccaacaacccatttctccccatccagaccagctccatttaaagaaccaaaccatttggcacatcatcatcatcatcatcatcatcatcatcatcatcatcatcatcattattattattattattatcagtagagtaaatttcacaaaactacaagtattttgtataatctatcacaaaacaacatatttagaaacttgtttcacagaactatagatttaatatattagtttatcacagaactacacatttagtgtcttcatttatcacaaaactataaatttagtgtctccattatcacaaaactacaggttttaataatgctgaaacctgtagttttatgataaaacctatagttctatgataatggagactctaaacatgtacttttgtgataaatgaagatattaaatatgtagttctgtgaaacaagttcttaaatctatagttttgtgatatattgtgcaaagtacctatagttttgtgataaacgaagatattgaatctgtagttttatgaaataagttcttaaatctgtagttttgtgatagatcatgcaaagtatatgtagttttatgaaatttactcttattattattattattattattattattat

SEQ ID NO: 13538 - DNA, 1501 bp, Oryza sativa
tcgaatgtactgtggacacaacaaatgtgtaaaaggttcttggttaaatttttcgcatttgatcaggccatgaaaaagtgtagttttacaagtatcacatattaatattgtctccggttaaaaagaacatgcgcggtttgatttttcttttcacatcttcagtgtgtgaatctaaacataattttgtatcggaataaattcataaaatatactgtgattaaaagattttaaaaatactttttcaagacacaatattcccatatttcgaaaggagtaagcattttactaaaagtttgatagtagtgtatgcaacactacttaaaactactccctccgttacaaaatgtttgacactgttgattttttaacacatgtttgaccgttcgtcttattcaaaaaaatttgtgaaatatgtaaaactatatgtgtacatgaaagtatatttaacaatgaatcaaatgatatgaaaagaataaataaataattaatttttttgaataagacgaatggtcaaatacgtactaaaaaaatcaacggtgtcaaacattttgaaatgcagggaatacagacttcagattgctgcattacttaggcagacgaatagaagtaccgagtatgccggatcagcgtaaacccaaaacagggaagcacatttgcactaggccttaaagaaaggaggaacaaaaaagaagcagcaacaccatcatcattaaaaccaaaacaagcagctaacccttgcctctggtggcacacccgccagaataaggtaaaccacgcacactttaacccaaaataagccggtaaggacaaccacaatgggtatcaataacctcttacaagaaatccatgtcagcataattttctacttggaaaggattaaaggaagaaagaaaccaagctttctacttaactaaagaaagtctttgagaaaaaacagacaatgcatgagagatttatagataccaatgtagatatactattaaggtggtttactattaatcgaatctattgctgagatgtacatgttttatagatagcaccttactttatcattgcgggtgctctaaccacgcccgccacgtacgccgtctctgggaccccgagccgaggcgcttgcggcgaaagtccggaaccatctgcttctcctcccctcgatctcccgcccgcgcgtcgccacctccgcacacgccgacgccgcgcgcgctgcacttttttacgctttctttacccccgtctccctcgcgtcgcgcctctccggaaatcaccagaagccgggcgtccgtggcgtggccccgcgcgtacgtgtcccccctaccccttgccacacgccgacacgtgccatccccatccacccacacgtgtcacccctctccccgcctatatatccctccaccaaccagcacgttttctcctcacttaatcacagtagctctcagctagctagctaaaccagtgctaattgtgttgctaatttgtgttgatttgtgattttgatacgaga

SEQ ID NO: 13539 - DNA, 554 bp, Oryza sativa
ccctcctcggggagtagcaaaacccccgcgccggcggcgggttccggccctttccacgcgacttttggacgcgggggtgggcgttctttatgagcgggggcgcgcctgcccgtgcccccaccagccgccgccgccccattcatgatcggggccatctcggcgcatcggcgcgtcgacgagagagagagagagagagagagtatatgctggtggcgcgcgccggtggctgtgagcttctcgttttcgtccggctccccgtggcgcgtgcgatccgctccccacactgcctaattttgacgtgccctggccgtcgcagctaacccagttgaagtgaaagctgcatgttccctatcacaaaagtgtataggccggcccccccgtattttgcggcccaaattttcgtgggctggtttgggtctcgatccaaatacaggtgggtgggcctaaatgggccgagttcactgtactgtttacccatgatagggaaaatatgtagtactccctctgttttatatattatactagtataaacatgcacgtacaatgtacgtttc

SEQ ID NO: 13540 - DNA, 1462 bp, Oryza sativa
  unsure (1)..(1462): unsure at all n locations
gcgtgcaggtgagctgctcctcacanccacnnnnnnnnnnnnnnnnnnnnnnnnnnnnnnntagttggatttttctcttttttttttcctttttcttttttattattattatcgggcccgtgcaggtgcaggtagtgacggtggttctcgacgacagggcccacacgcacgcgtggtactcgttcgattggaacgggcccattatagttgagccctattgggctgggatctatatgcgggccttacaaactgggccgtaactgtagtgtgcgtacgtcgatcgggaagggaagtcacgagagagaaaaccctagaatcgaatctcggcgactaggcgagattggaggcgggcggaggaggaggaagaaggggagcttctccggtcgcggccatgtcgctccgggccatcggttaccttctcacccgaagccggagggggttctcgccacgcgggatcccccgtgcgcaggcggagtcctcgctgggtatcctcactcgggcggggaggccagcagctcactctttccactccgttcgtctctcatctcacccggttctcaaatcgaaaatcttttcttttgttcactcgcagctcatatgtctctcatctcgttacgcgatacagatgggtttcgccgttggtggtggctctgttgttgtagccacggcttcattggttggattggcggccacaattctgtgtttcaagcaaaacactgacaagtcaggaggtatgaattgaaaaagcggattcagatggtgacataggataagcatgttaaaggtgatatagcgtagatctcagccctccaaaataaatccaacagctgagattcgtccacgtcatcacgagttaaaatttaactccaataaaatttgactccaagtaaaatttttactcctacgagttaaattttaactcgnnanaacgtggacgaatctcagccgttggatttgttttggagggctgagatctgagctatgtcaccttgtgacatgcctaccatatgtcatccaatctgaatcctgaaaaggccaagatttctcattgtttgttagtaattttttcctagtcaaacttaacaagtttgataaagtttatagaaaaatttagaaatatttaaagtatcaaattgatttcattaaatctaacattaaatatattttaataatatatttattttgtgttaaaaatactactatattttttttataaacttgatcaaacttaaagggtcttatgatatgaaacaaagggaatatttagctctgatccatgtaacttaaccatagccactaccactatctgtacataacctgtagctagggaggaggataaggaggaagtcacgaagaagttaccagctgcccaggacgccggcaaggagccttacctgagcaaggaagcagcaatcgaggcagggttcgtggacaaagatggcaagatcctgtggtctagcta

SEQ ID NO: 13541 - DNA, 284 bp, Oryza sativa
  unsure (1)..(284): unsure at all n locations
cgcgcgcaaggtggtgaagaatccggttggcgncgggnnggacgncggtgcgtgcgtccggaagaaagatgggtggataagggatggagcactttcatggaaaaaaaattccagttttctaacgaggtccaccagaccaccacagcgagctgtagcctttagccgtcgatactcgatcaaacaatgcgggaggagagccaaggagacacgtggcaaattcgcagggaggcaaacttgattttcagggcgccacgtggcccaatctctagccagggttagaacca

SEQ ID NO: 13542 - DNA, 1501 bp, Oryza sativa
gatttggaaatataactatcaaaagtagaaaagtagatggagggagtattaaataatttctatttctccccacatggccacatgtttccatgttatcatcaatttacaactactggacccactttgatatgaagtataaccgttcaatttgtgacggacatgtggatcgcactaatatgtagatgctacgtggcaccccacgttagtttacggaaacccatttgaacttgcataacacccaaaacatgtttaggcactaaaaatatttttgagagttcaggacctagatatcacacccgcttaagtttatgtactgttcatttacttcactctttaaaacattccatgggttgttattagacatcttttctagtcttatttgttctaacaggagttggatgtacctttacataccattcgaacctatgttatattgattcatttgtcaacaaacgcaacaactctcccttcggtctattcacaaatcatgctgagaccaactcaacaaaaccctcttcattttgaaactaaatctcatcgataaaggtgtggagtcacttcggtgttaggcgcatgcataggtggagattgcaatgatgctatttactcatgcgctaataaacgaacacactgattagttgttgatcgtctaaaaaatatgtggccatgaccaaacacatgaataaaaaaactattcacattcaccctctgtcccaaaatataagagcttttgagtatacgtggaatcattaatatttcttatcaaaattttcagatgacaagggaacattccttttgatttgatgattaaaattgtttccctaataatgcttaaatctttttgtcaacgaatcaggatcctctatagtcaatgcaccgtgcttttatcactaacatataagtctaatgtgttgttggctccatgtgataaaagcgcggtgaaatataccgttgagtatttcaaattctcaatcccttgtcaactgcccaatgcgccagggcttcattcggctttcgcgtccatcgctttcatctggctggacccaccgtactaatggcacgaccccctcagccgcttagaagcaagaaaaaaaaaacgagaccagccaggaaaccggtgctctcctctctctcccaacttttcaaaatccgacggctggcgaagacctccttccatcggcgggccgcgacgcgagggcggcgccgatttccatcacgcccacaagtttccgcatcgagaacatcgacaaccccacctccacgtgggaccacaccccaatcccaccccaaaccgggcccactgtcagcgacactggacgtcgaccctcctcgtgaccgtaactattagggctgcttccaactcaccaccctccattataaatgggcggtctgccctaaatgtctcgcattcatcgaaaccccactttattagcaccaaccccgtctccttcctccattcctccgctgctagaaccttctagaagctctcctcctcctccca

SEQ ID NO: 13543 - DNA, 1501 bp, Oryza sativa
  unsure (1)..(1501): unsure at all n locations
cgctgccccacgcaccgatctgcgnncgacggtcgtccacagcccggatcacaagacggtgtcggcctcagcggcatgcgcgcgacggcgacgaagagcggcgggttcagcggcgcgtgcgcgcaacgtcgncggtggtgacggccggacaggctcggacggtgggaaggcaccggatccggctaccgcgacggcgacggcgacgatgacgatgacggagaccgcgatggcgacgacgacggcgaccgtgaggagggttttctttttttggatattttttttggttttttatttttgcgtgcgggcgacataaccaccccgcacgcgaaaatcgcgtgcgggtgcgccacccacacgtaaaaatagtgattttaaagacacttggttccagacagttggaagatccgcacgcgaaaatcacttttgaccgcacagaagaatcatttctctactagtgtgtttagggctgtataggtccaggacctaaagttgtgactccggttggtcctatggtagatcaggcccaatgtgacctggatggcccacggttggtgggccaggctacgcactctaataagtggtatcatagctcaggtttggaatccgcaatgatttctatgggtcacatgggttgatgtgacggaaaagattgttgacaaaagtatgatatttacacaaatatcagatggctacctcctcgtgtgcaaagtagagttttcacaaagtttggaatccgcaatgatttctatgggtcacatgggttgattgacggaagagattattgacaaaagtatgatatttacacaaatatcggacggctacctcctcatgtgcaaagtagagctttcacacgattattacgcgggtaatgctgcaggtggcttatctattctattttcctttctcttctctctcttttaaccactttttaaaaaaaaattagacaatttttccttctaaattaattatacgattcatgattcaatttcatcattacgttcgtcataactaaatctttataaattgattctgcttgattatatttatgagaaaatatataatatgattacagatctaatttaaacatttttatattatacacgaaacaatgagatgtaaatgttggaatattagaaaatactcaatgaaacattcaaagtacaatacgtgcaatatttctgaataaataagtaaaacattagaaaataatgaaacatccgatgacactacatgcaccattaacaaataaactattgaaacatcacaaaataattattgaaacattaaaaaacacacccggtgtgacatttaaaatagatccattataacacaaaacttaaaagatgcagcatagtcaaattctaattgtaacatttatttctcacacgtcaaacttttgttggagaaaagaacggtacaggtacaactgcactgaacccgtcccccaatttcttcttgtaaatacatatagttgcaaatatcccagtttcttccccagtac

SEQ ID NO: 13544 - DNA, 970 bp, Oryza sativa
acaagtggaaaaccctttggtcatctagagaaccaacagtgatgtggctttgaatgaatgtggattatcttcagtactctttcatatgggttaattattattaggagttttgttgtaattatgcccaaagacaaatgattgtgctataactatcactactagcaaatgtggtagtttgtgtctgatgacttttgctacagataatattaatgaacatgattttcactaatcatagacaaacgccaattatgcatctgtttgagctgtccacaggcggcgcgccactggcgcgccccagcctctagtaaatatcatggctagtgtagtgggcaccttatccaaacaatgcataaaaagatagcttgaacttgcagctaaattgttcctttattccacttcttttttttattctcccaacagtggactacgcatatctgggccacgttgattttttttttccgaaaacggccacgttgattcggtggtccaatttaatgcacttgcgagcaactaattccgttccataaaaataaaccgatataaaaataaatctattataggatatgactatcatttaaattaagttgtgctaatatgatcctaatgtttccgctgtcattttaatttatttcatgcttacaagtcaatcaaactacagtatatatgttcaagtcaaacaacaaaagaaagctagatcaatctgtgcactcatgcacagcacagcagtagcaaagcttcaaactaactgtaatatctattacatgctaaaagtccattgaacatcctacaaacaattctaggctgtcacgtggtattccaataaatactcttaaatcgtcatatggcactataataaaccaatggaaccattacattcaactactaaatttatctctttaggaaaaaaaacttaacgaaatgatttaacgggagcctcaaggcccacctcgcttgctcccccgaacatagg

SEQ ID NO: 13545 - DNA, 1501 bp, Oryza sativa
acctctacgttgccgccgccgccgcggcagccagcacacccactgcctcatccactccgaccacgaccccgccgtcctccaactccaacctcctcctccacccgccggccggcgccgcgccctccaagtccaaccgcatcagcctccctaccaatcccaatcgcaaccccaaaccctagccttccctctcctccatgcctcccgtgatggaggtcgagatcaagctccgtctccccgacgccgctgcgcaccgtcgcctctcctcattccttgtgccccgcctccaccgcgcaccgccgcctctcctccttcctcgcgccccgcctccgccgcaccaccgccgcgcgccccctctgcgccgccaccgccgtgctccgcgtccgtctctacggcctcgaagaccgggccgtcgtcgcactcaagcgccgcccgcgcatcgacgccggcgtcagccgcgtcgaggaggtcgaggagcctctcgagcccgccatcgccctcgaggatgaggaggcgttggtggcgagtgggggaggcagtggttgacgcgcgtgacgaggtaggtggtgaatcggtgggggcgcggggcgccgtgacagagcatgtggacgcggagcgcgtcgcggatttctcccgctcccctcggcctccgcccgtggctcctatacttccgccggccgagcacacgcgccactcctctcctccctccggccggtgcccacgcccgcgcctgcgcaccgctcctctcctccctccggctgacgctcgtgtgctgcttctttcccagcggccgccggcgataggctcgagggggtggaagcggaggaggtcacgcctctccaggccgtcgttatctccgccggctggcgagactgcgagaggagggaggagaggggagagagatggagagaggaggaagaagaggaaggctgggagtatgacatgtgggccccacatgggtcccaccattttttaatgtgaaactgacatgtgggtcccatgggttttattattttttccgatcgaattgtcacgtaagcgccacgtcaatgccacgtcagacgaagaccgagtccaattggccacgtagacgccacgtctgccaaaaccacccttaaaaccgctaagggacctaatctgcgccggttttgatagttgagggactcgttgtgtctggttttccgtttgagggatgaaaatcagattcattgacaagttgagggacctcagatggactttattcctttccgcgcagcgagcggtaaatcgttaattaacttgagtgctgggccggcggaagtcaaaatagtttctttaggccgtggtgctgtggtgggttaaatgtggccgagcggacgctttcggcaccgagtacgagtgcacgcctcacgaaacaacggaacggagggactctacgattggtcactcgatttaaaatggagtcggttcacattagatcccttaatttgtcaccgagtcggaaattcattgctaaaccaaatta

SEQ ID NO: 13546 - DNA, 1501 bp, Oryza sativa
gtgtggacatgaggcggcgagctcgagcgccaccatgcccatctgccccacctcgagctcgaggatgggaatgggctcgaggagcagtgggagaagaggaagaggggagaaaggggaggaaagaaaagggttgtagagactaacatacgggtcccagtgtcatacttagagtatagagtttagcaatgagtttagcttgccaaatcaatttcatagctggctatatagatgtttggagtgtttgatttgggtagtctgttgaagatgctctaattactataagaaatgataggtacgtttcacttacgtcacaaaaactgaaatttacgtcatgacttgaaatttgtgatgttcgtatgatgaaaattcatttgtcacctattatgcgtctctaatcaagttttatgacaaaaactttttttggcattaatctagtaacgatccttctatcatcattgagtctatgacacccatttctatcattattgagcctagaaatcgtctgaactcactaaactttgatgagtagatgccacgtcagatagaaaacgtcataaaaattttagcacaccatgatatggagctgacatggcatatttttttgtcaatttattttgtcacaaaatttcttgtggcctgcgaagtcccatacaatgatcaatttatgggtcatgcccagttacaggcccgatttaggtttttaatccaatatttagcttatatgttttatactccaaggccctctttgtttaggcttagatttttttatttaggttttcaatctaatattttggcttatacttcctccgtttcatattataagactttctagcattgcccacattcatatataggttaatgaatctagacatataagtgtgcctagattcattaacatctatatcaatataggcaatgctagaaagtcttataacctaaaacggatgtagtatgttttataagccggtggctttgagccatatctccatctaacataaggaaaaaaagctacatgaagctttttttttttttgcttaataatgtaagaatggcttatatgtctttgaaaaaacaaaaaaaaaaaactagtcgtttgtttaggtggagttttgactcaaactttcttataagcctagaaagccgaaataacaatgcaattgatctagtaactgtttctcggattaattagtgattatcataatgatttattgactaacgtggcttaacgagacttcctgtttcatttgtaaatagtaatatatatctaggtgaaacagatatgtaacgaggggaggtgcctcttactgtcctacctcatcatatcataattagaaagacttagaaagtctaggtctttttactattaattgatctgttttcggtaggtagaattaacaaaagggatgagaattaactatatttcaacagccccggacctttatttaagcaggccagccagaacgaacaccgtgcatctaataaccagattacatcgagtcag

SEQ ID NO: 13547 - DNA, 1501 bp, Oryza sativa
gcacaccacacctcaggtttcacccccactcctcgcaaggcagcgggcagtcccctctcatgcctaggtgaatccggaagccgcataggccgtcgcagggcccatccaaactccatcacacccacccttgcctggatgcgtcagtcagaggaaagctacactacaagcccagccgttgcccacgttggcttgtggtaagtacggggaattctcccagggtttcctgcgaaccggtccttaagtgccatgggcgcgactagcaaaaccatgcacccacagcccaccatttaacatattttaatgaagcaacaccaggacggtggctctaatccaatgtcaacactagaacctgaagtctagacattaatataattttccccattgtgtgctagttgaactaagtatggctaagcaatccctagtccaatatctagtcatgttatatcttaagctaacaaaggaacatggtacaaaatagcatggctataacagtaggtaaacatcccatggtaatattataaaacaatgcagtatttgaaggaaaacaatagagcatttgcaatataggatcaacatgttcaagtgacaagcatgacttgccttgctctgctgctggaggaacctcggcgactatttcaaagtacaccggagcgtcgggagagccggaatctaagcgacatacaaagcaaacaatacaaacaagctataagactactgaaacagagagcaaaaccatttttaatggattctacgcatttttcttgatttactgagacttgaatgggcttaaacggagctcggatgaattagatatgaattttagaagattcactgtgtttttactataaacagaaaaatccttaattgatttattgcgcaataaataaatcccgggagagagagaggcggcgccgaaatgcgggccccacatggcagtgacatgggtggcggtccgcggtggaccgggtctacggaccgggaaaggggcggcgcaccacgtggcgctgacgtggcgccgacgcggcggccacgcggcagccacgcgggcggccgaacggatggccctgatccactcggggtggatcggacggcggagggggtggcactcggccggcgcgcacgtgcggctcaagctggcctgacggccatggcgcacggcggcgcggctcgacgcagcggcggcgttgcggcgacgcggatggcgacagcggtggctaagcggctaggcggcggctaagcggcgtaggagagagggagagagagagagagagaggaagagaggcctcaccgacgacgattgacgacagcgagcgacggagggcgatggcgacggcgggacgagctccggaaccacctagtgaacaagatgagaggggttagagggagagaggaaaatgggagagggcgaggacgccggccgaaggcggcggccatggcggtcctcaccggcgcacgatgtggagtgggttccggcggcggattctgacggggaagaggtgga

SEQ ID NO: 13548 - DNA, 1501 bp, Oryza sativa
ggggtttgttcatgcggccaaaataaaatggttctaataagagaaaaaggaaggaataagttcatctaaggtcccttaacttatcaacgaatccgattttcgtccttcaatcaaagaaaaccagatatcatggatccctcaactatcaaaaccggtgaagatgaggaccctcgacggtttagatggtggttttggctgacgtggcgcctactggctaatttgactcagtcttcatctgacgtggcattaacgtggcgcttacatggcaatttgattcagaaagataataaaaccagtgggacccacgtgtcagtttcacacacaaaattttaaaaatggtgggacccacgtgggccccacctgtcattctcacccctcctttcttgctctcttcccatctcctcctcatttctatcccctttcctctctcatctctctccagcgtcaccaccaccgactccgccgccgctcccgcctcccgccaccgccacatccctcgcgccgctgccgctaccaactccgcctccaccaccaccctcgccacctccgccgccgccgcctgcgcctccaccatcaactcctagctcctctcttgccttcagtggcgtctccgtcatggaagccgtggcgggcggcagcgggaggccgtctccgccgcggccgcctcgacgccgaggagctccgggcggcacgccagcgctgcacggcctgcctatggagatgacgacgggggagatggaggccgccatcgtcgccctccctacgaagaaggaggccccttcctcttcccctcgccagtcgccgctgcagccgcgtgccgccgtcgagccgactcgatccacacgcagaactggagggaggaggacgccgctgcctccgcgcaactgattgcgccgtgtgcctcggcatgttcgtcgccgccgctgccgcgagatcaagaccgattggaccaccgttgagattgtgttgccgttccttctcaaccgccgccgccgcctcggccggcgacacctccacccgcgcgtgcctcggccgcttccgcatgaatgacgcgccgccgcccaacgaagtgcgccgccccccgcatctcctctcctcccgccggccggcgcccgcgcgttctgcggcttgtcgttgatgacgaactcaccgcggccggtgtactcgacgtggtcgagtggccccttgacgtcgatgtaggcgcccacggggagcaagtccaggtactgcgtcatgagcccgccattggggaacttggggtgctcgttcttgaagtacaccttgatgaagaggtcgaagtggccgacctcgtcgaccatgctcgtcggcgtgtacgctcgcatgcacagcttcccttcgatgctggcgcagatcaagatgtgcttgccgacggggaggccgagcacctggtcaaaggacggcagcgcgaagcggaagaggcggacgtcgcgggagagctccttcttgtcgatgagttggcaggggaccttgtcgcccgggc

SEQ ID NO: 13549 - DNA, 1501 bp, Oryza sativa
gaggaattcgagagggggagctcgctgcggaggggagaaatcgaggcgcgcgcttgcctgctcgccgagctcgacggcgcgctgcgcggcctggccgcgctcgcgggcgagcttgcgcttctgggccttcttctcgcgcttgagcttcgcgtgcacctccttgcgcttgtccttgttcttgatctgcgacggcagcaccgggtcgggcctctccttcctcggcttcttctccctccggtggtccctcccctcgtcgtcgtcccccggcggcggcgcgtcggcgggctgcctccgcttcctctccttcgccatcgccgtcgccgtcgccgccgtcgtctcgggggaggttgaggtgtgtgttcgtttgggaggtgagggtttaagcgtctagggcaacgtggcatttgatgatatagtgggccgggtttataggcctggttacctagatgggctttcctttccaagatgtgggcacggtgcccatgggctgtatgttgcttggtttgactatggaatcaatcctacaaaatactccctccattccataatataagccacaactacttttcttatactcccttcgtttcaaaatacttgacaccgttgactttttagtacgtgtttgaccattcgtcttattcaaaaaatttaagtaattatttattcttttcatatcatttgattcattgttaaatatactttcatatacacatatagttttacatatttcacaattttttttggaataagacaaacggtcaaacatgtgctaaaaaatcaacggtgtcaaacattttgaaacggaaggagtattttataatataaggcatgcatgcatgtaagcccttaactatgaccatttctctattaaattattactttttaaaatcctttactctcatgttctctaattctatttgatacatgcattgtatttattaggataataaaactacgagatgataataataattatttttttgtctttgggttagaggtggttatgcctttatattttggaatggagggagtatttgacatttttattagatttcttatttctatgactccatctacatcagataatagtcttcaaaatcgtattatccttttagtgcctttccagggcacgatgaaatttacagagagaaatttgtagaattttggcctgaatgggcaagatgattttgctggagttttcttttacaaccagaactgtataaaatggattgcactaaactcttcttaaaatcgtctaaaatgctttcaaataaaacaaaactaaaaaaagacgcgagatattgttcgattcgacacgacgacactatcccctcccacttccccgactcatcgtcttccacggcctcaccgcgaagccgccggaaaaccaccaccgccaccaccgccaccgctacactcgcgtcgaggtgatcggcgatgttcacctgccggccgctggtgtcccctccgctgccgcggcgcctcgccgtcgcgtcccctc

SEQ ID NO: 13550 - DNA, 1501 bp, Oryza sativa
acgaacaaacagtgaagttcagcatagctcgcacaaatttacaatctctctatgactcgctaagcgaggggaagcgtcgttggagaattaacgcaggaggcagtgacctggaggtcgttggagagctcgacgtcggcgatggtggtgagggaggagaggtactggtcggcgccgagcgcggcctcggggaggacggcgcgctggaggacggggtcgcgggtgagcatgtccgcgagctcccgctggatctgcttcgccaccatccgcacccgccgctccttcgccatgcaccgcaccacgcgcagcgacgacgccgacgagggaggcggccgcgcgggcgccagaggggacgcgacggcgaggcgccgcggcagcggaggggacaccagcggccggcaggtgaacatcgccgatcacctcgacgcgagtgtagcggtggcggtggtggcggtggtggttttccggcggcttcgcggtgaggccgtggaagacgatgagtcggggaagtgggaggggatagtgtcgtcgtgtcgaatcgaacaatatctcgcgtctttttttagttttgttttatttgaaagcattttagacgattttaagaagagtttagtgcaatccattttatacagttctggttgtaaaagaaaactccagcaaaatcatcttgcccattcaggccaaaattctacaaatttctctctgtaaatttcatcgtgccctggaaaggcactaaaaggataatacgattttgaagactattatctgatgtagatggagtcatagaaataagaaatctaataaaaatgtcaaatactccctccattccaaaatataaaggcataaccacctctaacccaaagacaaaaaaataattattattatcatctcgtagttttattatcctaataaatacaatgcatgtatcaaatagaattagagaacatgagagtaaaggattttaaaaagtaataatttaatagagaaatggtcatagttaagggcttacatgcatgcatgccttatattataaaatactccttccgtttcaaaatgtttgacaccgttgattttttagcacatgtttgaccgtttgtcttattccaaaaaaaattgtgaaatatgtaaaactatatgtgtatatgaaagtatatttaacaatgaatcaaatgatatgaaaagaataaataattacttaaattttttgaataagacgaatggtcaaacacgtactaaaaagtcaacggtgtcaagtattttgaaacgaagggagtataagaaaagtagttgtggcttatattatggaatggagggagtattttgtaggattgattccatagtcaaaccaagcaacatacagcccatgggcaccgtgcccacatcttggaaaggaaagcccatctaggtaaccaggcctataaacccggcccactatatcatcaaatgccacgttgccctagacgcttaaaccctcacctcccaaacgaacacacacctcaacctc

SEQ ID NO: 13551 - DNA, 790 bp, Oryza sativa
ttaacatatactcatttataaatcctgcatcaaaacgcgagggatcacctggtattctagagtttcagaccatttggaacgcctctggttcgtccttatgcaccacccaatgtctgcattgggagcctcctcatttcagttctttgaaaaactgaagctgaaacatatactcaagaagcaagcaagcacacactgtaatgtcatcagctccaaaatgagacacaaaggaatttaaatggaaacacgagaatacataatattacaatttagattgaacccacgtcgcctctctgaaagtatgagatgctccagaacacaaaacgttaatccaatgatagaagaggagaggatgaacatgaggaaaacaccaatccattcatcaacactgatatatatatggcagagagagagagagagagagagagagagagagatatgttttggtccaatgagacagtaggcaaatttacatcagcaaaatggaaatcaatccctaattgcaacccctgcaagatcatcgatcggcgccaccacgtacggaaggccgctgctaattacatccacatttggagctaagctttcaccgggtgtacgtgatgatcacttgcaaacagtcagcaaaatactttacttattcgcctttaatccccaatccctgcactcttggcatctgatctatgtatgtttacattagtgagattgtgagaagaacaagatgatcagggacgatgagccggcgactacacaaagaacaaatcaagattcacatcaagaaaggaggaggaagaaa

SEQ ID NO: 13552 - DNA, 1059 bp, Oryza sativa
aaaaagatacaaccaattattatagaggttgtatgatgaacgactgtaaattttacaatcacaatttattagaaaacaagaaatttactaagaataccacctttaaagtatagactatttttatctatggttggcgagaatatgcataaccattttttttctctaacggcttacaagttctatatagttcttgtcttaaaccgaaaacagaatctccaaaatcaacaattaattatagtttcgattgaatttcacacacatcactataggcgggtaacgtcaaaccgaaaagaataacaccatagagcaacagagctgtaaatcaatgattcgctcaaatcttgctaacgttgtagccatcaaaacgacgctaaggacgcccctgaactctggaatctgaactcgagcggttttctcatggctctcagtgccggtgtgggatcgtggttgtgtgtgtgattgcagaaaaaaaaaatcctatccattatccatacgtttttctccacatcactcgccggccggtcagtgttcgcagtttgctttgctcagaactaatcggaggagaataaacatgtacgcaaccgatgcgagcttatgtgcaaccagagctaaccacagctaccttccaaaacgcgcccgatccaactcttgtcctcgcgcgaaaccgatcaaaatcccggacgccaccgccggctctcgcgtacgtacgtggcgaccataactcgccgttgcagccatctcactgcagtgtaccctgcaacatgccaattaacctccaagataagcatccatcgatccaccgctggatcaaccgcagcgcgcgagagatcgatcaacgtacgtaacgccatgcaccgtagccaccaagttccatgcatgcaccgatgcacgagtgatcgagcgagtgatctgatcgagtaataagttgcaggtttctggacgccatcgctcggtataaatacggcgttttctgcaggcgaagcagccaaggcatgcatgcacattcgctctagccttcctcatcgttgacagtgcgtggcagtgtactcttggttatca

SEQ ID NO: 13553 - DNA, 1501 bp, Oryza sativa
ttaatctcgtattgggttcttatatagacccatctttcaatattccttatttttaattccgaatttcagctattttaaaattgtatttctacctggactcttcttttccttttctccgattaatgtgggaatttctagcccccacagcgaacgtggtgtctcctttcaaagctgttttactaatataatagatagatctgagctacaatagttaaactacagcagttcagtatcactagttattgtgtattcgtgtttctccctgacaaagctgctaccttgatggatcaggatcatcatcctcttggagcatatctagttctgtaatcatgatctaattaagttcagtaactcatctaccctaaggtgagtttgaggaggaggaaattgagaaaattgggaagatacgtaacgaggtgagccattagcgtatgattaattgagtattaactattttaaatttgaaaaatagattaatatgaattttcaaagcaactttcctatagaaaatttttacaaaaaatacaccgtttagtagtttaagaagcgtgcgcgcgaaaatcgaaacaaactcactcactttcttcagctgccgaacgcagcctaagtgtttgagaggagagaaaaaaagaagattgagaagatacacaaaacgagatagatgagctattagcacataattaattgagtattaactattttaaattttaaaaataaattaatatgttttttagatcaacttttttatagatttttttaacaaatataccatttaatagtttgggaaatgtgtgcgtgaaaaaaggcagtgcattccctcccaatcccccaccaacgaacggttttctttcgctaataacccccgtcccgtgcaacgtttgctcgctttctcaggtctttctcttccccgtatccccacttcgcgaccaaaggcttccgcgcggagccgacgcggcggcgatgctcggccgcgtggcggtcgcggatgctgccgcgggcgggcgggcggacgcggacctctcgcgtgggcttctcgtgcggcgccctggacatcacaccccgccgtacggccgccgctcccaccgcggtggcgtgcgcgcgggccttgggtgcggcacactgctccgcggcgccgcgcggccgcgtccgtactctctagcctgcgggtaagcaacgaactcctcctgattcgatttgagttttgcgaatcctccagtttccttaacaagtcaagatggacacaatgaggtcggggaacgcaaatgtggtcgaacgatgtcgtaagcttgcggtaattgtagactatgcacatcttagttgacaactcgtatcgtaaattaaatagcctatccacggtcacgatggtttagaattctctttaggctgcacccaaaatttctatagtcaaacacacggggttgaataaaccacattgattagttcaaaaaaaaaaaaccacattgtccgttgaaatgttgcacgcgagtgtttaaactcatcc

SEQ ID NO: 13554 - DNA, 1501 bp, Oryza sativa
attgcagatccacccccatgcccatcttctgctggtagtatttgtcaactaagaaggatatggatctactcacaagatcaccaagaactgcagacaggagcacctccattctgaagctcccacagtggaagagggacggtttcttgctgggggtactaaattaattcagggatcaggacacagctgatctctggctggatgagtttaaacactcgcgtgcaacatttcaacggacaatgtggttttttttttttgaactaatcaatgtggtttattcaaccccgtgtgtttgactatagaaattttgggtgcagcctaaagagaattctaaaccatcgtgaccgtggataggctatttaatttacgatacgagttgtcaactaagatgtgcatagtctacaattaccgcaagcttacgacatcgttcgaccacatttgcgttccccgacctcattgtgtccatcttgacttgttaaggaaactggaggattcgcaaaactcaaatcgaatcaggaggagttcgttgcttacccgcaggctagagagtacggacgcggccgcgcggcgccgcggagcagtgtgccgcacccaaggcccgcgcgcacgccaccgcggtgggagcggcggccgtacggcggggtgtgatgtccagggcgccgcacgagaagcccacgcgagaggtccgcgtccgcccgcccgcccgcggcagcatccgcgaccgccacgcggccgagcatcgccgccgcgtcggctccgcgcggaagcctttggtcgcgaagtggggatacggggaagagaaagacctgagaaagcgagcaaacgttgcacgggacgggggttattagcgaaagaaaaccgttcgttggtgggggattgggagggaatgcactgccttttttcacgcacacatttcccaaactattaaatggtatatttgttaaaaaaatctataaaaaagttgatctaaaaaacatattaatttatttttaaaatttaaaatagttaatactcaattaattatgtgctaatagctcatctatctcgttttgtgtatcttctcaatcttctttttttctctcctctcaaacacttaggctgcgttcggcagctgaagaaagtgagtgagtttgtttcgattttcgcgcgcacgcttcttaaactactaaacggtgtattttttgtaaaaattttctataggaaagttgctttgaaaattcatattaatctatttttcaaatttaaaatagttaatactcaattaatcatacgctaatggctcacctcgttacgtatcttcccaattttctcaatttcctcctcctcaaactcaccttagggtagatgagttactgaacttaattagatcatgattacagaactagatatgctccaagaggatgatgatcctgatccatcaaggtagcagctttgtcagggagaaacacgaatacacaataactagtgatactgaactgctgtagtttaactattgtagctcaga

SEQ ID NO: 13555 - DNA, 742 bp, Oryza sativa
aaaaggaaaaaaaaatccatgcatgcatacttgtgagttgtgatgattaatacgggagctaattagatccatttctaatgtaccaaatcctgaatcaaatgtacaagtacgaacacctacaaaaaatacagtcacattattaccgtggaaatactcagtagtataaggtactccgtacaaaatactactctacatcaatagtacacgtacagagtatagaagcaaagagtacatccccacatttacacatcgccaccacttcgcttgcagccacacgtacgtacgtacacacaacacacacgtcatcacatcccgtgccgctacccgtgggccccaccacccctgagtcactgacagcgccggggcccaccgcgacgctccacgtcgtcgtcgcgcgcgggcgacacgagggccccccacaccgcgtctctgagtcactgacaggtgtgggccccacgggcgaaacccagagtgaccgacaaactcgaaccgtcgtcgggtgcaccaccggaatctcgccgccaattaatcactgtacttagagcatgcccaacagcttcctttttcaattccctatcctgtgatttagggaattttgatcaagaaacagatccaacagattctctaactaatatcccaatatctctggttcctcagtccgcatatatcgttcctcacaaacagggaagcgattttgttcccaatatttcctcgtcggtctctctcgcgcgcaaagcagtct

SEQ ID NO: 13556 - DNA, 1501 bp, Oryza sativa
acacatattttttatttctaatgccacctaagtgccacgtcaatgccacgtggaaaggagaccgagtcaacactgccacgtaggcgccacgtcagcgaaaccgccctccaaaaccgccgagggagtcaaattacaccggttttgagagttggggggtccatatatccggttttgtggtttagggtcatggattagatttcgatcacttttgagggtcacaaagtgaacttattccggttcagaaatataaactagattggagctatttttgagggagtcaaagtgaacttattccatctagtaatgtgtctacctctagtcaaggtttaaaaccaatggatccaaacttcttgggacagataaaaaacataaaccgctagattttttttttgtcaagttaaacaaaatcaaactgaattttaattttttgacaaaatttgtccgaattttgtcgtttttgtcagtttatcaatggttttcgctaattctcgtttttgtcagtttatcaatggttttcgctaattctgaagatatcgctcgcgagcagtttttgatcctgtatcgggattgtgatccatgcctctacttggctccttgcaatatggttctcttgtatcaaggcgttttaaacaaagtcatatggttcatccaatggtctggcctaatttagatgatgtggcttcacaagagaacaggaaaatggtattaaccacctaagtgaggattaattgtacaagtatataggaataatatgttattccatgcaaagaaaacaaagtcatttgtttgtcaacataagatgcagtctgtagtaatgacacagtggtttctcatgtgtcatgttacaatgttattcacctaggaagccttgtccaagtcagaatgaacatgaaccattgtgggaacacaaataatagagtaaaatatagggtaagctggatcagatcacaatcccatattattagacacaagttaaaaagatagatacagattaagaaaaaaaaggctggatatgaactggtttctttaaaccagaattcaaagaaaacctaacagaatcatagagtatacatgcaggagcacatctatgagtactataaggcctggcagggaggagaggctgcaaaaacgcttgaaactaacctaactagaacttcacatcagaagagctaaatgtgcagataaactagctagctggctgatttaattacctaatggcacaccgtagacctttctttttttaaataaaaacagaaagaaaatgaaccccttaggcatctgtttttataattagattataatactatacgccagtccacatttttctacacaatgataacgtgtcactgcatttctgaataatttaccacaaccttcacatctacaacactcccaactctgtaaaccatctggagaaaccaaaaactgaaattcatggtagtagacagaaacatatggatcattttaagcatgagcatattcagggggggttctggtctca

SEQ ID NO: 13557 - DNA, 1501 bp, Oryza sativa
tgtcacgctctgcggcgcagtaccagtgcggtgcatgcatggcacggcacgcgacgaccaacgctacgctgcgcagcggctcgatcgccgagcgagcgagaccgtgattggaatcaccacccaaccgcgtgccgctgcccgctgcggctgctgccccccctactactcctagcccttgatgtccgaagaggatttggattggattggaccggtcgtcgccccaggggtggggggcccacgcctcgcactctcgctgacctggcctaaccgaatcgctgtgccgacgtcacccgtgctgctgctctgctctgctggggtgtgagggtagatgggtcatttcgccgcggtgggacccgtgggacgtgggaccacctgggcccctcttgctaccaggtttgcgcccacgagacttttctgttgttttctttctcgcgtactctgtcccatgaaaaccattcattgttagaggttatttgggagctagtgactaaataacatcggatattttgacactaatttaaagtattaaatatagattaactataaaacccattccataatcttggactaattcgtgagacgaatctattgagcctaattaatccatgatttgataatatagtgctacagtaaacatttgctaattatggattaattatgcttaaaaattcgtctcgtggattagttctcatttatgaaattagtttttttattagtctatatttaatactccaaattagtttctgcacatccgatatgacatgtactaaaaagttttagccccatctaaacacctccttagtattaaacgtggatatatcctaatagtacaaatatagatgttttttaattaaatttatagtactagcatattcaatatctaatactagatttttttttcttatgaagggtgtacggggttacggtcaatctttcacatatttcacgaggggttacaatgttgggaatttgactctcagattataataagaaagcagctacaatgctaggccatgttttcgttggttattgttgacggtcgttaacgatcagtttcgcccgtcaataataccaaaatagaggagaactagttatggttgcaatgcatatccatgttagaataataatattccactagtatttggatcactaaccttttgcagagaataaccataaaatggagaggaatcggcatcaaaccagacgataaatcaatcggacgatgtcgaggatcagacttatgtatgaatgagccaagaactcagaaatgacatgaccaattaggctaaaattcacaagcctgcagagaggagaagtctaggaggacgctagccgaaaatgggctggattggactagtccatggtttggccgaaccagggggttcggccgaacccccatctgctccgttggacatagggtttggcgtggacgtctaggattgctccccaatgacggttagagggcatttccgaccattccaactgccatgatcgtcattgg

SEQ ID NO: 13558 - DNA, 1501 bp, Oryza sativa; identical to SEQ ID NO: 12828

SEQ ID NO: 13559 - DNA, 1501 bp, Oryza sativa
caccactcgatctcgctctcttggcaaaatggcaaccgaaatcgaccaacctggcttcccccttaatttgatcccaaaaatatagggaaaggtcattaccacgaatattatatatgatccatccatctcgttagttcgctggttgccgtcaatgcgagcgtacgtacgtctcatgcacgcgctgtagatagagaacgacgtacctctcctctcagcagtgtacgtacagcaccggagtcgctttcatcgataaccattttcacatgactcgatctgtacaaaataaaaaaaaagtcgggaattaccgtaactattttgctgatcacggtttatcctttcgggggggggggggggggggggtgagacggacgatgattacaaagctgggatatatattcgctgtacctcatctgactatcacatcgcagctgcaaaagaagaggcactatatatcgtgggtgtgacaagggaaggtgtagccgagaagtcaattcgaccgatcgagccatgtctcgagtggttggccggctcatggggtctcgattaagattttcaggatctgaattatctgtagttggaaaactaaacgacaatatagtctactccctccatcccaatatattttacagcctacccattctatgactacgaatctgggagtagctagctagctctgttcttttttcttcgtaggttgactcttcgccgtggtcgccattggtcagcatgtcagcataacatcccgtagtaccacttggcacaccgatacgtcatcctattgtagaggtatgtttttttttaaaatttgttcaatttcatataggctgcaggtaggtgactaatacgataaagtaaaagaataacagtcgcctgatgaataaaaaatgtttatcattaatcaaaagctataattttttaaagaaatttattctatttttctatatctatactatgtaaaatgttagtagtggtggtgtccattcccacaccacccctacaactgacatgtgagccccacaatctatattattacatagtcttttaaagagttatctctcatttcactattgattttcctcaaattttaaaatcatttggttgttcaataaggaaaataatattattacttggactaaataagctaattgattttttttttacgaaaaaccagcaggagaggctcctactgaaatgcattgccaatagaagatatttacaatcccaaaaagtttctgagagggagaagaagaaaaaaagaaaatagaacttaaaagaacaattaattgatttagcctagttaattgatttaccttattgattgatttagtaaggtagaaactcaatttgttttccgttgcaacgcacgggctttagcctagtatgatttaaatttcattgtgacatatcagaatttgatcttgtctaaatagctcgagatgcagagaagcagctggtgattagccaccaggtagaacattgggtttctcatattatggcttgt

SEQ ID NO: 13560 - DNA, 1501 bp, Oryza sativa
gcggcgccgtcgtgggctgcaccttcgaccaccgcgtctgcgacgcctactccttcaacatgttcctcgtcgcctgggccgccgccgcccgcgatggtcacggcggcggcaccgcgccgcctccgccgacgatcccgtccttccgccggtccatcgtcgcgccgcgcgacccgccgccgccgcgctcaccgtccaccgacgcgctgatcgaccgcctgttcgcccctctcggctccgcgcctccgccaccggacgacgccgcggcggccgccgtcaaccgcatctaccgcgtcgccgccgccgacgccgcctccctgcaggactcggcggggcccgggcgcacgaagctggaggcgttcacggcccacctgtggcagctcaacgccagggcggcggcggcggagcgtgagcggccgtgctgcatgggcgtcgtcgtcgacgggcgcggccggatgttcccggacggcgccatgagggcctacttcggcaacgtgctgaccataccgtacggcgtgatgggctccggcgagctgcgcgccgcggcgctcgccgacgtggccggcgacgtgcaccggtgggtggcggaggcggccaccggcgaccacttccgcgggctcgtcgactgggtggaggcgcggcgccccaagccggcggcggcgagggcgtacctgggcggcaccggcggcggcgacgcggcggcgtgcatcgtgtcgtccgggatggggttccccgtcggcgaggccgacttcgggacgggcgcgccggcgttcgcgtcgtaccacttcccgtggcccgccggcgccgggtacgtgatgccgatgcccagcgcgcgcggcgacggcgactgggtggtgtacgtgcacgtgtcgccggagttggcggtggcgatggatgaggagcccaccgtgttcaggtcgctggacaacagctacgtgttcggttgacaaggccatgcacgacaaaataattaatgtctaattataacgtgtctatctttttttttctttcgaataagagaatgtgtatcaactatcgactatcgtcgtatgggagtagtagtgtgttaagggtggagtaccgtgtgatatcgccagatacatcaatcttggcatgaaacagtgtgtgtgaaaaaaaataaaataacagtccatgcaatgtcactgtaataactagaaagtgtcatgtaattaacgaaatctattcgaaatctattaatctttgtacgttgcacgtaaagaagtgcagaaacgcgcaatgttgatggaacgttagttggcaactactctacgacgggatggatgtgtcaagatgacaaaaaccaaaatggaaatgctaggaatttcagtcactttcaagttccacaaggaggcgggcaggaattcgaagagataggaaggaaggagatagcgaggactcaaccgcgacgacgacgacggcgagctagccttggccgccagtggcgctggcacccaaatcccagatggcttttcttcgagttagg

SEQ ID NO: 13561 - DNA, 469 bp, Oryza sativa
atagggcgaattcgagctcggtacccatatgtaatataaagtagttaatacactagtaagagacatgagaaaaaactacgttcaccatatacaatatgcctcaaatcaaaatataaagattacaacttagtgtagtaccggagtcatggatgcatgaccctattcaacaggatacaaatttttaatatccacgaatataagttcggtgttacgtgtgcagtggtgtagtggtgcgcaatatccgcatatgcgtttgctgggtgcccgcgaaaaaaaacagagtacttgttaccctgacacgtacaaagcctgtaaacaaacgtgccacgtcatatcgtgcggcgcggaggaataaatacaggaggtgcaagcggcacgctggggcagaaggcaggcaaaaggcacactcattcgcgggccgcacgtgcagcggcggcgcggcgcgggtggatcgccgacggcggagcaa

SEQ ID NO: 13562 - DNA, 1501 bp, Oryza sativa
ttattacatcccatagttaatgatgcatgcatcgatctatccattttttagctcatggacatacttacgatatccaaagcttaatttaatcagtaaaaagctagaagctgtccttttttgctgttatgtggttgctgatgctatgcattctttgatgtagcctggccagaacatggaagaacataggcagatgatgcagggagtttcagatgcaagtatcgcagggaaataaccagtccattcatttcagtggtactccattttccaatgtcggagcatcttcacctggtcaaccttttccagttcagtcatcccaaccacatcagatgccacaacaatcacacgtgcttggaaatacacatcacccccatattcaaggaacaacccagtcaagcccacagcagcaggcttatgctatgcgcttggctaaagatagacacatgcaacaatgcatgatgacccaacaacagcacccactttctggagccagtgcagtgtcgactgtacagaatggttcacaaatgcaacagcagagccaagggccagcttccagtgctatcccatcttcgcagtcacaacataaacagcagcatccggcacaaaattcactagatagctcagtgcctcccaaccagcctgttaatacatcgcataagcagaagaagcaacagggtcagcagcagtctagacaaaaccagcagcaaagaaatcaaggtagccagcaagctaagcttatgaagagcttaggccgagggaatatgatgcaccagagttcaccagttgatgccactcaagcaagcggtatttctacaacctctaaaaaccaagtttctgataaaagtatggtgcaacagggcccggggtattttgctggtaataagggcttggttccatcagtggttcaacctggtaatcaacccaagatatatgggtctcagatgcctcattcaccaatacaaacatcagatgtaggtagtcaaagctcaatgcagggttctcctaaccagactatgttaacttctcaacaagctccacttcattcgtcatctccattggcacagcagcagcaacaacggtacatgaatccatcacataacaacatccagagattggtgatgcaacaaaaccgtcatatgaacactgatggtaggatagaatcacctgttgaccaagttcaacataatcaggcaattccctccacatccattgcaaagagtacagattcaggtagcccaggtggtgtttcatctataaaccagcggagacaagagtcatctcatgatccaactacagttccatcaacctcgcagttagctagctcgcctcaagatacctttgttggaaatgaaatgctgttgtcagtgtctagccaaggcatgttgcaaaggcaaatgtcaggtggcgtgcctatacatgggcatggtattggtgggcagaggcagcagctgcaatctcggcagcaacagcagcagaagcctgctgttcaaggcagtgtgtatgc

SEQ ID NO: 13563 - DNA, 218 bp, Oryza sativa
cgggactaaagatcaaaacacactatataatccatagtaccgatcctcttttcccgtccacacaacaaactcctccctctatctctttttttcctctctaacttcttatctctttccttatctctaactcccctcctctccttccttttttccttcaccacagtcaggcggccggcgcggaggcggcgacgcaggggccggcgcggaggcggcctgca

SEQ ID NO: 13564 - DNA, 1501 bp, Oryza sativa
tccaccacactcaaaatagaacaacttctaacctttaaaatttgtttcaaaatacaacttctccacttatatacattctcttatcaatcaatcataacattttaccattaaaattctctaaatatctctctcttcaacaaatcataattttcaccaatttaatttcatcaacttttttaatagtcttgtttaaccctaaaactacttagaagtatattttaagatggaggtagcagtagtagataccagtgtggcttgcaaggacagaattgggtaaagtgcatgctaggggaccagggcccatggagggcctgcctgacaaggcgatctgcatcggcaaaagcctagctagagtccagagagagagtggaggcccacttggagatggtgacgtcaccaggcatgcacacgaggttcaggtgtcaccggacaaggggacccacctgcaggtgacgagaatcattgatcatcacgctagctagctccccgctgctgctggtccgaggcttcacccaaactacgtcactctagctctagctagatcgatcatcgatcagctcaaggaaagagatgaaagaaggggggtaatgtagcagtggttgatccgtggatcagtctgcattcaggttactgattgggcagcagcagagagagagaagcagcagtacaagaacggtgtgacgcacgtacccgatgcatgcatccagctgacaagatccaacgaggcgtgtatcgtgcatcagcatgcacagtggttagcctggtggtagtactttcttcgtttcaaaataaacaaatttaatatgaaatataacatatgctagcattgtatgttcgtagctttagaatccatcacatctcttactaggttagttcctctccaagaagaaaatccactataaaatggtactacattcgtcccaaaacaagtgcagttgtggatatccgtgtccaacgtttgaccgtccgtcttatttgaaaaatttatgaaaaaattaaaaaaattagtcacacataaagtactattcatgttttatcagtttctaataagagtcaaacgttgaacgcgaatagtgtaaaactgcacttattttaggacggatggagtagagtactactagatcggatcaacatagttagttcacacaataatatattactatatttgttttcagaagtaatatctctatctttaagtgtaacttgtttagattcgtaatagtagaatgtatataatacaatcttatgtttgacggaggaagcagtaaacaaagaagccacaagaggtaagcttatacgtaccgtagtgactgaggtggacaattaatcaccgtttccagcggcattatgcattgcaaagctgtgacgatcattcgcgcgctgtgcaaagtgtgtaccccagcagcatgcgagaaacttgatggcgttttgctccgaggtccacatgtacagtagagatcggggacctcatccatcaccttcacatcacccctgtgtgtgg

SEQ ID NO: 13565 - DNA, 918 bp, Oryza sativa
gctaagcaaagcaagaaccctctctacctctgtctctgtttggtggtgcaactgcaaaggataaagaggaagaaagagaggcgtgtgggtatttaagggcacaactgcagattagtataataaggtgagccttgagattttttttttgactaaactaatcaatgctgattagtggataacaactggcttagctttgctcagctaagctactagctagctagcacaaggaaatggtcaaatgagagagccacatcaattggagaagatgatgatgggatgcatgcacgcatgcctgtggacttgtggataggaaaatggattttttgtaagcagaacaaagatgctgtttacacttcagggggacacacaaggtgcattagttttttgtgatgaaacagctattggaatttaaggtgtcacacaggaacaaatcagggggcaattgggttttgtggtgactgctggtttctgattggaattaggtttaaaataggacagcttctgctgattctggtctgggtgttaggggagggagaccaatcctatataatcatataaagaatatcaatggctttgtgcttgaaggaagggaaagccacaaaaaaaaagggaaaaaatgatgcacagatgtggtttgaagacaagggacatcttacctgacctcaaaagggtatattgtaatggagtttgttgtgttttccctcttctttttctgtgtttgttagtgaagcttgcaattgaggcctcaactaaccctataattaagacaaaaaagataaaaggctaaatccgaagtctggtgaaccatcgttctcaggtatcccaatagaaagaattgggtcgactttaagcatcatccaagtcgtgagaatgacaccctactaggtcagagtagcagacaaagggtagatatatatt

SEQ ID NO: 13566 - DNA, 1501 bp, Oryza sativa
aaaataatatcccctaattcccaccaaacagcaggtgctaaaaaaatttgagctgcaggagaaaatgcggcgaaatccccgtcctacccccaccaacccattcggaggtggagttaaccctccctatgtacacacacccacacaggggtaggtcagtaaaatgccagcagctaaagcaattgggcgctgcggctgctgctgcggatttaccgtttcaccctggggcaaatgacaactatgccctcgatgggtaaagcgtaaataccgcgagcgagaagggcaaaacggggagacggacggggaaggggaagaaggggggggtctctagtagtagaccaggccgccgccgtcttcgtcgtcgtcgtcgccgtcgccggcggcggcggcggagaggcggaggaggagctggtggaagtcggcgacggggcaggggatgcggagcgcgcccgggtggccgtagccgtactcctgggcggcccgccggagcagcgccgcgaacgccggctggccgaggaggtccgtccgcacggcgtagcgctccacgggcccgccctcctcgccgacgcacaccggcacgtgcccctccgggacgcgcgcgccgcaccccagccgcctcgcgccggcgagggaggaggaggaggacgcggacagcttcgccgtccggtcagcccggagcggctggtacgcggcggcggcgcaggcgtcggccgcggcgacgcgggagaggcgcctgaggagacgcttcatgatggctgcttcacgtcgaggcttggcaatggcggcgccggcggcggaagcggaggcggcggaggtggtgggttcttggagaggcggaggagggtacagttgagaggacgcaaggtgtttgtactggggtggtggtggccatggctccttcttatataacggaagatatgggagttatgagttgccaaagtctttttgtgattttttttttggctattcctttcctcctctcctctctctctctctctctctccgggcctttacaaattcttttgtccagaatgggttgtaggattattaattttgtgcacctgctttggggacaacttcagattacccaatgatgacatattctgttcaccgttcgtgggaaatatgtataaccgctagttacgcacacgtgaagattattgtatataattaaatcgctaacgactaataaatatattttattggattagtatctcttgaaatcaaccgttgactttattcttcaccattgctctaatatccctacatcaagcaattaagcaattaaatatacctaatggttttttcagcaagaattttgtttcaataaaaacctaatcaattattttttttaggtggtagaggatttattggtttggctttgtaaaaatgcacataaaccttgcccataacattgatagcatattcaagctatcaagacacatccaatcttcaggtcaaattgacatatccaatcttcttccatttattttcttaagtaatg

SEQ ID NO: 13567 - DNA, 1501 bp, Oryza sativa; identical to SEQ ID NO: 12344

SEQ ID NO: 13568 - DNA, 1501 bp, Oryza sativa
gtagtagggcatattgtggaagccattcatctcgttttcttgccttcctctgcaacctataccacctccaattccagcaccgcccaacatattctgaaaccttgacccctcaatcatcttcaaacaaccaacactaacagtagggttgctttacgaaacagtagaatcgctgaaaaacatccatttctcagttttcttcagtgctcccacggtatctagaatcaaaacaaaaaactgattagcgcctaaatacgcatatagtaaagtataccatcaaaattatgctaaaacaggggcggatctaataaactgaacccccaaactatttggggaacaaccaaactactattcgtatcaagtttcaaggcaaattaagagaaaagcttcctccgaggtctagaagagaaacaacaagggttcaacgcaaaatttggggaacaagcaaactactattcgtgtcaagttttcaaggcaaattaagagaaaagcttcctccgaggtctagaagaggaacaaccaaagggttcaacgcaaaattggagggaaaaaaaaagtgagtgggtacacagcgatgaggaagaggatgaatggatgctcaccgggatgcggcggaagcagcaggacgaacggcggcggcgcgcctcgcgggatcggcggcgcaggcggcggggcgagctcacgaggagtcggagtcggagtcggaggcgacgacgaggggaaggggaaatatcgtcgtctcgtcgaggcaccgcacaacgatctcctttttgttttccctttttttttcacaactacgctaggaaggatgctgattatgaaacattggtactactatcttttacggggaatgcaattaaaacgtagaagctcatggcacctgcaaactcactcccacaatataagttattttaacgtgtgtacgcttcgtacacacgtacatccatgtctacgagtaccttcggaagattgagctgatatatcttgagattaatgaatcattaaaatttcataattttaatataaatttgttcttctctatactgggggtaaatatctcagtattctttcgctattttattttgttttgttctcatttttctctattttcgacgatgatattgtttaaccttacgtgttaaacacggttagcaaactcgagtgtccacaatatgtactacatatttgtatttagtaaaacataataatttattctagatgcctaacttggtatttgttcaaatacatcacggatacgtatactaacacaacaacattcatatgagaatttgtattaaaattccgcttggaatcgacttaatctgagaatttgtattgtttttgaacttttaaatatctaattttaaagtagactattttttaatatgaacttttagtcataccaccctatctaacgtaactgaaaaataaccaatgctaatgttatcctaccaaactcttaaatagaagacgatccaagtatttttttactattgtagaaaat

SEQ ID NO: 13569 - DNA, 1501 bp, Oryza sativa
tgaagtcatcacgaatgtctcgctgttaatatgtatgttgtctatcactgaaataataattagcataaatacgagcacctatttcaagtgaatagaccttttatttgaaatagttttgaattccacgaaatccgaatttcttcggaattttgtcatccacccagaaactacctgtgtgcgaagtgaaccaatgtctccttccaaagttccaagcctttctccgtccgtccattgtcacttgcatcatcgtcgtactaccaagcaggcgacatttgtcacctatctctttcctacccccacgtggtcctcgcgcccattatccgggcccacacgtcagcctctcccgtccactgtcaccgacgtgtgggccccactcctctccactgttatcctctcttctccagtgagccgtgcccgtctgctcctcctccaatctctcccatgccgtctcagctcagctgcctttagctactagctggactaaagctagctcgcgcacttggggatgttttagatccataatgtaaaattttaccgtgtcacatcgaatattatagaatgtttggtgttcggttactaataaaaattattaattatagaatccgtcagttaaccacgaggtgaatttattaaaactaattaatccatcattagaaaatgttcactctagcaccacattattaaattatggagtaattaggtttaaaagattcgtctcataaattagatgcaatatatatatatataattagttatgttttagcctatatttaatattttatattagtgttcaaacgttcgatgtgacatgtgtaaaattttgacgctggatgtaaacaagcccttatctttccaactcactctcgcgttcgcgtcgtctccggccttttcttgctctcctcgtcttcttcctcccccatcttccggctgatgaatgcagatgtcatctcatctcatctcatctctatccaattccaacacggacacctataagaggttggtaactcgtagctgggcattgtcacttcttgttcttggcagcgagcgccatttccagaggatttcttgggttctataggtgaggttggaggcgcagcttcgtcgtcgtctgatggcgccatggcgtgcggcggcgatggcgtcgtcccagctcgcgcgccgcgcggcgaggaggctgctttcgtctcagcatcgccgtcactgcgccgcgcccgcctgtccctggctcctgggctcggcgccgccggttcttgcgccgtctccggtggctgcggcggcggcgggagatcgtcggggattctgctccgtccggcgtttcaccggggagagcaacgccgccgccgccgtcgaggaggcggagaacgggttggtggccggtggtgatcaggtatgtagacagcacacgtgccttactgtccttcacccattcttagtatgccactgctcgtacgaatgttcagaataatcttgtgtctgaaactctgaatcatatacaattatt

SEQ ID NO: 13570 - DNA, 1501 bp, Oryza sativa
ttagttgtacggctttagcttaatcttcaatcgtgacaatttatagtttggcaagcaatagcaaccataacatccagcataatgcaaaagttttaaaaagttcgaaattttagtgatttttattattagggattttcaggatattacatccgatgatttaaataatgggtccaccaattctagtgtacgtgtagatttgttaatatagattttaacttgctaatttaatgggtacacaatataatggtgtagactttatttcgaaacagtgcattatttgagaataatagtataatgtaataaaaaatagatccgatgatttaaataataggtcatcggtttaagtacacgtataaattagttaatgtagatcttgaattgtttatttgataggtacacaatataattgtgtaaactttattttaaaatagtgcactacttgaaaataatattatgagtacactattttaagtggaaattatcttatattataaatttaatgggtaacatataatggtataaattttattttcaaaaaaaaatatagagctaattagttacctgagttatatgatggtagatttttttttaattatgattatttaaaaaatatatccattatataaatgaaaaaaaaagaagaagggaaggaagcgtacgtacccatgtacgtacatatacctacctatgcgcgcgagaagggggagagctgggacgtatagtatttggtttgttttaagattaatttcatctaacggggtataataatggacccatcaatttaagtgaaaatcaaaggatatatattttgcttttttctttgaatttttaggattttatcgccacgtgacggcttgagagtatttgtaggaattttattggacttttagtatataatagataatagatatttatgcatatttcttaattgttctggtatcaagcccatgaaagaagcatgctactttgtcgttgattcattggaccttacaaattaaacaatttgttcttgtccctgtataagctgatatataataggtctttgtactatgcaagtactagttgctgggctagctttgcatcttcaaagttgtacagtggaggttggaatatacctttaccttcttatgattccttcgtgtagatcgagatggctgtcatcatcggagccaaacgatcgatcgagtgcccagctagcttgcataacaccacttgtatgtatagtactctcaattaattacaaaccacaccatcaaattcttgctcaatttgtcaaatacttcaggacaaatcagctgctgatcaattaatttggacgactctaactaaatgacaaattaatggtcgtcttgtccacaattcgatcagtactgagctaggaataagaactgtgcttcatgtaaaatcaaaggtgtttttattattattctgtgatgaacaattggcattggagattattaattttgttatttgaaatttattcacgaagtggtttcggaga

SEQ ID NO: 13571 - DNA, 940 bp, Oryza sativa
tttttctcctacagaaatgactttagttgaagtcataattgaggtatgcaaggaagaaaaggattagaaactgtagcgaatgcacgaaacttgacatcaggaaatgcagatatatgtggtttgtgtctttgtgatactgctgtgttagtgtggtattaacaccatgacactcaaacgatgatatgtgttatgcaaacaacaagtacacttggctttgcaaaataatcatatcctgccatgatgagctagatttaccttttcatttttgtggatcatccaagcacaattgattgagcaattagattgtttaacatactaggatgtacttctaccctccaaacttgtgaacttgtgtataccaagtgtttagtacctgaacagcctctttttgtgcttcaattcatcaagttctgatcattcgaaagcatctgcatcattattctatcatgagggcccatcgttaaatggcagatggtattatggtcttggacacattaatggcaaagaagtagaaaggtttttggagataaacagtcttaagaaacatttgacgccttaaagggaaggttgtacaaatagcatgaattaccacctttcaatcagcagctgaagataaaatctaaatcttcctagttcctacatactttagacattctttagattttggcattttgtttcttgattgcttgggtaattttaaggaaccatttagtgagtttgtatcaatttgcttcatgttcttttttctgaatcatcggttgatttatttatctttgtatattccttgagctggaaatgttctaacacttgctgatgaaggtgctcaaagaaagaattgaacgtgtcaaagctaagaagaatggggcttttacatctaagagcgaattcactgaagagatgttagagatacgcaaagcttttgtcatcatccatggggaga

SEQ ID NO: 13572 - DNA, 1166 bp, Oryza sativa
ttggagaaaagaccaggacccagctgtggatgctcaccaggacgacgtcacctccctcttccctggcttctcccctgcactatgctcgatgagagatttgataatttaacactccttaaaatgggttttgattatttgaaatcctgtcccactttcattcactcagatgatcccacatgtcattctcacaagtgtcaactaaaacaattggacaatgaaaaaagtgttaaattatcaaattttcctgctcgatcggcacaggcgagacaatacgggaagaatttttttttttacgcagagaggatgggggagattctcgacgcacaaagaatatatttttatcgtctccgtcccaaaaataattactactatatttgagagggtaatatgcaagttccctctgtctcccaaaataagttattatgagatatggcatattccctctatcttataaaaaaaaactcatccttatatttccattgaaagtttagtactaatgtgaattacctaaatgcccttcacccgaagggcagtttcccaacgaggcaacgatcgagacgatgctagaagcaaacagaatctcatccccaagcggccggaagacgcagcctaccagagagagaaggtgcgtctaccagagagagaaggggagggggaattaccgccggtgttcgccgccgattcaaaccccagcttccacgcccaacgatcgagagcaaacaagcagaatcctacccaccccaagcggccggaagacgcagtctacaagagggagaaggggaggggggcattaccgccggtgttcaccgccgattcgccggagcgccgtgaggggtggcgcgtctcctcctccgctcagctccgcgcctcggcctcgctggttcgccgtgagacacgggaaagaggaaataaaaaaagctaccgtgccaagaagtcggactcggactcggtctagcaaaggccataagaagttgggccggcccaatatgactaggcccatacaatctcaggctttcccttctccaatccatctctctcgcgaggccaagttgaggtagagctcagctcgacgcaacgcagacgcaggcggcggcttcggcctacctcgatctctctcccatggcgcactagaccaaaaccctaaccctaggtccgcctcctccgtc

SEQ ID NO: 13573 - DNA, 1501 bp, Oryza sativa
cgcattcagttgcgttgatccgatggcgcagtagcaaaaccgagtctcctctcctccctccctccctcccttccctttgccatcaaacgcaagccgggagaagcaccaccacctagatagaacaataaaaattgctgcatccgtcagagctggccactacaaaaaccagctgcatcacaggagagagcaggcagagaggcagctctccagctcgcgtttggggttgaccagttactccggcgaaccgacggcaagccggcgccggcggcgagggtcgtcgggagcggaagagagggagaaagaatggccaccaccgcctccgtccgacctcccctgctccgacaaggtggatccctgcatctcatcgtgccctcttgtgctattgggtttatagtactttcttggattctttagattgggttgatttgattgatggcccaacatagatatcgtcttggaggagatgggagcaacgggtgtgttgtgttttgctgctgttcttggattggattggattggtttatgtttcttgttactcctgtagagcaacccaagaactcaacccattactttatttattttacacttgtgtttctgtgcacttggatctcaaggaatttattatgttatcagttgttagttgtgatcctgttctgtctgctatccggcccaaacccatcaacagtagtatgacctcctagcataaaattaaattaaattaatcagtagcattctctccttagagaaaaacaaagtgggataaagtaaactaaccagtagaataccccagttgggcacttctgattgattttcattccttctaaatgtgcaatagttgattacagatgaacataatagatgatgatgatgttggtacagattatgtaagttcagtattttctctcccttctaaccgtcctgcagaattgggaatcttaaaccaaattgcagtactgtgggggcaaggcaaaacataaatgtttcagttaggagtagacatcatcttggtagtacatgtccaaattaaatattaatcagtgtaccacactcctagcactcagtttctatgcaacaatttcaacactttgagatatcagatatgtggctgaaaaatgcttatctagatcttatggaaattaatagtagtatatctttttttttcgggcctgttcactttgatgccaaaaaaaccttatcaaattttggcattgctaaaattttagtatagttgtcaaaattttggcaggattttttatatagttattaaaatttggcagcaaattaaatgtagccacttttttagcaaccttactaaaagtaaggttgaaaatggcatcaaagtgaacaggccttcaatctaatttctgaattctggagctgcaaatctgcacacacactaacctgatgaacactactacctgtattgcagcagcaggttcagaaaaagcctcactcctttgcaaaccaaagcagagagcttctgtcagaagaagaagcttca

SEQ ID NO: 13574 - DNA, 1501 bp, Oryza sativa
tcagctagtgctcgacagagcattaatccaaaaagaaacttgcactgcatttggcatcacgggagactatggcgcagggtaaatgaaaactaaatatcattcatatcgttgagtacaagaacaaggcagataaattcaagcatgtatttgctcggctcttatagaacgggcagggaaaaatacaggcaacacacaacaatgttacttcgacatcatcatttattgtaaatccatgagcaactagagaggtcaaaataaggactgcagcagttcatttttactcctttcaaatccaatagaaagataacctgcacaaaagataaaagcgattcaagtcatgatctataactatacaacataaatatagttgtaccttttcccattccatttttcttcaacagatgataaatcaaatgctagttatatggtgcttcagaggtagcaaaagatatcaagcaaataattatcaatacatatagtagcacaagcatgatggacaaggcaggatttgtgatgtggagtaaatagcgaacttaactgcgccatgtctgtgaacgatcacactcgggcactagaaatatgatatattaaaatcaaacaaaagagattccagagtcatcacaaaatgaccatattataatcagcatttttccctcttggaatgggaatatcacatgatcacatcagattaagaggctggagattatgtttgcacaaaatatttccacatgtattcttctattcgatcttacgaggcaagcaaagataaggtcaagagattgagagggatcttcaataaagagcgatagcagaatatcatgacatatggagaatcccatgctagaggatgcttttaagattttttttgaatgtatgtggagtgtttctaagccattcaattgtccttagaaataaatttaaacaaactaaatagctgacagcactaatggtaaatatagagttattccaaaggaaaaaagattggtgcccccttcacacgtatccacttttccctttacccattgttccttacgttatatgccctgagagcaggaatggtcttttttatggcatatgctgaatttgttcattagaaggtatccctacaactacatacaatggaaacggtaggcagtctcaagactccgaaccttcctaaacgaaaacgcttcctatattcacacaaaatccccaatcaaatcgaacaacaggttatgccccacgcaaaacatagaacagggtattgcagctctaattaattactcaagtgtgtgtgctgaattgcaaacatcctctaaatgctaggataagtattgttagaatgatgatggttaagtttaacaacaaatcattcattttaagctgcataattgacacaaaatagataagtattgtagaatgatggaagttaatattaacaacaaatcattcattttaagctgcataattgacacataatagataaaattggagtgcttcatcagacaagaaatagcctcac

SEQ ID NO: 13575 - DNA, 1120 bp, Oryza sativa
gagcaaatgtatatacccaagtgatatctgtgtgtgtgtgtgtatatatatatcctatttataactccttcgttgtgaataattgacaatttaaccagaccattaattaattgtttcaaaatatatacttatcgtgaacatgctttcattaataaaaattgcaattttgccccatacttatattttggttcagccctttcctgcacctccactttatttagttcattaattgaattgcctaacaattgacaagggcaaattgatcctaaattttgagctaaattgttgcattgttccacatgacatgttacgtacggtcaaaatgtctattactattgaagaaggatgggagtaacatgttttaatactccaattaatatgttatgagaccgtgttagatatatccattaaaatgtataactatatagtatatgtctttgtatttttaaccaaaaagaaaaaaacataaaactgttaaagtttatgcgtccacggagaggatgaattatttcattagcaagaaacaagaaaaaaacaaggaaagaaatacattacatacaattggctagatgcagtgattacaagcagcagcagcagcaagtgcatttggctggatggagacttggagaaaggtggtactccagtgtggagtagaaagaaaccagcagcggaggccaacaaaaccgagggcatgggacggccgcgtgtactacgggacggccgcttcacgtgctcccccagccgactgcctcacgccgtcaatctcgccgtcacctgcttcttctcctctataaaactcactcaccccggcggcgagctcaagctcaagctcagcctcagcgatcgacaagtaagtagatccaaatccatccatggaagccaccggcacacgggtgacgcgctccgcctccctcttcccacgcctccggcgctcccccacagccttgtgcgtctccccgcgcagcatgcatcatcatcatcagcagcagcagcagagcctccgccgcgccacctccgacgccgacatcgccagatccgcgcccgcgacggcatcatcgccgctgcccctcctcctccgcgacatcctggaggaggacgtggtcgtggtggtggacggcgc

SEQ ID NO: 13576 - DNA, 1356 bp, Oryza sativa
tggtccggttgcttggatctttttttctcaacttgtactagtgtaccatactaccttcgtcgcacttaatttaaatgcgacatgtacgtatgtatcgttcgcttaattcgtgcaagttatgtacgtacctgtatgggaactgtatggaaacttgtgacctcggctgagacttattattggcacaattattaagctagtcattctcatcataataacttagtacttttttcgctgacgagtaatttcatttaacgttgcgagtttatggatatactgatttactccctccatcctagaatataaaaagttttaaagttggacacagttattaagaaagtaggtagaagtgagtggtggagggttgtgataggatgagtagtggagataggtgggaaaagtgaatggtggagggttgtgattagttggcgagagaattgttggtgaagaagttgttatattttaggacaaatcttaagggaaagttgttatattttgggatggagggagtactttatatgatgacatatgcttgaatccctaaattgaaattaattcgatgttagtggtttttttaagtaacgttcggttgcgtttacaatatataaaacattaacggaatgctttctcatattaaatgttttgggagagaaaataatcatggtttcttgcattgaatattttcgtagataaaagtcgtttgcctttctttgaatcgacaaaaatcatttgccttgatcatattaaagagagatgctgtgagggtgctccggccggtcatggttgcagtttttcttgtcatgtaaaaatgtcttccgttgtatgtgttgggtactccctccatttctcaatagaaggcgtaactgcattttgtcaaaatgtccaaatacacgacggcaactacttggctctcgcgtgttttatgtgcatgtagaataacagctattgattcttttgtttggctagtttaaaagcatcggctatggatccctctcgttttcttttgaatgaccaacaccagatggtatgatgattcattgaatatagcatgagaaaactataaagctagtaacctagaagacagtaaccatgaaagaaaaaaatcagtatcaccacgcaccacgcgccaacagtgcttatacaacacccaggagaagattagcaccggaccgaccactgctagaccaacaaagaagctactgccgaaccacccaaaaccaaaacctaatagcgagcatagcactcgactctatccacgaccatgggactgtattaacccctatcttagctacactacctctctcacctctctctcacagtgttgaagtgtgttggatccaagcgtgggctgcatgggca

SEQ ID NO: 13577 - DNA, 1285 bp, Oryza sativa
gagattgagaggaagagggagagagagagagagattgagaggaaagtgggcaatagagagagagagattgagaggaaagtggggaagagagagagagagattgagaggaaagtggggaagagagagaggtgggagagtatgacaggtgggtcccgccattttttaattaaaaaaacgctgactgggatgccacgtgtatgccacgtagaccaaaaccaccgtggattgggtcgagatggggtaattcgtccagtttacatagttgggggtgaagaatatccgattttgtggttcatgggataattcggacgacgttatagttcaggggtaattcgtactttttcttttcagatattgtgggatggaagaagtatgaatttgttatagtagctcgtggaccacaagttgcagtaggacatacgaaaatgttggtccagccgagcaggagactcattcgagaggaaatcgacattggcctagtacaccataaacgggctattttggctgttgctcgaagaggcacacacatgctctgaccgatgttaaaatgaccccaacagatagttttgtagagcccaatagctagttttattgcggaataagttcacctgccatcccttaactttacatcgagtttgtttgacatcccttatcctcaataacagaaatcttcgtccctaaactatacaaaaccgtgcattttaagtcccatagcagtatagatgcccggtttcgctaatgtggcaccctacaattttctcttttcttttattcttttcttcggctgccgacgacagagggtgagaggcgacggcgaatccctcgccttcctccgtcgccgcttcgacaccaagtggctccttagccggcgtcgactggctgcttcctcgcccgcgatgataaccccgttgccatcaccttctgccgcgcccggctccgcaaggatccctaccgccggccggagagcggaggggagacgcggccgactgctgttgctgctgacgtcccatcgtcgcccaactccagcagcgcccgagggcgggggcagctggatccgcccgccggccggagagcggaggggagacgcggccgactgctattgctgctgacgtcccatcgccgcccaactccagcagcgcccgagggcgggggcagctggatccgcccgccggcttctacctctctcacctctgcctcttcctggctgagccgtccccactgttttcctccctctgggtgtccgcctcctcctcgctgctactccatctccccctgctcggaggga

SEQ ID NO: 13578 - DNA, 775 bp, Oryza sativa
acgcgttccacttcgtcggcatggcgggctccgaccaggccgtcgagctgctggagcgcaacgtcgaattcatcaagaaatgaagatcgccggcggcggagtcagatttggagcgtgtttagtctaatctaaataagatggggaaatttttctttttccttttcttttgccatattgttgtggtggcttctaccattatttgccacgaagtaatttgtaatacctgtggaatttatactaatttgattcgaaatatgatcgtttggcgttatagacatttttgtccctacaaatgcagaaatgctgtctcgtattccatgacggcacaaagagggtaagggtgttatttggaataaaccatgacattaataacctctagtgaataatttgttacagtgagcaggatgagaaatgatcaaatgcacctccacagagtggcaagcaatcatattccctccaaatcaattggaagggaatcatttgcaaataattgaccctaaacttcagctataatttgtgcaaggttgtgattgattaattgatgggtaaattacactttgcactaggtagagtgtatcttgttttgctttgtaacaagtgtagtacatccattttacatcaagatttcactttgcactatgttgcatcctattgtttgttgatataccatgatgttaaatggaacttattttaatacaacccagtgtaaagtgaaaattatttgctaaatatgtgcgttgtgctggtgcaaaatgcaacttattcttatatgata

SEQ ID NO: 13579 - DNA, 1501 bp, Oryza sativa
tttgcggtgcgagagattgctacgtactggttcgagaaccagcgagcaagtagaattatctctcgaacaccaatggaagtttgcggtgcgagagattgctacgtactggttcgagaacctgcgagcgagtaggattatctctcgaacaccaatggaagtttgcggtgtgagagattgttacgtactggttcaagaaccagcgagcgagtagaattatctctcgaacaccaatggagacgctagagttggtttattacatgtgcatctcatgtggccagcatgactcacatacccaacttatagcatatccggatatctgttcgcaatcatgtcgggcaatcaagccgacgacattcgcgaggaattatccgttaacaaccttttctcgactattccagccatggccggtgctatgagataggtcgttggtcttcgttggcaggttgggtgcgataactccgcatttgtcgagaatgttctcgataatggagtgtactcgatgacaacctactcatgtgctcaattgttcctgaaaaatattttctagaaggcaagacatatagcagagaatatcgagtatgtactcgaataactgtatggatcttctagcattatcaggatataacgagcagattaaatatcaagcattatataaaccgtgaacaagcatgatttatacagaagaaaataaagcgagcccccagtattagaccgcggtggtctaatattgaagacgctcgtataacagagattgtataaaaaacatgctctaggtaaacataataaattatagatctgacaatattatattatctgaaaaataagtacagtacattgcatataaaatattgcgtacctgtgtagatatctacgaaattagtagattaattcaaaaaactaatccactaattacccttttctttttacagtctgagcatcaagatcaacaagtagacaagaagccacgtgcatgtaactccttcacgtgccctggtcacgtatacgagtgtatatcctggtttttaccaacaagtgccgtgtacagacatctgttggctaccagtccgactcggtgactcatggacaggatctggacgcacacgcacagtgatatgcatgataatcgatcgatgtcgacttctgtcttccgcgtgctgatgtcctcctgatctctggcagctacatgcaagatggcgggtggctggcgcgccgtcctcctgctgtatatgtctgcatctctcgaaaaccaacgtagggccgaccagtcagggcgtcgcgaggagcactttcccttgtagtcgacgagaagatggttcggagatctcgtcgagtaatatgttgtcggagaatccatctcttgaacccatctcgtccaaatcctgaagcaccaaaacccccctacctggcgcgccactgtcgacgtttgatgtcgcgattccggtatttgcatagtatggggattgttggtactaggatatatgcgagactgaggtaaaataga

SEQ ID NO: 13580 - DNA, 1501 bp, Oryza sativa
ttatcatgtggaaagtatattatttattaataaagttataggtagaaagattattattctactttggcccatttaagtacaatagaagttttattaaatattttttcgctggacttattttttttattgtttaaaattcactcatacttttttgaaaaaaaatctatgttgaaagtttgcatatgcaaagtttatatataacaagacataaaactactatgcataaagctagtatatgtaaagtttatacagataaagttacatgtatgaaatagaattgtttatgttggattttagtctaaatgagaaaggaaaaggctgggatatgctagtgggcccatgaaaattttgcatatacgtggactatgttgtgggctggagtagagttttgtgagcaggttcagatacgcacggaagaaataggtagcgtccacgcgtttgctcgacacgagcagtcgcgtactagactcaccccaatctgggccaggagcctcataactcggatatatatgatggggctgttcactctaacgaaaaaaaaccttactaaattttagcaggattttttatatagttaccaaaatttgacaacaaactaaatgtagctaatttttttttttataactttaccaaaacttggtaaagttgaaaatgacatcaaagtaaacgggcccgatgtctctagctggcctacatgactcggcgggctattaggattaggctaacaacgtgctatgcggcgacctatcacgccaaagtcccaagcacgagcgtggcctatgtacggcctgaaatcgggctgtgcctgaccaccgccttggaccaggctaggaaagcatggcccaattcctagcatccggcaaacagccaaacaggaaactttgggcttcttcctcctagtcagcaaccattattctagatgctttgacatggtcacatggggaaattttttatatttatctgtatctctgtctttatgctaatggccactaactgaaatcaaaacctaaagctcaaacctcacgcttctatatcatcattagttgtaagacgatggatcagtgcattatatcacttctgagctgataaggaataagttcacttgtggtcccttaacttgtcaacgaatccgattttcgtccttcaaccggaaaaccagatacaatgggtccctcaactatcaaaccggtgcaaagcaggtccctcagcggttttgatggtggttttggctaatgtggcgcctacgtggccggtttgacttggtcctcgtcctacgtggcgctgacgtggcactggaaggaaaatataaaactaaaaaataaaaacaaaatgtggggcccacatgtcagtcagacaaaaagaaaaaagtgaacccaccgttagtgggtcccaccatcctctctatccacggacgattggacgacgggagactgggagagggagcgaccgacgcctcttctctctccctcccgcatccttcctcgccggccggcgagcgcgc

SEQ ID NO: 13581 - DNA, 1501 bp, Oryza sativa
ccggcgaggaaggatgcgggagggagagagaagaggcgtcggtcgctccctctcccagtctcccgtcgtccaatcgtccgtggatagagaggatggtgggacccactaacggtgggttcacttttttctttttgtctgactgacatgtgggccccacattttgtttttattttttagttttatattttccttccagtgccacgtcagcgccacgtaggacgaggaccaagtcaaaccggccacgtaggcgccacattagccaaaaccaccatcaaaaccgctgagggacctgctttgcaccggtttgatagttgagggacccattgtatctggttttccggttgaaggacgaaaatcggattcgttgacaagttaagggaccacaagtgaacttattccttatcagctcagaagtgatataatgcactgatccatcgtcttacaactaatgatgatatagaagcgtgaggtttgagctttaggttttgatttcagttagtggccattagcataaagacagagatacagataaatataaaaaatttccccatgtgaccatgtcaaagcatctagaataatggttgctgactaggaggaagaagcccaaagtttcctgtttggctgtttgccggatgctaggaattgggccatgctttcctagcctggtccaaggcggtggtcaggcacagcccgatttcaggccgtacataggccacgctcgtgcttgggactttggcgtgataggtcgccgcatagcacgttgttagcctaatcctaatagcccgccgagtcatgtaggccagctagagacatcgggcccgtttactttgatgtcattttcaactttaccaagttttggtaaagttataaaaaaaaaaattagctacatttagtttgttgtcaaattttggtaactatataaaaaatcctgctaaaatttagtaaggttttttttcgttagagtgaacagccccatcatatatatccgagttatgaggctcctggcccagattggggtgagtctagtacgcgactgctcgtgtcgagcaaacgcgtggacgctacctatttcttccgtgcgtatctgaacctgctcacaaaactctactccagcccacaacatagtccacgtatatgcaaaattttcatgggcccactagcatatcccagccttttcctttctcatttagactaaaatccaacataaacaattctatttcatacatgtaactttatctgtataaactttacatatactagctttatgcatagtagttttatgtcttgttatatataaactttgcatatgcaaactttcaacatagattttttttcaaaaaagtatgagtgaattttaaacaataaaaaaaataagtccagcgaaaaaatatttaataaaacttctattgtacttaaatgggccaaagtagaataataatctttctacctataactttattaataaataatatactttccacatgataagtttatataagat

SEQ ID NO: 13582 - DNA, 970 bp, Oryza sativa
tcgcgcgtccaccgcccgccctcgcacgcccgccgccgtgtgcgccgaccggccgcacggccgctcctgacgacgagccaccgcccaccgctctcctaacgacacgagagggagaggggtaggaggggaagaggaaaacgaggtgagagaatgacaagcaggccccaccgtgtttaaaaaaagaaatgctgactgggttgccacgtgtgcgccacgtaggacaaaactgctccggattgggtcgaggggggtaattcgtccggtattaaaagtttagggtgagtgatgtctgattttttggttcagagggaacttcggccgacgacgatagtttaggggggtaattcatattttttcctttgcgaaatagtggaacttgaagatgaaggcttgatataatgtcaagattgatatttgacgataacaagggtgggcatgtcatgtcccttccagtcccagatgcttgtggggaaaatatcttgttcattttgcatcttgctgattgcatccatccatatgttaattggtgttaatgaattgaaccggttgcttcttggtcgggattggattagctgcagcctgcaggcctgcatgtgtatgcaacgatgtatgtatgtggttgcttccattacttgacgctatatatgtaagggtgttgcggtctgaataagggtaagagatggtgatgtgagagatgcaaattgaagtgattggatgacattggatttggcggtggaacggaacggatgattcctcttcgatctgttgtttgattcaacgtagctgctggctaactatacgtgtttggttaataaactgctgctgcgcttcatgtacgttcagtgaagtgaataggcagctaaccttcattaagaaaacagcagaaagttaaaaaggttggattctgacattgaagcatatatatgttacatggtactagtcctgaacacggctggggttgagcagacca

SEQ ID NO: 13583 - DNA, 1501 bp, Oryza sativa
acaaaaagaatgaagagaaatcccaccaaatttgacaacatttcttccagaatctcatggctctgcatggtccagtgagggcaaagaaaggaagaattttgcgtaggagttgagcctggccaaattgcttccttagtgactgtcgatggaatgatagtttcggttgatttggagagggatgtgtaccaaataaccaaaccgaagtacgaagcttcgttttgccgagatacattgttctgatcctattataatctaatctaatactacttggaccagccggaacttctaatctaattaagcactgccattgccagtcgaaccaacctacggtttggtctgaagcctaataaagctcgttccttttttaaactctcctgtctgaaagggacagttcgcttattgctcaagcgatactgttgtgttgcatactcgcatgaattagttgacgggtcaggtatacatgtaatcatctaaaaactcgaaataaaatttactggcattatcttagagcaacacgatattgcggagattctggcgttagttgcaacctaacaacgaaatgattggccagtgtttaggcgtgatctattgttcatatccaaaggagcaatgtttgcaatacatatgtacatgtctatgctcgattaagaatctacttcttcccaagttggcgaaggcgaaatgaacgtctgaacttgaaaaattcaaacgcgcatgtacagagaagacgtgcaaagttcagcaccgaccgacaacgaacccacttaactcgtaattaacatcgccaattggattgactgggatttctggcaagttgaccttggcggaacagtcgccgacaattagatcggaacgatcaccgatgctgctggttttgaaatgtcaaactcaaagacgcccggatgtagcagtaaatgctaatttcaaacttcagagtttcggagcatagcaaaattcggactttagaacgccattacgtcgaagtaaaaaaaaacacggagaataaatcaaactttgctaggaacaagtcaataataggtcatccagtcatcgttacagcccaagtatgagagcattgagtatggatcggcagcgcaataacacaaccagggcccaaaccgttttgaaggagagccatttcacagtgatgaccgaacgctacgaacctgaggcctgcaggccacgagtcaagttcacaggaacttctttcttcaatgaataaaagcccacgacaataactcaacaatagccaaaggaataagttcatatgaggtcccttaattttacaccaaatccaattttcgtccttgaaccccaaaaccagataaaaccggtccccgaattgtcaaaacaggtgcaaaagaggtccctcggcggttttagctgacgtggcgtctacgtggctagtttgactaggtctccatctcacgtggcattgacgtggcaattatatctcggaaaaataataataaatgtgggcccacatgtcagccacacaaaa

SEQ ID NO: 13584 - DNA, 1501 bp, Oryza sativa
ctttgcctttcttctgtgggtaactgggtactggatggtaatgaaagtaggcatccaaaggctccaagcagtacaattgagtttgggagagtatgagtcttgagaaacaatctagaagaagaaaaaaacttgtttctagcttctagtttattttctagagttcgtaaatataagggctcgtttggattaaaggataggaaaaccataggatctgaaaagtataggaatagagaaggaatttaagcgtaaaacagaataatgaaaaacaaaggagtacaaaagttgagggcatgcggatcacagtaagttgactgtctaggacttgcatgtaggaagcaaaaaaagagcttgtgatggatgattttttcctggacttttcctgtgaaaccagcaccaaaggaaagggaattttttttggatagtattcctccaaaaataattaatcgtatgaagcgggtgatcgctgaccccctcccctatacgtccctcttctcccccctcctctccttctcttccctactacagaacaccacaaaattgtttttaaaaaacaaaagttagaaaaatttatgtaaataaatattatatataaaaaatttgaattcaaattcaaatttaaatcgggtatgtaaacttttgacttataaactttggatctgtaaacttaggtgtataaactttagatatatagaaatactatatatagaaaatatttgaattcaaattcaaatttaaatcagatataattcaaattcaaatttgaaacgggtatataaacttttgacttataaacttttatgtatagaaatactatatataaaaaaatatttgaattcaaattcaaatttgaatcggatatataaactttgacttataaacttttagtctctaaactttagatgtgtaaactcgagatgtataaatttattaaaataggaaagtaatgcggtgctaaaaaagaaaaccaggtggagaggagggcccgaatatgatcgccttgggcgagctcgctcagtagcatttccgggtcccatctatatggactaattttgttatatatattgttgttgccctaataaaatggttagaaaaaaacacgttcaattctcccaaaaggcccggcccttcgagaacgttggcccaacccaacgaagcggtcaagacgcaacacacgtcaggcctcgagaccaatttgcacagaacccgaagcactcctccctacgaacgacgacgaccgagtcgaacggtccaaccccaacccatccaccgagacaggaatgctctcacgcaagagaaaaaaccacgggcgagcggtaggatacgtggacccggtcttggtgctccccgtgtagaccaggcggccacccgctcccgtggcgcaccaaacaccgggtccaggcgagcggggcgcgcgtaaaccctagcgtaggcgcgtagctggcatctccgtcctcctccctcccacgggtggtgggctgataaaagcaacgccttcccccgt

SEQ ID NO: 13585 - DNA, 1501 bp, Oryza sativa
caacatggcctagctaagctagcctatctttcctttccggattattctctcccaaatgtgatattgatctagctttagtttcttcttttcttttaagcaattgttccctaatcatatttaattatctcaaaggagtatgcctatctattcctgcctccaatgcgacgctgtttccttacccacatttgtggttttagtgctgtgtaagtaattaaacctagctagtaatggaagtaagtaaaacaactttattttcttgaaaggtacccatgtgtgcgatatttgtggggaattcggattttagaaccatgatgaataatcatatgcacccaacttctcaactgtacctcgatctgtcggtctatttaggagagttttagattcagataagcagcttgagagaatagaaaaaccatgtgaaaaaaaaacacacaactgaaaaaaaaaacatttttgcaggcgtctgcttcttattattttcctgaattttaaaactatataacttctccaaacctaaataaaaaaactaaactatttgagtagcttttgattgtcggaagcctctcctaaaatagccatgtgtttcccgccttcccaagtaagtaaaacaactttgggctatagtagtggatgggaacagaagagtggactaattttgtaataatattttgtgggaaataaaatatatgctggtgcgggtatatcttagattctgttggctttgcaattgtcgcctgttgtttgcagatgcgcgctccgcttagaaaatagcagcagaattcctcccaagaatatgacaaatccgatcatccgatgcgtcatggaactcgtggcgtcatcacatcagcaaatccaagtacggtgaactactacgcttcaatcaatttcccttttcttccaatgggcctcacaacgcaccgcggcccaatagctcttagcccattgccatccgccatctcggcccggaaccgcatgggccggcccacgccacgccgtccccatcacatcacaccggcccgcttctctctcgcgcgcgcgggtgaagcgtcgcgcggcgcgccgtggcgtggcgtggcgacaggtgaagcggccggcgaggcgaggcgaggcgaggcgaggcggcgtcatctgcgccgcgtccacacacatgtacgtcgcgctacgcgcccgcggcgccttatcttgacaccagaatccacatgattcctgagccccagctataggctatagctagctgctgttgctgcttggtcccggataacgtgacaaatgcgacatggttcatgcttgctcgattgattgattgcaatagacaaaaactcttcttgtctcttcacctcgccaccggggccgccatacaattacctccataaatcttggatagaatgttaggagtaactaactctgcactgtgccattgctgtgtgtcagtgtgtgtatatatatccagctgccagctgcagagtgaagcataaacatcagtagacgacggcgatggcgc

SEQ ID NO: 13586 - DNA, 1501 bp, Oryza sativa
caaattttggtttataaaatttattgaatctactgattttctaccggatttcgtgaaaaccatcatttcatttaagcccggaacggtaggccatctcctattcgtaaacccaatacgagtgtccctccggagtccctgaaatgaacatcgaaaacttccaaaacgagcacggcatgcccttgacttgaccgagtgagcccgtagcgttcgttcgttcgttcgtcgtcatcttccacccctcgcagtcgccaacacagattttagtccacaaaattccagcgcaaggtttttgatttgatcggcaaaccacacgtacggtggccattaacgctgccctaaaacacactctccattggccaccgcgtaggagtacactgtacaccacgacgggccggtggggtgggcgagagcgagacccctcccgaccggtagcccccaccatcgactcgacaccacataagcagcggttgcacggcccatctcccccctccggcgtcgctctccctgtcacacggggcccgatctacgtgtggtacactgctactggtagtactactactagtctactccacccccggttaggctagcaggacagcagcagcagggggattgttacgcagattccccgggattgcactacggtcgtcacgtctccgggggtgtcaaatccccggcgccgttgcatcatcatcaccaggccagggctaggctacgccgctagtagtagtacagtactccctcgtttctaaaataaacacaaatataaattttcgtattcaattttaattgtttgttttattttaagtttttatgattagtattttattattattagattataaaatataaataatattttatacgtgctttatgtttttttattttttaaaaaaaaattaaataaaatgaacgattaaaattggacacagagaaatttatagctacgtttattttattttgaaaacggagggagtacgcaaaatacggtaggagtacgcagtagtattgggaaaggggatcatgagagataccttgaggtctaatccctccgtccaaaaaaaggcaaaccctagattttcgtggcaatatttgactgtccgtcttatataaaaattttttataattagtatttttatttttattagatgataaaatatgattaatactttatgcgtgacttatctttttaattttttttgtatttttttaaataagacggacggtcaaggacacgaaaatcaggtttgggagtactacggcggtgtaggcgtcggaggtgacgtggccgctgttgccatttaacgtcgcatccacccgtcacccgagagagagaggcacgtttggagagtttaaaattctgaaaaataacacgttgtagctatttccgataatctagaaatactaggttttctgacttctggctttaaatttattactacttgaattttataattacagttttttttaatctgaatcaaaagctaaactatctaggagaact

SEQ ID NO: 13587 - DNA, 1501 bp, Oryza sativa
ggggctgggccgacttgggccggtctgggccgaaggaagagagaaaattcggcccaaatgaataggaaggctttctaatttgtgtagggaattgagggatggagttaaaatccaaattaatatttggaagaaatttaagtggctaacctttgagatgaatttattttggagataatttccaaagagatatttcctaattatttgagtgcaatattttagaggtagcatataatggaatttatttgatgcactcaaatgaaagggtaagggatatatgaataaaattgaatgtgtaaataggaaggtgggaagaagataattggagaaggataagtagggttttagcctcaaaatatatggcatgtgtttcaaagaattgtttgaggctaataggaaatttggatgacaatgatataatctattttcttagcacaagagcaattattcataatatttgcaataataatatttcttgtgccgagaagaaaatcaagccacaagaattaaattggtggctagattaaaagaaaggatttgaatatttggatcgagaatcaaaggatgggtcgacaattaattccaattaaagttggaattgcacagtgtaggtttggagggttttcttggaccataattcatacaaatgaaaaggggtttccaaactaaatttgaataaaaggaattttgtcaaaataaggttttaaattaaaaccaagtcgagaaacaccttaatttaaccaaatatatttttaaaggaaagacataaaagaaattaaataccagagagggattttatgcaagttaatttttggaggtctctctctaattatattttcctaggtttagaaggttaataagaacataaaaaccggcatgatgcataattagaaaatagctaattttcagtatgttacactcgtccacgcgcaccctgctccgtgcccctccgtacgaccctagtctccagagctcccgcctctctccgcttttgtgggcgccgcaccgcgttggcgttggtctcggactccatcatcggattcccatagaagggaaaggcgatgttcgcctccacctccgctgctagctaggaggcgtcctcccgcaagtccgccgccacagcgtcgccgcgacagcattcacgccgctccccccaccccgctctgtcaggagccgcgtcgcgaagaacagaggaagaagagcagcagcagccgtaggggattgaggatgacatgtggggtccacgtgggccccaccattttttattatttggtgtatgaaacggacatgtgggtcccacatatattattatttttccaaatcgaattgccacgtaagcaccacgtcaatgccacgtcagatgaagacctagtcaaattagccacgtaggcgccacgtcagccaaaaccgctatctaaaccgctaaggaacctagtctgcaccggttttaatagttgagggacccgttgtatctggttttccggttgaaggacgaaaatcggat

SEQ ID NO: 13588 - DNA, 1501 bp, Oryza sativa
tggattttcatattcaattcctaactaatggtccctctatctttgcacgaaaatcgagtctctgttggatgattaatccgatgggggaccaatcaaacaggtgctgcaaatataggacagatcagcgtcaatcgttctccaaagtccaaaaagaagatatagcccattatttgatccgccgcccgcgtccaaacgaaaattctaccagatcgtctgacaaagcaccacaggaccagttagtaatatgtaaattttagatatgaatttggaaatttataaattaatttatcttctctgtatagtgtatgtataaattaatctttcctcttctatatatagtgcgagtatgaaaggacatgttcaaaggatgatgccttatctctcttctccagatcaactgtatatattaattccaacttgacaaaggtataaatagtattttcttttgaaagaaaatgttatatcgttagagcgcagtcaggaaaacgaacatgagaagggggcaaaaatatgtaaatatatacatggttatacatgtatcttaaagcaaaatttctagttccactaactgtaaacacatactccctccattccaaattgatctacatatagtttttttgaggttattcctaaatgatctatatatttgtgtttattcattaagtctattcgttatttgcgcattggagtaaatggacattgatgcatgcatccatgcacataagtatttataacccacatgcaatatcttgatttgctattggctaggaaataatggggatggtgcatgcatcgagtttgttgctggagtaaatgtagtatgagagagttattagtttttttttgtcttggtgtagctatgaaatatgtagatcaatttagaatggagggagtagaatattgcacctttatcactctcaacttttcctttttacccctatctatttggaagctagttagatccatgttgtccaagctaaactttgttgaaaaaagctgtgaaattctcggaaacaattacctttcactgtttgcacaatgaaaagcgctttagcactttatgtactactgcaaacctacctactgccagcacagcagtacacccctttcagcatgcaaattaagccagagtgtgcatggttaaccgttctctcactttgcttaattatttgtagctcttgatgagtagaagccgatgagtggtgggccatgtctagcttggtctaccgtacgtaggaacaaatatactcctctgacatgcaatgcaattagtagtagtactcacaaatattacaagtacgtagttgatgtgatattattcggacccacagttattacaggatcaatcaaccaaggatcatatggatgttgtactggccagaaattgaaccaaatttcacgtgtggacatgtgccaaacagtagttaaccccttcactataattgctgacatgtaactttcagggcggacgacctaccgatcaagacgcatgacagagtca

SEQ ID NO: 13589 - DNA, 1501 bp, Oryza sativa
gagagcccataatagagctacaagaattacaactgcaataaccgacaggagaaggcatgagcaggaagcgcttttcctcatgcgtgttgttacagatttcaactttttctgcgcacgctgtacatacaaacacgaaacgacatgttagctagcttatcttagaaagatgagataaatatatgcgggcatctgtagaatcaaacaacaggcacggtggatcacctgaagctggttgcttgtctcttctgttttctcgtctaagtcatcctgcaacgtttgtaaaaggcattagtataggaaccaagttaattcagaaacgatgcttacaaataggagctactgagatacttacaatcaacctagtgtgcagatccaactcttcgttgatcgccagcgcaatgtgcttggtgctgactatcgtctcctccagcttgtccaattcgtcgtcttgctctgcatcataattcagagaagttcagtcactgaacacctgtacattacatggagcagcacacgtacgtgctgacgccagacgagaagggaagaaaaaaggtatatcctctcttacctttaataacgttcctctgcaactcaatgatctcacggttgtccatattggcaatgctgcttacatcgatctttgcgtggttgtcgtccggtccaagcaggtcgctcctaaataaagattcagaaagacacaagtaggaagaagtgtttcatcgtaaagttcagagttcagacttgttggaactcagctgaagctgcaagcggttaaactagtggagtatataagcttgcaaattcacctattggagaagcgcttccgggtgaacggagcgccaacctccttcaccttggagctcagagtggagtgcttggctgctagcttgttcaactctttcaggcttctgccaggtttaagcaaacaaaattaacgttacgtttaggccaatttgatcaatatactatcgtccaattgcaatatcacgtgtggcttgcttaactacttacatgcgttgcttgtttgggagttgagaaaggtcttcctgcatcatgtcaagcctggtctcgagaatcgcgactttcctcctgatttcggcggttcgccgctgcagctcctgcggcagcgacggcgagacggactccctctccgcgatcctctcgacgacgtcggccacgagcctctccgcctcctcgaaccgcttcatccattgctccaatggggaagacgccgctgatgatcgatgatcatcgtcattagcacatcgtcagtcggatgcaaaggttaaaaagaaaagaagaaggttgagatgttgatgaagatacccgcgtgctggtacgtgatcggaagaagtggacgcgccatgtgcaatccgcgatgtaaactctacgagtttttcgtctgatcatccttcagtgaagaacaggatggttaataattgaggaaggttctctgatcttgtggtgttcgtttccgggtcgaacgtagggaggaaaccag

SEQ ID NO: 13590 - DNA, 1501 bp, Oryza sativa
ccacctcgcaagttcatatgccagcggtgtaattattgaattaattaaaagaccacaaagcaagctgaggaaataaaagtacagatatattgttcacactaaattcagcatcgccaaacaatataacaaaattgtcacttgcaaattgcaatctactgcaaatctgtgacagctatattaggttgttctttctatacgactgaggggggccttgatacatatttaaatgtatataactatataattaaacacgttaatactgtttttaattgaacaactataacttgacattatccgaaaaaatgtactccatccgtcccaaaatataacaaattgtacactttacaatttatcttaaaacgaaacaatttttccatcagcattctcttcctaactaatcacaccttccaacattcaatatccctacctatctccaggtttcaacaaatgtcaaccttcctctattaaatattcctactttcttaataactgtatctaactttaaaaattcttatattctgggattgagatagtagatttcacgttcactatttggttcatattggatcatcaagtgcaatatggaaacaattaaaaaaatcccctgattgattactaaaaattaattggcttttagcgttaataaatgataattgaacccatatcatattaacagaatggttttcctaccgtaccgagtaagaaacaagtctatcctatatatatcctaatccgttggcttagtctgattttttaacttttagctttaccctgaatcaaattttaaaatttaaagtaagtaattaatggctcagaaatgttgcatggacataataaaactttaagcattatgaagaatagaaggaagaaagacccatgaaatacagaaaaaaaatagaggacatttgagaatagattacaacagtgctcttctaaattgaaattatatgcgtcttgtagcatgctatatattggctatatattggacggccggagcgtagatctaggttttggggccggatacgtcagagtttcaggcgactgataatttatacagaacacaacagaatcatgtttatgttcaaaactattctgaaactgttgcacagtaaaatcaatatgaccccagtgaccattaattaattacatagatacaaatgcactgaagaaacaagccgtaataactattctgaaactgttacagtaaaattaaattaattaatatatgcttcccagtcgacatttctcttagcaaattacgttttccggatcccagtgaccattaattacatagatatatatgcactgcagaaacaagccgtaaatgtgacggacgtatacatagattacatcgtacgtacgtgcttaattacttacctgcaagctccatatcggttgtctcctggtggctatccataagctcgtttctctgtatgctatgcgtgtctagcttgcttctgtcttgctcggtagaattctgcaccactcacacacacacaca

SEQ ID NO: 13591 - DNA, 1501 bp, Oryza sativa; identical to SEQ ID NO: 12923

SEQ ID NO: 13592 - DNA, 1501 bp, Oryza sativa
  unsure (1)..(1501): unsure at all n locations
ccacggcgtccttgtccctgacgaacacctcgagcaccgaggcctggacgcgctcccgcgagaaggcgaacacctggttccactccggcgccgccttccgctcgtggtgccgcgttgtgccccggtagttcccgagccgcacctccacgtacgggttgcacccgccgccgccggcgaccgtgctcgccgccgccgtgagcccgcgcgccctgacgacgcgcacgtacaggtagtgcatctgctccacgaggtcgtacgcgctcgccaccctctcgccggagccaacgcccatccaaccaccgccgccgccgccgccacccgccggccacgtctccctgacctgcggccgtgtcggtgtcgccattgcctccttggccatcgccggcggcgcctgtgcacggaacacgtacggacacgccatgacccggctcaccgtcgtctccggctcgccgtcagggcggttcaccggtcggcttttcccgtcaccggcaagggaagccatgcaaaggtggcgccatcagctagtacgacgagccaccacgcaatggttttttgtctttgctgtttctaagcaaaatctttgcagaagcttgaagctatcagtgagcccacaagagtacggcttactaaggtcaagtgtaaaatggaaaaggttggtgagtgagatcgagtgatcgcgccagtttcgatggattcggaattatgggggaataaagatgagatggtggggttacttttttttttgtgtgtgtttttgggtttgaataagaacaggagtcttggtgaagattcctgggatttttctcacgaaactgcatgtgtttgtgctgctctcctgtaacctgtcgagttatttagttttcagggtgatctgcattggaattcatgtctttttctttcatgtttcagaactaaaaggaaggtttatctgtagtatcacattttttttgtgataaatgagagtggaagaaattcgactttcatataatatcttaatagaattccatgtaatgatcaatgcattttttggattctatccttttgtcgaagtggaatcgtagaacagaatgtgatacgatgagataaaatgcaatagaaacaaggatagcgaacgggttacctactcctaagggtcaaagcaagccctttgattcaattctttattcttacattaaagaatgaatcaaatctccccaagtnnnnnnnnnnnnnnnnnnnnnnnnnnnnnnnnnnnnnnnnnnnnnnnnnnnnnnnctgaggaataagggggattcgacctcctagagttcaactcccgctctcaacccatgaacaatatgagtccgaagcttctttcgtaactcccggaatttcttcgtagtggctccgttccatgcctcatttcataggtaagcccagagtggctctatttcattctatttcacttcctagcacttcctatcatttaatatccatccctttggtctaattgacataagagatgtcatttatagtctatctc

SEQ ID NO: 13593 - DNA, 1501 bp, Oryza sativa
cgttcttgcgcaaccccgacgggtgcagcaccacgagccggtgcgcgttggtgtacaccctgtccatctccagcgtcgagaggcgtatcctcaccttgccgatcctctggtccttgccgccgccgccgccattgccgaggttgcagttgtcgaacacggcgagcgtgagcaccgtgcacgggtcgtagacctcccaggtgtactgctcgttccaccgcggggtggaggagtcgacgacggtgcgggtgcgcacccacttgtggccgtacttggcgacgcagtacgcgtcggtggtgccccggccgccgtcggcggcggtcttcatcggggggaggccctgcgcgccgaggacgccgacctcgagcacgccgatgggcgggcgccacagctgcctcgccgtggggcgcgtgtcgctggcgtacatggcgggctcgtccatgacgtggtaggcgccgtcgaggcacgcccggaggtgcacgcggccggcgaaggcgggctcctccggcgagtgtcgcggccggtgcacgaacggctccaggctgaaccactgcgactgcgtgtgcgtggccgcggccgcgccgcgccggtcgaggcgcctctcgaagagggtgagcggcagcacggcgcggctgacgatctcgtccttgcccgggtgcgccgcccgggcctcgatgacgagcaccgccggctcgtcgaacggctccgccacgacgaacaccagctcctcgttccacgatgggctcgtcgggcggcagcacggcttggtccggagcgtcacgccgccgacttgcaccttgacgacgacgaaggcctcgccgtgccgtcccttgtcgccgcctgcgccggcgacggcgcccgggacgacgtcctgcgcctcgagcacgcttatccggaggtaccacagcttcggcgtcacgtacaccttggaccgcgtgctctgcacggccgccacgccgtcgccgcctccgcgcaccgacgccgcgccggcgtgccacgcgtccgcgaacgcctcgtcggcctgcgtgccgacccacaccgcgagcatgacctctccctgcaccgccctgccgcctccgccgccgacgtcctcgaggcggtaccactgcggcgcgagcgggctgtccggcggcacgcgcacgggcgcctcgccgacatcgaacgcgacccttccaacgtagccgtctcgcgccaccgccgccacggcgtccttgtccctgacgaacacctcgagcaccgaggcctggacgcgctcccgcgagaaggcgaacacctggttccactccggcgccgccttccgctcgtggtgccgcgttgtgccccggtagttcccgagccgcacctccacgtacgggttgcacccgccgccgccggcgaccgtgctcgccgccgccgtgagcccgcgcgccctgacgacgcgcacgtacaggtagtgcatctgctccacgaggtcgtacgcgctcgccaccctctcgccggagccaacgcccatccaaccaccgcc

SEQ ID NO: 13594 - DNA, 1501 bp, Oryza sativa
  unsure (1)..(1501): unsure at all n locations
agccgtctcgcgccaccgccgccacggcgtccttgtccctgacgaacacctcgagcaccgaggcctggacgcgctcccgcgagaaggcgaacacctggttccactccggcgccgccttccgctcgtggtgccgcgttgtgccccggtagttcccgagccgcacctccacgtacgggttgcacccgccgccgccggcgaccgtgctcgccgccgccgtgagcccgcgcgccctgacgacgcgcacgtacaggtagtgcatctgctccacgaggtcgtacgcgctcgccaccctctcgccggagccaacgcccatccaaccaccgccgccgccgccgccacccgccggccacgtctccctgacctgcggccgtgtcggtgtcgccattgcctccttggccatcgccggcggcgcctgtgcacggaacacgtacggacacgccatgacccggctcaccgtcgtctccggctcgccgtcagggcggttcaccggtcggcttttcccgtcaccggcaagggaagccatgcaaaggtggcgccatcagctagtacgacgagccaccacgcaatggttttttgtctttgctgtttctaagcaaaatctttgcagaagcttgaagctatcagtgagcccacaagagtacggcttactaaggtcaagtgtaaaatggaaaaggttggtgagtgagatcgagtgatcgcgccagtttcgatggattcggaattatgggggaataaagatgagatggtggggttacttttttttttgtgtgtgtttttgggtttgaataagaacaggagtcttggtgaagattcctgggatttttctcacgaaactgcatgtgtttgtgctgctctcctgtaacctgtcgagttatttagttttcagggtgatctgcattggaattcatgtctttttctttcatgtttcagaactaaaaggaaggtttatctgtagtatcacattttttttgtgataaatgagagtggaagaaattcgactttcatataatatcttaatagaattccatgtaatgatcaatgcattttttggattctatccttttgtcgaagtggaatcgtagaacagaatgtgatacgatgagataaaatgcaatagaaacaaggatagcgaacgggttacctactcctaagggtcaaagcaagccctttgattcaattctttattcttacattaaagaatgaatcaaatctccccaagtnnnnnnnnnnnnnnnnnnnnnnnnnnnnnnnnnnnnnnnnnnnnnnnnnnnnnnnctgaggaataagggggattcgacctcctagagttcaactcccgctctcaacccatgaacaatatgagtccgaagcttctttcgtaactcccggaatttcttcgtagtggctccgttccatgcctcatttcataggtaagcccagagtggctctatttcattctatttcacttcctagcacttcctatcatttaatatccatccctttggtctaattgacataagag

SEQ ID NO: 13595 - DNA, 1501 bp, Oryza sativa
  unsure (1)..(1501): unsure at all n locations
acccgccgccgccggcgaccgtgctcgccgccgccgtgagcccgcgcgccctgacgacgcgcacgtacaggtagtgcatctgctccacgaggtcgtacgcgctcgccaccctctcgccggagccaacgcccatccaaccaccgccgccgccgccgccacccgccggccacgtctccctgacctgcggccgtgtcggtgtcgccattgcctccttggccatcgccggcggcgcctgtgcacggaacacgtacggacacgccatgacccggctcaccgtcgtctccggctcgccgtcagggcggttcaccggtcggcttttcccgtcaccggcaagggaagccatgcaaaggtggcgccatcagctagtacgacgagccaccacgcaatggttttttgtctttgctgtttctaagcaaaatctttgcagaagcttgaagctatcagtgagcccacaagagtacggcttactaaggtcaagtgtaaaatggaaaaggttggtgagtgagatcgagtgatcgcgccagtttcgatggattcggaattatgggggaataaagatgagatggtggggttacttttttttttgtgtgtgtttttgggtttgaataagaacaggagtcttggtgaagattcctgggatttttctcacgaaactgcatgtgtttgtgctgctctcctgtaacctgtcgagttatttagttttcagggtgatctgcattggaattcatgtctttttctttcatgtttcagaactaaaaggaaggtttatctgtagtatcacattttttttgtgataaatgagagtggaagaaattcgactttcatataatatcttaatagaattccatgtaatgatcaatgcattttttggattctatccttttgtcgaagtggaatcgtagaacagaatgtgatacgatgagataaaatgcaatagaaacaaggatagcgaacgggttacctactcctaagggtcaaagcaagccctttgattcaattctttattcttacattaaagaatgaatcaaatctccccaagtnnnnnnnnnnnnnnnnnnnnnnnnnnnnnnnnnnnnnnnnnnnnnnnnnnnnnnnctgaggaataagggggattcgacctcctagagttcaactcccgctctcaacccatgaacaatatgagtccgaagcttctttcgtaactcccggaatttcttcgtagtggctccgttccatgcctcatttcataggtaagcccagagtggctctatttcattctatttcacttcctagcacttcctatcatttaatatccatccctttggtctaattgacataagagatgtcatttatagtctatctctttctatatatggaaagtcaagaaattctcatcgaaacatcgagaaattgtgcatatagaaaactctaaagaaagaaaaaaaggagacccatgccatgattttcaaatcttttctacttagtagtctaagtttctcgatgaggataattaattcggtcg

SEQ ID NO: 13596 - DNA, 1501 bp, Oryza sativa
gccacaccccgccgaaccctgaacctcaacttggagaagaaaatgccgggccatcaaaccaccaaattcaacatgatgttataagaagcagacttgaaacttgaactccccaaagggaagtaagcgacgatgagatagactcaatcatttttattaagaaagatattatcgatcgcatggcccaattagacccggaccgggatggattctggaatgagcaaaaggaccacttagtcgctcatggaatcctcaataagggtaaagagtataccttacagggactgataaacctttctaaaaaattggaaaaatccggtactagctgtaatgtattcaataaaataaagaagaatgaccgtaaatcatttcgaaagaactacgaaagcaaccctgatctttcttctatgaagaaagtacgtaggcactcctcagcgaggacgcgggttttaaagtaggttctacacattcgagaagacccaggcggattggagtggttgtgcgccggggcaatctctgcttgcatttcgcattggaatttcttgactagcccgaatagatggactcgttcgttcggtcgggcggggcaaatctctaaagtggaattcgtgaaaaggtaccacactcaaatcacatatgatattatgtcaaacaaatcaactagctaaaaagctaggaatttatgtagaagtctgggctggtcagagttcaactcactactcgggctccttttcagttaaggatgcaagggagacttccatgtctggggctgacagctttcgtgtactgaatttctatgagattctcttgtccgcgggaacaaaaagctagtaaattcagtacacgaaattaggatattctagacaacgaaaagctaaacaaagaaaggaatgacaatgagtgtggaaaatccatctacacaaatccactcactacgaggaggtaatcaatcttatgctcaggcaattcattcgtataaatcactactcggggtgtagaggaaggaaatcaggggaatccccggtattaaagtagacagatcaagactagtaggaaaggatactccacgcactagagctttgtctggtcaaagtgctcattctaaggttcaatgcgccgcagaacgagtgctattccttttatgaaattacaccgggaaggaattgagcaagccaagtcatttaactcactccacttaagattgaacaaccccagtcagtgttggttttggggtaaagaaaactatgatagctagctaattcaagaaattctattccatgaaattcttcctccggacaagaaagagtgcggcatcaaaatatgaaatgaaaaactaaataaactaaaaatctctcctctcagtaaattcgtctattcgactaggaaattgaagacaaaggaatttggaattacaagacggatatcagcttgctacttctgactttgactttcaatagggaggtcaaaaactagcacttttttcgaggagtgatcatggtttgac

SEQ ID NO: 13597 - DNA, 1501 bp, Oryza sativa
ctcaaacatggatgatggaccgcagaaatatcttttatttttataatagtaatagacttgtaaaattttaattttggtttacatgtttatagagtaaacagatgtatatgcatgtatatacgtgaggcagaatatagcggtaatagatcagaagcagctttgcatgatatacggctgtactctttccttgtgtgacgtgggcagttggaaacgtgggcttgactacaacatgtaccggcttaatatatactgggctgtgatttttggaaagaatacagataataaggatcggactgatgaagagatacacgagcgattagcggcttaaaacacgttgcgcggaaggaaataactacaaacacgcttaggactctgaacggatgacggatttgcgacgtacgaagatgatggcaaaaacattttaaacttttataataggtagagatacacggaaggtggaattatgcacggcatacgtggttgaatgaatatattcgacaatatactattttcagtcgtattttggttgattacgactgccttgttttggtttgctttttgaatgtatgatgaattcgaatccaaatacacaatttatacgcgtacgtcggtacgtgtactttatcagcaacacacaaggatacatgcgcagatattgtatactattctctcattttttttaatatagacgacgttgacttttgaacatatactagtattatttaatcatttattttatttaaaaattattgtacaaatgcatataatatataaattacgcttaaataattttagtgataaaacaactgacacaaaataaatgataattacgcaaattttttgaataagacgaatggtgtcaaatgtgtgttcaaatgttaacgacgctatcttaaaaaaaatgatgcagtcaatttatctgcaccaaataaatgcgccagaagataaatcacacccacttctcataccactgatccaatttgaacttcccaaaacactcaattacaaaatgtggagattatggatatcccatatctacacggcgatggtatttggactgaatacaggataccaaatatagatagaatatcttatttgtgtctcgggtttgtttctcaacttgtacatcaaggaaataccttgagacttagtcggctacgactgtattttatctgtatctgcatattccgttagggatatagattatcttttgtaacacggactccttcccatatataaggggggtccgggtgcctctaggggcagttgttgattttctccaaatcatataatcaataagacactcggcggattcatccccggacaggagtagggtattacttcttcgataagaaggcctgaacctgtataaatcctttgtctccaaacccatacacttttccagcttgatagccacccccttttattattgccgaaatctagtttcgacagttggcgcgccaggtaggggttgcgtcaagcttttcgccgatcagtgcaa

SEQ ID NO: 13598 - DNA, 1501 bp, Oryza sativa
attgcatggacaacaaataaaacccttttgcctgttagcttcggccactctcaaaaaataatgcacgccgtcaataaactctttggaccgccggtcagcgtacatccattgccgatccatctacatgacatgaaaaaaaatcgtacacaaataattattcttacaataatgacagtcatacaataattataaaataattacaaactctttgaacagtcagacaataatgacatatctttattcatataaaaatcataaaatattacaccaaataattcttatttactatttctaaagttttaaacttatattaatgtgttttacttcttttaattttcattttagtttgttttctattatttaagattaactttcactatattttccttctcaactattttataaaaccttctttagcaaatcaactaattttctatatattctttcttccccacacaaattttctctctcatcaacttataactgaattttggagataaaaaagtgtgcaaaacatagctccaaatgtaatatgacaaaaaaaacattggaggatgaagttgcaaaccttttaggcatctccgatttgtatgtaatcaccaaaataaattcactaaaaattttggcatgacctcccatcatttttaaagaaattttgaagcttgctcgggcagctggaggaggaagaaaacatatatatataagggtgggactttagtcgcggttggtgttaccaaccggggctaaagattcccgggatctttagtcccggttggtattactaaaggtacgatctttagtcccagttggtattatcccggaggggcctgacaggccctaacagcatttgaacctaaagatcaaatatgcccattactctttttaaccgggactaaagatcatctttagctgatctttagccccggtttttattgcatccaggactattgtggaattcggtcgaccgacgaaagatggtttctccaccagtggatacagccataccgtaagcaaaccatcacaaaaacgacgtgacgatctccgacgcgctcgcacgtgtaccacgaggcttcggcatctccctcctgctgcgccattcgagaaacccaattgcggtaacgtctactgtcaacatgacggcggtgaaggcgacgagcctgatgtccagcgtggttgcctgccgtgccgccaacacgaggcgggacaacagcagaacggccataggcaccgagacgtagcaccacttgaacagctttggcatgtggtccgtaggataagcgtacgtacgtgttccggaagtacaagaggcacgtagggagcgcacgcgaagaagacggtggcgtaggagaggcccacgaatgaaacgtcgctgatcacaacggcgccaccagcgaccaccgcaaagcgaatatttgtgcatgccatctatatagtcatgatcttttagtcgcgatcacctgagaaatgttcttttatatggcctgtatgcagtacatcaata

SEQ ID NO: 13599 - DNA, 1501 bp, Oryza sativa
tatctctatctctagtatgataaaaattgaaaatgtttttgctggtattttggtacgtcatccatgtttgaatcagtttttaagttcgttcgtttctagaaatacagtttgtgtttgagttggattttaaactcgtttgcttttggaaatacaagaggaatcttataagaaatctctttaaaaaaaactcatgctaacttgagatggaatatggactcctaattacagctcatgattttctaaacgagaatgctaggggacgggatactgtcccccaacgggatagctcctctccacaacgcgattcgcatcccccgccgctgccgcacccgtcccccgtcgcctccgccgccaccgcgcccgtcctccaccgccgtcgtcgctgtcccccgccgccaccgtcgccaccgcggcgtccgtcccccgtcgacgctgccgccgccgccgcgcccatcccccacctgccgctgcgcccgtcctctgccgccgccgccgccgtcctcgtctacaagggatggctgcagggggcgaccgcgcgtgtcggggtgctcctctcccaacgggatgcccagctatatctagcaggaatcacctgatatctggtaagtatcatctgatacctcgcaagtatcacgtgatacatggtagaaatcgtctgatacctcgcgagtatgacgtgatacgtggtagaaatcgtctgatacatgacaggtatcgcatgatacctcgtgagtatcacgcaatacgtggttgaaatcatctgatacctgacaggtttcacatgatacctcgcgagtatcacgcaatacgtggtagaaaatcgtatgatacctgataagtatcacatgatactttgcaggtatcacctgtaacgtgtgtagaatcgtttgatacctgataggtatcacacctgatacctactcgggattatcctgttctgtagaatcgtctaatacctgataggtatcacacctgatacctactcgggatcatcccgttcgaaaacgggattccgttatatagcagcccccttttctaaatgaaatattcaagcaaattccatggtgaattttatcctaactaaaccgtataataataataaaattaaaatagcatttatccgttgcaacgcacaagcattttttttttaataaaaattgaagatgtttttgccggtactttggtaggtcatccgtgtatgagtcgatttttaagttcgtttgcttttggaaatacatatccgtatttgagtctgagtctttttaagttcattcgtttttggaaatacataatggatagctttaaaaatattgcatgctaattttagacgatcagactcttaactgcagctcatgattttctaaaaaacatatatctaagcgaattcctacagtattgatgtactgcatacaggccatataaaagaacatttctcaggtgatcgcgactaaaagatcatgactatatagatggcatgcacaaatattcgctttgcggtggt

SEQ ID NO: 13600 - DNA, 1501 bp, Oryza sativa
gaactaatatgccttgccctatgttgatcaacacaagaagttgcatccacttagttagtttatccatcttcccttcatcaaccctgtcagcttcacctgctgctgctattgcaactggtgttgcaacttcttcattgaaatctaattccattccttccaccattctttggtaactatcataccacttgaaaaatgtgcaagcatcttgaacctatgaaaacaacaataccaaataaaattaactatacattctgaaattccaaccatctcatctgaaaatcaaactaagagaatttactaacatattgttcattcttctcgcatttgaaaaacacccgaccaccttgcctccaggatttgcactccactactgcattcccacatcttgggcacttcacaagaggaagtccactgggaccaagaagaaaacgagagagttggcgcccgggagcacgaaaggaactaccttgggacatgttgtcctcgctaccttgagcaattcttcgctgcatcgccataaccctaactagggttagggttatggttcttctctctgatgcccgcgacgagcatcgaggcctggggagggactgcggcttcgtgcgtcaactcctcctcgacctgccagctagactcgactagccggaccggagatgcagggcatggcggtggcgcattgcgatggcaatgagagagagaggcgaccgagcgcacacggcgaacacacgggctggctcaaccccctctcgctttcaagacccgaccgtaggggcaattccatcaggtcaacttgcatagaagggaaattcatttcgaaaatgagcaaaaggaggaaaatggcaaagtggcgagtgcggcgcgcttcatcctggcattttagcgaatcccgttttcgtgatggcattccggcgaagcctagttttgaacgtggcttaatgtccattttctccaacaaattcaacgccgcagcagaaaccttaaaccctttagcgatttgataaaacacaaagtatgtctcgcaattatccaaccacacacgaacatcggtgccatcaaatttcggataatccattttaggtgaccactggcgacgtggcatgtagtacccaaaatcacgcggagcagggagtatgggtgggtaaggaacctgctcccgaacaggaggaaccaggcacggcggaggcggaggtgggggaggtggtgggggaggcggagggggtggtggcgaagacgaagaggacgcccccggagtcgccagatgcggaggttgaggaggaggcggtgtagatggtgccgatgcgacgggagccgccgcgtccgccttcagagcgcgagccacttgtgtctgctcctgttgaacttgccccagtgatgtcatggagagatccatcttcgcttgaacccgatccaggcgctccccttgagtgacgagcttggcgtcgatctcccccaaatgcttggtgatgacgtcaatgttgtcgaccttcgccatcagctgcgt

SEQ ID NO: 13601 - DNA, 1309 bp, Oryza sativa
attgcgtctgtagcagcaatctgatctctaatttgattgttgatgccgctgtgtacaactgtagtagacaattgcctatggatggcgtgaatgttttattattctttaatcaccatggcgattgtagtcacatacatggtcatatttcgttcactctactaatttttatattatactcttgtagtagttcacaggcaattcagaaattcgactaggttactgcaaacagattatgctaattacttatccagtgttaccgggacactgacacgggtgtcggagtccgactcggcaagctaagaaaaaataggattcggggactcgctccataaatatgatttttagtgaaaatattatatatatcatcaaataaaacatactcttagtcagtaaaacactaaaacatatggtgtcacacattattctgcacagaagatcctatcttcttattagttaggacaaagactgacagccaaaataagtgaatttcatgtgtagaggatcccttgtgcagttgtgcacaaaaaaacccactgctatcctgccatccacatgccactaccaatactactcatgagtactactagttgtctctggagtactactagtatgcctgtgcattgtagatgcacgcacgcagctacttttcccatcgagctctcccatcccattctctctctctcttctgccttctttttcccatcctctcccacaggtctgccagacaaccaccggcactgctcgcctatggcagctgagagagacaccgctagtagtgtctgatgcgtgtcgaaccgtgtcagacacgagctgacacggggatgcgtgtcgacatggaaaatttttttggactcgcgtgtcccggtaacactggttacatctggggaggtcggttttatcttaggattcaacttcaaaccattctgctgtagaattcctacaaataaaaaaaaatagcagtcttgtgtttgacccagattgtttctgtatcctctgttcgtctcaactggcctcaagaacacaactattttaaggaatatataagcagaatggagagtttaaactccattctaattttgttcggttttgtctgttgtgcgtgtaattaggcatttaattttcctatttcatgttttttttgccaaacggccaaatggccacactctggcattcgatgtaacaatttatcatatcgggaactattgttacaatctgtatcttctttgtgtgctgtctaccacaagtcttatctgtaagatgtcatattttttatgattggttctacctgttactgagaatatcttctact

SEQ ID NO: 13602 - DNA, 1501 bp, Oryza sativa
caatgctaaatattcatggaatattggcttcaccgtaatcctgtactcataatacaaccatataagacacgtcccaaaaagatgaaggatacaaaatggacttattctagctatataagacatggcccaaagatatgaacgaggcataatagccttaattccaaggaggagcgtggtaggcttgtcgtgccttcaggccgacccggaacgactcgagttttattaggccgtgtctgggcagttggtgtagcccgtgggcgagcacgacatgacccggcgtgtcggtcgagccatgccagcccgactgatctcgggccatgcctggtcatgcttgggccaggccagttgacccatttagccatctatactaccaccccaccacacaagtatattttcaacaggtgtgttcgatataggtatcagctcaacccctggggttaatgtctgggccaaagaccctgatgctcagataagtttcttaaagatatttttgtaaaatatttctagaaatatctagaatgttaaatatccaaattagactatatataaaatgactgttcatacatttgagccattctgaacttaatagttttattatgaaccggctattggggttactctctagaccaaagagcctgacgctcagataagtgttcttaatatttttgtaaaatatttttaaaatatatagaatgtaaaaaatttagaatgtaaaatatccagattagactacagatagaaagactgttcatacatttgagccgctctgaaccgaacggttttattatgagccggtatagattagactataactataagaccgttgatacatttgagccgctaatgggcctgctggaggtccactctgtgtcaaaggccgacaacatcagctttaattgcaaaaggaaaaagtgcaccgaaggtccctcaacttgtcatcgggataaaaaacgttctcgaactgtaaaaccagatatacggggtcccataactatacaaaaccgttcactttaggtccctcagtgattttgaccccggttttatctgacgtggcggctgcgtcagcgtgggacccatgtgggccccacatgtcagggaaaccacgtcaccaccccctctctttttcacctcttctctcccttcctctctcctttttcctctgcgcgtggatgtcggcaacgtcttcgacgcggcggggagaagggcccgcgtggccggaggctgacggggaaggagcgcggcggagaggagggccgatgcgacgggcggcgccgccaatggctgtcgtcgcgtggggaggagcgcggcggtcgtctgccttccctcctcctccgcgtgccgtgcggcgccattgccgtggccgacgggacgtcgtcggggtgaggtggcgatgcacggtggtgcgggcggcacggcagagggaagggcctgcgtagagtggccgacgcacggtggcgcgggcagcgcgacgttccctccctctcgatcttggtcacgaacc

SEQ ID NO: 13603 - DNA, 1501 bp, Oryza sativa
gtgggaaagtaattcagtacagtttggaagtaagttagtatagtttggaagtaagtcagtatagttttgaagttagtaacatgcaacaggacaataactttttagacagttacagttagatgcctctaagaagcaatttttctcattttttgacaccagtggctatacttatggtttttttttcacatattgtttttgatgcagtactagaagagaaagagaggcaactaggaggaatgcatcatgttgtgtacacataccaggtataaaatggatacagaagtttttcactgaaattacagttaaaattgcccaacaatgtaattaatggatacaaaagttgtaactatgaaattttaattcaagattattttggaagcaacttgcatgttcctagaaagtaacttattgaagtgttagaactaagttttctattaagtttgctctgagaggcaactggggggatgcatcatgctgtgtaactagggaatgtaaattcaagtttttctggaagtaactttcatgttcccaggaagtaacttattgagttgatagaagtaacgttctgttcaaatttctttgagaggcaactaggggggaatgtatcatgtttctaggaagtaacttatcgaagtgttagaagtaactttctgttaaaaatgcactgagactttatgttaaaattgctataagatttcaacaccggtactcatgcctatgtaactacgaaatgtaaattcaagtttatttggaagtaacttgcatgtttctaggaagtaactttatgttaaaattactctgagatttttaaacaacagcactcatgcctatgtaactaggaaatgtaaattcaagtttattggaaagtaacttgcatatctaggaagtaacttatcgaagtgttagaagtaacccttttgaaattgcactgagaattgaacaccagtactaatgccttttttcctctattttttttcagcagcacttgaaaagaaatttattcgatatacgaaggaagtcagaaagggagacagattcatagtattcgtatctcggggaagacaggattcatagaattcatttctcacagaagacaaaaagaacctaaaaattctctaggttagtttgtatgttttttgtcgatagatctgaaaagacagtattggctatgtagttacctgtgatctgctcttcttttctctctcttcgtgcttcctcctcctcctcttcgtgcttcctcgttttctttttctgatttttgtgccgcggcggttgagttctggattgacactcttcgttcttctctctcgttttttttctgatttttgtgcagccacagctacgttcgggatcgacgctggtccggatttgttagattggagggggggtgaggcgcgtagcgcgcttcctttaggtgggcccacgctagctgtcccacgccaagcacggtgtgcgtggcacgacgcgcgcgcggctttcctttttttgtcagaggcgcgcg

SEQ ID NO: 13604 - DNA, 577 bp, Oryza sativa
  unsure (1)..(577): unsure at all n locations
agctgttcgtctcgcgagcctgctccagatcgtacgatgcgaacaagtatccgggcgatgagttcaagnaagggcgtctacttcctggatgacggaagactctacgatgaggcgtcccaattcgtgaatccccttccccagtacccctgcagcgacaacggcaagtggctgccgccnccnccgncgncgncgncgaagcgggttaccgnccgcgtggacaagctcttgccggagcaaggcccgtcgtactacacgtcgccggtttggattctgccgtgagactgccatgttcttagttagatcgtctgatgacttgttgtcgtgctgatatggtggttgttgatttgtccagttaatcgatgatgtgttctcgagatccatgtgtacctgcaattgcttgatccatcataacatctcttcagtactctgctattttcaccatgttagactaatgcagaaattgttggttctcatgactcagattgcattaattgcatcattatattgcaacgaacaatgattcagtctgggggattgcatcattatcctgttcatgctaatttttcaatttttcagg

SEQ ID NO: 13605 - DNA, 772 bp, Oryza sativa
  unsure (1)..(772): unsure at all n locations
gcggcccttgattgctnnncattganaacgcctgnannnnncnnnnnnnnannnnngnaannnnnnncnnnnaagaacataccgtagactttccccctgtaacgtagcttacttgtaacactttccctctttcggctaaattattggttagtcttttttgcccacaagctatgtgcagcccatttatggcccaactcataatacatacaaatgttgtatatatgcattttcatatagaaacattaaacaaagtatagaaacttcacacaatttatttttaacttttaagaaaaataaaaaaaattgtctattttgggccggatacccatgctgtgttgcagccactcgctgctggcccgttgaattcggcccaaaacatccgttctcacaaggccggaaaaaataggaataagttcagttttgtgaccctcgaaagtgatcgaaatctattctgtgaccataaatcacaaagccggatatctcgaacccctaactcttaaaactggtgtaatttgactccctcggcggttttggagggtagtttcgcagacgtggcatctacgtggcagtattgattcggtcttctttccacgtggcgttgatgtggtgcttaggtggcattaaaaataaaaaaatatgtgtaggtcccacataaatcatgctctcttctcttccttcatcctcccccctctctctccctttctctttccttcggaaggcactggtgaggagcggaaggcggcaatgaggagctgtgccactcgtcgccagc

SEQ ID NO: 13606 - DNA, 1501 bp, Oryza sativa
aattacattgtaattatattgtaactatagtgtaactactctataactatattgttatctctatataaattagatataaagttgtatatattattttaatacatatatgtaccagttattattatagtatagttctagtgaaattatatactatagttagatttaaaagttttcccctcaaaaaacactcgacagttttttaagctagtcccttagaaaatttagagatgctgggtttttcagcttttggattcttcattttctgaattctaaaaaaaaaatttgagtaataatatggactgtttgaggaactgaagattctgggtgtatttagatctcaaaatatttggccagaaatattacatcgaatatttaaacacatgcatggagcattaaatgtccgatctacatccgccgcccaccagtgccgatggctatggtggaggcggagcagatcggatgaggaggcgggctagggctagggagcctccccacgcaaggcaacccaagaggccatcttttctatttttttcttaaatgattctaactacttgatcgcccattggatcgtaatgtttggagaatcgaacgatatatctttcccgagattatttcatgaattcagtagggtgacttttataccttgtactggacgagattagttgaccaacttgttggtaattaaacgaattataagaacaagtgatcaattaactaagactgtagctagcctcgattattggtcagatcgatctgcatcaactaatggattattttttgaatactccatccaatctgcatcacaattctaagcctcaattaactaagactgtagctagtctttgtgcatagaacatcgtgatcactaagcatctaagcctccatagttaatataagaagtacgctgctaatattctcgcatcctccgccaggtgttaactgccaataccctcatttatacaaatccagctaagcaacgtactacacgtgactagcactaggtgcgacaacagtacgtagcaacgtttttctagtttgagaaaatccgcggaacggtcaggggttttatagctagctccataagatgataggctagccggtctagtttcaaagtctaactccttttatttatttgataactagaaaaaaatatttgtgcgttgcaacgggtgaagattattttaataataatattattatacggtttagttaaggtgaaattcgccataggaattcgattggacatattttttttagaaaatcatgagctgcaattaggaatccgatcgtctcaagctagcatgtaatttttttaaatagatttcttatacgactccttctatattttaaaaaataaacgaactttaaaaactgactcaaatacggatatgtattttcaaaagagaacgaacttaaacccgactcatatacggatgacgtacctgtcatagttacgaataaggcatacttactatcctatgacatatgaaatatacagata

SEQ ID NO: 13607 - DNA, 1501 bp, Oryza sativa
aaagacgcaaaagtcgagcggcgactgtgtgagcctctaaataatcccacatttcttagcttgggaggaggaagccaccttaaaagggagagccaccattcccctattgtactagtcttttagggagattgggtatttcccctattgggtgtgccaaagaactattggggttcaggcaaccttaatttgttgggcctcagccaaccctagctggaccggattgttatcacaacaaccacattattagaaggtataactttttttgtttgtctaagctatatagatccgaatccactagagaggagaccaaatttatcaatactgccgttggatttggaccaatctgaggcatccttctattcctacagatgactacagatgagatcatggcacctcaccctctcctaattgactcccatgatctggtaaatttggagggaaaacacttctgtttttaggtgttgcctccataaccaggattactcccgtcaacacaatcgaaaacatataaatcctcttctttcccaaacaacatatgtgagattcaaacctaagacttctcaacacatgcaaaccaatcttacctatagaccacatgttgatatatatgtcatcagatgttattcttttaactattcttgtccaaatatgaaactcaagatgacatgaaatgagaatgctttcaactacaaagttgcagatctcatcgagctctaccactttagtgtaaggtatgtctcatccaagatcagttgaaaatttcaaaaaatatttttgaaatagaacacatcacttataacacatattcagggatgaaaacaattttaaatgaaaatattttcaactaggttatagatctcaccaaaccctttgactttgatataggccatgtctccatttgagatcatttgaaaaattcgaaattacgtttttcaaaatagatatcaccacttataatgcatatttgggcatgtaaactatctcaaattcaaatgttgtcagcacttgcaaaattacatttttcgaaatagatgtcagcacttataatgcatattcgggcatgtaaactatctcaaattcaaatgttgtcagttttaaagttatagatctcatcgtgatctacaactttgatatagggtatgtttctatctgaggttgtttgaaatttcaaaaaattgaatttttttctcatctgtgacggttcgtaactacgttatccgtgaagggtggtaattaagatctgtcacggatgagtgctctcatatttgacgggtcatctcattacatccgtcacggatgacatgctatccgtgatggggcatggttgtgacacgttataggtcatccatgacgtgatagaattacgacccgacaaagatgaccttatatcagtgacgggtcatccctgatagtcatccgaaatgaggtcgcattagcccgacacagatgtttcgtcaaggatgcccggatctatactagtgtcacatcttatcctttaaat

SEQ ID NO: 13608 - DNA, 282 bp, Oryza sativa
cgctagctatctccccaaaatggcaatttggcaaatgcccaccgcgcaccgcacggaccggaccggaccgagtccatgttggctccacgtacggaatccagccaggcgccagttgggcacccgccgcacgtgtcgcgcgcccacgcacccctcacgtgacccccgtacgcgccgggccccaccgcagtgtcacttgaacctgtactacgtactatatatactcctcccgagcagagcaacccgaagcagagcccactggtgtagtgagagtcaccaaaaagg

SEQ ID NO: 13609 - DNA, 1117 bp, Oryza sativa
acatgtgggtcaagggtatttttgacatttcacgcaaattctctcttctcttcaactgaaaattattattttaattggcgcggtgtccactgacaaattaccacgtttatggagtgtttttccacgaaagtgagtttgggcagtgtcatagggctaaaaacacacataagcagtgtcatgtagcaaaatttgccgaattaaaaacctacattgatagtctgatatacctttatactccctctatcccaaagaaaaagacaacccctcctagtacaacgaatatggacagagagttatccagattctcccacacacaccagctcgatacacggaaggattccgtaatgttgagtgaaaattaacaggatcgaagtatcgaacggaaatgcaggtcccggccgggattctgcatcacttgttggatggaaacacggtgaagtaggtctgcgtagcagcgagcacgacgacgaaggcggcgacgacgacggagatggccgatcacgtgctggcaaaatagttgcggcggagccccgccatgtgcctgttgcgccacgtcccgcagtagcgcgtcacgtcctcgtacagccccgcgaacgcctgcgtgtcgtagtccaccgggtcgatgtcgcccaggcggttgaagaaccgcgccgcctcctcgtcgttgtccaacaggttctccaccacgccgcgccgccggagcagctcgacatcgcgcgccgtcatgatgagctggctcatcagcgccacgtagctgctcaggagcctggccacctcgccgccctggctctgctcgaacgcgatcaggttcgccagcagcggccgtctcgcgtcgtcgatcaggatggcggggatctccatcacgcccccgcggtcgtcgaacaccacgtcgtacgtcgtcgtctccccggcgtcggctggggctggccgactccgccttgcgacgaactttagccccacgtgtctcatctcggtggcgcacggtatcgcccggggtgcccgggtggtggtcgccgcccgtcggccggaacgcgcgctccgacggccccgcggcggcggcgttgatcagttgggaacgaagcactcgtagtacagatggagaaggtggtggacgtcc

SEQ ID NO: 13610 - DNA, 1501 bp, Oryza sativa
aggaaaaactcgatcgatcaggagttcaggacaagaaaaatagttcagatgaagaataaatgcaaggcatccatccattatatgaacagatcaaatgatcataattaaacactcttgcccaaagaaaacaaagggtagaaactgcatgagttagttaattttctctgaaaaacaaaataaaggccgagagaaacttagccgaaaacttaatctcttggttgacaaaaaacaagaaattaattaacccatcaaatcaagcactaaaaagagaacaagagacactaagctggagaaaggaaagattgaacagcatctgataatataagagaacaaaacaagaaccgtacctgcaggtagggctgcagtactcgaacatcttgccggtgctggagaagatgacgacgccgacgcgggcgtcgcagagcacggcgagctcgttcgccttcttcagtagccctccccgcctcttcgagaatgtcacctgcctgttcgtcgcgttctcgatcctcttgatctcgatcttgccgcgccccatgcctgctataccttcctgatcgagtttaatttaatttctgtgttcttttgtttctccttcttctgcacaagaggaaactgaagaagaagagaagaagaagaagaacagaaatggccaagttatgaacatatcgatacatggacgaattttgttaaaatcaacataaggcatgggtgctcaaattggatttccccccacagctatgtaaagggtgcaatcagaagtagaaaaaatttcatgtagagaagagaacaactagtagctagagatgtaaaaactctttgctgcgaaaggatgaagaactagctagaaaaggtgtccttttttttttcttgaattactcatgaacagggtagatagatagggcaggagtagtaatgtgctatgtacataccttgtgaagtgctaagcttgcttcaaaggctaaggcaggaggtgcagaaggagagacatatataggagagagagcttgtagtaatgtgcaacacacaatgctttctctctgtcacacactctcacactactactcctgcaaatcaaatcagtgtactactccaaatcaaatcaaaagtagatggagggagtagtaaatatccagaaagcaacaaactacatttttaactgtaactaatatgctagctagtctagttttacatttacccctgcatcagtgtgtaattaggatcagatagtgagtcaaagcaagaaacggatgcagacataagcatgacttcatgatgatgatgatcagatcagtgtgcatatccatgtgtgtacttgcagcatgcaatgatgatgcactagcatatactctctggtcgatctctgcacaaatacacgagcctagcttgtgacacaaaacacacactgcaacagtgcatatatcacgcacacaaaagttcagagatatcagtgtatgtagctcatgcaatataatgcaacagtattactcatcagagcacagtg

SEQ ID NO: 13611 - DNA, 1501 bp, Oryza sativa
tattagattacgtttaatactttatgtgtgtccgtatatccgatgtgacaaccaaacctaaaaattttcctcaactaaacaaggcctatctaaccgagttagtttagaataatgacaataattaaaaaaatattcggtagcgctaatacgcgcgcagcgctagaaatagtacgtttgtccgcttttctcgttttatttctacacacggacctgtcacgcctccttctatttgtcccaagtaaaatattactaccggcttggttggaaatacctaactaaaaaatacgcaagggcttccataaaaaatttcgtctgtcgtccgctttatccacacgagcaattggttccattaattttcgtccgtacgtgtaacgactccgatttgttaccatagacgtggcctgactgaccgttgaatagtcatattgaccctgtttagatcctaccttaaaatttttcaccctgccacatcgaacatttaaacacttgtatgaagtattaaatgtagactaaaaaataactaattgcacagattgcaactaatttgcgagatgaatcttttatgcctaattcctccataatttaataatgtggtgctacagtaaatatttgctaatgatggattaatttggcttaataaattcgtctcgcgatttactgacggattttgtaattagttttttattagtgcccgaacacccaatataacatcctatataaaactcgatgtgacatggcaaaactttactactattgacctaaacatccctattgtgtagcaacacattatggcataaccattgacattctcagttggttagccaatgaaacttgtggccgctatgatgggagttcgattcctatcacccatctgttttgtgctccttatcctctccaaatttttcttttcctctcctaagctgattatattatattttttataaaagtacatccatgtgtttgaaattcatattaaaccagcaatatatgtaattttctaccgtgtttttctacactttgtcacctcctcttattaatattttcgaaaagtatgtccatatgtttgaaactagtattaaaccagtaatacatgtaattccctactgtgattttctatactctatcaccaatgctgcttatcctctcattttttttccttttctctcctaagctgattatattttttaaaagtacattcacatgtttgaaaatttatattaaaccagcaatatatgtaatttcttacagtgtttttctacggtttatcactgtttgagatcgcgactacggtatttgcatggtatagagataatggtaccagggcatatgcaagattgaaataaaagagacagaaacaagaatttttagggtgcgttcgtaagaggcggttgggaactcatttccttcgcacgtcaaacggagcggttcattatcacgtgattaattaagtattagctatttttttttcaaaaatggatcaatatgtttttttaagcaactt

SEQ ID NO: 13612 - DNA, 1501 bp, Oryza sativa
ttgttggagttatatgggccttgtccatgtaataatagaacaatcaaaggcttacctaatgtaatagttgcatgcatgtgaacttcagtgccattctgttgatctactaagaataaatatcagtgtataaggaataatacattcttctcgctacttcaagaataatactatcagtttataaggaacagtgcgctcttcttgctacttaaatcatgtggttacgagagaacttgagtaacacacgctctcacatgtggcttagtcctggtaagcggataagggctcctagcttgttacatcattttagctataatatcaaatttatatatataataaatgtgcgcttatattttcaacacgacttatcagattaataaagtagcttcaacgaccaaagaatgaaagaaagaacctacacattgcttggcatttggaaacacgttaacttttgccgcatgcaacatttgcagcttttttatttttaattctgtggtgactatgttcttttcctcttcggacaaatcgaatgtcggtatcatgcctgcaggaactgattcctttccagctgtacaatgtgtagtgaagattgagcttttgcttttgttcaaagattgctggaaattaatttcatcccttccggacactagcacgcaaacactacatcaataacgactactcacatttataacgattaaaccaaccttacaacccaatagttacagacatagagactcatatgtaacggcactaaaaaacgtggagctgttacaggtgtgaaaattcaacttaaaaaaagaaaaattaggctcataagctatcacagatctgaaaattcccaataataataataataataataaagaaaaatcaccctgtctccatcccccctcctagcatcctacctaggggtgaaaacgcggtatgcaaagttcccgaccgtaccgataccgtttccgcaaaactaatataataataatatttttactgatgttaccgttttcaaaatttagtttttttaatttctgtcagcgtagcattgaagttggcactaaatagatgaattcataaatatggaaatttcccgaccgtttcattcattttcgaaaaaaataataaaataatgtaccatttccgaccgtttccgaccgtttcatccctaatcctaccaccgatggccgttgcacgatggtgcgaacgggtgtgtggggggagggaaggaaggatggtgcggccatggctggggcgcgcgacgagggcgtctatgtaggatcgagatgtcgactagagggggtgaataggtgatttaaactagatgagacctaatcaaaactaacctaagttgttaggcttggtgagggacaatgtaaactaagcaactaagttaagttttgcaaacctcgggtgatatgggctcaagtatatcactatgaaagtaaataacacgctaagttagttttgcaatcctagagtgatatgggctcaaatatatctatatgaaagt

SEQ ID NO: 13613 - DNA, 1501 bp, Oryza sativa
taaccttattacaggttctctccccctagggtttaggctttacaggagaatttacatggttacccttatgatagggacatgattaggggtacacaatgtcctttacacgtatggccccaattgggctaaatggctcagcccattgatcttggcgaatccccgcaggggcgcaacagcccgttgggcttcctcacggtggggtttggtaccttggcgaaatccataccttcgggccgaggctttttgcctcgccatcttcgcttgcgtggcctcctgacggggccctgtccgacgaagcacgcgtacttcccgagccatggctttcgcccttagggtatccctcttcgaccttcaccgcttgcttccggtttgaacctgtcgccaagttttcggtttcggtaggcccggccgaaggcccttcgcggtatacctccaacgcaaacatgacatcggccgaacttcctccatcgatgaggatgcgccgaacttcaaaactagccatttctaccgaaacgatcaacgggtcttggtgcgggaaaagaactcctttggcatcttctggtccgaaggatattggctgtgaaaagtatcttggaatgctgtcagctgtagagacaatgctgagacaatgcctttgtgcttgaacattgccttgctgccgaatgtttcgactctgctcggtcgtgtgcgaagagcgtccgtgaaaagcgcattataagttgtcacgcccggaatttctatccaaaattccaaacgcttacatgtgtgttaaaccctcgtccaggaatcaaccgaggcacacaatgacaatttgataatagagtacaaataaataactatttaatactcgcaaataaaaattattacagaggtagacagttcctctcaaacaaaaataacattctacgcagcggaaatataaaacgataacaaactacggaacagctatggcgactccactccacaggcatcttaaccaagaacaagcctaatcctccagatcatcaccttcactgagatactcctcttctgatgaatgaatattgcaagaatgagcgtatgacatactcaacaagccacacagcaaatatgcaagtgcacaggataacaaaggatggcataatatagctcatttgcagaaaacagcatttaataaatatataagagaataataaaaacagttgaataattgatcaatattaaataacaccatacaacacacccatgttgcataggcccaaccacatttgaacaactaaccccagttgaacaaattaaacctccaaaccaggaattaaccattccaaaccaggagtcaaattatttatcacattattaacattgatgagtagtgtgaaactaatcacgaaaaacattgctcaactcacccataaccgcgggtacggctattcgaatagtttaaactctaatcagaggtgtaccactgtacccacaagacacaaccccacatcatgtcaccatgtgcctcaataccaccacc

SEQ ID NO: 13614 - DNA, 153 bp, Oryza sativa
ccaccaccaaccacaacgcacaacccaaccaaacaaagccaaaccgaaccccaaaagccgagcaacttgttttttttttcttttttggaaaaccgtctcccgatcctgtcaagttgggaggacgacgatgaggaagggtgcgtgcggccgagc

SEQ ID NO: 13615 - DNA, 911 bp, Oryza sativa
gcctctccccaccgctgtcgtcccaagaagggaaaggccggggggagagagagacacgggagagagagggggagaaagaagagaagaaaagggaggatgacatgtgggtcccacaatatattttttttaatgacatatgagtccccacatatatttttatttttttatcctaatgccacgtaagcgccacgtaggataaagacttggtcaataccgccacgtaggcaccacatcagccaaaccaccgagggatattgtttgcaccggttttaatagttggaggagtcgatatacccggttttatggttggaggacatgaatcataatcgggcgatagttgagagagtcaaagtatactttttcctactggtattgatccaattgaaactaaagcccaaacagatcaaatcttacggatgactaggggaccgcctattcatcactcgggtgttttgagaaaaaatcacccagatttttttcttcccttggatttgcatccaacggactacaaaataaaataactaatacaaatttacttacacaatatttttatcaaaattacagtgcacttacatgtcatatcaactaaatttacatatgtaattttagttatataggactgtaattttatatttgaaatcaaataattaatgtaaatttacttacacaatatttttatcaaaattacagtgcacttacacgtcatatcaactaaatttacatatgttattttagttatataagactgtaattagaaaataataagtacatatttacttacacattatttttatcaaaattacagtgcatttacatgtcaaatcaactgaatttagttatataggactgtaattttatattttaaagaaaataataagtacatatttacttacacattattttttatcaaa

SEQ ID NO: 13616 - DNA, 1501 bp, Oryza sativa
ccccttcaccgctcatcgccatcgcggcccgccatgtctcagcgtcactagagatcgtggccccgggtccgatgggttaaaggatgctggatctggtggcttagagaattggtcgttggatcctggcattggagctttacttgccgtgtcagtgctgggagaaaggcgatggccattggggaagacgacacttgcgagaacaaggattgccgcgtcggtgctgagagaaaggcgatggccattgaggaagacgacacttgcgagaacaaggatttccgtgtcggtgctaggagaaaggcgacaaccgttggggaaaatggcgcttgcgagaacaaggattgtcgcgtcggtgctgggagaaaggcatcagccgttgaggaagacaacgcttgcgagaacaaggagaagaggaggaagatgatggtagcgaaggcaagatcgccctcgtcccttgattgtccaaagctgggtatcctcattgagcccttcttcatccctctctcttcttcctcctggatgtggtcgagcttggggtcgtggtcattgctaccgtggatggcgaggacgtgctcgacctcgatgctcgttggctggttggcgcgtccacactcgcggactatcacagctagtacggctcgacgccctccgcttgctccattgagtgagtggatcttgctcgttggcaacagcttccgtggatccggaaaatattgcggtaaatgtcttcctcgttgccggtttacgacagctaacatcggctcgctgtttatatttttttgggaattgctaaaaagttgtcacaagttttttggcaaaaaaaacttttaaatgttactatagtatagttgtagtataactacaatgtaactacactatagttacattgtacacaatagtgtaactactttaactatattgtaatctctatataagtgatataaagttgcatatagtattttaatacttatatacaagttacaatattgttatggtatagttatagtggaattatattatagttagatttaaaagttgttcctttaaaaaacttgtggcagttttttggatactatttttttcttatccattgtttcctcggcatgcaatctttttcactaattcttttcgtgttatcatgtgatttttttcaaccgagtttagaatgctctggattttttcctttgttttatctagactcttcacacacgttcaaaatgaacgtgctcttctggacacgtggcatattttgatgatatgtgaacttggtttttggtttggccacgtggcctaatgatttagtagagtttgcaccctgcaatcggtattttagatttaaccaaaatgggcatggcatgagccgcatgacccaaaattgtaagggcagaatagtaaattgacgtggaaaacgagggtttgcgtctctggtgtgccttttatccacataagaacactcgcggcggcgaccacttgtgctcggggaagttcgatcgatccctcacca

SEQ ID NO: 13617 - DNA, 1501 bp, Oryza sativa
gttaaacgagtgtttcagtgacacaagtaggattggtatttggctattagagaaatggtcaaataaattcctcaaaatgatgtcataaacctgactggggtaagcagagacagatgccacttacttagaaggaaaaaaaaaaactgggccataacttatggagtaaaaaccaaagcaggctacagtacagattggtacgcaagctagtgaaaaatttaattaacaatcatgcttgcactattgtacagctcaatagccccatttcgtatttgcgccaagctcttatttgtggtgtgcctcatttccagtagtaataattagtaaaggaccctaatcacatgaatccagcaattccatctacacgaattacttctgcaaacgctcgctcaagttcggtttaaagagacagggaggtgttcgaatcaatgatctcccagcgtactaggccatgataaactagtgatgccgcaatctgccaatccatgagatcaagaagcacacacgagtactacactgcctacaaatcagagcgggttttgcggcaggagagagagaggtgctcacatggtggggttgtcgttgggcacggcggcgagcgccgcctccttctccgacgccatggtgagggatcgatcgaacttccccgagcacaagtggtcgccgccgcgagtgttcttatgtggataaaaggcacaccagagacgcaaaccctcgttttccacgtcaatttactattctgcccttacaattttgggtcatgcggctcatgccatgcccattttggttaaatctaaaataccgattgcagggtgcaaactctactaaatcattaggccacgtggccaaaccaaaaaccaagttcacatatcatcaaaatatgccacgtgtccagaagagcacgttcattttgaacgtgtgtgaagagtctagataaaacaaaggaaaaaatccagagcattctaaactcggttgaaaaaaatcacatgataacacgaaaagaattagtgaaaaagattgcatgccgaggaaacaatggataagaaaaaaatagtatccaaaaaactgccacaagttttttaaaggaacaacttttaaatctaactataatataattccactataactataccataacaatattgtaacttgtatataagtattaaaatactatatgcaactttatatcacttatatagagattacaatatagttaaagtagttacactattgtgtacaatgtaactatagtgtagttacattgtagttatactacaactatactatagtaacatttaaaagttttttttgccaaaaaacttgtgacaactttttagcaattcccaaaaaaatataaacagcgagccgatgttagctgtcgtaaaccggcaacgaggaagacatttaccgcaatattttccggatccacggaagctgttgccaacgagcaagatccactcactcaatggagcaagcggagggcgtcgagccgtactagctgtga

SEQ ID NO: 13618 - DNA, 318 bp, Oryza sativa
acacatgcatgatttaaaattaataaaaattctaataatcatatataattagcatatgcatgatattaaattgttaaaaattaaactttacatatgtacataccacatgcatgatgtaaaattaataaaaattctaataatcatatataattagcatatgcatgatattaaattgttaaaaattctaattaacatatgtaaatgccacatgcatgatttaaaacttttaaaaattctatttatcgcatataactagcatatgcatgatttaaaattgttaagaattctaataatcgtacgtaattaacatatgccata

SEQ ID NO: 13619 - DNA, 1501 bp, Oryza sativa
aaccttaatttacgatagtgaactaatttaaaggttgcgttcgttgttcctagttaggaactaatgtgcagtgcacgtaaaatggagtgactcattagcgcataattaactaagtattagctatttttttaaaaagaatagattaatatgatttttaaaacaactttcgtgtagtttttttctaaaagcacacctttaacattttgagaagcatgcacgtggaaaacgaggagagggagttgatcctaaagtaacgaaacacaacctatggccctatttagatctcaccccaaaaattttcatcatatcacatcgaatgtttgaacacctgcatgaagtattaaatataactaattacacatattacgactaatttgtgagacgaatcttttaagcctaattgctccatgatttgacaatgtggtgctacagtaaacatttgccaatgacggattaattaggcttaataaattcgtctcgcggtttactaatggattttgtaattagttttaggtccctatcacattgtatgttggggtactaattagaagtattaaacgtaaactaatgacaaaacctattccataaccctggactaatttacgagacaaatctattgagcataattaatccatgattagcctacatgatgctacagtaacacgtgctaattatagattaattaggcttaaaaaatttgtctcatgaattagctctcatttatgtaattagttttgtgtcagggttatggataccacatacctaagagtagttgactaaatctcggcaggacccaccacataccatgtcttatacggaaacaaacttcggatatagaaggagttccgcataaggaaggatgactagagttctacatggaaacgacaaggactactcggattttatccatattggtttccctagttctacttggacatggggacacctatgggtataaatacaaggccccttaggaggagaggggacatggaacaatagacgccacaaaactacaagccaatacaagccaacatacgccaagacaagacgctggatatcgacatcagagatatgcctagaccgaccctatccggtacctacggaggccggctatagggatctagtgctgtctctgatctcgccgggcacgaactcgaggaggaagactaccctgttgtcgactatgagtcaacactttagaccatcaagtcaacaacagttagataggctacctcaaatattgttctggtgtgattatggtgaataagagcaacgaccggcttcggccaacaggagtagggttattacctgacaattcaggggcccgaacctgtataaaaatccttgtctccatctcttttattacaatctcgcatatatcctagtaccaacgatccccatactatgcaaataccggaatcgcaaaatcaaacatcgacagtggcgcgccaggtaggggacttttggtgcttcaggattttgacgagatgggtttaagaga

SEQ ID NO: 13620 - DNA, 757 bp, Oryza sativa
acaatgtacttaactccgcgacattaagtgctataggatgaacagtgtacttaacagtgcaaaatagacagaacctaacggcgatggcattttgggacaaaatcgtttgtacgatggtatttcttggaactcacacttgctaatggcattttttggatttggacgcttgtcaatagcatttcttggattatctcaaagatgatggcgccaagaccttgtcacacgttgtaagcaatccacgtcactagatggtcagctccaggaaccatccacgtcactagatggtcagctccaggaaccttggcattgatggaataagccttgtgctcttagtagccttgttggtttttggtctttgtcgttctgttttgcttttagcatcttaggacagcatcctttcagttttacttttagcatcttaggacaacatcctttcggttttgctctttagcatcttaggacagcatcccttttatgctttatgttttcctttcacctttagactagcccgcagctagcaagctatggctataaatatgtatccaacctcccccggatagtatgacttggtactagagccactctatcctgtagtctagacatctcttgctcatccccttcacgagctcccctctgtcctcaaccggcagctggaacatcggctattcctgctcatccctcttcccctgcactgacgagcagcagctcgtcagaggcaaactcttcccccacactgcaggcccccaatagcatgcca

SEQ ID NO: 13621 - DNA, 235 bp, Oryza sativa
ccgccacgtggcaatctaaaaacgctcctaagccacctcgtggcaaaaagtccattaaacttcctacaaacgctcttaggccgccacgtggcaatctaaaaacgctcctaagccacctcgtggcagaaatacatccaacccttaattttcattaaaattggtggacccattattgtggaccattagattagattaaaaaaatcccaccccttctcttccgcctatgtatgacagg

SEQ ID NO: 13622 - DNA, 1501 bp, Oryza sativa
ggggggagctcggcgacgcgcctgcgacggacagcgcggcggagttcggcagcgcgcttgcgggggactacgcggcatagctcgacgccgtcgatctgtcactgttgcgtttggaggcggcgcggaacaatgacaacgatgaagttaggtgctagatccaccaccttctcttcctccgccgccggcatcttcctttttacgccctacgccaccgcagttgctatcttctcttcttctccctataccgccgccgccgttgcatgggtatgggggcgtcgcatggggccatgccccctcccaatgtgcccctcgccccacgcctgccagttctgacgaagaacgggttgctttgtttggctccgtgttcttcggttggaaaaggtagatgtgtgcgtggcgtcgaattttcgacgtggatggtcagggttgaacgctatgagatcctgagttaacttttcgtggaatcgttctttagtttctcggctcgagagtagaaaactagaaatgtacaatgatgtatatatatacagtgctgcatactactgcagagtgcagagcttaagtttcatgtgtcaattatagtacttatgcatttgtaagagagagtatcaataatattcaacgggaaatgatggattaaagaattaactctgtcagcacttcaactagtaatgtcaatgatggatcaacagtccaaagtccataatatactaagcacgcaactagtaccaaatgtcagcgtaacttctagaagtagataatgaaaacactcagaagcggaccaaggaaagagcttatgtaattatattaatcaccatcacttgtatttgcataaggacgtaatgcagatcgctattactcaaaagctagattgttcaaccactgcctataaaaatcataaaaaaaagaaaaaaacataatacctcgaacgaaatcataggacgcgatgcatatacgcatacacgattgagcgcctgctagctagcggcgacacgtacggcggtgtcactcgcacaccgtatggtgatggggatggccatcagcagccagatgggtgttggggccggggcgcctgggactcgcgagcgtgacatatccggatgcgccatttacgatcgagtggatcgctactagctagctgatctatccggtgcggtgacacgctcacacacactactccggtgcggtgacacacactgacacggctttcctgggccatccatgccggccacgtggtccgtgttagaattacaagagtcctcgtacatgtgacaatgatacacgcatatgttaatacagtgtatatgtcgtatctatggttagagatagaatcggttttagttttctttcatgtattgaaagatgtaatatgtctccaatctgtgagggctattcttgcctatattaacatgcaacgcggcctagagagaggtaagatgcttctgccagatttacatggtatcagagcaggatagccacgacgagattgcatctacggcaa

SEQ ID NO: 13623 - DNA, 1501 bp, Oryza sativa
atagcgccgtatgattataacaaacaaaacctagattgtttacaccaataatgacacacttagttccctggcaggaaggaaccacacgcccatctttccagccacgcaacagcaagaggaagaacaacacccgtctcaagtcacactaatcaaattcagcagacgcctttacggtctccatcgtttggcttatttcctaataagttaaaacggcttattagaaaataaaaataaatttgtgggtaaaacttttataaatatgttctttgtgacttaaaagccaatgttaaaaagaaactacgttaaaaatatctcaaaattaagctcgaaaatttaaaatttggttttttttagcttattatgctatccgatgggagcctactacttttaacattaacattgcatagactactagtagacaagtagtagtagtagaaagaagaacataatactaccatcttgctttggtcaaagggaaacacatatggccagcatcaggcgatgtcaatggccggaacagcgagacatgcatccaaagatacgagatattcctacaatctatcaacagtatggatgcacactggctcttgctggcactaaagctacggcctttttctgcccaaaagccggtgaatttgcaagctgttttatgctttgctgcactctctcgcgcggagcaacatattcgttgtttcgttaggtagcgtgcgctcgctttgttctttttttttcttttttctcctccaaattggatggccgggaatggctggcaatttggtccccggcagctcaagcaactaagtgagtgagcactcatcacgggcgcctcctagttgcaagccatcaactacacaattattgtgatgcttttgttcacatctttcatattggtagctggaatgaaatgaaatcgtacagttgttgcgtcgatgtggatacagaaattaaagaattatagaatgggggaagtggagatgatcacaattcacaagcatttgtacaagttggtgacatctctttttctctttgtgttacttatgagacaagagaaatatgtgacaagatttggagagaaatggatctttgtataattgtatgtgcagtttatcaattactcaaactggtcccatgaaccaaagaatcgtgaaggccttgaaggcaagaaacaatttttttttttgtacaagcattcgttgtgcgtgggaaaaaaaatcgaaattttatctgctcctatgaattaatcaatgtggccgtggtggaatttcacgacgctgtaatggccgtcgtcgtgacgtcggaggtggcggggtactccgcggtttgctccgccgcggcccaacgccggcatgccctgccgagcgacgcggccttgcgccgcgcgcgctccgtgccggtggccatcagctcccatatcgcccactccacgccggagaccgacatcacctgcgccaccacggcggcgcccacgcggcggcagagcagcaccagcgcggcggccgcg

SEQ ID NO: 13624 - DNA, 1501 bp, Oryza sativa
cgtggccggcatggatggcccaggaaagccgtgtcagtgtgtgtcaccgcaccggagtagtgtgtgtgagcgtgtcaccgcaccggatagatcagctagctagtagcgatccactcgatcgtaaatggcgcatccggatatgtcacgctcgcgagtcccaggcgccccggccccaacacccatctggctgctgatggccatccccatcaccatacggtgtgcgagtgacaccgccgtacgtgtcgccgctagctagcaggcgctcaatcgtgtatgcgtatatgcatcgcgtcctatgatttcgttcgaggtattatgtttttttcttttttttatgatttttataggcagtggttgaacaatctagcttttgagtaatagcgatctgcattacgtccttatgcaaatacaagtgatggtgattaatataattacataagctctttccttggtccgcttctgagtgttttcattatctacttctagaagttacgctgacatttggtactagttgcgtgcttagtatattatggactttggactgttgatccatcattgacattactagttgaagtgctgacagagttaattctttaatccatcatttcccgttgaatattattgatactctctcttacaaatgcataagtactataattgacacatgaaacttaagctctgcactctgcagtagtatgcagcactgtatatatatacatcattgtacatttctagttttctactctcgagccgagaaactaaagaacgattccacgaaaagttaactcaggatctcatagcgttcaaccctgaccatccacgtcgaaaattcgacgccacgcacacatctaccttttccaaccgaagaacacggagccaaacaaagcaacccgttcttcgtcagaactggcaggcgtggggcgaggggcacattgggagggggcatggccccatgcgacgcccccatacccatgcaacggcggcggcggtatagggagaagaagagaagatagcaactgcggtggcgtagggcgtaaaaaggaagatgccggcggcggaggaagagaaggtggtggatctagcacctaacttcatcgttgtcattgttccgcgccgcctccaaacgcaacagtgacagatcgacggcgtcgagctatgccgcgtagtcccccgcaagcgcgctgccgaactccgccgcgctgtccgtcgcaggcgcgtcgccgagctccccccgcgtcatccgctaatagtcggaggaggaggagaagcggcgccgcgcttgggctaggccgccgccgagctccgttgtgccgttcgttgcgggtgcgtagctcagtcgccagggagacgctcactttctctccgccaggcaaaattgctaggagaggagagagatggggagaaaaagtgaaggagaaataatgacgagacccactacaaatgatttgtattgtggagcatatgataaatacagttcttagtctacgtgttatgtagggtt

SEQ ID NO: 13625 - DNA, 1501 bp, Oryza sativa
tcactaagtttgtaaagaaatatagtaataatatttatattaccaaattagttttattaaattaataattaaatatatttttataataaatttatcttgggtttatttaattaaacttaaaagtttaaaagtagtttgagtttgatcaaagccaaaacatcttatcacctaaaatggagggagtattttatactactagtttaatccgcatgtgcgtgctcgatctatctatcgcgcgtgttcggtgacctgtataacttgatcgcctgtttacttttggggcggtcaaactgggatccttttcatttgcccggatccgtgaagaaaactttgaccgctacgtggcgttggatgctgatcgtgcgatccggttttggccggtttgtttattattctcgccttcgtctggcgtgagaatgagatgagatcgttcctgccttcattgctgccgtactgcgtgtactatactgtgtggaattcggcctgggcagctgttgattttagccatcggcggcggtggccgacgtgaatgagccgtcgccgccatattttgttcctttcggttgctacttctatagtaggattatgttgttgggttagtacagcgacgggtactgtaaatttatgctcgtttcttaatttcctactctacttttgattttggggattccttgtctatctgtttggatcaacgtgacattagatttgaatctagctagctggaaagctctcaaggcgtggtgcatgacaaatcacagatgtataacctatttgcattcaacaaactagtgtaacagtagataaagtttccccgcgttaagcaattcttcacaaaaggaggccttagcccttaagcttcgcgtaggcctgtgagggaggaagcatttagctacagtccttttacattcttcttttttttttttgaacgaagtacttttacattgtgttcaccaacagatcgaagaggaaatggtcacgagtgaccctgccgccctgcacacacatgcacattggcacgagcttagaggaatatttccaacccttaacccggccttctcataagaaagcattgcttggaagcgatccgatcaactcaaaaccaaacccagccggccagccagccccaagctgagtcatcaaacacacccccaccaaaacacacccatctcacccgtccatcgaccacaatccagcggtcagaaactcacaacatcttcttcagtctatcaaaccaaaaaaaaaaaataataaggagaactcaataaaataagcacacgatgggtagccatcacatcaaggtaaacaaaagtcaggaggattccttccaggttccacttccaaccccttcccagctctcgaacaactcaacgcgctaaacgtctctctcgcacgtatatatatactacggcctcacgccttcgtctccgcaaccatacaaatttttttctgagttccaattcgatttgttcgttcggttactgcaaaagaaagtcagcaacaa

SEQ ID NO: 13626 - DNA, 1213 bp, Oryza sativa
gttggggcccgcgtccgcaggtggtacgcgcactgggaggtgcacgcgccacgctggagctcgcgcagcgtcaggccttcgtggagcgcgtgttccacgtcgccgaggaggacaacgagcgcttgtcaagaagctccgcgcccccattgaccggtaaaaaaaaaaaaaaaccgaaccaacaaccacccgatcgagtgaaaatggccatggatggcacggctcgagtccggccagtgattgactagatgcgacgtgtccgacgacgacgcctcctcgtcatcggcgccgccggccatggacgacgacgacggtggcccacgcttaccggagaagaaccgccagaagtagaagaacacgaggaggaccatgagcaagttgatcccgacgacgaacgccgtcagcaccgcgccgtgcggcgcccagtgtttgttcgcatcctccaccgcggcgccggcgttggcgcagggctcgggctgccgctctggaccgtcgacataaagaagacttggagagagagagaggggatgacatgtaggccccacatgttagtgggtcctacactatatttttgtgtgtgtgaatgacagatggatcccacaaatattttcttaattctaatgccacataagcgccacatgggagtaagactaggtcaacacagccacatcagtgccacgtcagcaaaaccgtcctccaaaaccactggggagttaaattgtactggtttcaatagttcggagagtcgttctatccggtttcctggttgaggggtacatattagattcggtctactttaaggaagtcaaagtggagttttttcaacaaaaaaaagaaacctccatgacatagatgcacaagcccaataaatactttggtggtggctacaaaggaataagttcacttcacatcccttaatttgtcgacgaatctaaaattcgtccctaaaccgtaatgcatccctcagtttttaaaactagcgcaagtaaagtcccaatgttagagataatataatcacgtataaacaggataagagaaaaaccgaactagatagagataaggttgttgttgttacatgtaaatagggattcggttttcctctacctgtgcacacagctatatgtattactcccgcacgtttgagtgcgctaattaacacggatcgtcgtatcaacgacgttaacctagattagtttcttttcatggtatcagagcc

SEQ ID NO: 13627 - DNA, 1501 bp, Oryza sativa
agggccagctccggtcgtcgggggcctcgggccgccgttcggctcgggggcctctcctccctgctctctcccgggtcgagtcgacacagggtgctcttcgtccgagaggccgcgcggggcgcactcggcttctgtgccgacgacatcggggtcagagggcgacaagcgcgaccttcccgtagtggccccggggccatcctgggggtcgggggcgcctggcaccgtcggacaagcgggcagagggccagctccggccgtcgggggcctcgggccgccgttcggctcgggggcctctcctccctgctctctcccgggtcgagtcgacacagagtgggggtgcgcggagcgagggttgtcctcgtcgcgctccacgaccaacgccgcgctgaccacctgcggggttgccgccaggtaaagtagcaacggttcatctggtttcggggcgaccaggaccgggggagaactgaggtacgccttcaactgagtgagggcccgttcagcctcctccgtccaggtaaacggcccggaacgtttgaggagcttaaataggggtagcgccttctctcccagcctcgatatgaaccgacttagggcggccatgcagccggtgacgcattgcacatccctaagtttgctgggggggcgcatccgctctatagctcgtatcttctcggggttggcctcgatgcctcgggcagtgaccaagaacccgagaagcttgcccgcaggcacgccgaatgtcacgcccggaatttctatccaaaattccaaacgcttacatgtgtgttaaaccctcgtccaggaatcaaccgaggcacacaataacaaattgataatagagtacaaataaataactatttaatgttcgcaaataataaattactacagaggtagatagttcctctcaaagaataaccttctacgcagcggaaatataaaactataacaaactacggaacagctatggcgactccactccataggcatcttaaccagaacaagctcaatccttcagatcatcaccttcgctgaaatactcctcttctgatgattaaatattgcaagaatgagcatatgacatactcaacaagccacacagcaaatatgcaagtgcacaggataacaaaggatggcataatatagctcatttgcataacagcatttaacaaatatttaagagaatagtaaaacagttgtataattaatcaatattaaataaacaccatacaacacacccatgttgcataggcccaaccatcctgaacaaccatacccggctgtacagatttaactccaaaccaggaactaagcaaattattaccaggtataacatctataattattgtgagaggtgtgagactaatcacgaaaaacattgctcaactcacccataaccgcgggtacggctattcgaatagattaaactctgatcagaggtgtaccactgtacccacaagacacaatcccacaacatgttaccatgcgccttagtaccaccacg

SEQ ID NO: 13628 - DNA, 1501 bp, Oryza sativa
gtctttgggaaggagtggccgccgccctacctcgggcctcgctcccctcgggggagggccacgtggccttggggggcagcctcctccgactagtctttgggaaggagtggccgccgccctacctcgggcctcactcccctcgggggagggccacgtggccttggggggcagcctcctccctctaaacatgatacccccggcccatatcaccgacacaattcaaaagtaccctaaattttccatccattctttctcatgtctaaaaacaactcttttatgtattgcatcttcagaatcttctatccaatttttccccttatactcacattctcacgagctaagggcccctttgaatcgcagggtggaaaaaatggcggaataggaaaaacacaggattctcaaaggaattgaagtgtaaaacagaggattgcaaaacacatgaaaaacacgggaattatcgtttgattggaccgcaggaaaaacgcaagaatcggatgagagagatagactcaaagaaagttttccaagaggttggagctcttgctaaatttcctcaaaaatctctatgggtgtatttggataatgggaaatggggggtgggattgggattgggaaatgaatgaagggttaggattaaatggtagagggataatgaatggttagaatttaaagatgggtggaaaatcatttccctttgtcatttgctaaacactgtctataagattgtctattccataataatttcaaaggaatggaaaagattcaatcatttgattcaaagatattcataggaatttttcctatatgattgaaatccttcaaaatttttatgttttttctccaaatcaaagagacctaaaagagaagacggtcatttaccagattataccaaacataccgagggggcaatgatgatggccgctcatgattcatgagtggaggtggtaggccgacagacactccacttgagagagggggtcctggaccatggctacgacctacgagggtcatctggtgttgaatttgtctgtacaattcaaacgacacagaactgtttagttttatcattggctctgtttggatccggagggctattaaatagccctccgaaatcttgctatttagaagtattaaacgtaaattactgacaaaacccattctataacccctaggctattttgcgagatgaatctaacgaggtatattaatcaatgatttgctacagggatgctacagtaatcagccactaatcatagattaatatatatcattagattcgtctcgcaaaatagcctaggggttatggaatcggttttgtcggtaatctatgtttaatactcctaaatagcaagattccggagggctatttaatagttcggaggatccaaacaaggccattgttgatgtagtactctgtaggctgtgtttagttcaacgcaaagtttggattttggttaaaattgaagataatgtgactgaaaagttgtgtgtgtatgacagg

SEQ ID NO: 13629 - DNA, 580 bp, Oryza sativa
cattggctataaaatcattgaaatacttagaatcataagaatattataaaatttgaatcctagaaatccttatattttgttttggcactgtggtgagcttgctattaccaaattttgtagtaaaacaaacagtaccattaaatggtaaaaaaatgtaagaatttgttaggcatcaattcaaataatcccttaatccaaaatggcttgatgatttttcgaaagttggcttgaacacaggaagacaagatagaatatacttgcttttgttgtgtcttatttaaagcatttgtcagatggttggaatggttgcacacgaaaggagcacttggtatcggtagcttaaataatcaaacaatggaaatttgtgataccttgaaccttgttacaaatagctatctgtctgatcctcaaattcaagctagtggggttaagagcgagttgacactccatatatatctttcatgtacacctctgaaacgtaagaaagctcatctgaccgcagtttagctccctcttagacagaggccagagggagaaagagagagagagagaggagaaggctgagactgaacattcaaga

SEQ ID NO: 13630 - DNA, 1501 bp, Oryza sativa
aagaaaagggggtgagttggactgacatgtgggacccacaaattttttttattattttctatgtgagactgacatgtgggtcccacgggtcgaattgccacgtaagcgccatgtcaatgccacgtcggacaaagaccgagtcaaattagccacataggcgccacgtcagccaaaaccgctcttaaaactgccgagggatctaatctgcaccggttttaatagttgagggacccgttgtgtctggttttccgatcgagggacgaaaatcggattcagtgtaaagttaagggacctcagatgaacttattcctattttaaaaccgataaatttttagtggcatgtatctaattaacccttgaaaatatatcctggagtaagtcgccatatttgcaaaaatagaagttcctataaaaatacaaaatgaataatcctagctgataggcagaaggactggaaccatattaaaacaaaattaagtctttatcatttttaggttgaaagaaatgtttttacggttggttgcatttttctattcttattatctatttgtgggtctataaaaatacttttttgttatggcaaaaattgttgcatgtaatcaccggtatcatatagtgtcaaatacattgctatatttgctttttagttcaaacataagtttgaaagcaacatatcaacggcaccggttatcagttttttttttggctgatccgtatttataagagaaatttcgttgtgtgacctttgttcgaagggattcaaaaggtggttatgatttcaatagtgttatgggcttgtttgttttggaaccaatttttgccatgccaaaatcttggtagtgccaaaacattaacaagttttggcactactaaattaggttgtattgaatttgaactaatgtaggtaaaatttagtagcaaaccaaacaatcacttttcactattgaagttaccaaacttttggtaggacaataagttggtataaaaccaaaccagccctatgtgtttaagggcatgtgactaattgatgtttgtaacacgggtgttgatgcgaaaaacacatactggcctggaagatctgcttaacttcagtgcaggtccaacaatcttgcctttaggttcgtgagcgtgccagttgatttgatcctacaatcaacaagaaataaagacaggaaaaaagcggttaaatctataaacgatagccgatcggccagtcgccgatgacgtatcatttatctttcagccgatgtcatatttgattcgatcgacagtcataaataagtaagaaagaattaaatatattcgatcggctatagatatcaatggtatataatactttcatcgatatatacttaaatcaagtgattgggatagatcggtcgccataccgagacaatagatcgaaatatatattaatgagaagattatagacatttatagcacagccgatcagacagatccaacatgtatcggctaatactccgatactactctatattaa

SEQ ID NO: 13631 - DNA, 1501 bp, Oryza sativa
gtagtatcggagtattagccgatacatgttggatctgtctgatcggctgtgctataaatgtctataatcttctcattaatatatatttcgatctattgtctcggtatggcgaccgatctatcccaatcacttgatttaagtatatatcgatgaaagtattatataccattgatatctatagccgatcgaatatatttaattctttcttacttatttatgactgtcgatcgaatcaaatatgacatcggctgaaagataaatgatacgtcatcggcgactggccgatcggctatcgtttatagatttaaccgcttttttcctgtctttatttcttgttgattgtaggatcaaatcaactggcacgctcacgaacctaaaggcaagattgttggacctgcactgaagttaagcagatcttccaggccagtatgtgtttttcgcatcaacacccgtgttacaaacatcaattagtcacatgcccttaaacacatagggctggtttggttttataccaacttattgtcctaccaaaagtttggtaacttcaatagtgaaaagtgattgtttggtttgctactaaattttacctacattagttcaaattcaatacaacctaatttagtagtgccaaaacttgttaatgttttggcactaccaagattttggcatggcaaaaattggttccaaaacaaacaagcccataacactattgaaatcataaccaccttttgaatcccttcgaacaaaggtcacacaacgaaatttctcttataaatacggatcagccaaaaaaaaaactgataaccggtgccgttgatatgttgctttcaaacttatgtttgaactaaaaagcaaatatagcaatgtatttgacactatatgataccggtgattacatgcaacaatttttgccataacaaaaaagtatttttatagacccacaaatagataataagaatagaaaaatgcaaccaaccgtaaaaacatttctttcaacctaaaaatgataaagacttaattttgttttaatatggttccagtccttctgcctatcagctaggattattcattttgtatttttataggaacttctatttttgcaaatatggcgacttactccaggatatattttcaagggttaattagatacatgccactaaaaatttatcggttttaaaataggaataagttcatctgaggtcccttaactttacactgaatccgattttcgtccctcgatcggaaaaccagacacaacgggtccctcaactattaaaaccggtgcagattagatccctcggcagttttaagagcggttttggctgacgtggcgcctatgtggctaatttgactcggtctttgtccgacgtggcattgacatggcgcttacgtggcaattcgacccgtgggacccacatgtcagtctcacatagaaaataataaaaaaaatttgtgggtcccacatgtcagtccaactcacccccttttcttcctcctctct

SEQ ID NO: 13632 - DNA, 1501 bp, Oryza sativa
atccggtgacgaggagcgcacgaagtgggtgttgttgcctagtaggaggggatccggtggttgccactctattagtttcacaccctatggaggctggctcaataagaactagttgtggtaggaggtgcgcatccaagcattgaaaccgccacatcagcgtgcggcagcctggtagagctcattatcgctgggatgggagggggaacaagaggttggggatgggagtggagggggaggggaggagaggaccgcggatgaccatgtcatcgtcaaccgttgtcgcactcaccgatagtcgctcgagttcatccttcggccgtctctgccattgttgcccccttctcgtcgaccgctgccttcccatggatgagctggcgagcttgtcaaccgccactgtcggagagaaggaggaaaagagactgacatatgggtccattattttctaattttttttcactaacatgtgggtcccattaaatttttttatttttattttcgtggcacaggttccatttagttttttatttttattttagcgccacatcattgtcacataagacgaagaccaagtcagcatgccatatggatgccacgtaggacaaaaacactagccgaaccgccgagggactcgatttgcaccggttttcaaagatggaggatgcgttatatccagtattgcgatttgagagacatgattccattaagggcagaagttgacggattgagagacgtttctattgttttctgcacacacacttcccgaactactaaacagtgtgttctttcaaaaaaaaatctatatggaatagttgctttaaaaaatcatattaatctattttttaaatttaaaataattaatattttattaattatgtgttaatggcttacctcgttttgaatatcttcttagtcattttccccttcctctcaaacacagccttattcctttggaaaaagtccactttgactcccttaattatcggcggaatctaatttgtgaccctcaaccgcaaaaccggataagacgactccctgaactattgaaaccggttcaatttgactccctcagcggttttggagggcggttttgctgatgtggcgctgacgtgtcgatgttgacctagtattcgtctcacgtggcgcttacgtggcattcaaattaaaaaatatatgtgggacccatctgtcattcacacagaataaaatatattgtggaacccacatgtcatcctctcttatctaccttcttcaacctccccctctctttctctctctttttgttcgcgagcgtgggatgagggccagcggtgggagggtgggcgggcgaaggccgaagcagggtccagatcgtcggcggcagcggtggacgggggccggagcagcggtggccggcgcctcctccaaccccatcccggctagagttcacccagcccggagcggagtccccctcgccgcctctctttctctccccccgcgagtcgtcgacgtcctcgcccgtccc

SEQ ID NO: 13633 - DNA, 423 bp, Oryza sativa
cccacaatattattttttgtgtgaatgacatatgggtcccatatatatattttttaattcgaatgccacgtaagcgccacgtgagacaaagactaggtcaacatcgacacatcagcgccacatcagcaaaaccgccctccaaaaccactgagggagtcaaattgcaccggtttcaatagttcggggagtcgtcttatccggttttacgtttgagagtcacgaattaggttccaccgataattaagggtgttaaagtggactttttcctattcctttcccattggtgcccctagcccattggcaccgcgaaaaagttttggcccaattatcggttggccagatttgcatcgatctgtttgggctggcccatgtgtaaagggtaagatgagctaatatctttctgcgtttttgctgctggacagg

SEQ ID NO: 13634 - DNA, 1501 bp, Oryza sativa
aacagctcataggcttaccaatgaacaatctttcccaaatttaatgagcacaacgatgagaacagggtattagcagcctaattaaacagcaacagtgccacatgatacattcatcaggatccaccggaggcggcagggcgtcgacgacgaggccgcgcatgccggccttgagctcgttgtcgcagaacctgcggtactcggcggtgtcgccggccttcttgcacacctggaccatgacgagctcccgcgtgagctcgaacaccttggaggagatggcgagtgcgcccttatgcccgttccgcgtcgcctcgatgctcaccatgccggcgatctcctccagcttggcgatgatgtcggccaccagcgcgccggacatgaagtgcatcctctcgccgcgctcctcaaacagctcagacaggtcgaagctcagcgacgacgcgatgatgtcgaacgcgttcaggctcttgggccgccgcatgcgcggacgctgtcgtggcggtacgcctccccgacgtggcgtcctctgctggcgagcctggtgccgaggtaggtggcgcgaaactcgtcgttggtggcgcggaactcatcgtcccacaggtcgtacgtggcgcgcgcttctgcctccatccgcttcaccatccccagcccccgcacgccgtgctccgtgttgtacctgatgatcgacatgatgtccagcggcgccgccgctgcgggggagcgaaggcgacgaggaggaagcaggccacgaccagcaccgcggcggcggacttgctgccgccacctgcctgagagagaaaaacttgtgggtgagagagagaagagatgggagagctaacacgtggatccaggggtattttcgacatttcactcaatttctctctccccatttaccgaaaattattattttaatgggtgcggtgtccgctagcaaattaccacgtttatatggtgtcttctcccaaaagtatagatggccaaaaggcccaaggcccgacggcccggcccatggcacggtattttggcccggcccaagcacggcacggcccgacggaggtcgggcccgtgctggcccggcccgaccaccgggccgtgcctgagcccctccaccggcacgttgtgctggcccggcccggcaagatgggccgacagctaggcccgatacacaaaaaaaataggggactaaaaatagacatattatatgccatggacgaaagaaaagggacctaaaatagactttttttatctatacatatgtcagccaaagaggagggacagagaatagacttattttagctatacatatgtcagcccaaagaggagggaaggaaaatagacttattttagctatacatatgaaatagcccaaagaggagggatgaaaattagacttattttaaaaaaggcccgataggccacccatgccttcgggccggcacggcacggcccgacaactagtgggccgtgcctgggcgggaggtgcagcccatgagccggcatggcc

SEQ ID NO: 13635 - DNA, 1501 bp, Oryza sativa; identical to SEQ ID NO: 12559

SEQ ID NO: 13636 - DNA, 1501 bp, Oryza sativa
cggttactaggtgtgcatcttatgtgatcagcatgacttcacatatattttttaaccaaattataagtatattggatgtccgttcacaatcatacaatcatgatggacaatcaagccgtaaacgatcgcgaggagattgttccgtgaaattacctacgtgaggaccgatggatcgatcaaccaatgcgaacttggccgaaatcaccagcatttatatatcggtgctagtgttgcatgcttagattggtcgatcgatgatccgactcggacaagaattggtttttctcctttttttttttgggagtttattaatgacaagaacttgatttatactagaaaaaatatccgtctatgcaacaagaaaaactaatgttataacaataattatagtttattttaaaaaagagaaaacatattcttcacttattggataacaacttacaaattcaaattgtttggcattttcatgtattcctaaactgtatggttgattcccactagccaacatgatttaaaccatcgaggttttggattttgtcaccctcttccgataggaaactatttctcctgattacttttagaatatttcacaaaaaaaatgaatttagaaaaagaatagatgtgaccaaattttgtttaagattttaaattaattcaaaccaaaattactgcaatttccaaaatatcgatcctatctgtgtctgagataggaataggcaaaccgatagcacgcacacaagcacacaacatcggtggtctcgtaacctaattctgtcttagctccttggatggagcatagccgatggacctacgtgtacgtgaactgatcacggtcaagtagtagtaaaaaaaaaaaaatcaaagtgagggagagacgaacatatgtgtgttctcttagcttttcacggttgcatgcaatgggccctccggtttgacagctctgagcttcgatgcgtcaatggtccatagaccatgtctatggcagcacgaaccattgcatccttaattccttatcgatctctccagtggcagagtgctccatattcacgaattcttttgagaatcaatattatccttatggaaaatcgcaaaagtaggggtcaacccggggaaaatcgcgacagtaggtccctggcgacgggtgcagttcgatagggcgcctatcgaacggccagagcgcgactggcgaggagatcggaaggctgccgttcgacaggacctgtcgaacagcccccgttcgacaggcagggctgtcgaactgcccctgttcgacaggatatccgtcgaactggcgcagttcgacagggtcgtgttctccatttattacgaacagcccccgttcgacaggcagagctgtcgaactgcccctgttcgataggatatccgccgaactggcgcagttcgacagggtcgcgttctccatttatttgtaataagttattttttttaataatatgtaatttattttagtgtgtaagaaaggaaaatatttttgtaatgt

SEQ ID NO: 13637 - DNA, 1501 bp, Oryza sativa
atccttggcaggctgcgaatgctccgcagactcgatctatttgcgatggggaatgcaattataagaattgggattcatgacaccctgttgttccgcaagttgagattctgcacgatggccacgacctccatccggtttgtaccacctcctgctgctagtgctgccgtcacaacacctgtctcagtcatgccatacctggaattacttcacttcagcttggacgtgcacttcttcaaggacaggaaaattgcttttgacattggcttggagcacctcccgagttctcttcgcacagtaaaggtttttgtgctctgccacttagccaaagaagaagacgtcaaggaggcggaggcggcattgttgcactccgtcagcatccatcccagccgtcccgcccttcaactcgaaagattggccgaagataaaatgctcccttctcacctcaaagatgatcagtgaacatcgtagccatcacatatctccccagtcactctatctgttggaaatcattcatgtgatgtactaagataatgtaccctgtattgcatgcatagtttcttggttcgttgtgtaatatcaatgaataagtctattttgcttccctcagctcatgtccctggttgaatcacatccctcgattgcaaaaccaggtataacccatccccaacttacaaaaccattgcaaatcgactcctcgagcggttttatcccacgtggcaggttgacttggtcttcatccacgtggcaccaagccttaaatgggacccacatgtcagtggagtaaaacaacaaaaataaattttaggcccacgtgtctccttcctctttaccctctctttctcaccctcaggtggatggcggcagtagcgagcgagatggagctccacaagctcggcggctgcggctcacacgcggggagggctcgcctgcaaggactttctgctcaaaagaaacttccataaacaagaggaacaccaaaaatgactttgtgttttaagttgaatgaaaagtagtggcatttgtacatattttgtcatgtacgatttcaacctacaaataacacatatcattattcatacatatctattgcagactgaggtaaacaatacaatgacacagaaagtacaataactataccatatgaatgtctgatatacagaactgttcattaaatgagtttataaaatataaaacatgcatggatcggataatcgatcttcaaaattttatagcaaaattgctagtctttcaattggtttgatgaaaagcaatcaacaattcaaatctaattttggtgatgttttcggctttagttatatgcacatgtaggatgtttccaagtattgtttgctcttgctaactgtacaaacaaatcaaatcagtgtttcttatagcttagtggtattttgtctataaaacttatctaaaaaagggtttcacacaatacccaatattttaaaaagcagtatgcagtttcatgcggtcacccccaccttgtagc

SEQ ID NO: 13638 - DNA, 1501 bp, Oryza sativa
ttcctctcgtatatatcttaggtgatttggacataaatacaactactccattcatttcatattaataataagatgttttaatatttttttttcaaacttctataactttatcaagtttacatatagaacatatcaatattttcaacacaaaacaaatatactaataaaatttattaaaattaatttggtattgcagatgttgctaaaatttcaataaacttaatcaaatttaaaaagtttgattaaaagttaattaaataatcttctcataatatgacggatggagttagatgtgagtataacgagtcgtggggacgcgcggcgtgggtcgcacgagagccaggtttggtgtgcggacttttcattagtggtcactgtctttcagatttttgtctgtcggctagctctgtttgcggctggatacgtatatcgccggtctgtcttgttgtcctcctgtcctgctccgatacaggcagtggattagtccctcatccagggtgagagatatgcttttgatgttagaatttgtttcttctttccagccggtgggctatatcaacacgactctatttgatgagcgatcactccaagtgattggcaaatgttttatccggagtgcgtccagcggaggtagggatgaaaaccgattgattacggtaagaaactaactctatcatatttattttcataattatttttcagaatcgaaatcaaaatcgaaaaccggatatgaaaataaaaccgaatattatcgaaaacaaatacggaacgaatacgaagcgaaacaaatacggtgacgaatattaatcggaatataaaaacccctcactactacacaaatattttttgttgtacgagaccccataatttttacaaatggaccataacttgccgcgtcggcatttacacatacgactgcttaagacgccaaaataagctcatttttgcatgtggaccactcaagagccctgatgaggacatcactacctcggatacagacaacaatcctccaacggtcattcaaggaccgataacaagagctagtgcgcggcaattaaatttagaggtgagctcgttcctatgttcttctttgtatgaattcgagaatagaggggacaaggaaacacttggagaaggacttagagccatggaggatcatcgaggacgtctaagtcaaggtggagacccaaaccaaatcgacctcgggtgcaattcggagtccagaaccagtctgcattaaaacggaagcccaggtcgcatacgcgctcggattggggcgttctttatatggatggaaagctaagaagataacctttccaatggttttggtcccatgtccaaattcttttcgagtcaatgggaatcgaccgaataagttgacatccagaatctgtcccggtgctacgtcaccgtatttgggcctttgggccgtgtatcgtgttggaacccattagggttgcgtcgagaggggattgtacgaccctaaactctatatatcagt

SEQ ID NO: 13639 - DNA, 1501 bp, Oryza sativa
cgccccgatctggcggcgacggtcgtcccccgcccggatccgaaggcggtggcggcctcagcggcatgcgcgcggcggcgaccgagagcggcgggttcagcggcgcgtgcgcgcagcggcggcggtggtggcgggcgggcaggctcggacggtggggaggcaccggatccggctaccgcgacggcgacggcgacgatgacgatgacggagaccgcgatggcgacgacgacggcgaccgtgaggagggttttctttttttggatattttttttggttttttatttttgcgtgcgggcgacataaccaccccgcacgcgaaaatcgcgtgcgggtgcgccacccacacgtaaaaatagtgattttaaagacacttggttccagacagttggaagatccgcacgcgaaaatcacttttgaccgcacagaagaatcatttctctactagtgtgtttagggctgtataggtccaggacctaaagttgtgactccggttggtcctatggtagatcaggcccaatgtgacctggatggcccacggttggtgggccaggctacgcactctaataagtggtatcatagctcaggtttggaatccgcaatgatttctatgggtcacatgggttgatgtgacggaaaagattgttgacaaaagtatgatatttacacaaatatcagatggctacctcctcgtgtgcaaagtagagttttcacaaagtttggaatccgcaatgatttctatgggtcacatgggttgattgacggaagagattattgacaaaagtatgatatttacacaaatatcggacggctacctcctcatgtgcaaagtagagctttcacacgattattacgcgggtaatgctgcaggtggcttatctattctattttcctttctcttctctctcttttaaccactttttaaaaaaaaattagacaatttttccttctaaattaattatacgattcatgattcaatttcatcattacgttcgtcataactaaatctttataaattgattctgcttgattatatttatgagaaaatatataatatgattacagatctaatttaaacatttttatattatacacgaaacaatgagatgtaaatgttggaatattagaaaatactcaatgaaacattcaaagtacaatacgtgcaatatttctgaataaataagtaaaacattagaaaataatgaaacatccgatgacactacatgcaccattaacaaataaactattgaaacatcacaaaataattattgaaacattaaaaaacacacccggtgtgacatttaaaatagatccattataacacaaaacttaaaagatgcagcatagtcaaattctaattgtaacatttatttctcacacgtcaaacttttgttggagaaaagaacggtacaggtacaactgcactgaacccgtcccccaatttcttcttgtaaatacatatagttgcaaatatcccagtttcttccccagtactgcaatggcg

SEQ ID NO: 13640 - DNA, 1501 bp, Oryza sativa
cctaacctaactggtccagaccggcagcaaggccgaagtggcccagccaccagtcacgcgcacgctgacttcgccgcagcgcaccgggcgaaaccggcccacgcgatagcgctggtgcgccgcatttgccgccctgaccgaatcgtggaggccgtctcccgtgcgcccgatcgaaaccgtcttgccgctcccgctcccgctcccgctcccgcaccacactcgaccgccgcgaaccagatcgaaccaatcgccgcgccgaccacaccaagttgccactgtggctcacgtcacccgcaccctattgccacgaatccggcgtgctccaataatgggcggcgcgcgactgggggctgtgttccgttggtagggctgggaacggggtgaataattagggtatgattaattaataagtgtagtattaaatatttttaagaaaataaattaatacaatttttttgaaaaaatttaaagcacaaattttatacgatttagtagtttaaaaagcgtgaatgagaaaaacgagatatggaagttagggatcttagtgaaagaactcagccttcagcggaccacaaacatactgccctaaccttcgcctctcgctccacccactcctgcggtcaagcaccttgcgtgcgtgtctcgtcgcaagctcgccatctgcccttcgcgcgagtccaccgccctttcgcccgccatcgcctacctcactattggaaatgtagccttgcaaatgttaatacagaaaaataagatattaaatatgacatgtgaataaaaggatgatctagtgatagttctaaatatgaacatattaataacaggaatagcatcatctactaacatattcaatactaaagtgaatagaacaacatgctcggagaacgctttggatccagataaggcattgttgttgttgcctccgttgttgtggccgttctctcctcctttgccaccgttttctcattcattgccgccattcctggtactggttgacattgccagcagaggaaacaggggaaggcaagaaagccctcccgtcccgtccccgtccccagcttagctcagcgcgcacgcgtgtgtggcagtcctaccaccaccctatcaataggtgctatccatttgtagcttatttaagtctaggtcccttctcattggttttaagatgatattaatcccttaacattaattttggtttcattaaaaatactacaattaaattgggcctatcccatcaaattctaatactcaccacggctcaccgtctgcctttacccggtacactatcacttctcgttcaccttgagctctaagctcttagctagtccgcccggagctggagccagttcatccagcaccttgtgtgcaacgtcattcgttccatcccttcctggttcgagcaagggctaaggatggggatccataatcggcgcgtgtgcgcccccctctaatccactctgttcctatatacgtatataagtatatacacatgtgtgtatat

SEQ ID NO: 13641 - DNA, 1501 bp, Oryza sativa
atcccaacaccgtagaatgttaaggcctaaacaacacaataaaccacgcaaacacaaacgcgccgaagccgaagcgcgatcaaccgccatcgcagagaccacgaacaccaccaaatttctcgaacgaaaccaaaggatataaatcggagaaacacggggtgaatcgcctcccgtcccacgcctgcacccaaaaaaaaaacatcacttcaaatgaaaacaaaaccaaaaaaaaaaactctcatgatcgctgctccagcattcgactccgacgaggaggaaggggattgggagggttttaggagaagctcaccgcgggatcgccggggcagacgaaatccatctccccggcgccgccgccgcgcctcctcgcccactcactcgctcacccgagcgcgtcgcgtcgtcgctctcgtctcctctcgactctcgtcgtctccgctcctctgagttctgacaccctcgactcgctcaacgcgccgtgcattgcaactcctcctcgaatatgagccactgatccgtgggacccacggtacatgggccccacgcaccaacgtccacgtgtgcagcggggtagggttcggcctaggtgagaaaagtatcgaaggagaaaaggtgcttttcggccttgggcgaaaagccgcgcaaccgcactcgcgggccgtacgcgaaggattggccaatgacaaggtgggccccgctgacgtcgggcccacaggtcagtgtctcaggacggaatcttccgagctcggatcgcaccgggaagtggagttgattttttggcgctagcttttttgggcttttggactgttcactaacgtgacacgcacgtaggggaggaaagaaacgaagcgccacgtggcccagatgcactgactgagatgggccggattgatgctaggtttgggccgagagatttactgtcttacgggggcccatcaaaggcggtttctgagacgtagttctttgctgggcctggtccacgggttggcattgggaggttgggctaggcgaggactttgctgtggtggcattgtgtcattgtggtgactttgctgtggtggcattgtgtcatggaataagttcactttaggtccctctatttgtcgcccagtctgattttcttccctaaaccgcaaaaccgggtatgacccatcccccaacttacgaaaatcgggcaaacgaggtccctcgacggttttgatagtggttttgggtgacatggcgcctacgtggctaatttgactcggttttcatctgacgtggcgcttacgtggcaaatccggaaaaataataaaactcgtgggccccacatgtcagtttcacaaacaaaataattaaaaaatggtgggacccacgtgggccccatatgccatcctcactcttctctcttctctatcctctctctcccctcttctctctatcccttccctctctccggccgatggagtagggcgagcggcggccgtcccggggcagcgcctgcacgagctgcgactcgagg

SEQ ID NO: 13642 - DNA, 1501 bp, Oryza sativa
tattaaaaatgtccaagtgcccaacctttttgtacaaaaaattgttgtctgcttttgcaatttgcatcctccctcgattatgtgattgttcaattggtattaaacaattgttttggtttacatgatgatatgagatgatattatatagtatgacatgtgttctgttcaccaactttacaatgacatcttttcagatactgcagtatgaagtggtaattgtttgtgctactgttgtcagtgttggtcattcccactcccactcacttggttctctgtggcctctgctccacttataaattattagcattggctaattgattcgctgtctctgtctgttctttttttatcccagaacaaatcggccgttgctaaaatttaaatattagataaatcttaggctatttttaatgtagttttttttttcaacattaacttttaagtcagtaaggatacatatataaaatgttttattcacattacttgttagtcgctaataaatcgtttggtatttaggtagttcttggtcaaccgatggggcattatggattgtgtaagttgattataatcgtgtcatttagagacgccaaagctatagctagtcttttttccacgcaagaaagggggtacagctagtttttgaccaatcatttattaacgattccatcctgcgtctggagagctcttgtcctatatgtacatgaattgtttgttggtcagagagataactctagaagttcagattgctgcgtttcaacaaaaatgttcagaatttcaggttgccaagtcatgataacatgtggccacggaaatggttggacaaattgctgcagtagagtcaaattgctgtacatgagttctttttaacgaaaattgctatacatgagtagatatgcattatgggactatgccactgaaagtctgaaatagttcatgtaaacatccaaaatttttagattgggcaatttgaagaagctggccttgcctcatctccgctgaaatgacaaacaccacagttaaatttatgcaatggatgggttaattgactcaacggttactcccacagtttcagtaagaacgtaggatgttttgattttgttttaaattaaacttatttaaatttaactcagtttataaaagaataaagccaaacaattactacctccatttcatattataagtcgttgtgaccatttccttgtcaaagtttgaccaatattataaaaaaatattgcagcatttccaatacaaaattaatctattatcaaaatatatccaatgttatatttaatgaaactattttaacattatagatgttgttatatttttctataaatttgatgaaacataaaaaaatttgacttagaaaaaagtaaaacaatttacaatatgaaacaaaagggtatatcataaaaatgtattcaaggttaataaaattaatttggcattctagatattactatatttttttcataaacttaattaaatttaatttttttccagg

SEQ ID NO: 13643 - DNA, 1501 bp, Oryza sativa
agatgtatgactccaccactaaacttagaacattaaattcactggcttataaattatataagccaataagctaacttaaaagtctagatcaataagcctaaacgtaaataaagagggcttgattattgcaaggctaagcaaaagcttaacagacgggttgtttattgcatctactgcgatatgatcttcacaagtggtgaatttttttcagtctagtttagtagctatctaatgcttctctgcattttgaaaaaagtaaaatcatgtgcagtttaatcctttggcttattaaaaaataatttatgagcaatcattagtgatttaaaaaccaatgctacaaaataaacttagataaaaaaaacctttaaatcaaaattaaaattaagttttaaaatttaaattttaactgcggttgataagctaaacggaaaggatggtcctcgggttagattcagtttggtgtccatccaattaacctgatgcagcttaaatcaacatttagtaattttgtgaaaagaaaatgtgttcctacataagtaaatttaaattacagttagtttactgcactcatgtgagcaattaacaaaatgtataaatgcacgttttttaagttgacaaaatgtgcattcatagttgtcacgtgacacacgcatggggccggggtgttttgagttttgacccatgcatgtaagccttgcgccattaattgcgagtgcatgattagctcttccaaccattttttttaattttctcaggaatcaacggaaggaaagagcaaaaatcaaaaaggatttttccttgtttagttctaatttcttgtttctattttccatttcagttgttcatgaattataattataataaaatatgtacacacagtgcttcctctcatattattttaattatgattcccaatgtattaaaaatattaattattttggcttatcaattgattagttaaactagcctttctcatccagattcaattatatttgtgtggttctgttttaaaaactgcacacctcataaagataggagatcaccatcatcgtttggctggcaccggcagtgtacgtgccgacgtgttgtcttgaatcacaaataattaaagatttaaactgatttcatcaattaatcatttactaatttaatttcagaccatgccaaggttggtacacgtccaccgatcaatcaacccaacccagagagatcgagcttacacgtttctcgaacacgcacgcgtgcacacacgtgtcaagcatgcctaattgtatgcggtagaaaattgttttttttttgggtgtgcagataaagattttctttctgacagttcatataggaaagtgaaggatttttctggttaagtatataggatgttgttagattcagattaggagatggcaaatgcgaaacataattgttaacatcactagtagtatcatgcaactgattaattgcatgtttgtaaatttaatgttgcctgttgcgtgcaaggaatgga

SEQ ID NO: 13644 - DNA, 1501 bp, Oryza sativa
ttgactggaaatagccatatggcatattaagtggacccaaggatgatttcaagccaaaacaaatatttagaggagctatatggacaaaataaaacgtgaaagaccaaattaaaccttcggtgaaacttgagggactaaattagctattcaccctatatttaaccagctagatgaaaattacatgtgtgttgctgctgttaccgtgggatagaaggttacatctaccgaattcacaatggttaaaatgagttgtgtggtgtgttgattttcattgtagcgattagcgaacatggtttgatttgatatattttatatgttttggaactttgatcaatcgattatcccaaatctagaaaaaattaattaagttgatgtggcaccatgagacaggatagacaattttcatatataaactatccaagatgtggcctccatgaattatttattaagtattgttttcaaagaaaaatcttggtacatccatttaatggttgggctccacgaaggagttaaattgtttcgcgtggagaattcgtacaaactccaaagcgagctaaatcgtgcagcaactcattccaaatttccaaccgttgaacttccttggttcgtccgtgttgtaaagctgacaatgctagctctctggatggagttaagtagatttacacttgctctggtatggtcaatgcttttctccggatgtaagccgccgcaagttgaccattggcgcaagggagtatgggacccagcatgatactgatgtaaacctactttcagttgatctctcatttatattcaatccagatcattgacctcaattttattttatcagcccggattacttattgtataccgaataaaaatgactaagtgccttgaccatgctcctgatatgtattcgatgcttggattatttcttattcataatcagataactataatactacgaccccctctatctacaaatataagcattccaaatatttttttaaaaattcagtattataaacattccaatcaattaaaatttattcacaaatgtaaagattttaaaataatatgtgtcccatcaatcatttatctctcgtttaaatttattttcgtcttatccccaacgaccacacttctacccctatccatacctcattctttccttcttaattttactccatgctaagagaaattttcatatttgtgcacggagcgagtaactactcgcagtaacaactaacaaaagggtaatagcggcctacttaatcactgagttttcaccaaagcaacgaataacgactccacaattcgatctctctccgttaaaaccaagcaagcggctagtcgcccgccttgcaaattgaagtcgtaactagatagtaggcgtcaagcatgcatcccgatcgagaacagaggtcctaattaatttcccaggatgacagtaataagaaattaagacgctagctagcgctgaaggaaggaagcaatataattaccagcaatgagaggcgca

SEQ ID NO: 13645 - DNA, 267 bp, Oryza sativa
gcaattttttattgcgttaggttttttttcctactggcccacctatgcaaaaaacaaagcaatgacccactaagtagtaactaggctatatggggcctcatctgttttatttattttttttaattcacttgcaaaaaattatataccaaaactttacacatatgaagtttctatatacaaagttttcatgcatcgtgtttcgttgcatatagtttatgtgaaaattgctatgtgtaaagtttcaacctatcaatttctttttctagg

SEQ ID NO: 13646 - DNA, 1501 bp, Oryza sativa
gccgtagttcgccccgccgtttgcagccgccgtccgccatccgttccggccgacgccttcttcaacctcccgccggcccgcgtggcagccacgtaggtgccacgtcggcgccacctcggctaggaccgggtcaacccgacctcggcccgccgctcccttccgccccgcttgcgcgcgcggtccaccgcgagccgtgaggctacgcgtgggcccgccgcatccgcgtcctccgcgagccgcgcgcgtgcaccgcgcccccctccgaaccctagcgccgcgctacctgctccccgctcacggtgagctgagccgccgacaagcgggtcccactcggggccacgcaaggtggacccggcccaccggttccccctccctctctcacctcgcgtgcccttgggctgccttctcgggccggccggcccatttagctcggccgagccgcccttttctctcgggccgcgccctagccgcccgagggaagtctatttcccctccctctttcttttctttttccaaaagggtttaattaaatcctttttcctttagatcaaaaatccaataatcttagaaattcaatatcttctcaaccgtacatccgattcactccgttcaacttccaaaattcctcaaatctcgagatctatctaatggcacacttagaggtcaataatagggctttgttttcgccgtttgttgagttgtcccgtttcacgtgtagtttcgaagcccgaagacccgcagtgtgaggatttcgacgatcgagctcaagatctcgagcaaggcaagtcacctttgatcatattgcacctataattaaaatctaagtatttattttccgcaaatgttgcatgaatatgttaaacacaagtaattcggccgcggcttgtgagatagcctgccggccccaatcgtaattgctgcaattaccctccgtgaattattgaacacttaaacgtttcttcgactgaggagccgactacaggaggcagccaggcaggcgaggagtagaggaggccgtctttagcagttttccgtgtgttaggccccttttgtgccgccgccaactcttttggagtcgtggcgaggtagtgcgtgcgtgtgtttgatgtggatgttgtatggtagtctggattctcctaggaggtgtgcgtatagtcaagctcggcgtagctctgtgacttgtccacacccgttgtatcaggtgtctttatgatttgagaaatccagtttatgcctagtatgtgctatctgagttgttatttattttgcttcttgtcttccttaagtgcttatctgttgcttatctcgcccttttctgggagtttagatggctagccgccccaccgcgctgctcgtgcaccagcccgcttcggttttgaggaaggtagagttgagccagaagcagatcatgagtcagctaatgagcagtctcaccacagcaaccgttcgcaccgtactgcttcccgcaatgcagaagttgagcaatcccaccgcagcaacc

SEQ ID NO: 13647 - DNA, 1501 bp, Oryza sativa
ctatacaatactgggtttcaagggaaatgcaatgaacatattttttaagaattaagaagattagggtttgagcgtacatcacatcaagggcattggaacttctctaaggctgtatttggaaccctaagttcccaacccctctacctcgtattccacgtgcacattcaaactgctaaatggtgcatttttttgcaaaaggtttctaaatgaaagttgcttaaaaaaatcattttgatccattttttttaaaaaaactaatacttaattaatcacacaccaatggaccactccgttttccgtgcacactgtgcgtgttgggaacatatgcttccgaatacagcctaagttcttgccctaacaaattgttgcctttgataacactacctttttatttgttatacataggatgatataaattcgtcaatcatacagtaattagcatttacttccccctctcaaatatatgactagcctaaaattgcaccaaaagaaacacaaacaataattaaaaggctagcatatctatcttctccatttctcatactcaaaactagttggtggtctaccctaagccttagattttgttacctagactctcgttgtaatatacagatttatgtctagatgaaaaaacaggtcttttatcctagtatgagaaagttttttttttcttattttctttttcaaaaatatattgtagggtcataaccggatttagttactcgtgatcaatctccacaaaactatatttgttgaaatgagctacataaacacgacatgtttttcacatgcaaaatttagacacttcttagataattcgttcgtgagcataatagcctttgcccacgatttcttgaaataaacacccacttaacacaaactaaacatcttccctagctaaggctaacttatgccttttatcattttgttggtcatgatgtctctataacaagctataattggcctcgaaactaaaccttggtgaggtcagcttttaagcaaatgacccccataggatcatagtctctcatgctatgtactgtagatgacagcaacaaattatatgagcgtgtgctttcaatagaattttagcaaaggttaaggagctgctgctagtctccatctatttgaccttatgttcgggcacatattcccggagcgcgagtatagtgatatatgtgccttcactcttatcttgaaaaaaaaagagacaaaatttaagactttatttaaaaaggatggtcatttataaaatttgaaaagtataaaaaaactacttctgccttactttcactacacgaaacaaatgaaggatcatgctgcatgaaataccacattccacaggcacctcccgcaaaaacaccgaaggtccccgtatgaggaggcagctcgtgctcgggcggcgagactgagacgagacgcgagaccaaaccctcccctccccgaccgcgccccgcccagatctcgccgccgacgagatgcatcgccgcggcggccacca

SEQ ID NO: 13648 - DNA, 1501 bp, Oryza sativa
aaaaaaaagaatacacgtacacgtttgagtcctactcgatcgagcacacatgacacgtgtgtatgtatgtacaccggccgcggcctggccacgtgctaccaccaggtgggcaccttcctcccgccgccgcccgcggcggccacggcggccgcgcgctcgaaccgcgcggcggcgcaggggatggtgatgccgcccgggtgcgcgaacccgaactcctcctcggcctcgcggagcagctcgccgaacagcgggtggttgaagtagaccaccggcaccacgtacctcatcgactccccgggctcgccgccgcccacgtacaccgccacctgccccttgggcgtcgtcgcctccccgggggattcctccaggagccgctcggatccccgccgccgcaggagcctcatccgccgcgccagcgaccgcccccacttgagcaccgccttctccccaccacgctgatgcacgacgatctgctgctgcggcggcggcggctgcttcttgacgctcccggcggccagcagaggggagcggccgcctgcagctcccgggcacggctgcaggcggaggtagccgcggccgcgccgccgccgccggtggcagagcgcccatcgccagagcccgagcagcttccggcctagccggaatcctctgtgccgcctcgcctgcatgcgcgcagctagctaactctctcggcgggggtgcctgactttggtggtggtggcgttttctaaacgagcggaagaagctagcgacgttgtaatggcaaggcgagcgtgacaacgggttgttttataggagacgagcagcagacacggcgtggcgcgcgtacgggtcgtttccccgtgcgaggccgagaaaacggaggggtttcatgtgcgcgaggctcgctctcgtttctagcctggttttggtgtctgcttgtccatttggccttctatctatgcatgattggttcgtgtgacggctgcggacctgcggtcatgtggccactggcgacctcccgagcgtggtcggttactcggttacggtttctctgacgggtaccgtacagtgctacaacgtgttctgttcacgagctcttccatgtgatacacacagttcgtccgtttaattccctccgtttgataatcttgtaccaatggttttgcatccaatgttacgtactacgtaggagtacattactagcaaatcggtagaagatcatatttcgcagtcatatctgtcaaaaagcggtgctgttgatgtaggcaagtgcgtcgacaaagcgagcaagggggaaagaggcgataatctttccttaaagaaatgtactactagtaaccgtaaaagtactgatggatccatgtcatcaaagcatttgggagcaaacagtatgaaagttcccccatggataaccttttttaccatgcaaccctgagataaaatttggaaagctcccccgtagataattttcttaaacatgcacactactggcaaattgcaaactgaaacttttaggtaa

SEQ ID NO: 13649 - DNA, 1501 bp, Oryza sativa
aaagatgtacacctctgatcagagtataatctattcgaatagccgcgccctcagttatgggcaagccgagcaatgtacccaagttagtgttttaattcttaaaacctgcttaacaactaaaatgtggaatggatggcctgggttggcttgggacgagctgggacccagggtcgggttgccagttcggtctgaatcatcgtaggccttgggttaaggcaggttcgtgtgggttcacggcctttattaataatattgtatagttctagaatcgtgtttacaaaatagctttgagcaactaagtgtcttttaatgccgtttactgcaaaccctaaccctttatattataacccccttgtactcccttgcatttattctgcacttgtgggtgtgtcttgttgagtacggtggttgtactcagtcttgctcaatttttcccaaacccagaagaggagcccctggaagatgaaggctttggtgtctagctcatgcctgccgtcaagcgcctgtggtcgtcgccctagtcttccgctgtttcccgtttgtctttgtgtgtgctgggccttcgccgccctgtaataaattaactatttacgcttccgcttgttgaactctgaactgtatcaacttttggtgtaccttgcctcctaggacaaggaataatgcacgcacgtaaggaacgcccgttagattatttccggtcgtgacaagcccccagcgttagatcgtagtcgatttaacatcggggacactcgcgcaatatatattgtataaaaacatgctctaggtaaacataataaattatagatccgacaatgctgtatgatcttgaaaagtaggtacagtaaattgtatataaaatattgcgtacctttgtagatatatgccggatatatctacagaattagtagatcaatttaaaaaatcaatctactaaatacctgatcatgggtggctggacacgtactgactccatacatatgcatgtgtactgtgtacgtgtaaggagcaggcatatttgttgaattcgcgtcatcaggacgagtagtcagatttgtcaactagaaatttgattctagcgcaaactacagaactcctcgaatccgattaggatattagccactgaacagatcaatgtggtgcttgtatttcagctcctcgacgtgcttgttttgttgatggagatcgatgccgagtctggcttggacccggccagctgatgccgcccaccggttggcgtcctgcacgtcgatgggttagtgtcggatcagttttggattccgccaacactatggtcctctgccgctgcgacatcttgaagcttgattggtctcgccggatcgaatagttgatggcgatgattccaatctcgttgggagacgtactttggccaggttggatctccctgatccgaagtcgtcgagtagcttattgttggagaatccatctcttaaacccatctcgtctaaatcctgaagcaccaaaaaatccccctacctggcgc

SEQ ID NO: 13650 - DNA, 1501 bp, Oryza sativa
tacagatccacgttttacaaaaatataaaagattacaaatgcagcggaaaagatgaaagccagctaagcctgaagacttgactccacatgcatctttgacggcagcgacgaaaccaatttcttcgagacatctccaactaagaagaacttcaactctggtgtggggaagagagagcaagactaagtacttcccactgtactcaacaagtcataccggaagaggaggtatgatgcaagatataaccaaaggaggctagcggttcatttgcataatgcttgcatttaaaagcagtagttgaaagcagtaaaaacagttgtagtatttaatcaatattaaccaatcactgctcaacactacaccacattgagacaagcccaaaccaccacctgaactaactagttacattagctaactaggggtgagaataattgtcggtgatatgggcctgaggatatgagaagtatggggaagtctcaatcccgtccagccacgcggccatacagcctggccctccccccacatctcggacgacgcagaggcagccagggggcctcggggtgccacgtcacgcccctttgaccctcaggctgcctcgccccgaggccctcgcccggccgccacgtggcggggggagtgagtggggcggtggccgaatctgagccgccatcaatgaatagcaccccaaccgtcccacaccgcatttaatgcggtgagggcggacgtgcggcgctgcccgattgacccgcgtcaatcgggcgtgaccggtctgtggccgatcacatccaatcggacgggcggcggtgcccccacgttccgccctgtgctcggcggagtgggggcaggtatgccccgtcccatcaatgcatcgtctagagccccctccacgtgaggtgaaccgccaaaagtctccattcacttaaaggggaatgacaagggcgtcccccgtgtcaggcaggggacggcgctgggccccactcgaggacggacggctgcttagcttccggtgaaggcacgaatggtggtccgctccaagcggcgtgggccccctcccttgaaggagtaggtagaggcggtgcatgtggtatccccttgaactataaaaggaggaccttgcccactgaaaaggggggatgactctcacttagcctaagccccagaggaagaagagtaagagttctccctggagtttagaaacctttgtaacactcaaccctaaatcccacgcacaggagtagggtattacgctccctagcggcccgaacctgtacaatcccagctctcacacgcggtctcgaaagactctaggcagatatacgttcttgatcagtgcgccctttcccccggccgaactcacaaaagggggtccctcaatcacccgcaagagaggatcattcctcgacagctggcgcgccaggtagggggaattcgcgcgtttgaaagagaaatcgtttccttccaccacaagtttccctccatcctcaacgatcatggtcgaggtcc

SEQ ID NO: 13651 - DNA, 1501 bp, Oryza sativa
cgcagctagccaactatctacatcagctactactactccctctccgtccgggatttttggatgaatgtaacagtactacgaatttggacacatatttctgtgtatgaatctggacaaactctctgtcttgatacccaaaatacttatcgtttttagttttttttaacatttgaccatttatcatatttgaaagattatgaaattattattcatttttgtttgtgacttattttattatcaaaagtactttgagtatgattttttttatatttacactaattttataaataagatgaatggacaaacgttgtaaaaaaagttaaaaataacatctaatttaggatggagggagtactagtttgtgtcacatccaattaaaatctcttatattttgagaaggatggagtagtacactagtaatacctccgcttcatattataagactttctagttttgctcacatttatacgtatgtctaaccctgaaactgaggaagcatttagcagtacttaccggccggtcttcatttattcgcatatgcataataagaaatcggtggatgcagttaagtggaaaagctaagatattcaggggaatataagggcgtgtagctgaatgggatgcggcgaattaatactacacgttgtcgatgctgctggatatcacattctattctattgcaatctgccttgcttttccttgtcgagattactctagcaatttaatttcccgactttagaggtttacatacctcttttgattgattgaagattgtgggttttgtgtaagatgccactatggtgtgatctcttgcacctttttacacgaggatgaattctaatatcttgggtggacgtacacccgtttattgcatgccacctaaatgattatgaaattttttttaaaaaaatcacaagataggttaatatgtaatatatcacttcacaaacatgcaagttcaaattcgacttctacaagttgtaacgaaaataacaaatcaaactctaactggtatacgtatattcacagttaaattaattgtttttgttacaatttatagaagtcgaatttggacttgtatgtttgtgaagtaatatattacatattaacctatcatgtcaatttttttaatttttttataaccatttagatgacatgaaagaaacgggtggacgtccacccgagtgtttaaaacagtttcccctttttgcatgtatagtatccccttctcccctatatatcaactccacgccgcacacagacatctccaagatcggaaagctaacaattctcaatcctaagcaggcacaatatatcatcacaaacttgacaatattatcacgtactatatactatcgaagcatatatttgttctgcacatatagtagctagcaatagtaattagtacgtgatctaagaaaagagtgatcgatcttcgatttgatcgatagtatcgtcaatcgtgtgtccgatccgatccgccatggagtggagggacagc

SEQ ID NO: 13652 - DNA, 1421 bp, Oryza sativa
  unsure (1)..(1421): unsure at all n locations
tttatgcaggtgaaatatttttttttttaaaccgaccaagatcaaacagtgcacgatgtttcatattgatatggaaaaaaaaaagcctataactttgaaagcctataatcagaaaaaaaaaacacccccctgtcaatgattgcattttcagttcgaaactttggaccccccccccccaccccaagttattatctcgtctgaaattttcggtttttctccattttttgtgagtttggtcaacatttagtcaaattcaattaaagtatgttaattcttttttaaaaagatggtccaaaaaagcgtcaaaattttgggtctaccaaaatggccaaaatttttagcgaaatcaaaagtgaaaaaacataccaccacacaccaaagggctagaactgcaccgattgccgctatgtgtcactaaacgtgaccaaaccaacaatgttgccactcgccaacgccttcaaaaaagctgaaaacaccatggtattgtggacaccaccagcgagaggagggttgcatagcgagtagacaagagggatcgagtgtcagtgaaatatactaagggtgcgttggttcacaggtaaggttggataggatatgaacatccatagttctcatgtctgatgctgatttgccttcatgatgtatcaccccttattactgtatatttttggctaaaagaatacgactgcttatatgcaattatacattatgttgcccgaaagacgccttaaaatggcctggcagaaattcagactgtttttaggaagctagatgataacctatcagcgtttggagaacaaagccaaagaagaggagatggatcctaatctctcgggtggatgtccacccgttttcttgcgcaatatgtataagcattaggatttgaacacccacaacttcaaagaagaggagatggatcctaatatctcgggtggacgtccacccgttttcttgcgcaatatgtataagcattaggatttgaacacccacgaccccatatgatgtttcatcaagttgtagttgccaaacaactctaataattatgaagttacttctgctcggggtcgatttgatacacggttagataatggaatcctgaacgctgcatcttgatatatatatacggtgtcaggtgaattcatcggtcagaacgaatccgatccatcggtcaaccacgcacacacgttgatcgatcgatcatggcgggcgcncggtgaacatctcttgcgacagccgccgcacgccgcgttcctcctccggccggccgccaccgccgccgccgccgtgcgcccgtgtcctcgccacccgcacgccgccgccgccgcgtcctcatcctcccctactgcgttcgtcccgcgcgcgcgtggagcgcagctgctccggcgtgggagcggatcagaggtcggcgtcgtgggcgggga

SEQ ID NO: 13653 - DNA, 1501 bp, Oryza sativa
gaaattttatctcggcgggtacaccatctcttcattccgtattccttgtcgagatccagcaaccgttctcgagcgatcgagaaggcgtagagtctgcgacggagccttgtcaacatttgtcgtactcgccttagtcgatcttggtgtagaactatagagacatgagttttcaacaaatgtcgaatagaattttcctgaaatcaatactcataaaagaatatcaaatagaaagagcccccgagcgaatgctcaaagggtgacatgttataatatgtatggtaaattaaaaatgaattaaatttaccgaccaatgttttgtgtatgagcgtcttctcttttaccgacttcgactagtcagtttgttgagttatgcactctccctagcctctagccttgtcgtcggagaatcgttctcgagggacaaggctcttggacctttgaactgcctcggttgaacaagtactgatcctagcccccagccgtgaagttggaaagttaatttccgattacgcggcttggttaatacgcacggggagaactcttacacgaccacggctgacatggtctttcgtctctaaagaatccgacaaggccttatcggctccgggcatccccagccgaagatcccttaggttcctcggaggccttgtcagcatggcgtaaagggacagtaggataggtgtcaacgctaggtgtcatctgggtgagggatctctgggtaaaacacttggcgatcttgtgtacctgataccaactttgttggagtagaggtagtaggagagtcgctgcaccactggtggaggaccaggcagtagtcgtgactcgaccacttgaagtggaaacagtgggtgaatcgctacaccgctggtcgagaaccagaggtagtctaaacttgaccactagaagtatgggtagtgggagaatcgctacaccgctgattgagaaccaggggtagtctaaactcgaccactagaagtaaaggtagtgggagaatcgctacaccgctggtcgagaaccagaggtagtctaaactcgaccactagaagtaaagatacgagagatcgctacgattgactggttgagaaccagtgagcaggtgtttctcgatcaatttgaagtcgtccgaagtcatggtgcgaggactgctactctgctgccgttcgaagatcaatcgtagtcgtacctcgaccatctgaggttgcggtgcgagagattgctacgtactggttcgaggaccagcaaacgtgtagagttatctcttgaacaccaatgaagtttgcggtgcgagagattgctacgtactggttcgaggaccagtgagcgagcagaattatctctcgaacaccgatggaagcgctagagttggtttgttgcaagtgtatctcatgtggccagcatgactcacgtacccaacttatagcatatacggatgtccgttcgcaatcatgtcaggtgatcaagccgacggcgttcacgaggaattattcgttaacaaccttct

SEQ ID NO: 13654 - DNA, 1501 bp, Oryza sativa
cgctcctggcgaagtcgggtcgagttagccgcgtgaaggccaaagctcccaggcgtgcagcgtcgtgcccaggtcttacggagatgtgcccgggcgaagtcgggctgcgtcagccacgcaaaggccgaagcccccaggcgtgcggagtcgtgccttgagagtacgtgccccgggcgtagtcgggccacgtcaaccatgtaaaggctgaagcccccaggtatgcggtgtcttgcctcgggcgtacggagacgtgcccagacaaaattgggccgcttcagccacgctcgaaagacgaagcccccgggcgtgcggcatcatacctcgggagtagtctgtctggggcgtagtcgggccgcgtcagccaggagaagactgaagcccccgggcgtgcggtgtcttgccccgggcatacggagacatgccccaggcgaaatcgggttgcttcagccgtgcgaaggccgaataccccgagcgtgcggcatcgtgccctgggagtagtccgtctagggtgtagtgtcgggccgcgtcaacgaggagaaggccgaagcccccaagcatgtgcggcgtcatagacggtgaagcctcatggtggcgttggtgccggctagcccggggacatgttcaccacgcggtggcgtggaggcagccgaccgcgaaattgttcaggcaatcggcagtgtaagcagatgtggccgacatgggaacacggttgccactcggcaactcgaagatggctgactacggaggcgatggagctaggctgctacgacacaaaggcggccagagtggagaccactcggcgacgtcgaacatctccggcgcatgtgcaaaatgattgttaacgaccgaatttggaaatatcgatgcgatggcgacagtgtgcccatgtgcgcggctaccgacgggcatgtcttctgtctacctggtcgtgtccgagtgcgtggccctcgcacctgtgtgcgcatggccacgactacacacgccatcactactaggaaaagcattttcgccggcaggggaaacacatcttcccagccggaaggccggtccgcctatagcacaacgcctaggaattcatgtgtattcatcctcttatgggatatcaatgggatgaagagttttgagaattaatccatttgattagggaattggtaacttatatcaattactcctaattgatggatggttgatggttgtgtagtggaggatggttcatggctagttgatgacaattagttgctctattcctcttcctattccatttgtaacctacatcaattactcataattgatggttggttgatggttgtttagtggaggatggttgatggctaattgatgagaattagttactctattcctcttcctattccatgactcttactcttcatcttccatttctcatataaaatgagaatggatttgatctcccaaaagagaaagtgagacacactttcatccattttccaacgctgttgctgctacggtaatcccatcccga

SEQ ID NO: 13655 - DNA, 924 bp, Oryza sativa
  unsure (1)..(924): unsure at all n locations
aaagaaaagaattcctgtaaaggtaatgtggtatttcctaataataccacggctaaaggcgtttgttcaggaacaaagggaaatgctagaatgtttcgatggcacgctgaagagcgtcaacagnacgggatgctaaaccacnccgccgatggttcgcagtggcgaaacatcgacagaaaatttaaagaatttggaaaggacgcacgaaacatacggtttggtttgagtacggatggcatgaatccttttggagagatgagcagcggccatagcacttggcccgttacgatcagccacccgggactaaagatcccgggggggcctgacatgacctgacagcattcgaaccgggactaaagatgatctttagtcccggttggtaacacaaaccgggattaaagatcaaatatgcccgttacccttttgaaccgggactaaagatcatctttagccccggtttttattgcatccgggactattgtggaaatcggccgaccgacgaaagatggtttctccaccagtgcacaaacgaatagacggacgatgacgctcttggcctcttgggctctcggcttctcgggtcgccacgcgttagggttgggcgacgtcagaaggaataagttcacttcgtgaccctcaaaagtgatcgaaatctaatccgtgaccctaaaccacaaaatcggatatctcgacccccaactcttaaaaccgatacaatttgactccctcggtggtttcggagggcgatttcgctgacgtggcacctacgtggcagtattgactcggtcttttgtccacgtggcgtttgcgtggcacttaggtggtattagaaataaaaaatatgtgggacccatttatcattcaccaaaagtatgggtgggtcccactgacacgtggggctcatataaatcatatcctcccctc

SEQ ID NO: 13656 - DNA, 1104 bp, Oryza sativa
  unsure (1)..(1104): unsure at all n locations
ctgaatgtcanttgtananccnncatcnngttaagnatcctcnttgtcgcatgccggcaggctcgactttagaggatcccccgatcgaacgaacgatagcgagaacgaacacgtcaacgtacgttgtccgagaacgtgttcgagaactataacgatcgaacgaacgagagcgagaacgaacacgtcaacgtacgttgccgcgaaaacgtgaacaagaacgagaacgatcgaacgaccgagagcgagaacgagaacgatcgaacgaagacaagcgagaacgagggaacgaacgtgaacgagaacaagcgaacgaacatgaacgagaacgagcgaacgaacgaggacgaacgttaacgtgaaatgcaatatatatatatatatatatatgttacttcgcatttatcctaatacatctttttgtatcttgtagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataaaattattttattgcaaattagacttagtatgacattattgactacggaattggtgcgactcctagcaattgactattgtagtcttaattagacttagcatatacgcacgaaacacttagcatacatgactattttagtcttagcatgtaatattatttgagttttaatataagattactttatttgtaattagacttagtatgtaattattgactacggaagtggtgcgacaagtagcaattgactattgtagtcttaattagacttagcatatacgcacgaaacacttagcatacatgactattttagtcttagcatgtaatattatttgatttttaatataagattactttatttgtaattagacttagtatgtaattattgactacggaattggtgcgacaagtagcaattgactattgtagtcttaaaacataaatgtctcgtgacttagcagatgtttgttgtatcaacaga

SEQ ID NO: 13657 - DNA, 1501 bp, Oryza sativa
ctgtcaatgtttttcattacaaaccttttgtgctttcccaaaaattcgaaaacgtttacaatatggttcttatattgttactatatcacagattcttgaatgtgccccacatttcttttctttattttaccaggagtaaaattttgctactgaaccctgaaggctattattttttgggtctgttttgtgaacagtgcacaaaagacactacggctgaacaatatgtttggtgcttttcaggctgctgatgaggtcaaatacatgaaggatgcaaaggctgatcgcctgaggcagctccaggaacttcattccaaaattgatgagagcttaattgaagatatagaacaactgcaaagctttgaggatgacatacagtttgctaagtctgctgccatttctgtggacgacagtagaaaagcagctctccagcttgcatttgatgaggatcagcaaataattgcagtaagctgttagagttttttttaccaaacatatatattttcagtgcatctgaagtgacctatgttgcatatcaggacaaatggatacatatttttcgtgctttgagtgaggaaagaggaccatggtctgctaacccatttccaaatagtactgtgacgtactggaaacttgacaagacagaagataaatggcggcgacgactgaaactcaagcgtaactataagtttgatgaacgcctttgtcagccaccatccaaatttagtaatgaaagcaatgcctcgtctgtcaacccctctgttagtgccaaaattccagaaaaaatgaagcacttacttctgaaaggagttcgtggaattacaggggatgttagttctgaaccttgcgaggataacaatgacatgagtgagccttcccagaataccctgtctgagacccagggctcaagtgatgctgcagattcttcaggttattctactagtgttcaaaataggaaagaaccagtgtctactggtggagatgacgactatgctgcagtaagtaggctttatctgtaattttgtatatgcaaaattgacataccgtttttaatagcttcttccctgggatccttattttctcattttcccagattctgtcatcagttcaatgtgttcttgtaaccccaaagagaaaactcgctggacaattgactattacacaaaaagccctgcatttttcttttgaatttttggttgagggcactggaggaacatctgttttcaacagatatcaagaaaaagattctgaccccaagaacgacctggggggtgcagaaaaactgaagggtagtcttgacggaggacgaggcaatgcaactgaatctggtgatgctctgatgaaaaatacatcaaacaacatcaaacaccatagaaggtggaaaataagcagggtacgtcctctatcatttactctcacatgcaccagcacaaccatccacaagcacatgatatgtgtcactccaaatttaattcccggttgtccttgtttgccagataaaagc

SEQ ID NO: 13658 - DNA, 1501 bp, Oryza sativa
aataagtgcacaaacacctggaacagagatatatggattcaattatagatcaaccttcatatgctaaaaaagcaagaatacaggaagtaaaatctttgcagttcttaccagatagaatagaaggctgactcgagcaacggggtgacgccacaaaaatctagttgcacgtacagctcctgaatctagtaacttcgcagccttttgtaactggaaaacagaatatgcaaggaaagtaaggtaaaattcaatattcagggtgcagcccttcagatttccattggtcatgtatacctgctgatttgctgttgccatgtgtcgatgatgtagaggaagaggcctgcaaatagtacacttaattgtctaagacaacagcacttgaaaatataaggaccattttaaacattatgtgaatcatcaggtgtgattgagaacagaaggtttgctcctgtttccctggatgttcagaacaaaagagaaatggtgaacgtactccagtgccttgatatcagcatcttcttcccatgctgatgctgatctgcgagcaactctactcctttctgcttccatctatcacatggagaacataatggagtaagataagaacatatagatgaaattgattgcagcaagaacattatgacaaggaaagaaatttaggaacctgcacttcatgaaactgctttattgatttctccagttgaaactccagtgcagccttttcacttgccatggattctagttgtgtttgcttgtggtactggaagaatggatccatacataaataaacttggtcttattaatctagatgtcaaaggtaaaaaaagaacaatgatttgaatcatagcataccagcaagtcagtgagctcacgatatctcttctccagttcaacatgctcctaaaaataagacatgtttacataaataaatgcgacctgtgagaacaatctggtaataagctgaattactgcagaagttatattaaccaagctagatgttcgattatctaaacacaaacatgaaaaacccatataattgttagatgtattgtatagctagctgtgtatttactcccttcttgagggtgctttctgcatatttgtattgagctttgtgtatacctgtttggcccagttggcccattcaatctaaggtccaatatttgcaacatggtatcagagcatatggtttagggttccacatccgccgtcgtcgtgaagctctctctctcctctcacgcgactggatccctcttctctctcgcgcgagcgtcgccacctctgccctgtgacctcgcctgtggtcgccgccgcgccgccagtgtcgccgccgcgcctctgcctcttggggtcgccgccgcgccgcctggggtcgccgccacgccaactggagtcaccgcccctcttgcgggcgccgccttcctctgctcgcgggcgttgcctgcccctgctcgcgggcgccgccgttcctactcgcgggcgggtggccacgggcgggcgctgc

SEQ ID NO: 13659 - DNA, 1501 bp, Oryza sativa
accgtttccttggaatttcatccaaacataagacaagtacgaccacatgggtggaatgggacacccctggctgagtaactagcttatcaagggagccttgatgccgagagacatgtggattcgccggggtggtgtcggggaggacccctgggcttcctggcgcagtatggtctgggacctaacctgttgttggtctgtgacccctctcgtcggcatatggtaaacctgtgtcggctttggaaatgccttgtcatgaaagcttggaggtctcccgacgtggctgattcccacaggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaattgctgttgtggaaggggttcgatgtttgaaaaatctgtagctgacgggatcagctaggcccgggtggccgtttgaaaagctattggctgggtgccaaccttgaatcatttctaaagactgatacattgcacatactccgaccggacgagacgcactgtctcatccgtgtcgtttgagaagcactcacttagtcgtttttagaaaagagttcaaataaaatcaactgcaaaagcaatagtctttccttgaagcctgcattaaacacttatttccccagctgctgaagaagatgaagcggatcctgctgatgaggagttcttccaggagcaagccggttacgatgagttttagggtttcggcctagttcccaagtcgcgcctgtgatgtttggtccaagtcttggcttccgctttccttttgtaatgcagttgtgagctcggggtctgtccgcagcccaacaagactgtactcctactctataataaagagacctctgttgctgtgatattctgtcttcctgtgataccagcactgttttctgggactggtatcgattaacaggttaatttggagcgtcacgggctagttccggtcgggactagttcggggcgtgacaaggttcttgtaatcattaggctacaggccctttcgctttgcaagattaattaggatcaacttcctttagtttgtccccttgcggtctgatattgcgaacacaaaaactcagtttcttcatgttgaaggaccccggccggatactagatcttaagtctgacgaaaatattcgtaagtctgaatgacatgaattagtttcctttcatttatacgtcctgacgaatctgaagtcggaacgaaaggacacaagcaagccactggccagtggtcatgataaaaatgaagcatgtggactgataagcgtacgtacgtgttgcatagtaagtcccagaaaagggagaagagagacgaccttttttttttcctctacactcgggagcagcacctgatgaagaccaactcattcttttagagactaccacgtacaaagtacaaactgaaggac

SEQ ID NO: 13660 - DNA, 1501 bp, Oryza sativa
ttcttgatttactcgcgtcggtcgatctgcttcgaggcgctgctgcctaacctgccgcagcaatatattgcaatgcatgcatgcatgcctgccctgcctgatcgatcggagatattttcttcagcgctttcgtgccatcaaggccatgcatgattgcatgttgtgctgttaggttaggtaccggtactgatgtgtagtagtagggcacttttcattcgtccgtttagtttcaggacccgtgtcgtgaaacatatagcccgtgtggtttctgaattcaattctgacgctgactgtgtgtgggacatgtcatttgtgtgcaagtccttcagtttgtactttgtacgtggtagtctctaaaagaatgagttggtcttcatcaggtgctgctcccgagtgtagaggaaaaaaaaaaggtcgtctctcttctcccttttctgggacttactatgcaacacgtacgtacgcttatcagtccacatgcttcatttttatcatgaccactggccagtggcttgcttgtgtcctttcgttccgacttcagattcgtcaggacgtataaatgaaaggaaactaattcatgtcattcagacttacgaatattttcgtcagacttaagatctagtatccggccggggtccttcaacatgaagaaactgagtttttgtgttcgcaatatcagaccgcaaggggacaaactaaaggaagttgatcctaattaatcttgcaaagcgaaagggcctgtagcctaatgattacaagaaccttgtcacgccccgaactagtcccgaccggaactagcccgtgacgctccaaattaacctgttaatcgataccagtcccagaaaacagtgctggtatcacaggaagacagaatatcacagcaacagaggtctctttattatagagtaggagtacagtcttgttgggctgcggacagaccccgagctcacaactgcattacaaaaggaaagcggaagccaagacttggaccaaacatcacaggcgcgacttgggaactaggccgaaaccctaaaactcatcgtaaccggcttgctcctggaagaactcctcatcagcaggatccgcttcatcttcttcagcagctggggaaataagtgtttaatgcaggcttcaaggaaagactattgcttttgcagttgattttatttgaactcttttctaaaaacgactaagtgagtgcttctcaaacgacacggatgagacagtgcgtctcgtccggtcggagtatgtgcaatgtatcagtctttagaaatgattcaaggttggcacccagccaatagcttttcaaacggccacccgggcctagctgatcccgtcagctacagatttttcaaacatcgaaccccttccacaacagcaatttcacaagcagtagtcaaacaaaactacgctaggaatcacctcacatccgcccatgaccgtgggcacggctgttcgaacagtttgttaacctctgcagagggggtacactttacccaca

SEQ ID NO: 13661 - DNA, 1501 bp, Oryza sativa
tcctcgctcgcggagctcgctgcggcgatggaggagatcccctccaagcatgcggccaggatcggcaaggagacgtcaaataggatttacaccggggcgtgccacgtcctcgcttgcgtgaagctggcataccctgaactcgacctctagaggattctggatcagggggccgccaatgacgcgcgcaagggcgtgatgaaagaagtcggtgacttgggggagtccattctccccctttttgaagagtagggttgtatttcccttgtactccttaatcaattatgcttgtaaaactttcgtcggttcaaactgcctttgtgtatgcagttgtttccttcgttttctttagcatgttgattccgagtactttgctgtcattgtagagatgttgatatcgaggatgtccagcagcgtgggcagcctgagtcgccggtagtcgttccggcacttgcgcttgagccgtacgtgccgcgggacgatgtcgatcaaagcctgtctgtgaaggcggacgtggcgacgacttccttaggttggtactttggttttcatctcctttattcttttgttcggatcgacttaatttgctgtgttctcgaaagaggagaacgacctgacttagtcatttccgtattgagcagacctcgagagtacgttggccgaccgagatcgtcgaatccaatattggaggacgaagttcgaggtggccgaactcgagaggactatggtggaagtgaagaaggaccaagccgtggaagcactccgaggtcgcgaggtgtggttcaactcgtacctcaggagttgttatacagcgatggctggagtctgtagagagctccaagtaccccgcgggaatctcgaggagtcagcggctgggtatatctcgtggttgaacggggcctgcactctgcttgaaggcatcgggaagcgtatcgacgaggccttgaaacaggagtgtcgtcggtcgagccgatatgtcggagggcatgtgctggcctgtatccgagatcaccgcccacagctgcacctcgagttcctccacgaagggtttgcacgttctcggagggctccacgtgtactctcctgattacttcctgatgacggttgaagggtagttaggacatttaccatggccataaccgtcatatggtagctataaaaggaggactccatcacacttcgaaacacacaactttgagctgaattataagaggctctattgtatcttttgtacattagaaaataggtagagagtgaggagaagctctggaggagtgcccggaagtttggcactctctctgacttcttcctcggcgagtgtagctttctaggaggaatttgggaggagtactagagctgccggtacactctgctccgggttcggagaaacttcttctattaagttagcattcgggatactttgttatgttatttaattatttagtataagtaagtgtcacgccctgaagtttagccatgctctaatatgctaacatgattttta

SEQ ID NO: 13662 - DNA, 1501 bp, Oryza sativa
atctgcaacttgatgtagagatggcatccggacaaatgctcatcctccagcagtgcaaagcacatggaggaagccaaggagaagttccaggagatccagggcgcctattccggtcttaatcttccttatctcaaactccaccctgttctgtaatcacttcacttgttacaacgattatgctacagataatgaactgatcacaaccaaagaaaacggatttagctagttggcaaacttattgcatggagccctcgtgctcccatcccattgttcttgtgcagtcctctcagactcaaacaagcggttcctctacgacgtgggggtatatgatgatgacgacaatgacgatgacaacgtaaggattctagccatgattatgatttattgtcattgttggttcaactttaactcctactgcctctgctgcagctgcaggggatgggggacttcattggtgagatggcccagatgatgagccaggcacggccaacggtaagaacagttagcaccttggtcctagtactagatgcttctcgtaggctctagctgagaggtggtactggtacatcaggaccacaaatttagctgcaaccgtgattggctaattagatccccttttgtgttgtcataatgcgtgataggttccagctagcatttattactttctatgttcttttgactaatcgtattatcatatttcgtttcgaaaattctatcgctgtattttgtaagcaccatcatacctgttctgttctgtcctttgcaaaagtacgctaaaatggttgaaaattaacttactgcttttggtctgagaaaacaagtatacacatggtaaattattgtggtttgtggttctagaactctcgtcatgatacctctggttctcagcgatgattttgctacagtttattgggaattctatgctatttggggttgcatgtcatttgtcatgcatacaatcatttcttgttcattggaataacaaaagaaaatgctcatatatgaatgctaagttatcagaacttctccaggctgtttatctgaaaaaacttgtaaactttggaaatttttgtatagtttatactggatattgtttgttctatgttcatatgtcacaggcttaaaaaaggaactgttatgaaaagctccatgcccctcaactgaaacttttaggtgattttttctagaaccaagctggaaaccggcctctttttctcctggacctgatgcatccaagataaatataacaatagcaataaaataacaatgaatcattggatttgcagaggcaggagagctttaaagaactgcagcagctattcgtagacatgttccaagctgatcttgattcgggtttctgcaatggaccctcaaagtgctaccatacccaggcccaaagccagactcgaacatcctcaacctccccttcgatgtcaccgtctccaccgcctccagtagctactgaggcagaatcgccatcatgtaatggtattaataagcg

SEQ ID NO: 13663 - DNA, 391 bp, Oryza sativa
ttgatcctcttattcggtttattagtgagacatggaagaacaaactgaatgttgtgttccctataaggcctgaactctgaagtcaggtgaattggctttgggtggtggtggggctggattcaaattcctgatattgttagttggagtgataacatacatatttgggtttggttgggttgatttctggtaaacttgggtattcaaggtcccacaaaaaaaggttgaacatactccaatgcctgtttttggtttaattaacgattggtatggactcaggcaagaaataagtgccataatatggttattcttgtgctaaaatatattggtggagattttaacttttagattgattgaatgttgacattttttctgttcttttgcaggatactct

SEQ ID NO: 13664 - DNA, 705 bp, Oryza sativa
acgtgggccccaccattttaaaactatttttgtttgtgcaggtgacatgtggggccacgttttttattatttttccgagatataattgccacgcaagcgccacgtcaatgccacgtgggatgaagaccaagtcaaacaagccacgtaggcgccacgtcagccaaaaccgccttcaaaaccgacgagggaccacgtttacccggttttcgtaagttgggggacgggtcatatccggttttgcggtcaagggatgaaaattggactgggcgacaaatagagggacccaatgtgaacttattcctcagaataatcgtactgcagcagctgggccttaaaaagtcgtagtgccggtgtccccatgtccgtccggaaaccacaagcccaacacaaatccttgtccaaagggaaatttttcgagtaataacttacaaatgcactgacaccaccgaaatctgacttattggcatgatcattaacgtgttaattaattatgcatgtatatctatacagtgcaaagcaggttctgtggacagcatatagtatcaaacaatatcatacatgaacttatcacgttattctcacagtgtctattctcctatcctttccttcggatttcagataaacctgcgtggtttccatacacaatgatcaaattttcgagcaggcaggagggagatgtgaagaccacgcatgtgacacgatgat

SEQ ID NO: 13665 - DNA, 383 bp, Oryza sativa
ctgacatgtgggaccacaggggcatctccttttcttattatttttgtgtagctgacatgtaggtttcatgttttttattatttttctgagatcctattgccacgtaagcgccacgtcaatgtcacgtgggacgaggaccaagttaaagggagccacgtaggtgtcacgtcatacaaaaccggacacaatactaccaagggatctcttttgcacggttttataagttgagggacccgtcatacccggttttgcaactgagggacgaaaatcggactggacgacaaatagagggacctaatgtgaacttattccttattctgaggccaccaggcagcccatcatcttgggctccgcaggccaaattgacttctgtcgttgtccga

SEQ ID NO: 13666 - DNA, 380 bp, Oryza sativa
ttataataagttttatattataagtcgcttgattttttttctagtcaaactttattaagtttgaccaagtttattgaaaaatttagcaacatctaaaatattaagttagttctattaaatctaataaaaattaatatattttgtataatgtatttgttttgggttgaaaatactactatatttttctataaatttggttaaacttaaaagaaatttgactaggaaaaaagtcaaatgacttataatataaaacggaggaagtatttgagagtacagttgtcgaagctgttatactagacagataaattttattgtctatcacaatcctttctattgcaaagagatatctcacacatttcctttgctttccccaggagcag

SEQ ID NO: 13667 - DNA, 1404 bp, Oryza sativa
tgccctcatcgcctcctcgccggttcctgtcggtgtcctctcgtcgttcccggtcgtcgtggcattcgtccctccgtcaagccgttctcgtccgtcgtccgtgtccgtcaagtgtgccgctgcagccccgtcgttgtcttcgtcctcgcctccgcgtcgccaagcgttgcgccggccgcgtctcgccttcgtccaaggatcgccgccgaagtcgtcccctcgcctttcgtctccgtcattcccggccgtctccgccgcgcccgttcatcgttgtcgttccctcgcctcgtcgcgtggtggtaaggatctctccttcgctgccccgtcctcgtcctttcggtatcgcccgtgcccgttgtgcggttgtcgaccccggtacccgtgtaccggtgtcggtagttgttcgcttgtgcgtgtggtgaccgtgttagtgtgcccgctcggtagccgcgtggtttccacgtgtgcagcccgtgtggtgtctagtggagtccgtttgtcggccactcgcctcggttgacacacgggatctgcttccgtcgacccgtggactgtctctgtgtactcggtctaccgcggtcctttaggttgacatgtggggtccgcatgtcaacggcgcagccttcctgtcttttccaggctagcgcttacacatgttttatagttgcaaaacctaattataataatccgcaaatctccatgtaacagcattaaacttcggatgatcatatcttggtcatacgagctctgaatcgatccgttcaagtctcctaatgtttgttataacctaaagaaccctgtgctttctttttatgtattgttattgcttctttataggcttgtagctttgcttgtgtgcttcgcgtagtcttcgtcgttccggaggttcccgaagcgtggtttgcggtcgtcgccgaaggttcggaaggccgttatctctgagcaaggcaagtcacatcatccttaagcatattgaatcccagtttataaaattattttgatttaaattaatgcattatcgctttatttaaattcctgcgttatcactgttttatttagccatgcctatttacctttgttatgaccttattattattgctattgttattattaccttgttcaccctaggataaacaaaaccccaactagtgggtactctattcatggttccactagtatgaatttaggtagatgcttcgctgattaattaggcaacattaggtggttttataactttagactttgggaattctcatatcatttggatactatggaatggttggcttatgttggaattggacacacacctccccctctattcaaaacccccaaaatggttttaggctgggctcgaggtgcgtggttgggttttgttagtcgtacctcgggtactataaggattaa

SEQ ID NO: 13668 - DNA, 1501 bp, Oryza sativa
aacaatataaaagatgctgtttgtttaaagaacttataatttatcccggcaaaaaataaagaaattatattttctaaggcataacataacaacttccagccgctggcaactcagtggcaacaatgaaatatagcccctcacaaaaaaattgcaatatttctagctgcggcctattccatctatctaaaacaaatcctatcttagccgtatttaattccctttaaacttccaacttttccgtcacaccaaatgtctagacatatgcgcgtagcattaaatgtggacgaaaaaaccaattgcacagtttgcatgtaaattgtgagatgaatcttttgagcttaattacgccataatttgacaatgtggtgctacagtaaatatttgctaatggtatattaattagacttaatagattcgtctcgctgtttacaggcggaatctgtaatttggtttcttattagtctatgtttaatactttaaatatgtgttcgtatacgttaattttttttaccaaaacaactaaacacggcccttgagtcaattcgatttcagaattggatttattttatttttgaggaggagtacgtacaagggctgccttttttttagatttttgaaacggctaattaaccacacgtaaaacgagaaacgtaattaacatataattaattaagtattaatatataaaaaatagtgaatatatttattaggttttttaaacaacttttatataaaaatttttcatgtaaaatgcacagtttaaccgtttaaaagatgtgctaacgaaattaagagtgtgtttgaggagaaggggattaaggagattgggaagatatgcaaaacatggtgagccattagcacatgattaattaagtattaattatttaaaactttaaaaatagattaatatgatttttttaaaacaacttttctacagaaatttttttaaaaaatataccgtttagtagttcgggaaacttacgcgcggaaaacgaaacaatctttctcgcagctacgacagaaaaaagagcgcagcctgtcaaatgaagcacgagcctgggcgcggtggctcaaaagccgaaaccggctaccgaacagccagtcaaatcgtcaaacgggccgagcattttagaacgggctgaacgtccgccgcggtcacggtccaacccgccgcacgcatgacgcgtactttcgtgctcacaatcacgggccgcacgtacgttcgcatcagcacaagtttgcgaaaggagaaacagaaaagagaaaacccagagtggtcaggttcagaagccgacgaggcagccgttgcatgcatcgatctcaacttctctcaagttcagaagcggccgaaatgtccgcggacacgtacgtacacagtacacgacaagccggccgggcctcctgtgacaacggtggtgggttacaccgtttgcggggccttgcggccaccacatgcatgtgccgcctgccgcgcagaagcaatctatggcaaaccgcccgg

SEQ ID NO: 13669 - DNA, 1501 bp, Oryza sativa
tcggtcgcccggctcgtcgtctcgcggcgccgcctccgtcgtcggcatcgcagtggcgtgttccacgccatcctcgtcttcgtgcagccgctgtaggctgcccacgtcgcctcctcgccggccccggtcgtcgtcgtcgtcgccctctcgtcgttcccggttgtcgtggcgttcgtccctccgtcaagccattctcgttcgtcgtcctcgcttcgtcaagtgccgcagccccatcatcgtcttcgtcctcgcctccgcgtcgtcaagcctcgtgccggccgtgtctcgccttcgttcaaggatcgccgctgaagtcgttcccttgccatccgtctccgccgcgcccgttcgtcgttgtctttcccacgcctcgtcgcgtggtggtaaggatctctcctctcgctgccccgtcctcgtcctttcggtgtcgccccgtacccgttgtgcggttgtcgaccccggtacccgtgtaccggtgtcggtagtcgttcacgtgtgcgggtggtgaccgtgtagtgtccgtgttagtgtgtccgctcagtagccgcgtggtttccacgtgtgcagcccgtgtggtgtctagtggagtccgtttgtcggccactcgcctcggttgacacacggggtccgcttccgtcgacccgtggaccgtctccgtgtactcggtctaccgcggtcctttaggttgacatgtggggtccgcatgtcaacagcgcagccttcctgtcttttccaggctagcgcttccacatgttttatagttgcaaagcttaattataataatccgcaaatctccatataacagcattaaacttcggatgatcatatcttggtcatacgagctccgaatcgacctgttcaagtctcttaatgtttgttataacctaaagaaccgtgtgctttctttttatatattgttattgcttctttataggcttgtagctttgcttgtgtgcttcgcgtagcttctgtcgttccggaggttcccgaagcgtggttcgcggccgtcgccgaaggttcggaaggccgttctctctgagcaaggcaagtcacatcatccttgaacatattgaatcccagtttataaaattattctgatttaaattattgcattatcgctttatttaaatccccgcgttatcactgttttatctagccatgcctatttacctttgttatgaccttattattgttgttattgttattattaccttgttcaccctaggataaacaaaaccccaactagtgggtactctattcatggttccactagtatgaatttaggtagatgcttcgctgattaattaggcaatattaggtggttttataactttagactttgggaattctcatatcatttggacactatagaatagttggcttatgttggaattggacacacacctccccctctattcaaaacccccaaaatggttttaggctgggctcgaggtgcgtggttgggtttggttagtcgtacctcgggtactataaggattaa

SEQ ID NO: 13670 - DNA, 1501 bp, Oryza sativa
ggctagagcagctaggttcagtggtagagagagaggcggaagggtgagaagagaggaaaaagccagaggagaaggaggccccaaagggcgccccgacgcagaggcggaggaggcgataagccctttcttcgagtcatccgaggagccatccccagaagaatccggcggcgaagaaacctagccggccgcatgggaggccacaaccgcagaggccgccgccaacatctccccgcccgtggtcaccatcagcgagggccctgtgggagctcctagccccacgaccaccgacgacgaggaggagagcggcgctagtgcgacacagcctcgctgctatctcatatccatcctcgtcatccccaggagtagagaggtgtggcggcagcggttggagcaagaaacgcaactgcgaggggtgaggggagatgagcgccttagcgcagctcctgccgcaagctacttttgtctcaggggggtgtgccggcgatggagcgaggctgcggcgtcgcccacgttcctcgctgcatgtggtcgcatccctacgtgggacccattgacatatgtgtcccattattttttatcttcttgtagacattagacatatggccccgcatatttttttctaatttttctccttttatttttttcggatcaaattgccacgtaagcgtcacgtcaatgcgcgtgggacaaagatttagtctaaagagccacgtaggcgtcatatcagccaaaatggggacaatactatcaagagatcttatttacactagttttctaagttaggggataagttgtatctggttttgcagtccaggaatggattttggactcgacgataaattgtgagggaccaaaagtgaacttattcccttcaaaattggttaagttttggtttcgttgaatttatttcactctgctcccaccgaatctttctcacgatgaaatcattttccttggtggcgttttcaatctaggtgggcatcacatttcctatataaaaattatgcaaaaatgactgaataatactcactccgtccaaataacctcaacctactaccgtaaagaaaaaactaaagctatgtgatgataagacaacataggaacagattcgttatcctatcctagattgtatcacatcctcgattaggttaggttgttttgatggagagagtatatatatgtatatgtatatacacacatatacacacacatgcttttgcagaaaaaataactatatactacctccatattttaatgtatgacaccgttgactttttgtccaacgtttgaccattcatcttatttaaaaaatttacgtaattatcatttattttattatgacttgattcgtcatcaaatgttctttaaacatgacataaatatttttatatttgcataaaaaattttaaataaaacaaatagttaaacattggtcgaaaagtcaacggcgtcaatacggaggaagtacaagtctaggactaattaagcatgccgtgttgcg

SEQ ID NO: 13671 - DNA, 1501 bp, Oryza sativa
taatattgtatagctctaggatcgtgtttacaaaatagctttgggcaactaagtgacttttaaatgctgtttactgcaaaacttaacccctatattattatccccttgtacccccttgcattaattatgcatctccggtgtggcttgctgagtactgtggttgtactcattcttgctctatctttctccccccttcagtaagagaagctttggagaagaagtcttaggtggagtcttggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtatggtgtaccccggcttttcctgggacggggattaatacactagcgttcgggaaaatgcaattttctcggtcgcgacaatttccttgacatacaagtttagaatttaatccgagtcctcttaaagatattctttctatacatggcaccccatacctagtcggactatacatgccgtgtaggtatggggtatccataatctccacagtagcccctgagacctttacagtcgacgaaacaatctcttctcgtagcacaaaatgataatccgagtactccgacttcttctgccttgatctcccgagtaccaaaatcaaagactgtgaaggtctaaaaatagaaaaaaaccgggtgcatcgactagatgcacctaattaggtgtagcccccgactatgtgattagttaaaaaactaaacatatagtcaagatgcaaactacatccaacagagtggtttgacaactgaatatcatatagcaaagcatatgcggcgttcaataaaacatccagccgactgcttttagctttaatataccaaaaatgaagatatgaaaaggcccgagtgaaaaacactctaaagatccataaattcacacatttgataagaatccgagtaaaaactctcaaaaagatccatcaaacgtgatataaatgtgataacataacaagtgatgagtctaactagcttaggctatgactcacaccagaaaaataagcatataacatgccgagtgaatgactgtattaaaaccagtcatctcaataaaacccaaacagccttcgcagcctaataaggcctacaaaattagtataacacctttctgttgggcacctttttatttgcatcataataattccaaagaattatctaaccgcatcaaaaatgattttaacagcatcgggctaaactgtcgtgagcaagtgttgccaaagcaaaaatacctaagtccctaaggatcacaactagcaacgctggtaatagaattgggctgaagtactgtaacatcccggcctagggcttaataggattaatagaatactcatatcaacaagttgcaacttcttttccaaaatccaatctccaaagaactccagggttaagcgtgcttggcctaga

SEQ ID NO: 13672 - DNA, 1501 bp, Oryza sativa
ataaaactatgctggtgttgtaaatatgaaaactgatatattttttaattgatatagatcctactaattattgcatcctttatagttgttccaagcatgaatcaatctctatgatctccataagactcgtttctcttttttcattgtacagtgtgctgcaaccgggcgataattctattgtcagctcgcgttctctctctaccattgtctcctccaacatagcaatgagatcgacgtggtcacgctatcgccggtccatgttagcctattaaacatgcttttagaagagggttataattttatatagtttgttcagctcctcattttttttatccgcccataaatagaattttctctcatataggacacatctgactaaggatgcgttcgttcctgcaggttcccaactcacttccctcgttttccgcgtgcacgtttaccaaattattaaacagtgcattttttgcaaaaaaaatctacacaaaagttgatttaaaaaatcatattaatctatttttcaacaaaaaggctaatacttaatcttgtatatttatatagttcatccccactaagtgtgtagttaatgctatttctctcttctcttatgaaaccacatcatcccaattatttttagcctttggatgatagatctatgctacaactagtctcttctttattctctcgtgaaaccatacaatcccagttttttgtctatatttgtattgttcatccccactaagtatagttaatgctaatttctctattctctcatgaagccacataattccaattatttgtagtctttaaataataaatctatggtacaaataatctcttcattcttctctcataaaaccatacaacctcagctgtttttattcaaaattcataagtatcaaaaatatgttcaccttgcattatatttgcagtcatgtgttaattatataaaacataggaagtcattttattttggcttacaaaatataatatagcttattgtacatactatacaacttagtttccagcagcaacacgacggggtattcatgttccagttaaaaaaacaaacaaggcaaacggtgaacagaaaataaccgagcctatcaaggggttttgtagaaactgtccaagctgctactccgtactactttatagcgttccaaggatggacggctaggatgcaagcaaacattccaagggcaaggtcattcggcacccggggggcctcctagaactctcgccttccccgcgccgccgccgccctctcaaaacgagcgatcgagaaaaaccctcgctgctctcctccccctccccctccccctccgccgccacctcagatctccatctccccgccaccaaatccccccgaaaccgcgagctcctcgccatggcgtccatgatggtaagcaccactatcccagtctccattgacgcgacctctgctcccctccccgcgaggttttgaatcactggcgtgatttgtggtttggggttttttgtg

SEQ ID NO: 13673 - DNA, 1501 bp, Oryza sativa
tggtcaattggcaacacaattctccgtccaaataaccctatgacgctacaaatacatacatggatgtatatgctaacctatgattctaatatacgacactattgatattttagatacgcttgaccattaatcttatttaaaaaatatatgtaattaccatttattttaatatgatttaatttattatcaaatgtttttataccacgacttaaaaatttctatatttgcaaaaaaaaatgaataagacaaatgatcaatggtaaatttaataaactaatttggtatcgtagatgttgctaattttttctataaattaggtcaaacctaaaaaattttaactaagaaaaaatgaaacgacttacaatatgaaatatgaaatagagtattaaaaatcggaggtagaatatatatataggcagatagaactatatgactattcgttctattgaaataattttataaataagttattactaaagtacatatctatgcttttataaaaattgaaattgtttccgccagaattttggtatgtcatccgtgtttgaagcaattttaattttatgtttctaccaaattttttcctttttttccaactctagagtgtctctcttacctaagacatacgcgaattaattgggcccgtggcttttcacggcgtagcacgccccttgccgcacgcagcgatcgggtccgcgcctaagtccgttttccacacgcgacattgcgcaccaccgcggttgggcccgtgacgccctcgcgcatgcgatttgcccttgccgcatgtccgattgttattgtttcgccctcccccttgatttaaaaattgaagatgtttttgtcctgagttcattttccaaatgcgacattgcgcgccaccgcagttgggcccacgacgccctcgcgcgtgcgatttacccttgccgcatgtccgattgttattgcgtcgccctcccccacgatctaaaaattgaagatgtttttgtccaaactatggtacgtcgtccgtatccgattcccatgtgcgtaacattcatcacgaagtcacgacttacgagtgaactgtgaaagagatttcgtgtgatgtggatacgaagcgaatgaaattcgcagagtccgtgtggataacatacatcgttgcccagatcatccaatctattcgtattacacgtcacgttttctgggatatgctaatatgattttaagtcagtctctacacatgctcgtatgtactattaggatactgttacaataatccacaagaatcaattttactttcggaaagaacatgccaacggaaataaaggtaaatgaatattgtgataagagtaaattaattagtcagtagcaccgcaaaaacctcataaaaatggaaagataagagtagaagaaatttatttttgaaaaatccaaagggatctgtatttcaagttcacctcaatttaccattcttcgcttatgtgcacccagtcttctactaagatcagtagcatacaatgcg

SEQ ID NO: 13674 - DNA, 972 bp, Oryza sativa
atttaaacctggggtttatataacgccgatggtgaacgaacgtgaacttaacgtgaatgtgaacgaacatgaacgaatgaacgtacgtgaacgaaacgtgaacttaacgtacgttaacatgaatgaacgtacgtgaacgaaacgtgcacttaatgagaacgtgaacgtgaatgatcgtgaatgaaacgtgaatgtaacgagaccgcgaacgtgaacgaacgtgaatgaaacgtgaacgaatgtgaatgaaacgtgaacggtcgctttatatgacactacgtgaaatacaatatatgttactttgcgtttagactaatacatttttttgtatgttacggaaaagacgtcatcgtcgtcgtccctcaagccggagtggtagctagccctcgaaggaattcgcgtaggcaagtgatgtaaagatatgattgttagatttttaatgtaattaagactattagatttaatatacaacacttagacatagcatatatgattatctagggttctaatgtacaacacttagacttagcatatatgattatctagggttctaatatacgacacttaggcttagcatataaaattgttagagttagttttaatacaagattagtacagttttattgattatctagtgttctaatatacgacacttagacttagcatatatgactattagatttttaatataagattattagagttttaatacaagattatttgagttttaatataagattattatatttgtaattagacttagcatatatgattatctagggttctactatacgacacttaggcttagcatatatgattgttagagttctaatacaagattagtacagttttaatgattatctagggttctaatatactacacttagacttagcatatatgattgttagcatatatgattgttaaagcaaatatgacctatagacttggcaaatatttcttgtatgaacaaa

SEQ ID NO: 13675 - DNA, 1501 bp, Oryza sativa
caataatggcaatccacgtaccagggtctccctgctcatttttctcagcgcagtaaagttgatgtgcccgaaccgagcgtgccaacgccacgcgttttcgccggggcgcgccgtcaagcaaactggccgcgcgagcttgatgtcaagcacatacaagcgccctgggctccgagggatttgggtgagcaggcgccactgctcgtcgcggacgcgcatgatgccgtcctcaaccaatacttggaagccagttttgtggagttggccgatgctgacaatgttggcagcgagccacggcagaaagtacgtgttggcgagggtgcggtgttctccattcttgcaggtgaacaacaccgtgctgcgcccctcgatagggacgatcgagccatccccgagccgaacgttgccggtgacactagtgtcgaggtcggagaaggccgctcggcaacctgtcatatggtttgacgcgccggagtccatgatccagctgcgcgggtcgcggtctgcttcatcatctaacgcagtgaacaccttcttctcgacgagctcgatgcagacgcactgaggcgccggcgtcgctggtggcggcggtggcggcaacatggagcctgcggtttcgacgcagcctccagtcaggagcatgagcgtgggctcgtcttgggccacatgggcctggtcttcatgcttgggcttgctccggcactccttggcccaatggccgagcttgccacagttacgacatttgtcatccctgtgtgccagtgaggaggtggtgtaatatacccgaaattctaggactcaaaaatttcatgtcaaaataattagaggttaacttctccaattttgagagccaaaaatttccgttttaaacttaggtgatgaccaacttaaaccattgcatgattaaaatttgggagcaaaataaaatcttttcattcccaacattagactagaaatgtcaccaagcatatgagcatacatgtacataatgcatgcctaggctcgagttctttgtgcatttggagttttggtcttgcattccataataggtcccatgagcataatctaaaagaattatttcactaaacatcactaaacaaacctatagttaatcttaggtgataacatgtggacttaatattaaactcaaatatcatcttctcagtctaaaagaagtttaatgtaatccctataataatattagatgcaattatgaagtgggaatacatatacaaacaaaggtcatcctaattctctaaaatattttgtgcaagataaaatcatggaaaaatttatgtagatagtgattagcacaaacttatcctctgtactttttgtcaaatgttaacactcaagttgatacctcaaattaatcagtcaaagcaaacaactaaaagaaatcaaattaaattttaatcggctaaaaccatatttcatccaaaagtacatttacctgcacataagtgaatatgggaaataatttattcgaatactagattattta

SEQ ID NO: 13676 - DNA, 1501 bp, Oryza sativa
aaaagctattctctctctaacgagcgtaagagctgttctgttgttgcaacgagctttcctgctattggatttatctgatagaatatttgatggttgatatcagtaccatatagatgtacttcctttctttgacaaattaaatgtgcttgagtattgtaatatgctggcttaaacaaatgtaaacatgtctctggctggtgcaaatatttagagctaagctatatatggcctggcgcaacctcaatcacaatggtttcgttccgataatgggaatagctcaatcccaaagatgtttccttgtttcacatggtacaacaatttggcgggggtgggtgcgatacagtgcaataactcgagaattgaacgttcgagtgcaacaacttgataagtaggtgcgttttagtataagaacttgacaatttagtatttgatacataaacttagctaagcatatgctaggtacttaaaatatacaaatccacgctagtatattgtcaaaataagtacttaaaaattaaatatgtataaaaaagtgctccaaataattaagttgccgcataacttgttaacttattgtatcgaaatcgtacatatcttgcaagttgttgcatttatgtgatcacttataaagttctggtactaaattacacctatctgccaagttgttacgttaaaacgctcatttctcaaattcttgcaccaaattacacccatctgctaagttgatgcaccgtaggtgtaatttactctttcagtagtttaaatgtgtcgagagagaaattagcagatccatcagaataggatataaatttcgcagaaaataaacaaaaaagggaataaaggagggagactggccggagcgccgctcccgccgttcgccacgtggcagcgggccatggagtcactcacccctatccagcacacactagaatgctcttggagcgccctaaggccggcctcaggtttgctcatcttcatcgccctccgtggccacggctgtcggtgacatgggaccgggagtatcatgactagaggcttgggcaggagcaatcacccacgaggcctgaccccctcgggggggtcgggcccgagggtgatgtggccgcccccctctttgtcttcccgaggggtcggaccgctcccgtttcggccccgagggctgaggcgccccgaccccttgtaggttttgcgccgcgtgtatgggttaggtgagcgcagcggggctcacctaaccgcatttattgcggtttggacgagcgcgtcacgccgcatgtaacgcagtgcagcgcgctcgtttatccggtctgtgaccagtcacagaccgatcagatcgtgggttaggtggcgacaggcggtctgacgcacgcctcgccccatcccgtcaggatgagagcctccaagcactcatccctagccggggtcggcgtgttagctcctggaggtggcacgttggacccggtcagatatataccagccttcatcctaaccattacaggcaaga

SEQ ID NO: 13677 - DNA, 1501 bp, Oryza sativa
tcgccggtgcggtggagagaggaggtggcgcgggaagacgtttgggagggctcggcttgctgggaggaggcaaaaggggaagaacgggaggggcggcgccattttataggccgagaggaggagggaacggccggagggagctcgccggccggccatccatggcggccaatcaaggaggattaaatccggcgaatttaatccgaattaagaggggaaatcaagggggaattgatgatgaggaggagaggaaccgattttcgcaatcactttggaggagaaaccactggggagggagatcaagaggcggccgcgcttctgttcagccgtgagaagaacaggcgacggctcggctggaggaggaagacgacccagcggctgggccagctgggccacgcggaggattagaaacagactttatccgcggagagtgaggaaggttgggccgagcaagggaggcgaggagatgggctaaggagaaggaaaaaggcccacgagggagggagagagagagagagaggaggaaggggaggaggggggcgctgatacgcgatcagccgcgcgcgcgcggtcagtcgctccccctctagtctcttctctgtatctactatacttatgtatatactacatatacacacatatatacatatgtatatatgtgtgtatatatatatatttataaatatatttttaatatataaaaaatatatacacatatatacaaactttgtatccgatgtatacgaattttatatacatatgtattaaaaaattaaaaaaataagaaattacatcacgtatacaaagtttgtatacacgtatgtaaagtttgtatacgcgtatataaactttgcatacgcgtatacaaactttgcatacgtacgaatacaaactagcttggtatacatacgaatacaaactttgtattcatacatcttaaaaaaaactaaaaaaacagaagagaaaccgaaaaaaaaagaaaaactaaactgaaccgaaaccaaaaaaagggaaaaaaaaaagggcaaaccgaacagaaacggaaaacatggaaaaaacaaaaaaaaacagaaaactcgctctcccgtgcggcgcgtccgccgccccctctcctcgcgcgacacgtgtccagtcatgcggggaggggcgcgcgcgagtaatagccttctcgaggggaggaggacaataagacttctgccatgggctgagagagagggaggactttgggccgaaaatgacccaaagggagagaggatttatttttaggttttctatttttagttaactctgaaattggtttttgttgcttaataaatatttttgctgctctgaaaatttgagtaaaaattgagggctcctctttgaccatggagaatttaagaaaaatactccaggccacatttgaatttttcttgtacgcattttaatgtttgccatttcctttttgaattttaattaatttattatttcttttagagaatgatttttaaaacgggatgaattt

SEQ ID NO: 13678 - DNA, 1501 bp, Oryza sativa
tgaacaatacaaatatagacaaaaaactgggattgtatggtttcacgagagaataaagaagagactagttgtagcatagatctatcatccaaaggctaaaaataattgggatgatgtggtttcataagagaagagagaaatagcattaactacacacttagtggggatgaactatataaatatacaagattaagtattagcctttttgttgaaaaatagattaatatgattttttaaatcaacttttgtgtagattttttttgcaaaaaatgcactgtttaataatttggtaaacgtgcacgcggaaaacgagggaagtgagttgggaacctgcaggaacgaacgcatccttagtcagatgtgtcctatatgagagaaaattctatttatgggcggataaaaaaaatgaggagctgaacaaactatataaaattataaccctcttctaaaagcatgtttaataggctaacatggaccggcgatagcgtgaccacgtcgatctcattgctatgttggaggagacaatggtagagagagaacgcgagctgacaatagaattatcgcccggttgcagcacactgtacaatgaaaaaagagaaacgagtcttatggagatcatagagattgattcatgcttggaacaactataaaggatgcaataattagtaggatctatatcaattaaaaaatatatcagttttcatatttacaacaccagcatagttttataaatctataattgaataagttttcataatatatttatatgaggttaaaaatattactaatttttttcaataaaattagtcaatcttaggagtagtttaactttaaccaaagttaaaacatcttataacctgaaacggagggagtaccattgttatatggacaatctatactaacaagctataaatgacgtagatgtgttacaactagcaagttgacaacatttataaatccgctctaatggatgtatgaaaaataaaattaataaggtgtaatggggacacccgtagttaccacgtcggcaatagaggctcagagacccattcgtatggcagatccacgtagttacccgtagttaccacgtcgtcccatggcagatccaacaccattcgtatgaatggctaccatatttttttctttcacaattcgaaaagataatccacgtattcacgaacccgtccaatccacgctcgccgcgcccggcaatcgcgtggcgcgtgtgacgagttcggagttcggttaatgtcaacgacgagttgggcagccacgcagcagcgagagcagcgtcgcgtggattccagccaaacccctcctcctctggtctccagtggcgtaacgacgagattcgtcctcctctcctccgagtaaaagaaggagaccccctttgcttcgctgttaccgcacagtgaggccacgtcgtagggtttttgcttgcttctcccggctgcaaagcggagccgcggcgcggcccggggacgaggagggaggggagcca

SEQ ID NO: 13679 - DNA, 1501 bp, Oryza sativa
tgcgccctcgtcgaaaattcactccgtgactagcgtggtgaacttttgtcaattaatgtcgatattggcacacgtgggtgtgatgtttttaacaagaacgaaagattcaaaaagaactaaaacatgagttttggacatattggagtgtatttggtgcgtccgaatcgaaaaatcactctgtgattcgcgcgacgaactttcaattaatgctaattttggcacacgtgggtagcggaaccaaaattttcaaaatacacgaaagcatgagttttggacatattggaattgattgggtgcgtccgtgtagaaaaatcactccgtgactcgcgcggtgaactcttgtcaattaatgccgatattggtacacgtgggtgagatgtttttaaccagaaaaaaaaagttcaaaaaaaagtaaaacatgaattttggacttattggacgtacgtccgtgtcgaaaaatcactccgtgactcatgcggcgaacttttatcaattaatgccaatactgcactatattggcacacgtgggtgagatgtttttaaccagaaccaaaaagatcaaaaagcagcaaaatatgagttttggacatctcgtagtggattgtgtgcgtccgtgtcaaaaaatctctccataactcgcgcaacgaacttttgtcaattaataccgatattggcacaatggcacacgtgggtgctatatttttaaccggaacaaaaaagttcaaaaagcaccaaaacataagttttggtcaaattggagtggattgggtgcgtccgtatccaaaaatcactccgtgactcacacggcaaacttttgtcaattaatattaatactggactacattggcacatatgggtgagatgttttttaccggaacgaaaaagatcaaaaagcagcaaatcatgagttttggacatcttgtagtggattgggtgcgtccgtgtcgaaaaatcactacgtgactcgcgcggcgaacttttttcaactaatgccaatattggcctatattggcacacgtgggtagcggaacgaaaaaattgaaaggtacaaaaacataaattttggacatattggatttgattgggtgcgtccgtgtcgaaaaatcactccgtgactcgcacggcgaacttttgtcaattaatgccaatattagcacacgtggtgcgatgttttctcaccggaacgaaaagttcaaaaatcaccaaaaacatgagttttggacatatttaagtgtattgggtgcgtccgtgtagaaaaatcattctgcggctcgcacggcgaactttcatcgattaatgtcaatattggattatgtctacataactatctcgtagcaaagtgcgggctatcaactaattaaaccttccctccggcgtcaacatcgtcacaacgtcattcttattcgtgccaaatttaggtggctttcccagtttatccgcatgtccacaaattaatccctcatgctcttggcatttacccaccagacgatcacatcacccg

SEQ ID NO: 13680 - DNA, 625 bp, Oryza sativa
  unsure (1)..(625): unsure at all n locations
cgctacaagaaaacagatccttcaaatctagaaaccancctgcatgtgataacaatcaaaacaaaccctatctattctaactaccggatcaatatcacatgtggcgcaaggcctatcttcagctgaatcaaccgaacccttatcatgtcatttaacatcttcgcccgtcgccggctgcacccctcccccgccgcccgttgctgagccccgccggccaaccgcgtcgtgccgccgtcatcaggccgtgccaggtcgccacgtgccgtgcccggcctcgccatctgctgccatctgccttacccgtgccaggtcgccgcgtgccccgccgcccgtagccgaccagcacaccgtacgcgccgctcgccgccgtgcgctctcccgcatcaccgccgccacacggctacctctctgcgtcgcaacacaccgcccggccgccttgcgcccgactcacgtcgacgagccgcaccggggtgaagagaaaggccaggggagagagagatagctacacactgacatgtgggtcccaccacgctgagtcagcttgtcagccgggtcaacaacgccacgtcagacgaaaccaccagcaaaacaaccgagggaggtgatttgttctggttttcggaga

SEQ ID NO: 13681 - DNA, 1501 bp, Oryza sativa
ggcctctgttgcaaagcactaccgtacttccacatgtctagtgggtaaggcttagtttgtggctcagtctggttataaacaaaagtacacggatggagatggacgaagtcgggggtcgatggacatctccagggcaaatgaaggctacacgagctgcggcccggtagtcgagatgtcatggcacagggccggtgtcctgctgctaggggctcagtcctacctacctgtcccgggggttccggccgtaggtgggattgggtcggtactcttgtctatggctaggatgggttggaaactatgtcacgtcttccgtctgtataccgtggtggtatgtggcacgtggttgcacgtgaggaagatgtgtcttgtgggtaaagatgtacacctctgatcagagtataatccattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccggttcggtctgaatcatcgtaggccttgggttaaggcaggttcgtgtgggttcacggccttgataaataatattgtatagttctagaatcgtgtttacaaaacagctttgagcaactaagtatctttaaatgctgtttactgcaaccctaaccctttatattataactcccttgtactcccttgcatttattatgcacttgtgggtgtgtcttgttgagtacggtggttgtactcagtcttgctcaattttttcccaaacccagaagaggagtctctggaagatgaaggttttggtgtctagctcgtgcctgccgtcaagcgcctgtggtcgtcgccctagtcttccgctgtttctcgtttgtctttgtgtgtgctgggccttcactgcccatgtaataaattaactatttacgcttctgcttgttgaactctgaactgtatcaacttttggtgtaccttacctcctgggacaaggaataatgcactcacgtaaggaacgcccgttgggttatttccggtcgtgacaataggcatggctaaataaaacagtgataacgcgggaatttaaataaagcgataatgcattaatttaaatcaaaataattttataaactgggattcaatatgttcaaggatgatgtgacttgccttgctcgctttcccaaacgtcggcttcaacctccacgaagagcggatcttccgaagctacagcgtctacacgaccaacggaaaagaaaaggcttttactctaataaactccatataaccagcaggaacaaagcacaaaaataggttcttgacttcttaagaaaaaattagagacttgaacggtccaattccgagttcaaatggccaagttatggccatttgaagtttatatgctctttaaatgaatatttgcgaatttcttcatttaaattttaatttaaaatggatttattgcgtca

SEQ ID NO: 13682 - DNA, 1501 bp, Oryza sativa
ccttatttgtcaaaactagtgcaatataagccctatgatgatttgaacggcggtttcagctgatgtggcgcctacgtggctaatttgactctgtcttaatctgacgtggtattgacgtgacgcttaagtggcactttgatttggaaaataataaaaaccgtgatggggctcacatgggccctacatgtcattctcacccctctttcttcctcttctctcccactcccctctcttcatctctctcccctctcctctctccaggctttgtcgagcccgcccaagaccgaacccaggggaggcgtgggaggtggcgagggcggtcgtggtagtggaggcgagggcgggctcggcaagcatgtgtcgctcgccagcgaggcgctcgacttcctctcgcatcacagtcgaatctggagcagggatccccgatgaacaacatcgtccggccacagggaggcaggcagtggtgcgtggttgccggtgggaaagaagcagcgcgtggcggccagcaagagatgggagaggagagagcagcgtgtgacggccaactggagaggatgggcgtgcggtggccggcgggagacgggagaggagggagcggcgcacggcgtccggtgaggcgggtggggagggaggaggcagagaggccggtgatggcggggcgtcgtgggtagggctcgacggcgacgggcggaaagagaggcgcgcagggggcgacggccagcgatcgtcttccgcgtcaatctccacctcttctcactggctgccgcccttctccctctctgcgcgtgctcgtcggccgacgaggaaggatggccaggagggacagaggaggaggcgtcggtccctcctctctcgtctcccgtcttctgtgtgtagataggagggtgggacccattgacttgtgagtctcactattttttcttttgtctgtctgacgtgggctccacatttttgtttttaattttagtttttatattttgcttatagtgtcacatcatcgtcacgtaggacaaggaccaagtcaaagcagccacgtagacgccacgtcaatcaaaaccaccatagaaaccgttgagggacttcctttgtaccggttttaatagtcgagggacccattgtatctggttttccggttgaaggatgaaaattggattcgttgaaaagttaaaggaccttaagtgaacttatttcttactggaaccagttgggcccaaaagaacataccacaagacccaccactgactcaaaccttgcttcgtgcaagatctttagaaatgtttcttttttttcctttgaagattacatttaaaagaagaaaaaaaaactgccgcctaatttccttttaaaaaaatgctataagatgttaacccgtttggatgggatggtactttacaggtatcatatgctatcgactaattcctattagacataagacgatatctaagaggtatcatcagctggtacctaccaagtatcatttcgtcgaacgggatatctactt

SEQ ID NO: 13683 - DNA, 1501 bp, Oryza sativa
cctacttatctttctcatatagttttttttggttccggtgtccgaaccgaaagtttacagcccgtttttcctctcttttttttttctctcctacacctcggcatttagccggtttatagcgtaccattatacttgctcttatggcttatccgcttctcatagcttccacgtcaactgcaagacaggcaggtacggcgagaggcaaatcattggcggtttttgtagtggattggcatccaaacaccagcgccaaacataaaacatagctgtcgttcgccctgtccacgatttcacgaatccgtatgcactccgctgcttgagagcggtttgccaacagccaaccaactgctgctgctcggtgggtgcttaattaattttcgtcggcgtcggtgtcagcggcggcagaaagcgttgaaacacctgaaccgaccatcggctctaatgccaaacgatggtcgtcgtgccgtttgctgagtagcttttggcgctggtagtgcgctactactcggtccatttgttggaagaggtcgcatattgcatattgtttttttacttgtgtggcttgatttctgcaacttccaagctagaaataataataataataataataataataataataataataataataataataataataataatatactaaagtagatatcccgttcgacgaaatgatacttggtaggtaccagctgatgatacctcttagatatcgtcttatgtctaataggaattagtcgatagcatatgatacctgtaaagtaccatcccatccaaacgggttaacatcttatagcatttttttaaaaggaaattaggcggcagtttttttttcttcttttaaatgtaatcttcaaaggaaaaaaaagaaacatttctaaagatcttgcacgaagcaaggtttgagtcagtggtgggtcttgtggtatgttcttttgggcccaactggttccagtaagaaataagttcacttaaggtcctttaacttttcaacgaatccaattttcatccttcaaccggaaaaccagatacaatgggtccctcgactattaaaaccggtacaaaggaagtccctcaacggtttctatggtggttttgattgacgtggcgtctacgtggctgctttgacttggtccttgtcctacgtgacgatgatgtgacactataagcaaaatataaaaactaaaattaaaaacaaaaatgtggagcccacgtcagacagacaaaagaaaaaatagtgagactcacaagtcaatgggtcccaccctcctatctacacacagaagacgggagacgagagaggagggaccgacgcctcctcctctgtccctcctggccatccttcctcgtcggccgacgagcacgcgcagagagggagaagggcggcagccagtgagaagaggtggagattgacgcggaagacgatcgctggccgtcgccccctgcgcgcctctctttccgcccgtcgccgtcgagccctacccacgacgcc

SEQ ID NO: 13684 - DNA, 1501 bp, Oryza sativa
tgatttttgagtttagggggtaattcggtcgaccacgatagttcaggggtaatttgtacttttttttccttatataaatgaaaatcgttcatgctgctctcaggagtcaggatgcaaagaaagatatatatgctgtgctagatgattttcagagcttgggaagaactaaacaatgaagatactaaatctttagtcccggttggtaacatcaaccgggactaaagatatctttagtccgggttatacaaccggaactaaaaatagatatttttagtcccagattcgtagtcccggttacataaccgggactacagggggttgtgaattgggactaaaaagggtttctccaccagtgaatatagccttacagtctgcgaatgcaatatatagtggtcagaagagtcaataatagtttgatccattgtagcctgaaaagaactgtgatagtgcgttattcacctagtagtacatcatccaacatgtttatcaatttgttgtatatatatattagggttggggacatcctcaactatttgtttttttattgatattatctaaatcttgataaaattgattagcgggcagtttttttttttaatggtcgccatggggagagtttcctcacctgaatttcattcaactacagagagaaagatacaagtagttcgtcaaattacagaacgccgaatagaagaggaaagagcttccttccaagaggaaaccactattctatcattagtatcgagtctttcagcccaaagcgttgcatcgtccaagcatttggttaccagacagctgagtgatggttgcattcctcgaaaaaccatgtagtgttggtgattgcatagtccgcagaaacacagaaggtagaagacctgaaaatgtttatttgggacgccatggggtttctgtaagctcactgttttttgaaacaacctgtaaaagaaagtgtgacatttctaatttctattgataaagaaagaataaaatacaagtctatagtcttgggaaactatactcaggaaaaaataaacaaccacaccatgcgtctacgtctgtccctactactaaatacagaaaaagcacacaacacctctgaggaataggtcttctaaacgacgccttcaaggaagaaacgacgctaaaagcgtcgccgccgcccgccctactgcaagcttactagatttgccatatcagggatcgctgctagtatttacatggaataagttcactttgattcccttaaaagtgacccgaatctaatctgtgaccctcaatcgcaaaccagataggacgactccccgaactattaaaactggtgcaatttgactccctcggcggttttggagaacggtttcgctgacgtggcgcatacgtggtggtattgatctggtctttcttccatgtggtgctgacgtggcggttacgtggcacccgaatttaaaaaatatgtgtcgaacccagttgtcattcacacaaaaaaataaatatgggacccact

SEQ ID NO: 13685 - DNA, 1501 bp, Oryza sativa
attgggtgtccttttgctcgttccttctggcaagctatgtaataggaataagtttactttgaatcccttaaaagtgacccgaatctaatccatgaccctcaaccgcaaaaccggacatgacgactccccgaactattaaaaccggtgcaatttgactttctcgacagttttggagggcagtttcgctgacgtggcacatacgtgacggtattgacctggtcttccttccacatggcgctaacgtggcagttatgtggcacttgaattttaaaaatatgtgtgggacccatatatcattcacacaaaagaaaaaatatgggacccacgtgtcatgcatcctgtctcttccctccttcctcctccctctgtcccttctctttctttctctcctcacgccgacgtcatggagcctcgattccccgtcgtcggcgcctccacctcgccactggtgacggcgtccacgtccctgccccccatgtgggggcacctttgcccctcgccgctgcagtagctgcaagccagcgctgatgaagtcacggcggtgtgatgaagtccgcttttgctgctccagatctgctgctatttgcttattgcttgatgaagcctagataacgatgaacgagcttgcggttgttagctcaacccgacaacaagctactgctgcttgtttgcttgagcatgaactaaaccaaaagaaggtttgttgtgctgttgctgctactacttggcgtaggaagaagaatagaaggtccacctcggcaccgccggcgccctcctgtcatcgtcctccccgacccctccttcatggattcacgccggcgacctcctccgcccctagtcccctcggctccgtgtgggtctccagcacccacgagcggatctgagacccacggcgccgtcttcggcttactccgctgtccacgccgccgctggcctctccaccgtagtcacctccaccggcaccgcgtagatcgaccttcttccttcggagcacagtcacggcctgtgtcaccgccatggggagcggcaggaggagcaccgtggagtgatctgacaccaacatgtagcgtcagctctgctaccagacgccacacggtggccgaacgggaggcgccgcacttggccatcttctgcccgagctagagcagctgggcggctagattcttcgccacgagctcgccgaacccctcatccaacgcggcggcagtggtggccgtcggcctccaccaccacatccgttcgcacagcgcgcacgaccaacaccatgcctggccactcccctcgacgctggtcatgagacgcgcgcaccgtcgatcggggaggacgacaccgggagggcgctgacggtggcgacgtggagacaccgacgagaaagggagttagagagaagggagagagagggaggaggaaggagggaagagagaggatgacacgtgggccccacatataccagtgggtcccatatttatttttttgtgtgaatgacaactgggttcgacac

SEQ ID NO: 13686 - DNA, 219 bp, Oryza sativa
tatagagccacacacaacatccacatcccaacgaaataccccagtgaccacagctcacactcatcttaacccattcataataagctagacactactggccggccagctagctgtggcctctgggctctctataaagaagaaagagtatgttgtgtatgagagagagagagagagagggtatgaagaggagaggtggtgatggagggagaacattagaca

SEQ ID NO: 13687 - DNA, 1501 bp, Oryza sativa
gaaaggacatgtagactagtggttatagtgacctgagtagtaccccaaggtcctgagttcaaatctcctatggagcgaatttcagattgggttgtttgcggggctaagttccctatttcaatggccgtatatatccgattggatgtagaggacgggtaaaaaatacccttcttaaaaaaacacgtaaagaagcttagttgagaacacgtaaagacgatgctggatgcctgaatgcatgtcaaactgtgcaatgtgatgttgaaatagagcacgtaagtccaagaatttaatgctctcaaaaacaaaagtccaagaattgaagcaagctgtttacttttaccgttgccatggaacgtattatactgttatcatggaacatgttgtactgtttattgacagatggacacgaggagcttgcagaagggtacactatgacaatgacaataattatttttagcattggctttgaaatctctaggacaaagttttgtcaacaaattattaaactactggagaactgatcttttcgtgtgtcggccaaaaatcatattagtcccggttcctgttacaaacgggactaaagaatatgtttagcctcggctcaaaagcccaatgaaactttttgatctttagtcccggttagtattatcaactaggactaaagattatttttagtatttttagtgattttggatgtagatgattttgttattgaatttgtggatgattttgtgatgtttttttgaatgtaaatgattttgttgttgagtttggtttgaaatcaacatacaagcagcaacaaacaattagaaaaagaaaaaaaactttagtccggcttgttaacaccaaccagagctaaagatggtagcgccatccacatagcattaccatctttcgtctcggttgctattatcaaccggtctaaagatcaatcttaagttccaattatatcaaccaggactaaagatttactgagcttcctagtttgcaatccgggattaaaggccattgcaaaccgggagtaaagagagtttctccacctgtgttatttttatttgctgaacgatggatcagttttaggcccaatggtgtgagcagtaaagaataagctggatgctaaagcatggaaatgggcaaaatggctatgcccgatgtttgaaaagtgcatttcagacaacgaattgaaccaaacctgcggagaaacggattctaatcgcccgataggctatcccctcatattctttccaattcaatgcaaaacgctgtagaaagaattttaacaaaaaaaaatgacaccgagagaaaagaaaatgactcattgaggtttgaatagtacaagtacttttcaatattcatacgttaatttgtctttcttttatcttatttcctatgttgagtttcgccataggatgaagtgatatatatacgttgcatacatgttgtcggttttttaaaattttttataattatatttttttaaacaaacgagaggaataccatc

SEQ ID NO: 13688 - DNA, 1501 bp, Oryza sativa
ggccggccccaggtttggaaaactcatgcaatagccaataggccggtcactactacccctgcaaatgcttggtagctactcctgctgttaattaaatccatcgatcaattgaaggctggcgcgaccacgtctaggcaggtcctatatagccatataggcaggtcgatcggaccgcggggcgcgtagtttcccgtggggtgcgcgtgcgtgcgcaggggccgcgtcgtccgtgtggcggctgcgtcgtccgcggggcgatcgcgcgcgagtgagtacacggcgggcaccgcgtcgtcgtccgtatagtacggtggattacggggacaaaactgaaaagcgaggggtggatcgctgcatgcgcctgctgcgatgcgcttgacgcgcgcggtagctcgcgagacacgagcgacgcggcgtctatcgatggatagctcgcggtcgcgcggcgatggaccgacccgggcccggagagcgagcgggtgggacgggacacgtacgccaagaggccacactggtcgttaattttcgatcgattacgttgaagaatatgcacacacatctcgcatatctgtgcacagtacaccaccagtgttcgctgtcaatcgttgtgaaacgcatatcctgataggggctggcctgtggccggcctataggctatatctatagatggccatctgggcccggcatggcacggcccaagcccggccgtgcctgggccgaggagcccgaaggcacgacggtctatcgtgcttcctcacagaaaaagtctatttttggtccctcaacaatgtgcgctgtgtttaaatggctggaaaataaatctatcttgtatatcttgtcttgggccttgccttatacgattatttaagtctattttgcatccttatatttttttatttgatcgggccgtaccgggccggcctaccatgctgagggtgcagcccaggcacggcccggctgtcgggccaggccggcatgggcacgaccctagtcgagtcatgctatgcttggaccaggccaaaattgcatgcttcggaccgggccgtgggcctcgggccatatggccatctatagatatagcctaaggtgatgtggctcaattagagatgaaaaataatgatatagatgaatcatccaaatataagattaagatgatatgacttcataataaagatttgtaccatagatcaataatccaagcattaggaacacttgagatgatgtggtttaatgagaaaaaacagaaataatactataacaattagtggaaacacaccctttacaaatatataggatgccactataaagaaaatgttttttcgtgaacacaccttttttatcacatgcaaagaagacctatatgtaaagagatttgaaatgtatccaattaatataggcccgtatgcgaaaattcatttcacaagcgaacctgttaagaggcataaaaaaaagtctgtttttgtatgcggatctgtttgttaaaaagtccgtatgcaaattt

SEQ ID NO: 13689 - DNA, 998 bp, Oryza sativa
acacgtcaacgtacgttcccgcgacaacgtgaacgagaacgagaacgatcgaacgaacgtgaacgagctaggaaacgtgaacgagcgaacgaacgaggacgaacgttaacgtgaaatgcaatatatatatatatatatatatatatatatatatatatatatatatatacatgtatatatatatatatatatgttacttcgcatttatcctaatacattttttttatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctaggaattgactattgtagtcttaattagacttagcatatacgcacgaaacacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttagtattagcatgtaatattatttgagttttaatataagattattttatttgtaattagacttagtatataattatttactagctagggttgtataatatacgtcacctagacttagcttatatcacgatttgtaattagacttagcatgtaaggttgtgtagggttctaatgtacgacatttacacttagcatacatgacttagattgttaaaacataaatgtctcatgacttagcagatgtttcttgtatcaacaga

SEQ ID NO: 13690 - DNA, 1255 bp, Oryza sativa
gttttgatcttctgtggttgccctcgaagatttagatgttgtttggcactttggcaacatgttcaccactgatttaatgtccctagctagacatgcaaaggttaaactgcatgtttatgccttctttttgtgaaccagtttcctgggcatattcaggattttgtaattgtttgacctgacaaaacactccttgcacgttctggagccattggctttctaatttgattccacctttttattatcttttttttttggccttgttgattactatttatgctgcaaaactttttcacctgtcaatacctttgcactcctactcctagaactttttgtttatacaagaacaataaggttgggacttgggatgtttctctgtttgtttgataattggatggcatgtaaaggataaaactaatagtagtactcaagatataaaccaaaatcacttaattagttcatgtttctgcagatatatcatgatcgtcttttaattgatcattacagcaacaagagttttcacgaacacaaaggcaagcgaatttcttgaggaaaggacatggacgaacagacagcatacctagaacccagtgatatcaattcatcgccgcttgaccgccatcaaccatgaacacatgaacacacgaaagctttccatgtcttcaaactaagaggaggagagaagattgatacctttttctaagcttgaaacggccaagaatggcgtttggtagatagaaggggatacaagacaacgccatcagagaaagccgggcaatagaaggccctcatgttctcagacagaccttgtcaaatggttgcaactgtgaggccatagttgacacctggtgacacatccaacctcttgccgtttctctcccatcacctatttttaaacagccatatctgcaaagtctgcacacggactgcttcttcttcacagagaaagaaaaggtttaaccaatgctttttcaacgcttatctttcagaaatcttcaaagagcatgacaccaagaggaacgtatcgtttgagtacctgtattttttttttgtaggaagtactacctgtatgttttttttcttatgatcagttgataacacttttccaaatcagtttttgtaaagagtttgtcagaattttttttttgtgcgtgtatcattttcatttctcatggttaacagttgacagagacaaacagacagtttgatagtaacaaaaaaaagaaggcatgcgggagttaaaaaaaaaaagaaggca

SEQ ID NO: 13691 - DNA, 1501 bp, Oryza sativa
gctgtcccatcagaagggctcccggatggaaaccgtaccgatctccgcccattaaagagaaaaagaacagtccagtttggaaagagaaaggtgcatgtggtatccccttgagatataaaaggaggaccttgcccatttagtggggggactttttcccttttggaaggcagaggggaaaggaagtgaatactttgtagctccctcatacacagatccactaaaaacacaggagtagggtattacgcttcccagcggcccgaacctgtatacatcgtccgtgtctcgcgtttcttccgggcacgcgatcttcccacatacagagagagcttgagatctcaccctaagcccccggccgaactggcaaaggggggcctgcgcggtctcccggtgaggagccacgagctccgtcagacatgccatgtcacattcctatgcaaaatctatatgatttgtccaatttacccttacgcacaggaaaataaaaaacaaaaggaaaaagttaaaaaaaatacatggtatatgtaagagcaaaaatatacctctaaagggtgaaaaaaagagtatttttttcctatggctatgtctaattcacttttatatttatttttctatgatatacataaggttaaattagacaattcatcatagattttgcatgaatgatgacatggcatatccatatgatgattttggtggacctaaggagtattctaggccttatgacaaagtttaaggatttctttagactatttaaaaggttaggactaaactgattctataaagaaattttagggactaaagtagctgttctccttttttaaactaattctcttaaaagaattttataaaaaaacacatcgtttagcataagcgtcagtgcgggaaaacagaaaacagatatattttttcctctctcagtctggtgcaacaaacgcagccgtacgagtgtgttcgggaggaggtagagtggaaaacggaacttgcattcggtatgatttaaaatactttaaaaatggattaatatgataagcagaacccagcatgtagtagactccacgtggacttggcgttgacgaggagagactgaatagttcagtcttcgcccgatcggaccagagctccaggtcctttttacctgaacgcgcgatatccacggagctcaaggtcgtcggacagaagacttgagtggactagcaactccgtgctgtgcttcccatctccttcagagaaattacctcccaaaccgattggcagcgatcaagaaagtacgtgatttaactatgaaatttctcctctatatatggcggtgcgtgtgtttgtgtgcatatgcactcagcatgtttgaaaacaagaacacaagataggagtagaaaagaagatcttagtagacaagaagtattggcttcgtctaaattgctgcaaaaattttactgttctttctccgatctaattaagctttgcagctggacattgagttaggggccggcgtggtgaggtaaga

SEQ ID NO: 13692 - DNA, 772 bp, Oryza sativa
  unsure (1)..(772): unsure at all n locations
cgctgtgcgttgacanccattttanatccnactcggtacccaattagctcgaccacggtgttgctgcaataaaaaccggcgggacgggacggcaaacggcatgcatggcatgagtgcgcggcacgaacggagcggaggctggtctggtggtctgctttgatttcatctcggctggccgcggccggtgcgggcggtggacgacaccgtggactggtctcgagcgcggccgctgggtggtggttggtttccaaactttaaatgcgagcgatcatcccgtcgggtcgtgcggtacacgcgagcatgcctctccgctgcataggcgtaggacgcttaccttcgtgtagcgaagttagtacaatgcaatggcttcacatgcgctgcgaacaggggcgcgggcagtgtgatattccaattctcgtctcttgttgtgacttggtcgccggtgaagctctggtagcgtttttactgtggcaagttatggttgatgctgtctgttgcatgtgaccctgtaggttgaggaaattaggacctgtactgcggtgggattcggtggataatctggtgatggcgtgatgctaatggaacaagcgacatgattacacgacccgctcgatgcaaattaacagtcttctctctttctttagtcagggcacaagaaatcagatcgtgtcccatttttttctcttggaatcgaattgggaaacagatatctgtttgtgtcttgaactcttgatgatactactactgagtatctatctagtgaggcatggga

SEQ ID NO: 13693 - DNA, 1501 bp, Oryza sativa; identical to SEQ ID NO: 13033

SEQ ID NO: 13694 - DNA, 1406 bp, Oryza sativa
tggtggccgaatgcttgaaatcaaggtgaaattaataaagatgagctgaaaccgaatcaaacttggagtcggattgtgttacgaatcggagtcggagatcgggctactcccgcgctcgatcacgccgctacgtcaaggtgcggaacgccgtctcgtactgcgtgaggatggacgtccaggatttttgcttagatgctaggaagggaaaatagaagaattcaaaggatttgttggattcaaattttgaacttaactttgaaccagggtttcggaagaggggcttttgatggaatttttaaacaaggaggtattcaatgaatgatttcggaggggaaatttgaatagcaaaaattcaaatttcgagatttgaattcggatatggttttttgaatttagtactaaggaggaatctaattgagatatttggcgcttattccttaatgacacagagagaaccaactttttgtaattagggtttatgtaaaatatagtattttttaatgacttaaaaattggggtgttacatatatcaagaaattaaaaaaaagtaacaccccaattttcaagtcattaaaaaaagtatatctagtgcacagcccaatctatatttgtttttctccctttaatatgtacgttgattttaaagatgatttttttgaacgactcgcacgagacgatgtgaagttctattaatagagtaggaaaaaaaatacaagattataacccaggaaggtcgtaaccagaaaaaaaagaaaaaaatataccaccacccacacaccgacagcaccaacacacaggtccagaagaaggctagaaccagaccggccgtaactaagcgtaaccggacgccgctaggccaacaacggatcacagacgagatcacccaaaaaaacgcccttacaaccaacacaaagcccaactctatccacatcttccggatttagggagaaagagtgagagagaagatggaacacctctccccctaggccctccgacgtggccaacttgtagaaactaggacaccgtcataagaggatgagaatctagagcgtgcttgcaccaattgctcgagtggttttagcaaggggatgcctaaacgacgtctccaaggacagaagcgacggaaaaccgccgtcgccgtccatcaaggtctcaaaggagctaagactaggcttttgcccggcaaccacccttttgaagatgatttttggtcgagttagatgtcagtgtcactatactctacagccaatttttttaatcaaatttattttacaatcacttagtcgaatttgaatgaaaacgttatacaagtagtacaacccccttgagtatcggcaaaattagtagtagtagaatcaatttccaagtttgcaacagatcggaaaggtgttcgcgccgcgtcctca

SEQ ID NO: 13695 - DNA, 1501 bp, Oryza sativa
tgggacggagggagtacactgttagctctggcagccagttggggcgcctgaatgacggtactgttaagaatggaaggtatcacatcaatggagctgacaagagctagcgtgccattcatctgccgacgctgttcttgtacccaaaacggcactgtttaattcagccttttcgtcggcttgctccgattcagtagctcatacaataatgtagggatttccggtgtattgggaaacatccttcaatagttcaatttcactgttttaatccattttctaaaaaaaaagggttcaatttcacagcatgacgtcttctatatcgaaaatgttgttccgtatactctctgtgagtctgtgtgcaaggtacgggcaaaagccgcatgtctatgctccttataagcttattgtgttatttttccggcccaaagcatcgagcccaaaatagataacagggccatattctgggtattctgccggcccacatgaattctttttattgaaaccaaaaggaataagttcactttaggtcccttaatttgtcgcccagttcgattttcgtcctcagtccacaaaaccggatacaacgcatcccccaacttaccaaaaccgtgcagacgagatccctcggcagtattgtgcccggttttggatgacgtggcgcctacgtagctggtttgactaagtctccgtcctacgtggcattggcgtggcgcttacgtggcaattgatcccaaaaataatagaaaactgtaggacccacgtgtcaattacacataaaataataaaaaaggtggggccatgttgcggcggtcgcctccagtagctggctgggcgcgaagcgagttgcggcggcgttcccaccgcagctcctcggccttccgcggctgctgcggcgtcggcgacaaggaggaggaggcaacccgtcagttagtagcacaccccgagagttcaatctaagcggccgtggcatggagaagggcacattgatgcagcacacattaccttggagtggcgatagggcacgccggaggaggaagcggggccggaggtggaggaggaggagacgtggagcgcgacgacgagcagcgttgcatcggcggtgatggtggcgcctatcgcggcgagcgagagcagccaccaccgcaccgtcgcccaccgccccgttgcagcggcgcccctcacctttcgccgcagtggcaatggcgtcgcatccgccctgtcatggctaccacacgggaggtaggaaggtcgatccaggcacgggggtcgctccgtgtctcaccgatggggatcgatcctcgccggcctcgtcgtcacggctgtctacgccatctccaccgtgtgatctcgctccggcttgacgatgacgaccccggcaagcctatcactgtcacgcggtgccgcacagtagtaggaggacgatgcccacgaccagcttcgtctccaagtctgaatttttctcctttccttttcttcaactgaagaaactgttgatgtttgatta

SEQ ID NO: 13696 - DNA, 1054 bp, Oryza sativa
acggttgaataactatcctgtatgcctgcacgtcgactctagatgatccccttttccaaaatctcctgaggttctctaaatggtccaaatttatttaaccaatagataagtaaaagctgaaaaacacatctcttctagatgtttttaagaatctccggcaatcttccaaacaagatctaattgtgaatggactaacacgtggtggttaatcactatgttacaatattgatcatgatgcgtcattaatttagcaattgatacagtaacatacaagtatagatgcatatggatatatatgcctccagcagcaacagtagtggatgacattaagcagtatatttagctgagttaattaattgtatagtggtcaagaggtgcgattaattaagaggatacgtggcaattttttaattagctactctgatgacatgcttcatgcattagcgttacgtatacgtgcggtcgttgcatcaacaagagcgtcatccttacgtatacgtacaatggtcacacagcgccactcgccatgtgtacattttttaaaatcaaaggtgtttttgtttattattctgtgatgaacaattgacattggagattattggttttgttatttagaatttattcatgaagtggttttagatatgattggatttcacaggtgatcgcaggattcgtcattttatgtgaccggtcagaccgggctttggtaaccggtcagaccggcgtgtaatgcgcggtcagaccggcgcagcccgcggtctgaccggccgacgctgtgtcagtttcggtttcgggttgtttgtttggatatccgtgattatttcatgattatgacttctagatggatactatacgtatgtaatactactgtttgctactaatgagtcaagttggagatagcttggtcttggaatatggtttctttgtttatttcatgtgtagatgactcaatgcttcgggagagtatttgcggtgatggatcgagaatcggcttggggataagacgacgtccgtggtggtcagagatcatgcggaatacttagactagagttga

SEQ ID NO: 13697 - DNA, 717 bp, Oryza sativa
  unsure (1)..(717): unsure at all n locations
atcacgatgaaggacggccggtgttccccctcttttacngttcttctcccccgttgccgcacggcgcgccgntactttcggcngtngagctcgcaatcgcgccagccgtctctctccattttatctcacttacatgtatgccttagatattcatttttttattttttactgactaggatatcacgtgagcaaaactggatgtaaatactgccataataccttctttgcacggtttaaatgagtttagaggtgaacgtttctgattttgtggctgaggaatctcaggaaatctctctgttaagttgaggaacgtccggtgaacttattccttgtagcttctactcggaactggcctagcccagccaaccaaaacctccaaccgatcaagcctgcggtcgccattgttagggctgaatatcaaacctgctggtgagctcggcccggcttattatggctttaattaagataaggaaaaagtacgccgaaggtccctcaacttgtcattcgtccctcaaccacacaaccagatatatcacatccctcaacttataaaaccgttcactttagttccctaggtggttttcaccctggttttgtctgacgtggcagccgagtcagcgtgagacccacgtgggccccatgtgacagggtgtccacgtcacccctctctctctctctctttcccctctctccttcctctctcatttttcgccttga

SEQ ID NO: 13698 - DNA, 475 bp, Oryza sativa
tcggaagggtgggccagtggggaaaggagagttatgccggtgggagacaggcgatggatgtggattgtggttttttttaagaaaaaaaagataaatctaatagtcgaaaattgatggtttaccgatttattataattccacgtggcggtttagtagtgtttataggcgtaccacgtggtagtataggagtgtttgtatacctttagtatataattttttttaattttaaaatggtaattaggatgacatgccctagaaattattcttttccatagaagtttaccacggttgaatcattaagtattttaaagacaccatggatctaaatttaaatgtgttcgcaaatttgatgattaagataaatctagtagagcttagcaggatgaaaacacgtgcacaccctcatttgtagcagacctaatgctaactgcattgataatccctagcaagaataggttagtctatttggataacc

SEQ ID NO: 13699 - DNA, 1501 bp, Oryza sativa
tttagcagattgaaaaacgtttcacgaatatctaaatttccatccaacttttgtgggagaaaaaaacatggcctaaaacacacacgagggggcattttactttttgccacttttacctctcacattttacgacatatgggccttcatgtatcaatgacacatgagctcaatgataaatccttaattaccacctataagagtggcaaatagtttatattccttaaaaaaaaaactcgaagcacatgtgaactggaaatttctaatttgctaatttccaaataagccttacatgggcttatggtataatggagtttgacgacactatcgggtaatggacgtctcatctttaacggtgttagagaaaaaaaaatatagtttatactatgtattattaaaagttttcatattatgtcactatttaaccattatttacattttattttggaccaccctattctatccatctacaagtccgattactcagtaaccactccacacactaagtctctctctctatttctattttccctccgacaattgaggatccagcaaggagctcagatctagcgtctccgctcttcgttgggtcggctcctgccttcttgagtcactgcaggcccgacacatccgatctaaacgacaaccataacagtagtgtgcatgacaatgggagaggagaagagacatgttggtaactagagggtgcggtcccgcatacaaagcgcggagaggaggaacgatttgaacttctatcagatccacataaacaaaagagatcgattcatcgatttgtacctgagaagacgctaagaaaaacaaagtctcgaccgccgctgctagttcgctggcaccaccgctgctagtccagggggtgtttaaatccaaaggtgtaaagttttttgcatgtcatattgaatattatatggggtgtcacatggagtgtttgggcactaacaaaaaatactaataacagaatccgtcagtaaaccacgagacaaatttattaagcctaattaatccgtcattagcaaatatttactgtagcaccatattgtcaaatcatggagcaattaggtttaaaatattcatctcataaattagttacaatctgtataattagttattttttagcctatatttaatattttatgcagacatttaaacgttcgatgtaacatggtaaaaaaattttcgccggaatctacacagggcctcgctcgcatggctgcccagcgacccaaatcaccggcttgctcggtgtaggtctggctctagctgttggtgagggaaaaaaaaaaaacaaatggttagcgggccaaagggatgcagcccattacaaaacgcgcatccacaaccaagcccaatagcgcacgaatcttgacagaaatctaatggcccacaaatcggctgacggtgacggattgcaatttttcaggcaactgcaaaatagcaaagctgaaagaaaatctcccgtctcggctcctccgctccttgcgccatc

SEQ ID NO: 13700 - DNA, 321 bp, Oryza sativa
aaaattttttaaatctgaattgaatgttttcaagcttgacttgaaaattttcaaatataaatttaaactttcaaatatagagttgaaagttttcgaatcaaagttgaaaagattcaaatctaagttaaaagtgtttaagagaattaagcactcccgtgacgattttttttccggaaaaaaaaagagagaaacacgaacgggagtttggcttttcttcgtacgtgatgccgaaaacaagtgggcccaccgcttctctacgcgcgcgcgacttaggtaaagggcacgtacgcgctaattagccatccccgaaataatatgcta

SEQ ID NO: 13701 - DNA, 735 bp, Oryza sativa
cccaactagaaaacctagagcggcttctttcctctctagctcatttctcctcctcttagcctcccaaaaccctagctcccctcgatctgatgccgtgaggctgtgacctccccagtttcgccatggaagaccccgtggttgccccatcttcctccgtcgcggtggcggcggcggctgtggctagggttgcgccggccgctcctctccgaccccatgcagaggagagagaggatagtgagataaatggagtaatgaggctgacatgtggcctacatggccctcaccatgtttaaataattggtgtgtaactgacatgtgggccctataggctttattttttttggatcgaattgccacgtaaacggcacatcaaatgccacgtgggacgaagacctagtcaaataagccacgtagatgccacgtcagttaaaatcagatgctatactgccgagggacctcgtttgtacggttttgtaagttggggatgcgttttatccagttttgtgatctagggactctgaactcgatagcaaactgagggacctaaagtgaacttattcattgtttcgttagaatagagcccagcccagcctagcccagttaaggagaacccaaagaggcccaatcgtgggcggataacgcagcctgaactgatgaaaacaggtcggtctctctgtgcgaccgtgcctttccagtatccgcccgaccgcccctaccgcaacctgtagccgctga

SEQ ID NO: 13702 - DNA, 1501 bp, Oryza sativa
cgttctcattcacgttcgttggctcgttcacgttcgttcgctcgttctcgttcacgctcattcaccttgttctcgttcacattcgttcgctcgttcacgttctcggtgtggcggcagcggaacgtcggagtgccgtcagcgaatcgccgtcgggctggctcggcgacggcgtggctccgcgcgcagcatcggcgtggcgcgacgccggcatgcggagtcgtcccgtctcgtggcccggcgtcgtcatggcacggcgtcgtgtcgttacaaggtcgccgtcggcgtctaaaactcggcggccggtgtcatccgagagggagagagagagatcgagatcggagagagagatcgaaagggaggcggcgcgcggcggctctcaccccagatatgcggcggcggcggaggaggcggaggcggcggtgacgatgacgagcgcgagacgacggcgagatacggcggcagcgtcggcgcggggatgccctaggcagtggcggcgaaggagaagccgagagagatcgatcgggcaaaaagttctaagtgctagtagagaagacgagggcgcgcatcgggaatatatatagccctagatctttaatcccggttgatgagaacaaccgggagtaaagatatctttactcccggttgttgagaacaaccaggactaaagaaaagatctttactcccgattgttctcaacaaccgggagtaaagatatctttactcccggttgttctcctcaaccgggactaaagatcttttcccgctatttccaaattctttttaaacccggttagggttaagaaccgggactactgataagcgcactgaatattattttctattacatatgtgtttctaaaataaaagataatgcattacaattttttaaagtacaaagattaatgacaatttcttcgaaaaattattgttgtctgtaataaattaagtggataaaacgtaataagcaaatatatgatttaaaattaataaaaattctaataatcatatatacttagcatatgaatgatattattaaattgataaaaactctaattaacatatgtatatacatacggcatgatttaaaattaataaaaattgtaatcatcatatatacttagcataggaattatattaaattaattgttaaaaactctaattaacatatgtaaatgccacatgcataatttaaaaattttaaaaattcgaatagtcatatataattagcatatgaatgatagtaaattaaattgtgaaaaactctaattaacatatgtaaatgccacatgcatgatttgaaactttgaaaaattctctagtcaattataattagcatatgaatgatagtaaattaaatgttaaaaactctaattaacatatgaaattgccacctgcgtgatttaaaacttttaaaaattgtaagtatcgcatataactagcatatacatgatttaaacttgttaaaacctctaataatcgtgcgtaattaacatatgccata

SEQ ID NO: 13703 - DNA, 1452 bp, Oryza sativa
accgggtcctcgtcgtccacccccctccctgccacctccaagacgccgccgccgcgcagggactcgtcgtcgccgcctcatttcaccacggtgagcccacgccctccgcctcacctcttctgtcttctctctgcttaaccccatcttctcctcctcagccgcgccgggactcgtcatcgcgccggtgtaccttggagatgccgtcgaccaattcatactatggcacatgaatgatattgaactagggtcaacggatggaactgatcgtccaccaaggataccggtgtcaccgtcgcgtccaccagtcgtagccagtccgagggatagtcctattgcttcaccccctagaccagagccaccagttgcatcacctttaggaccagagccaccagttgcatcacctcgaggaccagagccaccagttgcatcacctccagtaccagagccaccagttacatcacctccagtaccggagcctcccgttgcatcacctcagacattaaaggatgcagaagaaccatcagagcctgtacaagcagagcctacaaagctagcggcgggtgaaattgaagcggtgcctgatcagccaatgcccgatcaaccagagcaatcacaaccagagccatcgcaaccagaggaacctaagggtgctgatgtgccagtgatggtaaggacgcacaagcacaaagcaaaaagtgagtccaagaaacattatatggtaacagattccgaggaagggacaaagatatcataaatgccgaatttgataacagaaaattaaaagggttcaaacagacattcgttgactatctcaattatatcaattccccagacgtgccacacgagtttgagaatggcaaaccattcatttacgactggcaactaagagaaggaccgtgacaactaagaaggtggcacgattggtacattagggcaagcaccatgaaaggcatcgattcattcacagttgccgtgggggagaacatcttctggagcgatccttgtctactccaagtccatttctccgatatgcattccctctaccgtaggaagcagctagactccaatttgattgccatctggtgtctgtaagtgctacacttgaacgtgttaatagatcactacacctatatgcgtagctcatttgatcatccattgttggcaggatgaattacgtggaagcggaagcgatgaaaaagcctgtcgcctacctaaacccgtgcaggataagtaagccgaaccacacatacacgctaaatgagaagaagctaccagaacaaaagagaggaaagcttacatagtacaaaagcatcttgaaaagatgctcgatgtcgctacgtacgtagctattgcgcttgaatctacgtaggacaaggagtgtgtttatgcccaatatgcctttgagtaagttgtaatatatatgcactaagagtatatacatataatcatggc

SEQ ID NO: 13704 - DNA, 1501 bp, Oryza sativa
tgagtagaaaaattttgatgtaatgaaaaagctagaagtttaaagaaaaagttgggaactaaaccaggtccaactagccaggagagttgggaagactacctgcgtagcttttttcccttgatccgacattcactgtgcaaaactaattttataaatttatttatatatttgggttagtaaatattgctaattagatgatctaatcgatttttgcatgtcaagtgatactatctaatctcaaaattggctctttaccggtggtatactagtattatggctggattatattacttttgtaattacaattagcattactagattggttggttagaaagacatatacgcaccagacaagttgattggcagttaatggataccaaaattgaccaaagtacgtatatatcaaaatctgggtacattagttgatgggccacatgctatcttatctcacagacaatattttctctagacattattttctctagattatagaaaaataggtttatgatgtaggatatatttgtagaaatatcagtcatgtatttttttatttcaataaatcccaagtgatatatcattttcagacatcactttaaatgtcattttcacaatatatcatgtttgggtggtgagtggacattcatggtgatatattttctaagcagactataacaaaatgagatgttagcatatagatgtaaaaaaattaccagacatgcattcttttattttaatacacgccaaagtgatatagcacagttatatataaccgatagacacagtgaccaactgacaaaaactggtagtattttacaacatgcccatttcatcaccaaatgtgatttagtatgcgttcgaactagctgttatggcacgcgagacgatataaatcattagcgaatataagttttaaaaatagatttatttgattttttaaaaaaacttctatatagaaatctattacaaagaaacataccgttttagcatattgaaaacgtgctcacattaagtgagagatttattcaacaaaaactcactaacgtgcaaagtgaagttgtgcatgagaaaaaggaatgtgaagttgggaaacttaagaacatgtcctaaatcatttttgcaaagtgatgtccgaaaataatattgcaaaatgatttcaatcacaggcatgtgacgtcggcttggctagacacaagataaagttttgaccaaacagggactttggtgtcaggatgtggccatgtgggtgtggcagttgtacagctaacttgtaccacgcaaatgagcatgcatatatctctctataggaatgtaacggagtaggtacatcttacacctgcattaggaacataatagatcaaacacatccctgtacaatgcgtacatgtgtcaggcatatgactgaagtgcatatgaactatggtccatagtgtgtaagaaatcttaataatattatataattgaagaatcttttgtaaatcctgtaaggagtttagtgtgtttt

SEQ ID NO: 13705 - DNA, 738 bp, Oryza sativa
acaccggcggcgaccatcggggcgcgggtgcgccgcctcccgtcggctgtgccggcgtggccgccttcgggcgcgccccgcggctgccatgtgggggccggccgtcagccgcccgcgccctcgggtgcggctgacgcgtgggacccacggcgccggccggtgtgagccgggtgcacccggtccaccatggaccgtgaggctgccgcgtgggccccactcccgtggacccggtccgcgcgcccctcccctcggctgacgcaataaatccattttaaattaatatttaaatgaagaaattcgcaaatattcatttaaagagcatataaccttcaaatggccataacttggccatttgaactcggaattggaccgttcaagtctctaatttttccttaagaagtcaagaacccatttttgtgctttgtttctgcttgttatatggagtttattagagtaaaagccttttcttttctgttggtcgtgtagacgctgcagcttcggaagatccactcttcgtggaggttgaagccgacatttgggaaagcgagcaaggcaagtcacatcatctttgaacatattgaatcccagtttataaaattatgttgatttaaattattgcattatcgctttatttaaattcccgcgttatcactgttttatttagccatgcctatttacctttgttatgaccttattattgttattgttattatttccttattcaccctagattaaaca

SEQ ID NO: 13706 - DNA, 1501 bp, Oryza sativa
cctgcatgagcacgcaccccaatccttggcgcgaagcgtcacaatacaccgtgaagtccttgcgagtatccggcatgattaacactggcgaggaaaccagcttttctttgagagtttggaacgccttctcgcattgcgggctccacacaaatttctcttctttcttcaacaactgtgtcatgggtcgagcgattttggagaagttctcgatgaacctccggtagtatcctgccaaacctaagaaactgcgaatttgagtgactgtcttgggttgcttccaatcagtgacggcggtcactgtttcggggtccacagcaactcctttagcggatatcacgtgccctaagaacttgacttcggacaaccagaactcacacttgctaagtttggcatacaattgatgttcccgcaactttcccaacaccagacggagatggtgctgatggtcttcctctgattgtgagtataccagaatgtcatcaatgaaaaccacaacaaacttatccaagtattccatgaacactttgttcattaagttcatgaagaaggcaggagcattggttaaaccgaacgacatcaccgtgaattcatacagtccgtatcgcgtggtgaatgcggtcttcggaatatcttcttcacggatgcgcaactggtgatatccagaacgaagatcaatcttggagaataccgtggcacctttaagctgatcgaacagatcatcgatccggggaagagggtacttgtttttgatggtgacttcattgagagctctgtagtcaacgcacatcctcttcgtcttgtctttcttctccacaaaaatcacaggagcaccccagggggaagtactcggacgtatataccccttttctttcaactcttccaactgtttcttaacttcggccagttcatttgctgccatacggtagggtcgcttgtacagaggagtggttcctggagcaagatctatccggaactcaatctctcgcttgggcggcataccgggtagttcttccggaaacacgtctccgaactctctgacaatggggatttctgacagtcctatctgatgaagttctgaactactgacagaggttgggggtgcaaagaaaacaaccggttgttccggccctcggtacagagtgacagtgcgtcttgcacaatccactactccttggaattgagccaaccaattcatcccaaggatcacatccaagttcttggtgtctagaagaatcagatccgagggaaaaggaatcccctgaatttctatagggacggcaggactataatactttgctgtcataacccctccaggggtggtgatgagtagagggttcctaagcctttctacccccaactgatttctccccatgaatggcacagatataaacgagtgggaagctccagagtcgaacaaaatggtagcagggatggaatggatgaggaacgtaccaacgatgacgtctggagttgtcagcacgtcctcggccgtcacgtggtt

SEQ ID NO: 13707 - DNA, 1501 bp, Oryza sativa
gagtcgttgctagatccaaccgccgtggacctgaggaagccgctgctgttgaccccatgcccgtgcgagggagcctcatctgattcggccaccgcgagcctcgacgaagctgccgccgccgcttcagttccgcatgaaggagccattgtcgccgccgccaccttgtccacctcttgaagtgctcgccagcgtggccgccttcactggtctgtgaaagtggaggagaggaggtggagtggggtgaggggaggagaggatgagggaggagaggggagatagagaggggagatgataagggttagatttttaagggagagtggagtgggcggctagctctttgggcttgtagcaggcggtccacttaacaagtccacttgcgaaaataggtttattttcacagacgagcctattaagaggcccatctgaaaattgatttttcatacaaatctttttttttcattgcggataatgttatacggtcagtctggagactaaaagggggcttgtccataaaaatcgattatgtaatagtgccgtgacactccctatactatatatcatgtttaaattttggtcgtaaatattaaatatgagagttttttcaatcgcaagatcaggaaggaatttattgttggcctctatgatcctatttggagaagtttctagctgctgcagctattttcagaaactgtaactgttcgaaacataatctagattatgagagaatctatggctatagaattcaaaaaataaattagaagttgggttttgcagcttctctagaccctcacagtctgactagcagctagctgtttctgaatctgagactagcaactaccagctaactgcatctcgtgatctttaagtttttcaaactagtcctatgtatttctcgtgttggttagacagttcacttattgttggtagctagtgatctggaacttatgtaagatggtaccatttttctcacgttggtttagacagtgcacttattgttgcgcatagtgggctggtgcttacgtaagatgagacttaggtggaggttggataagagacttaactttagtctctgacactaatttagagtattaaatatagactaattacataaatgaaagctaatttgtgagataaattttttaaacctaattaatctataattagataatgtttactgtagcatcacataggctaatcatgtattaattatgctcaatagattcgtcccgtgaattagtccaagattatggatgtgttttattaatagtctacgtttaatatttataattagtattcaaacatccgatgtggtagggacttaaaatttttagtcccatttaaataggtcttataaaaaaaaggatattctgaacttatatagcgagcgcgaatgcgaagacggacgcacacaaacgccccaaaccaaataaccaattcgcgagcctcttacggacgaacggtacggtgtagctagtgtcgtcggtagccgatcgatcgatgg

SEQ ID NO: 13708 - DNA, 1501 bp, Oryza sativa
ccattaggctgaacaagaaaaacttggcgcacacggaagagtatgagagctcagaaaacacacgctgagccccctacctggcgcgccagatgacggagctcgtggctcctcaccgggagaccgcgcaggcccccctttgccggttcggccgggggcttagggtgagatctcaagctctctctgtatgtggaaagatcgcgtgccaggaagaaacgcgagacacggacgatgtatacaggttcaggccgctgggaagcgtaataccctactcctgtgtttttttggtggatctgtgtaagagcaagttacaaaatatcaaccagccctctcctctcccgggaaaatccaaaaatcccccccttctctttgtgggcatggtcctccttttatctcttaaggggataccacatgtacccttccctttttaaactggacttttcttctttacataaatggacgtagatttgcacggttgccctccgaacgtccttctgatgggacggcacatacctacctccacttctgccgggggcaggcgcgtcgtgggaacgtggctgtgcgctgacgacatgagcagtgtcagaccggtcacaaatcggtcattcttgtccaccgcgtgtcagcttagcaacgtgcatgtttgcccttcttcacacaacatcttgcctgtaatggttaggatgaagcctggcatatatcgatcggggctaacgtgccatctctgggatgtaacacgccagctccagctggggacgagtgcctagaggctctcatcttgacgggacggggcgaggcgtgagtcagaccgccagtcgccacctaaccgttgatctgaccggtctgtgactggtcacagaccggataaaagagcgcgctgcattgcgctgcatgcagcgtgacacgcttaaccagaccgcaataaatgcggttaggtgagccctaccgtgttcacccaacctatgtacatagtgcaaaccccacaaggggtcggggcacctcggccctcggggccggggcaggagcaacccgaccccccctcggggaaatcaggaggagggcggacacctcaccctcgggcccgacgtccccgaaggtgccaggccacgtgggcgattccatctgcctcaagcctccgggcgcaatactcccggtcccatatcaccgacagatacccttggaatactctcgggtgaaatgttacaatggtatatctgtgcgcttgcgaatgaactctgtaaccataatataccaggagtatttctgcgccattgctaggaattatatttctagtaatgacgttaagaaataccaacacccacggtgagcaaggggttgaaatggaagaagatgcctagtaaaaaaaaagaagaagatgaagtggagaacgagaacattccgaattgggctcagtacgctggatttgaaggaaatcaaacgggcgaggtggacagggatgctgacgataacgacgctgcggacgatcttggtcagatgttgtagg

SEQ ID NO: 13709 - DNA, 1501 bp, Oryza sativa
aatatcattggccatgtttggtgttgaaattcaccagttttatagttttgcaggaaaatctataggaagctggaaacaacagtgcaagcttggctttctgtcgattgttgctctacgtggtaagcaacgttcatggtgtaatttatgaatgattagtactttctctgctacatattttgtcaaaatatatgtcattagattggtgtctggtgaatctattaggttgtgtgatcagtgtagataaatttgaagtgtcgactcttttctgaagtgaacagtccatgttgcagccttcagtgatccaaacttctgaatctgtgagtttcagctctcttttacttctgagcatgatgaagggtagtttggatgcttaacaagtgattgtcttgtaccaaatcatgtaatttttatgtctttggttttcaaccacctctccaacatcttaaaaaatgttggttagaaatcagatgatcttcaaaatcaacctttctaaagtaacttgggagtttagaaaaagagtaaagtgcacaggcggtccttaaacttgtagaggtgtgtcatctaagtccctaaactctcaaaatgtagatccaactcccagaacttgtcaaagtgtgccatataggtcccaaatcgcaacaactcctccaaaatcctacgtggcgctgatgtggcgtgccacacgaacgtgacgtggcatttaaaaattttccttttccttttttttcttttcttcttctctttttttttcttttattctcttctcttttctctgtgacctgagcaacccgtgtagcggtggcctatagctgcagtgagagcaagaaaaggagaagaaaggaaaaaaaagagaataaaaaagggaaatgaaaattttttaagtgggtctcatttgtcattcaatattatgccatgtcatgtctgtgtgtcattgccacatcagtgccatgtaagatcctggaggagctgtgacgatttgggacctacatgacacactttgacaagttctaggacctggatttgtattttgaggacctagataacacatccctacaagtttaaggaccggccgtgtattttactcttttaaaaacaattgaatcaatgttcctatctttggaggctagaaaaggagaaaacatgattattgaccctgtaaactatggtctcccactactgttgtatgtggttgattttatttttcaaagaatccttacgctttgattgctcaagtgaaactgatcatgcaatgggttttaaatcaatatactttgagcaacaagtataattagttgtttgattctcaacatgattctatttttctgtctatcaccattgttttatgaaatatcaccgtagcgttagcacgttcatattactagtatagtaagtcaattagtaattagtaggcatatactctctgtttcatattataagttgttttgactaatcaaactttatttaatcaagttagcatagcattttaaatacaaaacaaata

SEQ ID NO: 13710 - DNA, 1501 bp, Oryza sativa
gtatgcgactgtcgcgtgtatgaaagcgaggtcaagttgtcaactccttccggcccggcacgctcgaattaaatttgaaaatataatgttagtttatttttttctcaaacatatttgagattcaaattatttggcacgaatataatttcgctcaaacattacgcgagaatgatgtggatgtgacgtcacaagcggtctcgttaatcatgataattaatcatttttcaaaacggtgttgatgtttggccatgcaagaccgcgcggtctcgtagtttggttatgcgagacgcatcgttaccatgtgatactgttgtcgtcgtcagcccacgttattttcgtgcatctattatgcgatatctatatctgtgctaaaaaaattgaatcccaaatatttctaagaaaataaaacaatatatttcaaatttaattcatctttttgataatgtatatatgcatactcggtcagtcgatccagtaggtacacagttgctagcttgctgctacttctaccactgacttttaattgtgagatggatttgataaggtataccactactcttctggttccataaaaattaacttagaattaaaaatgatataacctctttaattctatattgattttttatgaacggggagtactgatcaccacgtgatgattcaactctctctccgtggcggtcgatcggttcgttccaacaggagaattcccagatgccgaagtagatggagtacagtagtacgtacagacggagtggatgtttcctattcaaacgcatccgccagcagcgtggtgttgaagcgaccaccataccttcacctcacatcgatctgggacgtggtcaaatctgcgcttacgactggaataaaatatgcttggcgtaaggccgatggatgtccccatgctctcgccaacccggaccagcgactccagtcgttttcagaaaattaattagtagtacccctacaacaacatgggtcctctttgcatctcctcctccatttcacagtttcacacacgtagtaataggcgacaattttacacgccgccaaagtgcctagtttcccatttttggctgtgattgccttttttatccctcgcacacgtaaaacgaaataatttattagcgtaattaattaagtactatctttttctatcagaaatagattaatatgactgttgaaagtaactttagggtataacttttaaaaaaagtattgtttagcattttggaaacttgtgtgaagaaaacgaaagatgtgaattgagaaacctcaactaaagaacttagccagcgaaaaatgtcaattttagttcgacgaaagtacatatgccggtgacgaagtttttgaaggtcttcgagaactcatattaggaagtactccctccgtattttaatgtatgacaccgttgactttttaaccaacgtttaaccattcgtcttattcaaattttttatgtaaatacaaaaatacttatgtcatgcttaaagaacatttg

SEQ ID NO: 13711 - DNA, 1376 bp, Oryza sativa
ggtgaccggagcaactaggttcagtggtagagagaggaggaagggagagaagacgggaaagagagccgaaggaggaggtcctggtagtggaggcaacgagccctttcgccaaatcatccgaggagcaatccgccgccgccgcccgagaagaaagaagttgagccagccgtaggggaggcgctaaccgccgatgctgccgccgacaactccccacccgcggccattgtcagctcctagccccgtggccgccgttgaggaggagagcggcgccgcgggagctcctggccatgtagtgtgatgccttcgcagtgtccctgtccacgcagcttgggccgccgacgaggaggaggatagcggcgccgaagtgcgaaaaatggtggaaattctgtgaaatggcgaatatggctaaacaacggtttggcatcattgggagtggctttttaacgaatctaattcacggagtggcatttgagcgaaacccttttggcagtggcacaatgtctaatttctcctttgtgacatgccgctggcctctattataatggatcgttcacgatgcccagttgtgtactagtcgagtgacaatcggacaattaccattttttaaaaggaaagttgggtttaattacaattttaatcggatggaatattgaaagattaaattgtgattgatttggaaaaccttttttcatgtgtattctttaccagtacgtcttatataacaactcgaattttatggcaaacagtcgagtatgaaatgtgtaaaaacccagactttttttttttacagaattcgatttgaacgtagctataccgagatgatgatttctgagcttgaaaaaaaaggatttgtaaaatgagaactaaaagaaattgagaattttctcagagtacaattaaaacttgtaaaccaggaaaaatttaatgttattaattcgaaccagaaacctgattaaaaaattaggaatttagagagaagggaggaccttcgttactgggccgaagcccctatctaaagtgagggaccttcacatcctctgccaatggcccatgctacagcactgtgccgttgagcaatcttagcccttcttttctaatcaacgttatagataaataatagatttttattttgttcttcccgttgaatttcatttctatcatttccttcctcccacgagaaagagctgactctttctctaaacttcccacaaaaattaaaatagcgattaattagttgaacgcaacatatacaaaactagaagatttttttttagctcttgcaacctgtctacatgaattcattcttgatttccgtatgaaagaaagcaagacagagatcaaaagggggaagaaacaagcccatacgtatccagtta

SEQ ID NO: 13712 - DNA, 607 bp, Oryza sativa
ttttggctgacgtggcgcctacgtggctaatttgacttagtcttcatctgatgtggcattgacgtggcgtttacgtggcaatttgatcctgaaaataataaaactcgtgggacccacatgtcagtctctcacacagaataataaaaaaatggtgggaattcattatctaatctttcaaaattttgcatcatttttcatatataaacatacaccatgagcgtcagcacatttcacagaactacatgtattttgaccaaattatcacacaactataaatttaaggcgatgtatcacaaaaccacagattaaacaataaatttatcacaaaattacaggtttaaggctaagtatcgcataagtatagatttaataataaaattataaaaaaactatatattttggagtttaaattcttaacactaatgttatggttgatttctaaacgtccaagtattgtcattaaattgatgttaagcctatagttttatgataactttattactaaaccatacttcactttttaaaaacaattacagaaaacctgctcccccagcaacactagctccttaactatttccatggtcctaaatccacggatcaaacaaca

SEQ ID NO: 13713 - DNA, 1501 bp, Oryza sativa
actccagccgagccgcgccaccacatctgtcgttgcctaaggtggctgtcgccaccgtcaggttcggaagacgaaggagaagcttgaccgcacctccgcttcacttgggcatcgccggagcgccaccgtcgacatcaacccgaggccgccaccttttcaagctcggcgccggccactcctatcgccgctcgtcaatttgcaacggttttgagttggaggaaggttgtatccagttttgcagttgagggatgtgattcaactaggggcatgagctgagggaggcatagacttattccttgatttttcaccatgtaaatatttgttgggccaaaagtggaacgggccaggcatccgaggccttggaccatttttgaatccacccctgcagtatagtgatgtgatgcgaagatgtgatttatatgaatgattattaattttgtactatctgtttctgttgttaagagtgccgaaaagcattttggaaaagtacataagggaataaaggaaaagtgcatatgggcgccgcccagtactacgactagcactgctatagctccaacaagccgcgtcacttccccttgtgatgagaagaatgataaatttccctgtcagtcagtgtcaagcggagccatatacatggagtatataatactcgtcccaacatttaaccgtcggtctaacttaaataatttataaataaaataaaaaaagtcacgcataagaaattattcattgttttagcatctaacaataaaaaaaatattaatcttaattatttttaataaaacagacgatcaaacatttaacacgaaaatccataactatacttaaaataaaatggaggaagtactacatagtaatatactatatatatgcaatatgcatgcatcgtcctccacaccaacatggctaactccactcgtacgtacgtgttcgcctctaaatcacgagcactgtactgcatgtcacgtaccgatatctctagctttatatatctatctgttaaacatttctgatttatttagcaaaattaaaattaaaggaaaatgactttcgtgcctttatatgtagggtgcgttttaagcataagacggaaaaggaaaatttaattaaataggaggtacaattgatatcatcgatagacgcagtggcggagctacgtgcactctgcaggatcatatgaccccataggtttttgcaaaataacccaaaaactattgatatttgcgttgcaacaatagaaaacttgaaattttatagctttgaccccacattatttgctgctggctccaccaatagaaaacttggaattttatagctttgaccccacattatttgctgctggctccgccactgaaaatatagaggtatatgaatgtatgcattaaatattaatgcttatacatattgttagatgcaggggcgaaaacaaacctatggtagcttggcttgagctcgaactctacctctataatcatgcttaaaataagtccccttaaat

SEQ ID NO: 13714 - DNA, 1501 bp, Oryza sativa
ttttaaatatgtggttgccaattaataactttttggtatgttatctcaggtaggacccaaagaacaaaccgccggccacatggctaggaaccgtatcctctgacattacacactaatatcatggtgtaacattcttgaatccagaccatccaaaataaatcaatggctatagattaattggcatacaagtaatcaaattaattagcagattatgtagttaaacattaccatacttaatgagtagaaaatttttttagcactaaagtagtcccttcatgttcattaacatgagcccaccaacttgtagattataagagaattgtctttttcttatggaagatgaggcaacacaaagaaaattgatgcacgagattcattccttaacaggttcatatgctaatcattgcgtctaacaggtaagttaaaccattatcgtcatgtgctagttacttgccgattccggcctgtagcatttagcgatatttgcctccttgataatatatttgatctaaaggaatttgtttaactacataatctactaattagtttgattaattgtatgccaaataatctatgaccgttgatttagaatggatggtgtggatcaaaggaatgtcacaccatgacattagtgtgtaatgttagaggatacggttccacatggctagctagctatgtcaaaacattacattgtgttcatacatataacatatatatatgtacactatatatgctcgtgaaatgttctcgtcttagtcgttaaaaagtacaatgttgtattatgttggagtagtacaatgttattgtgtttttaaaatgtgttccttctaagataacgtgtgtttttcttaattctctgaaagcacgatacagcggcgcccgtatatatttggatcatctgctagctcccctagctagcagatttcatctattcgtcggaggcagcattcaggcatgcatatttctctctgctcctccattgaaatttacacattaattcattgcttgcgccagaaagggagaaaaaaaataatgaccagccttaggacaaacactaggatcagaaatgtccagcaaatgtacacgcatatgattaagaaagagaaacaacgcatatgccgtttgtgtacttattgcatctgacaatgatgcttctcgtctcttttggggaaaatcaaaatttatacttttggagctaattttaagatactttcaatgtaattctttttagtgtgggtttttaagtcgctacaaataaatatataaaagttttacctctaataaagtcttgtttggatccagggactaaacatatcggatgttggaacactaattagaagtattaaacgttctataaccctgaactaattcgcaagacgaacctattgagcctaattaatccatgattagccgcctatgtgatgctacagtaaacatgtgataattatgcattaattaggcttaaaaatttatctcgcgaattagctctcatttatataac

SEQ ID NO: 13715 - DNA, 1501 bp, Oryza sativa
catgtctccatcgtacactgggccataaatttggtcaacgctgcaggccgtgacagcaatgggcagtggcaagtacttaataggggatgtgacccctcctatattgatgtatgtggatacagtgggtgtccacatatattgtcctaggagaggactagattgattttttttttgagacgagggagtactacacctgcggcaaatacggtgtacacgtcgctcgccattgggcaggcaaggccccatgggtagtaatccctctgtctcaaaatattaccctcgtcccaatataagtgtagttatgttttttcatgtccaacgtttgatcgttcgcttatttgatcgcaataaccaaaatagaaaaaaaaataataagataaacacaagacacttcactttgtggatgcatactaatgacatatttgatctattagtttgtcaaataaataataaaagtaatatattgctaggttcgttaggagctcgagttgaactttgataaaagctcgcgagcttagagcctatttagtagagttacaactcctaaattatgcttcaggaattaggtttggagtggagttgtggagcagcctaaacccagctccacctctctattcattttgcgagaatgctccacccagctccgctcctatttctgttgaagctgaaactgtttggctgggctccagcctcaggagaggcacaggctggcacaagctcgttaggagctcggtccgttcattgtgttcgcaaattggcttgagaaagctcatttctttgctgatcagcgcctgcgaccgttcattgctcacgtctcctgcggacgtgccgccacgaaatcacgccttcacgcgggggtttgctggttcgatcccgtggggtttggtatcggtgcaatgcaacttcatctcatccgctgcgcctgcgtgcgtacaaaacgtatcacaggtgctccatcgatcgcacatcattcgctggagcgcgaccaagtcgagtcgaacgaaaccagccgtcccctccccgtacgtgcgttgcgtctgcgtgtgggtttcgtgtggcgacgagcggctgggccgcgatatcgcgcgctcggtgtcccgctgggcctgtgccctgtggcgcggctgcgcgagaggtgacacggaactgggccggttaagttttggcgccgaggtgacggttcgagaggagagagctgggccggtctctgccaaaaggaataagatcactttgactctctcaactcaccaccgaatctaaatcgtatccctcaaccgcaataccagaaatcttgaccccccgaacttgtaaaactgatgcaatttgactcccttggtgattttggagagcagtttcactgacgtggcgcacacgtggcagtgttgacttagtctttgtcccgcgtggaactgacgtggcgcttatgtggcattaaaataaaaaaatatatatgggacccatttatcactaaaaaaatgtgtggaacccactgacatgtagg

SEQ ID NO: 13716 - DNA, 1501 bp, Oryza sativa
ttttgacacgagatagagagagagggggaaaatgctgaaattttagtcccacatcgctaaaccagcgcgcgttcgtgcctggttataagtcgagtacggctatagctcgagtaacgcgcgggccgcgatcgtgcgaggggcacttgcatttccccgcgagatttttacgatgaagaccgcatcgtcgtcgtcgtcgtcgtcgcacgggttcccggccaccgcctcgctctgcaccccgtatctcctgctggtgccgctcggcctcctcgccgtggtgctcgtcgtccccagcctcggctcctcccacgtccgctccgacggcctcggcgtcctctgccacgccggcccatccaccgccgacggctacctcgtcacgccgggtggagatgcagcttccgctgctgctgctgctgctgagacgaaggccgtcgtgcggccggagctccgtctgctggtgggggtgctgacgacgccgaagcggtacgagcgtcgcaacatcgtgcgcctggcgtacgcgctgcagccggcggtgccccccggcgtcgcgcaggtggacgtccgcttcgtgttctgccgcgtggccgacccggtggacgcgcagctggtggtgctggaggccgcgcggcacggcgacatcctggtgctcaactgcacggagaacatgaacgacggcaagacgcacgagtacctctcctccgtgccgcggatgttcgcgtcgtcgccctacgactacgtgatgaagaccgacgacgacacgtacctccgcgtggccgcgctggtcgacgagctccggcacaagccccgcgacgacgtctacctcggctacggcttcgccgtcggcgacgacccgatgcagttcatgcacgggatgggctacgtcgtgtcctgggacgtcgcgacgtgggtgtcgaccaacgaggacatcctgcggtacaacgacacgcacggccccgaggacctcctcgtcgggaaatggctcaacatcggccgccggggcaagaaccggtacagcctcaggccgcggatgtacgacctcaactgggacatggacaacttccggccggacaccgtcctcgtgcacatgctcaaggacaaccgccggtgggcggcggcgttcaggtacttcaacgtcaccgccgggctccagccgtccaacctgtaccacttcccatgatcgatcaatttttgttttgtatattctgattgtttttatttaatgttgttgaggcgacgttggttgattccgccatggtagcgtacgccattcacattctttctctggaatttgttatttagcaattggttacattatctgattgcgagctgacagcgtggctgagccaaagcgaattaatagtacaatcattgcacacaggtcgcaatatgtagcgggggaatgcagccatttgcttctcctgatgatttcactccgtcagttaattccgcttcttcacaacagctaattgaaaactttcaaattactaagacgcaaattcaaatt

SEQ ID NO: 13717 - DNA, 1501 bp, Oryza sativa
gggacgtgtcacctgcatacgctgcctagcgaccgcccaagaagctctcgcgtcgtcgcccatttagcagcgcacgcgcacgcacacgaacgcgccgtgcagcatcagcaggcagcagcagcagcttcctcctcctcctcctcatcttcaccgacgacaccgcacgctccgcttgctcgtctcgccggcgccatgtcgtacaaccattcgccgtccatcaccgcagagaccataaaccagaaggtacgtggctacgtgcgtcgttgcgttcctccgtcgatctgaacctcagctcgcgatcgatcgatcgatcgatggctagctcgatcgagttttattaactgatcaaatatgtgcgcattctcattcgtcttgaaggtcaggatcttcacctacgagccatgtggggagattgtccgccacgcacgggtaactataaatctcatcaacctacactgagggcaaagccaatgtttgaagcttacaattaccttgagatgagacccataaatagttaatttttgttgtagtatgttatacaatacttatgatcataagataagggcaatgtatacgggttaagtagtccttatggtacggttaggccctgtcacaatagacttcagttatctctatttctatcgctacaaacatgggatgggaatcatgggacccactaacaaataaaaatgtattccctccgtttcaaaatgtttgacaccgttgactttttagcacatctttgaccgttcgtcttattaaaaaaattgtgaaatatgtaaaactatatgtgtacatgaaagtatatttaacaatgaatcaaatgatatgaaaagaatacataattacttacattttttgaataagacgaatggtcgaacacgtactgaaaagtcaacggtattaaacattttaaaacggagggagtagtaagtaacatcaaacacaaaagatgaagaggggagcaaaggagagagatattcttatttcttatgggtagtcgttagttactccatggatagctcatgctattgactcccataaagactccttccacaatatatacattggtacattgaaacatgagctcactacataccctatcttattataagttgatgtccactatctcctaaaattcaacatgtaagtgtaccatatcatcaccactagtaaaatataacctttcagtgatggtgggagtatagatggccaaaaggcctgaggcccgacgggccgccccacggcacaacattttggcccgtgcctccccccccccccccccaccggcacgttgggcaggcctaggccaggcccgacacacaaagaatagggagtaaaaatagacatattatatgccacggttcaagaatagggacgcaaaatatagttattttagctatatatatgtcaacctaaagaggagggagaaaaaatagacttattttatgtcacagcccaaagaggagggaagaaaaatagattcatttaaaaaaaggca

SEQ ID NO: 13718 - DNA, 1501 bp, Oryza sativa
gtttggaaactccacaaatgtaaaaaaaaataatcactcatatatcgtacaaatagatatgcaccacctccatcattgtgacatattttttttctaataaatttgagcatatacggtttcaactaatatgcccaaaccagttattaacggacccatgtttaaaatagagtcaaaaataaaaattcgtattaaaattcaaacaacattaaacaaacttacacgcgcgtacgcgcgggctaccttcgtagtttttatagtagttaacatacatttatccatacattcgtagtaaaagcacgttgcaggtaaacataaagtaaaaattttcccactagaacggaaaagcgtaaaaaataatccgaagatttgttataatttgaaattaacagtaaaagcaagtttttaggaaggtttgtgtcgcagcgaataaaagtcttatgcatatttcatctttcatctttttaattgctcgctcacaagaagtatatttcaagaattgctcgctccaataaaagtcttaggcatatttcaactttttaatttcaaatgagattatcatatttgtaatgtatatataataaattaaaatgcatttatatttggaaaaagcacaccgaaggtccctcaacttatcagcgagataaaaaagtcctcgaactgcaaaaccagatatgcggggtcccttacctatataaaatcggtcgcaataggtccctcggtaattttgatcccagttttatccaacgtggcgctttgaccacggccatcggcggctgagtccacgtaggacccatatggacccaacatgtcagcgtgtccacctcaccttcctctctctttcccctcttctctcccttcctcctctttctctttctctcaatcttctctctggggctttgggcaggccaccgccgtcggtagacggggcgaggcgggagaggaggtccgcagccggtgacacagcggcgacgcgggagcaggggagcaaggtggcggcagggggagctgtgactggcgtgggggagctatgcttgcccggagccgccaccgacgacgaggccgagcggcggggagtcgtcggcggcggtgtcgaggtggcctgctcgacgaagcagtggcgcgagtggcggcgcccgagtccatactagcgcgccgctgcgcggctcgagggagagaggcggtggccaagtcggcgaagggaatagcgagcaggcggggcgtgatgcgggaggcgagcaggcgacggccctttccctgcccggatctgccaccgccgacgaggccagagtcgtaggcgccgccactccgcatccacagcggcggccccatgggaggaggacatggcggcgcgcgatgcgagagcaggaggcggcatcttcgatggcggtggcgatggaggtgaacgccgggaggaggaagacagcagaggggaagggacatgcttcgtcgccgctctcccttgtcggccgccgcgcgcctcgcactctcccccggccgccac

SEQ ID NO: 13719 - DNA, 1501 bp, Oryza sativa
tcacgttcattcaccttgttctcgttcacgttcgttcgctcgttctcattcacgttcgttggctcgttcacgttcgttcgctcgttctcattcacgttcattcaccttgttctcgttcacgttcgttcgctcgttcacgttctcggtgtgacggcaacgaaacggcggcggggcggctcggcggcggcgtggcgccgcgcgcggcatcgggccggcgcgtggcacggcggcgtggcgccgcgcgcggcatcggcgtggcgcggcgtcgtgtcgtgacgaggtcggcgtcggcgtctgaaactcgagagggagagagagagagatcgagatcggagagagagatcgagagggaggcggcgcgcggcggctctcaccccagagatgcggcagcggcgaaggaggcggaggcggcggcgacgacgacgagcgcgagacgacggcgagatacggcggcggcgtcggcgtggggatgccctaggcagtggcggcgaaggagaagccgagagagatcgatcgggcaaaaacttctaagtgttggtggagatgacgagggcgcgcatcgggaatatatatagccctagatctttagtcccggttgatgagaacaagcgggagtaaagattagatatctttactcccggttgttgagaacaaccgggactaaagaaaagatgcttactcccggctcgtctcacgcaccgggagtaaagatatctttactgccggttgttctcatcgaccgggactaaagatattttcccgctgtttctaaattctttttaaacttggttagggttaagaaccgggactactgataagcgcactgaatattattttccattacatatgtttttctaaaatagaagataatgcattacaattatttaaagtataaagattaatgacaattacttcgaaaaattattgttgtctgtaataaattaagtggataaaacgtaataagcaaatatatgatttaaaattaataaaaattctaataatcatatatacttagcatatgaatgatattattaaattggtaaaaactctaattaacatatgtatatacatacgacatgatttaaaattaataaaaattgtaatcatcatatatacttagcataggaattatattaaattaaattgtgaaaaactctaattaacacatgtaaatgccacatgcatgatttaaaaattttaaaaattcgaatagtcatatataattagcatatgaatgatagtaaattaaattgtgaaaaactctaattaacatatgtaaatgccacatgcatgatttgaaacttttaaaaattctctagtcaattataattagcatatgaatgatagtaaattaaatgttaaaaactctaattaacatatgaaattgccacctgcgtgatttaaaacttttaaaaattgtaagtatcacatataactagcatatacatgatttaaacttgttaaaacctctaataatcgtgcgtaattaacatatgccata

SEQ ID NO: 13720 - DNA, 1501 bp, Oryza sativa
cgggcgttgcttcctttggggacttgttgggagtgtagcgtggctctgccccctctcgttgtttggagtagcgttacccgtcgtacgaatttttctttttcttccttgtttttggctttgttttcttccttctctggcataggccggtttggccgattgcgttgtgtaacaaaaactctattcctctaatatattaacgtgtaatccttttgcgtgttcgaaaaaaaaagaggaataactagtggcatgtttaaatggatgataagtagaattacttatccttgatcattgtgccaagatgaaatataactatcaaaaatagatggaaggagtaattgtttaaataattactaaaatgttctttgtattattaaaattaataataggaaaattcctaagagtataattaatcatggatatataatttaaaaatgattaaatatagacatgttttaattaggaaattttatttctcacattaaacttcacttgtaaattaatgaaatttaatataaattttagaaataatttacaaatcccttaaacgaaaatgagggtgtgacagaacaaaaatcctcaaaaaagagcacaataacaagcggaacatatgagtcgtatccaagacctaacacacccgagatcataaaaacatatgtcatctttagtgccacctatcggctccgctctccttgctccaccttcgagatggacgggccttcgagacagacggcagcttgcgtccctctgctccaaacggtcggatccgccaaggagattttccttaattttcttccctttgcaacgcatgggcactttttctagtctataataaactcgtaatcgataaatctgattagggagaaccgggtgatatgggtgcacatggccagcctcatcgcaaagtcgggctcagactcaactacgactctacaagcatcatgcatgggcctgctcgatgcgaaaaacgctatttattaccctctaaggctttaataggcactacgacaattgtactctctctgtcaaaaaaaaaaaaagtatactctaactatgtatctggacatgcatcatatctacacagccagagtttgcctttttttaaacggagggagtgtgatggtaggatcctagtaatcgtaatagaggtgagacccatcagtgatatatgacaatgatggtccgtataaaatacctatcacaaatcatagtgaaattttttatgttaaaaagaaaatttatagatccaatgtcacattccgcaagaatttatgaggtggtgttttgatctagggacttaactttagtctctgtatttaaacactaatttagagtattaaatatagactacttccaaaactaattacataaatgaaaactaattcgcgagatagattttttaagcctaattaaaccataattagagaatgtttactgtagcatcacatagactaatcatggattaattaggctcaatagattcgtctcacgaattagtccaaga

SEQ ID NO: 13721 - DNA, 1501 bp, Oryza sativa
gtatattaagactgtaaggatgttgccttagtgattcgcatcaaatgattcttcttgtacatcacgttttgtagcaccacgtgtgtatcatcctcatacagtgcttgacaaaagatgtgtaacgcgttgagccggcagttcacttcattgccttacatgttgctaatgctgacagattcttcagaattcaagttactgccatccttttggtctgtatgaacaattgctcccccgtgtcggtgtactcatggatggcatataaatatttaggtttaaagaagtggattgaaaaatatatattggttatcaacaatacaatttcccaaactatatatgatgattctatgagcagggatcctgcatatttttcagacgggagaaatctgaaatctgtgcaacctatatatatatcaatccatccacgcggcacgtcccttcaatatcaacacggtggcgtgcacaatacacagtcgcacagaagaataacaaacaaattggtgggtgttagtttccctctactgactgaaatcgcttgcttgctttagtttagtcgcgttggcatggaagtaaaacccatatttagtcagattagattccctcctcacgcagcaattggcaaatgcttggttggttcgcaaacgcactactaagagtgaataaacagtcactgcaacatggcccagcagcaaattaagcaggataaggccatcatttcgatccaaaccggccaaccaagcaagaaaaccagcaacacgtctcgatgtcatcacatgtacatgatctccagcgatatagagcgcgcgcggcgacgagtcacgactgcaatttgcgacgcaagaaacctcctccctttagatcgcggcaacacatacgttatctctgacaaacaaccgtgaaaagaataatggccgtttcggtagatcgatctccaattgacgatcgaattgggaagaagcacctctaaccttactgctccctctgatgtggtgttcactgatatatagactcacaagctatggaaccgatatgccaaccactcaaaaacagagaaaagtaaattagagattcatgagctgtgaaaaataattaagggccgttttctagctgtcctattcatggatatgatcaattggtaagtgcctgcaggcacctagccagagactatcccgccgtattatttcgaccaaattctccaagcaaacatgggaagatagatacgtactcctacgcgtgtgccgtggccgtacgtacgtgtgcctgcatcttcaccgcaagtcatgcacatgcgcatgtgcttcatcctagcctacgttgctgttcccgctcgccacacactttcgcctttctgacttacacgcgcgtatatatacacgcagcacgtctgcaccggccgtttcaccattcctcgaacaccatcatccacaaacacacaagtacatctcgatcgaagctagctagactagagcacgcacacgtacgatctcgtccatggcgggcgtcg

SEQ ID NO: 13722 - DNA, 1501 bp, Oryza sativa
cgcatatatcagggaagggtggtctacttagaaatttatatgtaaatatatatatataacaaattgtgtcaattgaaccaaataggaggactagcttggtggtacaaataaaacatattcattaacaataatgttatttaggatttgctaaaaaaaagaaagcccctaaacattttattaaacaagacagaacactacatgtttccatacaaattaaatctaactcttttctacatattgttagataattgtttataggaatgtattaaatattatatattttaaaagctaacaaatagattggacaaattataaaagcaacactgatgaggataagttatggataaacagtatttttgaaatggcaagtgtcatctggttgatattctatcattttaattttttttcaaacataatctctaatacatgctcgcgcatcgcgtgggctaccttcctagttatatactaaaggtccattaaacttcctacaaacgctctcaagcctccacgtggcacatctacaaacgctcctagaccaccacgtggcaatgcctaatctcaccgtcaattttcactcaaatcggtggacccgataatttagaccattaggttagattagatgtattttatttaaaaagttgtgagaaaaaacatatcaaccattggttttcatttattttcaaccatccgatacattttagatcatatccctactttcagctaatggacaactcatctttaattgtgctagagaaaaaaaatactctctctgtccaataaaaaaagccaacctagtactggatgtgacatatccaagtaaaacgaatctatacatgcctatgtccagatttgctatactacactatgtcatatctctagattcctttttttacagagggagtaaattacagtccatactatgtattcttaaatattcttaaaagttttcatattatgtcatcatttaaccattcttttcttttacacaatagctaactttacatttcaatttggaccaccctattatatccatctccaagtctgatgactcagcaatcactccgcacactatctctctctctccattttctttttccctccgtttgataactgctaggtatagcaagaaggagcacggatatagcgtcttcgctttttgttaggtcaactcctgcctcccagtcccttcacgcccgacatccccgacctcaatgcaaccataacaatagtgtgcataacgatagtggaggagaaaaagaaatgtcggtgatgacggtaaaggcaaagaggaggaacgatggtggctcaggagaaagagcggtgatgacggtgcatggagtatcagttagtggttgctagtggtctgagaaatttgttgtcgacacaatcgctaactgtgtttgttaatttttgatgatatgtgggtcaccagtcatcataaagaaatactattaactagttttaaaatagtaaaaatattaagataaagttggagtagact

SEQ ID NO: 13723 - DNA, 1501 bp, Oryza sativa
ctagattacttaaattatgacggccaaaaaccgtcaggataaaaaaaacacgtcaggaaagttgtacatgacgtgtcaatgtcagaaaaataaattccgccaggactagcttgtcagagaaaaattccgtcaggatagaaaaaacccaatatagttttttttaacctttaactggaaaggaccaaggaggcatatacatctcaataattaatgggaatggaatgggagaaaaccatttttttatttccctatgctgttcttttgtcattgcttgcagactggatgtgcattgcatcggaaaattaaagaagaacattctcatttattttaaagcctctaaaaccgtgtaagatcaagtttaataagaatggtactccctccatccaagaaaaactcaagttaggaggggttataggttagttttttttggacggatggagtagttgctatctgtaattttgttcattttgctagtcattaattaagagtctagatatgcgacaccctacactatccctaatacacttattccaatactaagaatttattttacttgttttctctccttttctcttggagctcgatcatgtgcaagctgcctcttctatgaggggcatcatatatacccggtctctctcctctctttcgtcttgacactattatgtacttgctctaatcatcaagccctttttcatcattttctacatatggcgccactgaatttctgcatatagtgcctttctaaataacaggtgaacttataggcctcacactgttttttgtaaaaaaaattgctacgtgacacttaaaatatatgatctttgctgctagacatctgaaaaaactaatacggctcgtggacacattagaaactgataatttgttaagggacactgttgtgattattttattattttcagaacaaattgagagagaaatagcattgaaaagacgagtttttgcccctctcctcctctctgtatctcccgaagttgatcagcagttcagcaccagcccatcgcgtctgtgcatgagaaatttttcatgtgcggctgtgaaccggtggttctcaaaccataggaacttgaataatttttccataaaatttctttgttaaccatttaatttgctgttcttcctctaaacacagaacccccacatgttcttcttaccatgcatggatgagttgatgtttaaaggaaaatgcctaaaatggagatagcaagtatatattgagtgacaaataatcaagtgatagactgatgagcagttaaagccacatttattaagtggaaaaataataactgggtcgtcgtgcacagcgccgcacatacgtgtcggtctcgccctgcgcgcccgtgctcgtgctcatggccctggacaccattgggacacggttcacgttgcgttcgcggagacgcaccggtcgctcgacccggtggcgctgcactgcaggaccctgtggcggcgctgaacgtggtcgcggccgacgcgcgtcagg

SEQ ID NO: 13724 - DNA, 1501 bp, Oryza sativa
taaggtttaaccatgttgtcatcaatcaccaaaaagggggagattgaaagtgcattaatcctcctagtgggttttcgtgattaatgacaaatgtggttaagggactaatgagctcattgagtagctttcaggtgcattagtccaagatgtggaagatggatgcttggagaccccccaaaaagtacaaaatcaaagaggaccggaactcgagaagtgcataggatagtttattttctgaaatcgagtttttaggaaaaaccgtactattaagaggggttccaggtgatgctctgagatatatcaagcgctcttagtgtgaaccaagtatcaagtttccctaggagttcttttttttttgcaaatactccatctgcccaaaaatgcaagtccggaacttcctgtcttccaggtccggaagttccggtcttgtgaaaaagattttcctaagtgtagtccggaagttccagtcttccaggtccggaacttcctgtcttgtttccagttcaaatttgtgagtaacggctagatgacgtcacctagccgttatacatatgcagctcgtttccagctcgttccttggccattccactttcacttttcgaaccaagagctattgctagcctctccgaagtgtttcttgtctttacactgaatctagagcctaattcttgtgtgaaagagagattgagagggagagaagaagatttggagaggtgtgaagactaggatcttgggtgagcacttggaatatctcgtgggctgtcatcttggtgcttattactcttggagatgatctcctagacggttaggtgtcacccgcgagaatccattgcatattgtggatgtcccgggtaagtttgtgaaggatttcctctcctccgaaagggaacgaggtaagttagtgaagttcttgtgctgagattctagagcctttccaagtagagcaacccacacttgtggtggatttctagaagtaggttgagttggatcttggtggtcactcaattctagaaatttgcctaggggtgtttggggttaaaggctgtggatttcctctggggtttctgcacaagtgaggcaaggggttaatcgagacccagctcttggagctcctcaacggagagtaggatcacaagatccgaactttgggaaaaaatcgctcttgtctctttctatgatgtttctgtggatgattttgtgatatatcctcggcttagaatacctgtgcaccatcttgtgaagattggcttagtctcttgttttgaaatttaaatttcatctctcttctattacccggaagttcctgtcttagaacaccggaagttccgggcctgggaggccggaagttctggagttccttaccaggaagttccgtgtctgattgaatttgaccgctgcgatttgtttttaagttttcagggacagcctgttcacccccctaggcttcatcaacgcgtttagagttcatggtgatggtactcagggggttcaaggtgaaggc

SEQ ID NO: 13725 - DNA, 1501 bp, Oryza sativa
ccaaacagccgatagggcccgtgcaaggggttttcaggtgaattcggctaagattatcaacaaatatcagaggaagtatgacaagcagcaggagaagcatcatgaagaatacgatgatggttttgatcctcattggggttgtgagttctctagattctgctggaatgaaggtatgaggttgccatctattgaaaactgccctgggtgcaatcggctaaggcagacaagagtttctgttcatcaaagattgggtccagtaaatcaagatcatggccaagaggacaatgtaatcaggaagaatcaatggtgtccttctagtattttcacgaagaatcagaagagaagggttcagagattgaggaacagggagcaccttcaggaggttgaacaagaaattaatcatcggctgaagaaagcaaagccaaggcaggagtggcatgttaaaaatcaggttcctgtagccgataatgttgcagccgatgaggcaaagaggttggcaaaagggaagagtgttgtgactgcaccggttaacatggtctttaccttgctagccgaattcgggatcgatcaacccgatgtcgacgaggtggaagaggaatcagctaagttggttctgtcaccggaacaggcagtgtttgagaaacctgaggggacagagaatcagcatcttaaaccattgtatataaacggctatgtcaatggaagccgatgtctaaaatgatggttgatggtggggccgcggtaaatttgatgccttttgctatgttcaggaagttgggtagatatgctgaagatctcatcaagacaaatatggtgctcaaagactttggtggtaatccatcggagaccaaaggtgttctaaatgtggagctgacagtcggcagtaagactattcctacctcgttttttgtcatcgatgggaagggttcttacagcttgttgcttggaagggattggattcacgccaattgttgcattccttcaactatgcatcaatgtttgattcagtggcaaggcgacaagatagagatcgttccagccgacaggtcagttaatgttgccagtgccgatttagctctttgggagatggatgaccttgattgtttatctggaaaagtttgggatggagattttctaaaagtgtctgattctgatatacagccaattgaagatggagaacccaagctattattttgagggcgtcgtggagggttcaaatgtctacactaaggatacggtagatgatctcgatgacaagcaaggtcaaggtttcatgtcggctgatgatttggaagaaatagatataggtcctagcgatcggccaagaccgacatatattagtaagaacttatctccagaatttagaactaagctgatagagctcttgaaagagtttagagactgcttcgcttgggagtattttgagatgccaggactcagccgatcgattgtagaacatcggttacctatcaagccgatatgcttgaacatgtcaaagcta

SEQ ID NO: 13726 - DNA, 1501 bp, Oryza sativa
ctggactccagccgattcctgctctgttttcgaactcgatctctgccttcgacttcacttcgatctaatcttctttcccgatgccgatattaccaattttggatgttaacacatgccccccaagtctagaatatttggtaatgtttcggatttgctgtaaatcgactctgagcaagtttcgcactttgccgttttccgaccgttactgccgtgctttaaatactaaccgttaccctcgagaagtctcacacagtcctcctccgttttcaccgctgaaaccaactttgttctctctctctctctctccggcgatctccccgacgtacaaagcaatccccaggcgatttcgttcctgatcaaatctccacctgcggcgatgtcgtcttgtaatgccctagaaaaaaaatagaataccgtagaggatatattggaagttcctaaggttttggtgtttgaaattagaagaaaaacaaaaggtatatgctagctaggctagcttttggccagcccaaggcccagctgccccctggacatcctcaaaacactaggagatcccctccccacctccccctagccgtcttttggtacccctgggcgcccacctctccctctggtcgacctccccatgggtgccctactgcagacctaggaagaagaagggaagaagaagaaagggaaagaaggaagcggagggaattgagatgaagaaggaaatgaggggttttggttgccgctgcccatggaggcctaggtatctaatacatgatcctttccccctgttttggttttctattagggtttagatcaagtgttggaagcgagtaagtttgggatcaaccgatttattcctcaactgggtttttttgctgatctgccaccctacgtagttctgccttggctgccttttcggccaacataatgggatttcctgtgaaaagtctctatacaaaagttgtagataacgtgtagatctatcttctgaccaaatggcatgagtttatatcaagtggtttaggaggtatcaatttctgaatttggctgtctgaatatcgatgcatttttctgtagtccaggtttagagggattttagaggatcttaatgatggaatcagagaatcttgtgtttacagaagttgtagcatatgttttgatatacctcctacataaaaattgttagctttcatcttgtagtttgttgtcagtgctcttttgaatggttgttgcacagttttctggtctgcacttctctgttttgtgccatgttttaggcccgctaaatggaagaattcaaatttgttctgtagatgtcagaaatgatatattttgctgtgttatgtgatgtagaattggaggtatcgaattgttaatctatgctgcttttatcggaagattatcggtgatttgctttatgttgtttggggtgggatcccagcgtaggaagcgtatgtgtgattcttgaatgattatgcatgttgtttgagtctgagccggtgtttattct

SEQ ID NO: 13727 - DNA, 1090 bp, Oryza sativa
tagtcaagaaaagacaatcgtcaattcttcatttctgtatgtggatattggtctttttcttctgcccattcgtttacccttcagtctataagctgcaacaaaaaaaaatataacctaattttggagttgtttttgggtttttctttatcgtagtttaaaattttatactatgataccacgtgtatttgggggtttactattttgatataccacgtgtatttctcagtgcgaggtatctaataaggtgaagcaaattacctataagctcgagtttatgggcatctgcatcactgcatgcagtcgctgcctccgtgtaaatgaattgcacagaacctatccgatgtgacatatttcaataccaatgtgatattttcttggtaaaattagttgtgaagataaaggtcatgtaatctttgcatatggtgatttgaaaaaaaaaactcttatttcttcagatcagtacagaaaaaaaaacagataactacaccgatgtttgtgccgttggcttgaattggttgagcttgatgtgtttaggccagcaccactactggaattacggttctgttcgtccgttgagttctaccgcccaatacctggagattaattagccattctcatgtttgccgattggggctaaacaaactagcaaccggaaccggggctatcccggacgaaagctctattaaattataatatttttgaataaactgacgatgaaacttttataataaatgatagttacagtgaaatttgtctgggctcgaaaaattttctaaccccaccactggccagaattgtttaattatctgtaggttttgaggtgttgatacttcacatgaagaaaacaggaacacaaacacaagagataatagtttgtacgtataaatttctcaagataggaatatggctctagagtctttcaactttcaagactacaagcacaaccgtagctgcattcttttggggttgggaaccttcccctcatgcaaaaccggaacggtagactaacgaatattaattaagtatcagctaaaataacttgagaattaaatttatatgatttgttaagacaacttttctacataacagt

SEQ ID NO: 13728 - DNA, 1155 bp, Oryza sativa
  unsure (1)..(1155): unsure at all n locations
cacattgtactcccntgcatatattcggcactgtgggtgtgtcttgttaagtacggtgttgaactcagtctggctcatnttttcccaaaccagaagagaagcccctgaagatgaaggctttggtgtttagctcatgcctgccgtcaagcgcctgtggtcgtcgccatagtcttccgctgtttcccgtttgtctttgtgtgtgctgggccttcgccgccctgtaataaattaactatttacgcttccgcttgttgaactctgaactgtatcaacttttggtgtaccttgcctcctaggacaaggaataatgcacgcacgtaaggaacgcccgttagattatttccggtcgtgacaagcccccagcgttagatcgtagtcgatttaacatcggggacactcgcgcaatatatattgtataaaaacatgctctaggtaaacataataaattatagatccgacaatgctgtatgatcttgaaaagtaggtacagtaaattgtatataaaatattgcgtacctttgtagatatatgccggatatatctacagaattagtagatcaatttaaaaaatcaatctactaaatacctgatcatgggtggctggacacgtactgactccatacatatgcatgtgtactgtgtacgtgtaaggagcaggcatatttgttgaattcgcgtcatcaggacgagtagtcagatttgtcaactagaaatttgattctagcgcaaactacagaactcctcgaatccgattaggatattagccactgaacagatcaatgtggtgcttgtatttcagctcctcgacgtgcttgttttgttgatggagatcgatgccgagtctggcttggacccggccagctgatgccgcccaccggttggcgtcctgcacgtcgatgggttagtgtcggatcagttttggattccgccaacactatggtcctctgccgctgcgacatcttgaagcttgattggtctcgccggatcgaatagttgatggcgatgattccaatctcgttgggagacgtactttggccaggttggatctccctgatccgaagtcgtcgagtagcttattgttggagaatccatctcttaaacccatctcgtctaaatcctgaagcaccaaaaaatccccctacctggcgcgccact

SEQ ID NO: 13729 - DNA, 951 bp, Oryza sativa
tgccgaaggtgctcctttcaaaccaatcgcacccggaccacagcctaaacacaattttaaggggttttgattaaaaggggaggtgtgtaatccaattcccaaataatccatccatttcaatagtgtccaggtaatgagaatattcccaaattctagagttgtaaaaccaccctaatgttggcttaataaacaagcaaagcatctaccttaaattcatactagtgggtaccataagtagagttgtccactagttgggggttttggttaatctaaggtggaccaaggtgattattaccattaccaataatattaggttcataacaaaaggtaaataggcatggctaaataaaccagtgataccgcggaattttaaataaagcgataatgcaataatttaaatcaaaataattttataaactgggattcaatatgttcaaggatgatgtgacttgccttgctcgctttcccaaacgtcggcttcaacctccacgaagagcggatcttccgaagctgcagcgtctatacgaccaacagaaatgaaaagggtttttactctaataaactccatataacaagtaggaacaaagcacaaaaatgggttcttgacttcttaaggaaaaattagagacttgaacggtccaattccgagttcaaatggccaagttatggccatttaaagtttatatgctctttaaatgaatatttgcgaatttcttcatttaaaatttaatttaaaaaggggtttattgcgtcagccgaggggaaggggcacgcggaccgggtccacaggagtggggcccatgcggcagcctcacggtccacggtggaccaggtgcacccgggctcacaccggccggcgtcgtgggtaacacgcatcagccgcacccgagggcgcgggcggctgatgaccgggccccacgcggcagccactcggcccgcccgaaggcggcc

SEQ ID NO: 13730 - DNA, 1182 bp, Oryza sativa
tatttaatcaatattaaccaatcactgtttaacactacaccacattgagacaagcccaaaccaccacctgaactaactagttacattagctaactaggggtgagaataattgtcggtgatatgggcctgaggatatgagaagtatggggaagtctcaatcccgtccagccacgcggccatacagcctggccctccccccacatctcggacgacgcaaaggcagccagggggcctcggggtgccacgtcacgcccctttgaccctcaggctgcctcgccccgaggccctcgcccggccgccacgtggcggggggagtgagtggggcggtggccgaatctgagccgccatcaatgaatagcaccccaaccgtcccacaccgcatttaatgcggtgagggcggacgtgcggcgctgcccgattgacccgcgtcaatcgggcgtgaccggtctgtggccgatcacatccaatcggacgggcggcggtgcccccacgttccgccctgtgctcggcggagtgggggcaggtatgccccgtcccatcaatgcatcgtctagagccccctccacgtgaggtgaaccgccaaaagtctccattcacttaaaggggaatgacaagggcgtcccccgtgtcaggcaggggacggcgctgggccccactcgaggacggacggctgcttagcttccggtgaaggcacgaatggtggtccgctccaagcggcgtgggccccctcccttgaaggagtaggtagaggcggtgcatgtggtatccccttgaactataaaaggaggaccttgcccactgaaaaggggggatgactctcacttagcctaagccccagaggaagaagagtaagagttctccctggagtttagaaacctttgtaacactcaacccttaaatcccacgcacaggagtagggtattacgctccctagcggcccgaacttgtacaatcccagctctcacacgcggtctcgaaagactctaggcagatatacgttcttgatcagtgcgccctttcccccggccgaactcacaaaagggggtccctcaatcacccgcaagagaggatcattcctcgacagctggcgcgccaggtagggggaattcgcgcgtttgaaagagaaatcgtttccttccaccacaagtttccctccatcctcaacgatcatggtcgaggtcc

SEQ ID NO: 13731 - DNA, 1023 bp, Oryza sativa
  unsure (1)..(1023): unsure at all n locations
agtgaaaatctgaaaaattttatatttttattttaaaaatatttagactaatatatagatatttaatntaggtattagtaaatcaaatcaactatagtttgaattaaaaaacaaaatgatatatgccaggacaatctattacaatagaatgcactttggttaaatgttacttcctaatttcttaatttctagtttggctccccccacngttatggtaaaaaatcgttatgttttaactatttatctgctagagcatatgtaatatttatgtaaactatgttctttattaccaatcaaaatagacaccttacctactttcatcaaaagaaataaaaaatgtagtaggtattattctggaatactcttcgtcggaaacatatggaacgcatttccctcaaaacgcaaaaaccggggccccgagccctcgacaccaaccccgtcagatgtgaagccgacggcccaaatggaggccagcggtgccaatgcgtaggccacgcgtgcctctgcgcaaatcttatctcccgggaggcttcgctccacttccctccccgagtcactcaaaccatccaatccccccaccttccctttccttgcccccattccccaccgtcgcaaggaaaaatattattaataaacaatgatgttgatgtattattattaaacaatgatattgatgtatttctaaatattttcacgtattatttattaagtgtcagtgattgaaatggatcctggtcggaaatgaatcctggtcggaaaatggttactaatgtttttccttcatataatatttctggatatgtataacaatgtgggtcagcaatattgaactatgcaaaccattactctgtacaatcttttcttttcaaatgctggccacatttcgctcgagcttactgctcatgtatgcagctcatggatcctgagatctagacgtcaacgtgcttcctggaaagagagaggctcaggcatgagagcatacctctaaaataatgtccgtgcttacctgtgtgcttgataaca

SEQ ID NO: 13732 - DNA, 1273 bp, Oryza sativa
attcctgcaccccttatatagtgtggtgatggaatctagcttgtataagtctttgagagattggtgacctactctttcctactaacagctctgattagacatttattagactgatatttaactaactagctactaacttagtaatataatactgacattgcacaacttgatcagagcttgcatgaatatggtcaattaagatgtacacagatgatgatttttcctggtccagctgttcaattatgggaggattggtacttggtaggttagttgattgttttggcagataggcatgtacctgggatggcagataggcatcatatgtatgcttcccccttgtatatttctatatcaaatttgcatgtttcctctctgcaaataaaaaggggaactagtgatcggcctaaaagggaatatccttagaattcatagtttgaagataaaattttcggtatgaaagttgggagtattcatatggccaaatcaaagttcactgctattaggaagtgttgactagtccataatcgaagtttgaaattaatcagagctagagatcgttttcaggtgtaataatgtgtggattggtaggttttgttgattgttggcatccaccatgagatgtactaattttggctggccttctcccgtaagatgtactcttttttttctgaatagttgaatagttttatgataactactcgaggtacgaacaattatatataactattacaaagttaaaagaatatactccttccgtttcaaaatgtttgacaccgttgactttttagtacgtgtttgaccattcgtcttattcaaaatatttaagtaattatttattattttcatatcatttgattcattgttaaatatactatcacgtacacatatagctttacatatttcacaaattttttttaataagacgaacggtcaaacatgtgctaaaaagttaatggtgtcaaatattttgaaacggagggagtatttaacttggatggcaagatgtaatatatcaccttgccgccgtctacttgacggcatgatctatttctataaatattttcgctggtaatatatttctgtaaatattaaaaaattaaaagttaaaaatgaaaaaaaaaaagtcgacatcaagtatatgcggcaaccataaaacacggccaaaaaggagggatgcaaaatagacttataaaaaacacaatgggctgccacctttgggccagcccggcctgaccgttgagcgggccgtgttggcccgaccgatctcgggcca

SEQ ID NO: 13733 - DNA, 641 bp, Oryza sativa
cggggcggactgttgcggccgatttgccccgaatccgccgcactgttccgcgcccaggtcggcgacgcggccgccgcgcctactcgcgattgccaaagtggggctctctcccgggttgccgtctcgatacagccgcgtgccttgtcctttacgacctactcctgctccctccgtcaaaaaaaaaaaaaaaagacaaacccaccctggtttctgtgcgacttatttgaaaaaattataaaaaaaattaaaaagacaagtcacgtataaaatgttaatcatgttttatcatctaacaacaataaaaatacgaattataaaaaaattttatataagacggacagtcaaagttagacatagaaatctaaatttttttttctttgggatggagggagtacgtacgtactcggtactctcattttccttgctgttttttttcccatctcacgttcgtaaacgaggcaagcgcgactgcatcttcccttgatttacagtgtattttcttttcactataactcgctacagtgtaaagtttagtgcgaggttatcgataccgtttcagtactagccggaatagccggcgcgtggaatttcaattcactactcaaaaccagtaaatgtcaagtggcgtactgttccagcca

SEQ ID NO: 13734 - DNA, 1501 bp, Oryza sativa
gaattattcttctgaaacttgtgattaagttctcttaagagcctttgctgcagaaatttttttcccttgtagataaagaacactatattggaatcctgattagtttcgttgttctaataaacttatccacatcattcttgtccatatattgaatatttacctggacttgtctggttgggagaggataggatagaataattatcattcactgtttgattgcatttataaaacatcccatttttaaaaaagttgcaatgattgtatagatcgtatatgattaagtcatatatgatcgcattggctatgttctttgccctgggttcccaacccccctctctctcgttttccgcgctaaacggtgtggttttttaaaaaaagtttctagacgaaagttgctttaaaaaatcaaattaatctattttaagaaaaaattagctaaaacttaattaatcacgtgttaatggactgcttcgttttccgtgcggaggagatgggttcctaacccccattagcgaacacaccagtgaatgatgacgtggatgatgttttgtcacaaaaatcggctgcaaagagcaaagaactggaactcgtagatcacaactagcctcggtctcgtctagttgcccatcgtattatttatcaaaattgtataataattcgccattcacattaatgtatataaatttgattttaatacgattttgaagtattttagagtaatctattgtttatatacgtttgtatgtacactaatgtaatataaaaggcacgatttggaaaatgggtgaataaatagcacgaatttaaaactgagtcattcaatatatgggtaaaaaatacccatctctaaaatatatatatggatatccaagttagctaataactcagttagcaaactaatttcctgacgacattgcgggtagggggatttggtttgtttgccgatgggggtgccagatccactccgacaccgccggggatgatatgggatggtacgagtagaggtgaaaacggagcggatttggatggatagtagttataccatatcctaaaccatatttttttaatcggattcggagcagttgcggatagtgtgtggatgtggagcggattgttttcggatgtcggaaatggtgcagaatcggttcggacacggattaaatttatcgaatgttacgtgtatatgcaatcaatacaacatcgagttagcaatgcaatggacaataatacaataaccaataaatgacccatcgtaataattatatgcttaagtactaaacaacataaatacatgatgtccataatataaaaatacagctacgcaagtataacatgagacggtgaaaatctcagactaagaaatttaggttaattgatgaattagaccgttggatgaaccaacttatgttatatgtaatagatacagtggttacatgtgttgataattttggattatctagctaacggtctatcagataatccgcatccgcatgctttcaga

SEQ ID NO: 13735 - DNA, 1501 bp, Oryza sativa
gcctcggcgatggcggatatggagcttggcggtgacgggcttggcactcgacggcggcagtggacttggcctctcctcttctcgcgtgccaccgccgcctcacctgcgtcttcctcgcgaaggtcgccgctgactggagctttgcaagtcggggctcaccggatctggctgtgggcgacgattgcggcgagttggggcatggcgcgatggcaacgagtcgcgacaatggtgtggcaagggtcgccagatccagtggcggtgtctcgtcgaggcacgacgcgcgggcgcgcggctgcagcgagtcgcgacgacggcgtggccaagctcgccaaatccggtggtggtggctcatcggggtgcggcggcgagtcgtgacgacggcgtgagtgcttggccaagctcgccagatccagtggcgacggctcgtcagggcgcgacgcaaggatggacgtggcagtggcttcatcgctggcgtcgtggtcgccgccaccctgccctcctcgcctacgccggcgagtccctcccctcttcgccatcatattccctctctctttctctcctgcttccagtcatgcgcaagtgacccacttcctcactttttctgaatttttttgagaattaatattatttttatggaaaatcgcaaaagtagtggccaaccggggaaaatcgcgaaagtaggtccctgtcgaacgggtgcagttcgacatacacctgtcgaacggctggcgttcgacacgctcacctgtcgaacggagggaattcgaaagggcccaccaccggcgccgcgaggcctgtcgaactgggggcgttcgacagcctcatctgtcgaacggagggagttcgacagggcccaccacccggcgccgcgaggcctgtcgaaccgggggcgttcgacagggccctccaccgaccctgtcgaacaatgggcgttcgacaggccggtttaaaaggcccgtccgcgagctcgatttgtttcgaggaccacatcgccagccgccgccgagagtcgccagttcgtcgccgtgagcgccggagggagcgaggggaggggatagcaggccggagaggaggccgaggaggcgccggccgggaggaaagggttggcgacgccctccagcagtgaagttaaggtatacattagtaatccctaagtacaatgcatatgaaagtttaataaaaaattggtttaagagttgttaattgtttcgcattgttcgatgttagtatgtatggttagcacatatttgttattgctaaatgctggtagaggtatctaagtaattgtacggttaaattagttcttagttagtacatattattgatatgttgtgtgttaaaatatgtagaaaggtgttatattttatttggattattaaactagttgtttgttactaatagttgtaaattagtacacggcaatgtagtataagttgtaatagggtaattatcgaatgattaaatgattaaacgtgagactatttgtcatgttttatcagga

SEQ ID NO: 13736 - DNA, 1501 bp, Oryza sativa
ttggcacgcgataattaattaaactaaactaaagctgggtgatcttagtttggcctttttttatgagagagagagagagagagagagagagagagagagagagagagagagagagagagagagagagagagagagagagagagagagagagagagagagagagagaggagtttgtttagttaccttcagaaatgtgaagtcaaggcgtctaagcttagtgtgtgacatgtgcaggcacattggtgcagtaagccagtaacacgtgcaagcaaatagccactactctctgagtcacctttttcttaatctaaatttataatctgtcgatcgaacaagtgcgcattgccgcattggtaatttgatatggctcttatatgtccgaagtacgtccattgggcgtgtcccgatccgccgtcaaacaacagagcgtacgcacggacgtaggcaccgtcgcaccgaccaactagctcgccgcaagctgcgttcgatcgttagtactcgctctgttttaaattatggcgtatgtattttttttacataactttcaataacatattttaaatattaatttatttcatattatattctcaactaatatgaaattaacatatcaaatacttcaaatatataaattcagttatataaaatgcataatagttagcatagatatgactagtaaattagaagttattgagtttgaattatatgacgaatgagtaatacgtagtactagttggaaatattttcccttcacacgtaaaatgcgatagtatattgacatatgattaattaaggattaactaaaaaattaaaagattaaaagataggttgatatgattttttcacagtaagggtgtgtttagtttgcaccaaaattgaaagtttggttgaaattggaacgatgtgacgaaaatttggaagtttacgtgtgtagaaaagttttgatgtgatggaaaagttggaagtttggagaaaaaatttggaactaaactccgcctaacttatctacaaaactttttaaaaataattacattatttagcactttagaacgagtggttatggaaaacgagatgaaaaatatagagtttcgaacgagagtgtccacctcgactactccgctcccgtttccgctagccgaccaggggaggaaagttggagtgggctaatcggtttctgaactaggccggcccattcagagcttcttgtaagcccagtaagctttgagagggacgggcccagttagccagtagggctgatttgggaacactaaaattaaagcccgcccctgtcttttatgggccattgttttaggcatgctcttaatgagacaaaatacaccttatttttgtatacgaatggaataggattttcagtgaagaatgatgtttgttgatcagtggatggttttaaaaatatataatacgtaacgtacccacatgtactcttttactaaaaccgtacgttacgtatttgcatgatggcattcgctagattacagct

SEQ ID NO: 13737 - DNA, 1501 bp, Oryza sativa
ccgacccgatcacgaacgggttgggcatcttcagcccgttcacgcgcacggagaggtccggctcgccggcgccggcggaggcgcggacggacaccgccgcgtgccgccgcccggggacgcggcgcaacggcgcggccgtcgacggcgatgcccggagagtcagcgactccatggctggttgctttccctctctatccttttctccggcttttttttttcttcaatcgataagaatctttgggagtatcacggatgaaggagaaaggcaccgccgccttttatagcgtttttaacgaacttttttaatcgcacgcatgcttcgccatttgagttatctaaaacatgaggttatccggtggtaaatgtgattatcaattggattgcagcattctggatttggagaaaaaaaaataaaagctcgtttagttagcttggtacaaacttgctctcattaatctattttttctttcaaaataaaatttactatttaattttgaatggaagttgttttcatcctgcctcggttcggcttcccagctcgttaagggaaatagtctcaaatgatggagaaaatataataaattatgaaaaataattttaaagatagctcgataaaaaaaaactgatcaaagcttcctttttttttcccacaccttgctcattcaaccatttatgggaagataaacatcgcttgatttaaggaaaaaatggcaaatgttatcataattagatcggatttttagcaaatcgtaaattgttttataaggcatctaaaagcaagcatcgtaacgaagctgccttacgtgtcaactctcaattatcctagctgtcaccctacattaacaagaagcaacatggaaacagacactacaagttgtttcagactattattgctatattggagtatgacaatttgtttttagttccttgtacttggggtaatcaccacctttcgtccaaaaaggtaataaaattttagcaggaattggaaagcttagcgtgccaaggagaaacgatgttaacactggagaaacaatgcatagagattctccacggcagctagtgccattcggtagtcctaatccttgattttggaatagttttagctgccaacacgtcacgccgagatcagcatcatgattttagaattagttttagctgcgaacacgtcacgcccggtcactggtggttccgttgtcccgacctggcgcacatggcggaatcccccatccgtcccttctttttgttcgtcagttgacgttggttcatccatggaagtgtgaactaaacacagccttattaactggagaattttaacctttcagccactaatacagtaatacctatacactggaattctgtcgtatttgatgaaaaactaatcgtcgaaaactggggaaaaaaaactctaggtgacggaccaaatggatagaggatcgagttggatagagtgtacaaacagcatgttgcacatggcgaatctgagcttttcagttattta

SEQ ID NO: 13738 - DNA, 1501 bp, Oryza sativa
ggtataggtagatggatgatgcccctctgggaggatgtatgctgtggattagtgctggttatgcacgtatcatctttgagttttggctgtgtacgtctctccagtcctattttcctactgtgttgggaccagttgagtattgtgctggtttacggaaccttatcgatatcatgtcaagaactgtccctatacaattttaaataactgaaaagctcagattcgccatgtgcaacatgctgtttgtacactctatccaactcgatcctctatccatttggtccgtcacctagagttttttttccccagttttcgacgattagtttttcatcaaatacgacagaattccagtgtataggtattactgtattagtggctgaaaggttaaaattctccagttaataaggctgtgtttagttcacacttccatggatgaaccaacgtcaactgacgaacaaaaagaagggacggatgggggattccgccatgtgcgccaggtcgggacaacggaaccaccagtgaccgggcgtgacgtgttcgcagctaaaactaattctaaaatcatgatgctgatctcggcgtgacgtgttggcagctaaaactattccaaaatcaaggattaggactaccgaatggcactagctgccgtggagaatctctatgcattgtttctccagtgttaacatcgtttctccttggcacgctaagctttccaattcctgctaaaattttattacctttttggacgaaaggtggtgattaccccaagtacaaggaactaaaaacaaattgtcatactccaatatagcaataatagtctgaaacaacttgtagtgtctgtttccatgttgcttcttgttaatgtagggtgacagctaggataattgagagttgacacgtaaggcagcttcgttacgatgcttgcttttagatgccttataaaacaatttacgatttgctaaaaatccgatctaattatgataacatttgccattttttccttaaatcaagcgatgtttatcttcccataaatggttgaatgagcaaggtgtgggaaaaaaaaaggaagctttgatcagtttttttttatcgagctatctttaaaattatttttcataatttattatattttctccatcatttgagactatttcccttaacgagctgggaagccgaaccgaggcaggatgaaaacaacttccattcaaaattaaatagtaaattttattttgaaagaaaaaatagattaatgagagcaagtttgtaccaagctaactaaacgagcttttatttttttttctccaaatccagaatgctgcaatccaattgataatcacatttaccaccggataacctcatgttttagataactcaaatggcgaagcatgcgtgcgattaaaaaagttcgttaaaaacgctataaaaggcggcggtgcctttctccttcatccgtgatactcccaaagattcttatcgattgaagaaaaaaaaaagccggagaaaa

SEQ ID NO: 13739 - DNA, 482 bp, Oryza sativa
attcgctccaaaggagatcaaacatagggcctcttatttaacgtagaagttccactagacttttgcaggaaccaattcaattttgcgaggaatcaagagcataacatctcattctgcgataggcaactggccaagttgaactatctattggccaagtagtgactgaaactgtagcgggatttacgctgggctagaagaattctgcaaatggaaagcccaaaccgacagaagcatagacccaagtgacgaagacctccgatgagaccccgatccaggcaacgttgactttgacttggaatggacagttcaaattttgatcaagaattcggttctgattttatccaaaccccctatcttgttccctgtgaatccaatccatcacccttttttttttttgtcatgtcgatccgttatgtatagttttctagcttagttgcacatcaatatcatcatgcactttaacttatctactcagcatagca

SEQ ID NO: 13740 - DNA, 1501 bp, Oryza sativa
ctccacgattctcgcgcccgcggttgtctcatcatttcccgcgtccactcatcacatcgcccactgaatccgcgccccgcatttagtgcacccgtcagcggcacactcggcgtagggcacgcaacggtcacgggcgcaacctaggcgaaccgtcgccagtaccaccgcatgagtagcgagcgaaggagtcgaggcgtggtctaaccgaccccccgattttcgtgtcttaaacatcctcatcatcagcacggtcagtggcggccaaaccgctgctgtggttgatacgccaacttggccactcggcagcattcccttagattccctgccgggcccgcaaccctagcttgggaagtcgtgaggcaccacgtcagaccgacctcaggaggccaatgtccgatatggtgccgggggctactgtcggagatatgggaccgggggtatgcgaagtgtggggaatctaccttcctatcctgccgcgtgtccctacagcctggtcctgcccctgtagcccgcgaaccgctggagcggccagggggggtcggggcctcggggtgccacgtcatgcccctcgggcccttgcaccgcttcgccccgaggccctcacccagccgccatttggcggggggagcgagcgaggagggggcccaggctgagcttcctttaatgcgtgcaacgccccaactgccccctgtcgcatttaatgtagtgaggcagacatgcggtgtgcgcatctgacgcgccataatcaagaatgaccggtctgtgaccggtcatgacatcggtcacgtctgactagaccgacaaccgtgctcccacgtcgcgtctgctcccggcggagtggaggtaggtatgacccgtcccatcggagggtcattcggacggcggccaccacaagtcttcatccattaatgggggaatgacagggctgtcccccgtgtcaggcgagggacggcactgggccccactcgaggacaagctgtggcttagcttccaggcgaaggcacgggtcgagttctggtcaagatagggtgggtccccacccgaaagaagagtaggtagaggcggtgcatgtggtatccccttgagatataaggaggaccttgctcaccgagaagaaggaaaacgctgagtagacctgaattctaggagaagaagagcaagagctctccggagttaaggaacccttgtaacactcaaccataatcctaaacacaggagtagggtattacgcttctcaccggcccgaacctgtataattcgattgtgtgcaagctagctagtagccctaggggcggatacgagatttccaagagacgagcttcttcccccggccgaactcacgaaagggggtcctcacgacctcccgctatcgagggacttccctcgacagctggcgacagctaatgcgccaggtaggaggaagtcgcgcgttttaaggagaagtcgttttcttccgccccaagtttccctgggccctcgacgatcatggtcgaggtcctgg

SEQ ID NO: 13741 - DNA, 1501 bp, Oryza sativa
tcctgtgtttaggattatggttgagtgttacaagggttccttaactccggagagctcttgctcttcttctcctagaattcaggtctactcagcgttttccttcttctcggtgagcaaggtcctccttatatctcaaggggataccacatgcaccgcctctacctactcttctttcgggtggggacccaccctatcttgaccagaactcgacccgtgccttcgcctggaagctaagccacagcttgtcctcgagtggggcccagtgccgtccctcgcctgacacgggggacagccctgtcattcccccattaatggatgaagacttgtggtggccgccgtccgaatgaccctccgatgggacgggtcatacctacctccactccgccgggagcagacgcgacgtgggagcacggttgtcggtctagtcagacgtgaccgatgtcatgaccggtcacagaccggtcattcttgattatggcgcgtcagatgcgcacaccgcatgtctgcctcactacattaaatgcgacagggggcagttggggcgttgcacgcattaaaggaagctcagcctgggccccctcctcgctcgctccccccgccaaatggcggctgggtgagggcctcggggcgaagcggtgcaagggcccgaggggcatgacgtggcaccccgaggccccgaccccccctggccgctccagcggttcgcgggctacaggggcaggaccaggctgtagggacacgcggcaggataggaaggtagattccccacacttcgcatacccccggtcccatatctccgacagtagcccccggcaccatatcggacattggcctcctgaggtcggtctgacgtggtgcctcacgacttcccaagctagggttgcgggcccggcagggaatctaagggaatgctgccgagtggccaagttggcgtatcaaccacagcagcggtttggccgccactgaccgtgctgatgatgaggatgtttaagacacgaaaatcggggggtcggttagaccacgcctcgactccttcgctcgctactcatgcggtggtactggcgacggttcgcctaggttgcgcccgtgaccgttgcgtgccctacgccgagtgtgccgctgacgggtgcactaaatgcggggcgcggattcagtgggcgatgtgatgagtggacgcgggaaatgatgagacaaccgcgggcgcgagaatcgtggaggcaaccgtgagggcgtgaaacgaggaggcgagcgcaggcgaggtgaggataaaaggatacggaggcagggactttgcattcttcctttcgccaagtgctcacccgcctactcacccgcctactcgctctctaagccctaacattctcgccaattcacactactccgcgcgccaagcccttcgccgtttctccgccggccatcatggctcaagacgctggcgacacagtgctcccggcatcacgcattatggcggataggcaccttagcctcccccgcaagacca

SEQ ID NO: 13742 - DNA, 1501 bp, Oryza sativa
gatgtacagtacaatacaaatggctgaaacttggtagtaactgaaaactgatgttcttctgcaagtaagcttaacaaaagttgcaaatgtttttctcctcaggttcttggaccatgcggcgatcaacgacgcgccggacggcgagcagagcaagtggacgctggcgacgctgacggacgtggaggaggtgaagacggtggcgaggatgctgccgatctgggcgacgacgatcatgttctggacggtgtacgcccagatgaccaccttctccgtgtcccaggcgaccaccatggaccgccacatcggcgcctccttccagatcccggcgggctccctcaccgtcttcttcgtcggctccatcctcctcaccgtgcccatctacgaccgcctcgtcgtgcccgtggcgcggcgcgccaccggcaacccgcacgggctcaccccgctccagcgcatcggcgtcgggctggtgctgtccatcgtcgccatggtgtgcgccgcgctgacggaggtgaggcggctccgcgtggcgagggacgcgcgcgtcggcggcggcgaggccgtgcccatgaccgtgttctggctgatcccgcagttcctgttcgtcggcgccggcgaggcgttcacctacatcggccagctcgacttcttcctccgcgagtgccccaaggggatgaagacgatgagcacggggctgttcctgagcacgctctcgctggggttcttcgtcagctcggcgctcgtcgccgccgtccacaagctcaccggcgaccgccacccctggctcgccgacgacctcaacaagggccagctccacaagttctactggctcctcgccggcgtctgcctcgccaacctcctcgtatacctcgtcgccgccaggtggtacaagtacaaggccggccgcgccgccgccgccggcgacggcggcgtcgagatggccgacgccgagccatgcctccactgatccacaccgtccatccatccatccatcagacggctacgatttcttcttcgcatcttgtactatatatatactagtatactactagtacgtacgtacgtacgtgtgtaccaagcgaggcgtgtatgcgtatacgtatacgtgtacgtgtgcctgcgtgtagtataatggaattaataacttgttagaggggggaaacagtaaaaaaaatgacgaaattaatggtggggattagggagagatttttaagggtggtggtggtggggtcggggtgtcagtgactcgaggttggtgcattttgtgtcgtgtgggagagtcttcgtggtgtggtaaaaaaaaagagaacaccacggcttcatcagtgtacaatcatccgatcgaaaggaaaagatgaaaaaattgcgtgcttttcattaacctacaaaatcattgttgtgtcccagttcatccatcgtctatttgtctcctttgacagtgtcttcttcacatttgacatgatgtttttcttttcgtataatgcaagatgacatgtgacatatt

SEQ ID NO: 13743 - DNA, 1501 bp, Oryza sativa
gttgtttagtctctgttcgatctgtcagtgtctccagattatgaactcacatcttcagagtttatctggggatgtatagagccgcagatgcgtatatgattattatcaacattgcatcaaatcacatgaaaacatgttgcttgttcctgatactaattagtagcttgacagatcagatcaacttgtgcaaatgggaagaatactgccaactatgagacacacttgacaaattgtttagtccttagttttggctggaaactctgacgatgttgttttcagaaagataagccctggaagacttagctgctgacgacgattccctcacgaaatgagagggtgattttaatttgacgaatagattatagatggtcatgttaatgggggcataatcagagcaactaactgggataaaattgttttagtgttatgattggatttgtgtcttgttcttgtgaagcatcttgtttctgtgaccactgctttagcttgcacacgacctccttgttgcctttttttttctttggtcccaaaggtgaaaagaacattgcaatagcttttgtttcaattaaaataggtcaatgatagacacaagtattgcaaaagtcttactttatatgttttctgcaatcactgcctaaactttttgaaaagttaccaagtttgcaaaaattgctgatgaggtttctgaatctgaactctgaagagaacaactcaatccttcgaaattcctgcatgctgattgaaagaattagctgacgattgtactacacatggttgaaactgaactgacaattgatgtacacgtgtttgaaacttaagtgaaaattgatggacacatggttgaaacttcagtgacaactgtagtacacatgattgaaacttaactgaaagttaatgcacacaaagattgaaactatacatggttgaaaattttaactgaaaattgatgcactcatcattgaagcttaaactgaaaatcgatgcacacgtgattgaatcttaactggaaattgatttttttttctttttgcaagtaagcttaataaactctgcactacacatgattgcaacttgactgaaattgatgcacacatgattgaaactcaactgacaattgtactacacatgatcgaaactcaactgaaaattgatgcacgcatgattgcagcttcactgaatactgatgtacacacacatgattgaaacttaactgaaaaaacttaaatgtacaatacatattattgaaacttaactgaaaaaacttgatgcacaatacacatgattgaaacttaaactgaacaaacttgatgttacaatacatatgatgattgaaacttaacctgaaagaacttgatgtacagtacaatacaaatggctgaaacttggtagtaactgaaaactgatgttcttctgcaagtaagcttaacaaaagttgcaaatgtttttctcctcaggttcttggaccatgcggcgatcaacgacgcgccggacggcgagcaga

SEQ ID NO: 13744 - DNA, 1501 bp, Oryza sativa
cctctttccggtatgtcgtggtggcatgtcggcgcacgggaacgtgtcgtggggctgtgtcttgtgggtacagttgtacacctctgatcagagtaaaactattcgaatagccgtgcccgcggttataggcggtcgaccagattcaccgtgattagtctcacccctagtttagcttaatgaactagtgtagttcaggtggttggttgggcctgttgcaacgtggcgtagcgttggacagtgactggttaatattgcttaattactataactgtttttactgttttcaactactggttttaaatgcccgctttatgcaaatgaaccccgtagcctcctttggttatatcctgcatcatacctcctcttccggtatgacttgctgagtacagtgggtagtactcagtcttgctcttttcccccacaccagagttgaagttcttctcagttggagatgtcttgaagaggttagtttcgtcgctgccgtcaagggttgcctgtggaatggaatcgcccgctgcaggagtcaagtcttcaggcttagctcgcttttatctttttccgctgcatttgtattctttcatatttttgtaagacgtggatctgtatgtcaacaattgtcatttgtgtaccctggctagtcctggacaagggtttaatacacattcagcttagaaattctggttcgtgaatttctgggcgtgacaagttggtatcagagccgaccttgaccgtaggacaagccaactggaaaacctaagagccctctgaaccccttttcatatgcacatgccttcttcacttggatttgtttcgggaaactttggggtttgatcttttgattttgggagaaaatcttggtcgcctatttaatcggatcttttgactagggacagtccagggttttagcaaaactttatttggaatttatttggcagtcagtcgggaattgttaggtggtatgcattaagttgtgtctagattcgatgggatgtagtctttatgtgcatcattattatcatgcatttatttcatgcattaagttattgtttagtcagttgcattagtgtcttttgtctgggttcatgaaaaatgttccatgcataaaaatcatcatgcttggctagttggttgggccatttgttgcattgtttaaatttggatttgagcatgcattgattcctatcccttgtctaccttagaagtcagacctgttcttcgatcgcaagcgccgctccgagcttcagagtcaccgcccttagctttatcgtcttcttagtctgtttgcgtgctagtttttgtgtttaggtttgttgcttgtgggttagtcggcggtcgatatcatgtgtgagtggtatgacagccttaagtaggaattgcgtgcctctttttcagtgttttaatcaagattaagataattgcacttaattttataagaaagattagtttccgagccatttgttttcttcctttctcttatttctacctatcctcatccagatgg

SEQ ID NO: 13745 - DNA, 1501 bp, Oryza sativa
tagctgaattttcttattcaagcttaatggtatgcatctccttttagttatgttattcggttcttctttacctttgtggataattgcaggctatatattacgtgattggtgctgcagtttcatacatactaacattatagttgtcatgttgaatatcttgcagattatcttacatagagcaaattcaaccatgcctggtctcttatcttttttattcaggcgaaaaataacagttcctttcttactgaaatggaaaatacatgaaaccctacactgcaattttctgcaatgacagggtaaatagccatatcaagcccgtttgttgctgttgggctgcctgcctcttatttttcttctttatttctgtgatcatcaacaattactagattgtcgtcccttatggtctttcatttgattcactgcacggttgatgagttcactcatttgctgccaattgttgttgactaatttctttttcacattttcttttatctaaatatatttattctgtacttctattgggccatatatagtctgatttagtgtttgtcatttcaggtgaccttgcttcttagccaattggagcacaaaagaaaaatccaataaacaggaaaacatgatttagtcttggacatcatttctgaaggcttttgcacttaagaaacgcgaatagacaagaataaggtatgcagtaaacatgatacttctgtgtggctcactacttcactggtcctactactttagagctatatatttttgtgtgactgtagatgggttccattaatggatggctgtgagaactaacatttcaattttgtatatatggtagagcttcctcaggtggttggtagcagaacaagatagtataagttttcaggtggataaagctaaagcaaggctaagaattaaacatgtgtaatggaagtatcagggatggctgtgagaactaacatttcaattttgtatatatggtagtataagttttcaggtggataaagctaaagcaaggctaagaattaaacatgtgtaatggaagtatcaggaattcagaatggtagttggcgcatatggagcagatttgataaccgaaaattgtgtaccctgtgaagaatccattgctggttttaagttttaacttcataccgttatcatttcaaggaaagaaggtcttgcaatcgatcttcagaagagctgagaaaggtacagcttaaaaccattatttgttctatagtgaagttgatgtgtgtatactaaataacatcgtcagaatgagcaaacgctataaacaaaaatcaaccttcaaatataatatgtataagctttaaatgttaatggtcacttatgcaaaatgcactaggtaatgttgttcttcattttcaggagcgatttgtaaattaggttaatggaacaaaatattccacgttttgcccaatttctataaatttgagtacctgaattcactcacaccaaatggattgccacatcttttaaaggacaaagt

SEQ ID NO: 13746 - DNA, 1501 bp, Oryza sativa
aataaataactcattttttttttgtacacagagtccactttgtcttcagatttctttagcagtggtgcctgaagcctgaaactgaaacacaagcttgacttgcattgcatatctgaatctctttatttccccgtttctgaacttagcttggcatgcacatgcatagtttcagtgggtgatatacggggaaaaatgaacgaaacgtctaaaaccaaaattaatgtatgaataaaaaaatataccagtattattaacggttcaaaatctaatactgtaaaatagacttacgatgaaagaaaccacaactccaactagtttcaaaatttaaactgtaactctaaaattaagtttcaaaattaaaatattgattacaattgacaggtctttgtttttttttaaaaaaaagtttacaattggcaggtgaaaggtaactgtggggccatcctctattcctgacccgcccaaagccccacaaacaacaaacaatttggagcaagaaagactgggtgccaggcgagtaggcgacgtggcctgagaagtcaagtcaagagatagagagagagagagatagtttgcgcgttaaacatcagacgtgggcgcaaaactgtactgcgacaagcaaccctaggaaatgaaagcagagggcagagcaaactccgggatctcttcccaactccgggattcaacaaaagcaaaccgcgttgcactctttttttcttcttcttttgtttttttggcgattgactatacactagaggacgaggaggagcataagtaagtcaattgttgttatctaaaacacatattgttccaattatcttcacaatgtatcgtagccgatttttgaccgtcggatatttggatctatatccggctcctccttatcctacaattaattaggtattagcaaaaagttttttaaaaatgattaatatgctttttataacaacttttctatagatttttttttaaaaaaatgtagaagtacacgtatgaaaccgttcaaaaaaaagtacacgtatggaaaacaatagagtagacgctgggaaactgtaccatagaatacacccgaatcctcgatcttcagttcatcagatcacccacggccaataatccggcaatttcctacttttctgggctttatctaaacctgattgtcatccctcgaaaacgtaattgtgcaaaaaaaaaatattatctttgatgtcgatcaaatggtgaaaaatatcgattgggattacgctaaaagcgataagtatgcattatttatctttagcaattttgttatgcttaataggccggctctatcaggtcagttcagattgaagggacgtgcaggcccagagaaaagtatccaacctcaaggcccgaacttccgatatctccactgcactgggccgctcaaagcccagttcaatttagcacatgaaaacccacaaaagtaacaacagaacgggccgaaatcggtatgctcatgcatgatcatatacacacgagacat

SEQ ID NO: 13747 - DNA, 1501 bp, Oryza sativa
atgtcattcatgtgatcacgttgcgtagtgctagatttttttttatgtaaaaagtgctatagattatagttatgtttttcataccttgtcagttttcttcctgaggtgcctgagcctcgcgatcttgttcacggcgaatacctgcaggtccatcaccttgagatccaccccggccggcggtccatggacgaacaccttggcgcagcgcggcggctcgtcgtcgtccacccggaaagagcccatgatctcgccccatttccccgcttccgccacgaccacgccgccgccgaccgggcgaccgtcgtccgtgcaaacctcgacgcgcacggcgtggcagcacccgtccgccgcccccgcgccctgcaggccgacccacccggccacgcggtacgtgactttggccgccggcgcgcgcgagagctcccggcagaggccgtccctctcgccggcacggtgcgccgccagcacgtaccgcccgctgggcctcggcctgggctcgtcggcgtcgtcttccgtagcggacagaggatgcggcggtggcgtctccggcgccgggtcgtcgtgcacggacagtgtgcaggagccagacggggtccagccggccactgccaggccgccgccatcctcgcagtgctcgacatggttcatgaccaagtgcgttgtctcctgcgggcgccaacaacacatggtgtacactagtgtcagagaaagacacatgtcgcggaacaccattcagagattgctggcgcgaaatgggtgtggttgaagaagaaatcctatagcagttcgatatgggtgacgcactggctagcttattgtcacttgtcaggatcagacagctaatttatgtgagacatctgtaacgagctactccagctcgtgtagttttgcttggctttaaagcagagaattggaatgcacctacaagggcataactactctgaattctcaagagaattggaatgcacctacaatgcacctacttttgtgccatgaattcacaagaccattgaagttgcaataaagttttaattttcaggttgccagagtcccagagaagaactaaacaacaagcaggtttgccagtgagctctcagctctggcagtaatattgcaaactttgccaccaaccactgtaagaattggtgtgttacaatctagtagagagcagtcagacatggtaattaagctctaattaagctgagtagctgacagttgagaacttgcaaagctgagagcatcacatacctcggtgaacgccatatggaccgaaggagtgcgaggggaaaactctgaatctgcagcaagtctcagctagcgtttgtgcttttggctgctgggttccggtggcaagtgagaccgactgtgtgagagatgagacgcacgcaggcgggcaatttataaggctgcgtagctgccggtttggtcggcaatcacacatccatcgcgacacagcggaaaggcagagtcactagccaaaaaccggtgtttcatacagcag

SEQ ID NO: 13748 - DNA, 1501 bp, Oryza sativa
tagtagatgagttggtgatattttttttgcgatgtaaagatctaataaataaaatatatgcaatatatataattaatatatgttgatacatgcatagactcttctaatcaagtgattaaatgagcctaatctaactatctaaaatctgtgtgatttagactcaaaaatctgtcgtgtgatggatagctagtcccaataccattacgctcccctgacccatacacgcatgtcctccatttctttaactagtgaaatgaatcgatcaactagcttgtacgactagcaatacagatttattcccatatccgcggtagacaggtacatgatcgcatatctgacgaagaactgatcatcaacgacaaattaagacagttcaatactgtaacacacgtagtgcgtactactagtacacacatgcatacacacgagcgacacgtacgtacgggctacatatgacaattatattattttcccttgcttgaaacacagtttattattggcatatccttgtgatcatgccaaatgcacgcagcaaacagccgaacacggacggtgatatgatcagcccgagatggggatagccttcagctgcggcttcttggtctcctccttgggcacggtgaccgtgagcaccccattgtccatggacgcgctcacctggtccacccgcgcgccgcgcggcaggcggaaccgcctctggaacttgccgctgctgcgctccacgtggtgccaccgctcgtcgttcttcccgtcgacgtcctcctccctggcgcgctcgccgctgatgacgagcacgccgccgtcctccacctccaccttggcctgatccttccggacgccggggaggtcggccgtgaagacgtgcgccgtcggcgtctccttccagtcgacgcggacgttggtgagcacggggcaccgctccgcgagggagcgcacggcgccgaacgggtcggcgtccgcccagaagtccaccgacatcgggtccaacacgttgccgctccgcactagcgacattgtgctgttggttactgcttggttagtttgttgctctcggtttcgcggtttaattccaacgtttgttttgttttgctcgctggatcaagatggctttgcacgcaggtttgtgtgatttttggcgaccgatgatccggtgttcgaggggggtggatttatacgagaatcagttgagaagtgaggatgggttggatgcgtcgtgaagggtcgaggagtgggtgagtgatgaggtttcctgcttgttctggaggtcaccggcatatggcaagcagcgggtgctgggtgtggcgcgagatctctagagctgatcgacggcgcgtccgttggtggcgtggactggaccaggcttcaaaattaaatgggcctgttaggattgcacaatgggctgataatctatacgagatggataatggattcaattcacggagctggattggacttttgctgggctggcactatttgtgaaggagtaccttagaatttcttc

SEQ ID NO: 13749 - DNA, 1501 bp, Oryza sativa
aagaagccgcagctgaaggctatccccatctcgggctgatcatatcaccgtccgtgttcggctgtttgctgcgtgcatttggcatgatcacaaggatatgccaataataaactgtgtttcaagcaagggaaaataatataattgtcatatgtagcccgtacgtacgtgtcgctcgtgtgtatgcatgtgtgtactagtagtacgcactacgtgtgttacagtattgaactgtcttaatttgtcgttgatgatcagttcttcgtcagatatgcgatcatgtacctgtctaccgcggatatgggaataaatctgtattgctagtcgtacaagctagttgatcgattcatttcactagttaaagaaatggaggacatgcgtgtatgggtcaggggagcgtaatggtattgggactagctatccatcacacgacagatttttgagtctaaatcacacagattttagatagttagattaggctcatttaatcacttgattagaagagtctatgcatgtatcaacatatattaattatatatattgcatatattttatttattagatctttacatcgcaaaaaaaatatcaccaactcatctactaaaagttaaagtgtaattacactaactataatgtaattacagtgtaattatagtgtaattacacttacatgtcatatcaactaaatttacaaatgtaattttagttatataggactgtaattttatattttaaaggaaataacaaatacacatttacttacacattattttttactaaaattatagtacacttatatatcgtatcaactgaaattacgaatgtaattttagttatataggattgtattttttttcactaatcagcgaaatgaaaaaccacgtgtttagctaaatcgaatagggaggaggaagcggaataagtgagaaaacggttccggacacggcgcactaatcaaaaaattcgcacggaaacatgggcccacgcggcctcaactcccccttgcgccctaatcagcacaaatcgtggcgtagatcatacggtcgaaaaaacatcaaatacgaaggaaaaaatcacgcgacaaattaatatatagcaaattcataatttaaatatttcaattttagcatcacagcgttggcccgtaatgcatgcatgttaattttcctcacccatcatctgtgggcccatgtgcgaagggtcagctggcccatgaaaacacacagatctcaaagcatatcgaaccgtcaaaaattctagtgatatctcacgagaaatctgtcgacagacgtttagcaaaatcgaatggtattttgtttttctttctcaatttcgcttcggcccacgggccatggcgagagaaggctgatctcatacgaggtggtctccttgtgggaaggccccagagtggcttgcatgaagccttgggtggtcttcggaaaaagtacattgaagatctatctcaacttgtcatcgaattacaaaatcgtcccccaatcgtaaa

SEQ ID NO: 13750 - DNA, 1501 bp, Oryza sativa
tctacctcatttaggaattgctctactcgtctgtagttgttcttgtaaaggcgcttcactgcaactactctcccatcccggagctttcctgaatggcagaaaggaagaattgtaactgctaagttaataggggaagttatctattatggaacaaagttcaacggagcccctgtcgcatgcaattaggcatgctaatgaggaagtgattagatgagaaatctattaacaacaagggagttgtgcaaacatattctcctacctttgtaaacagttccaaaaccaccatcaccaagttccctcgaggcactaaatccagcagtagcctcttcaagttcctcgtaagtgaatatatggggagaaccacccaactcaaggtctttgctgtatgattgcattgaagatgaactatgcatgagatctttcaaatctcgggtttgtttcctcttcttgcgtttgtgccaagcaaaaatgaatatagatacaatcaataatattccgccgcttgatccacatgctgcaataacagagacagagcactatcaatatgtgagaaccaaggatctgaagcatatcttcataattacattttgaatggttggggaagtccaagaaacaagaatgaattatactcacctattcctattatgtgactcttgcttcttgaacctgcagaagaacagacttttaataccttgcacaaatatgccatgaacaaatagaatgatcattcataatcacattgttagggtatcattgctcccctaaccccctgttgaaacgaaggacagtgcttatacaacttttcagcctaattcaacagaaatacagatgcaatttatgctttccacatgtttggaacacactaattaaggattagaaaatgaaagggtatttgctgtcaatcagatgagggatttcttcgtcagtcagcaatcagcagaagaaaaattggaacatggtattggtatgatatctttatcagatagtgtagttgaatacttcaaactacacgtaacacgtttgactaggattccataagctgccaaatgccaatgttcccatcagtgaaataattgtttgatgagaaactaacaaccaaaacagcaggaacttgaagcaaacactcataattcaaaacaaaaatatcaatatccactttgcattttatattcttatgaacattgctgtgacaatgctgtgtttaatttctttcctcgatagcaaaactagatgtcacgcgcattattataataagagtttatctagtggacattaggccacagtagcatggaaatcttcctgtataacgaaatgatgtgtcattcttttctatatatataaagaaaactatcaactagatgaacacactttggatgcattgaatcggttaggatggcctaggctgcatgttcacagaactatgttaaaatttttattctaattgataattgactggacaaatttaccgtgctcttccgattttctgaactctctacacttg

SEQ ID NO: 13751 - DNA, 1501 bp, Oryza sativa
ctcaggcccaaccattctgaagcaaccatacccggctgtacagatctaatctccaaaccaggagctaagcaaattattaccaggtataacatccataattattgtgagaggtgtgagactaatcacgaaaaacattgctcaactcgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctttgcacaacacaacccaccaaagcgcaccattcctggatcatagtcacccccttataaacaaggcatggactccccagcgacccccgtgggcttatctccgccacttctcagtctggtgctctgcaatgaaccatgctatacgaaaggtaaagccgttgcccacgctggcttgtggttggcacgattaatgtttcacaatagtagctcgcgaaccggtccttaattgtcatgagcacgactcttaaaaccatgtgctcacaacccaccattatcaagttttagttggcaagtaattaattaaccaatcacgattaaccatcgtgaactatcattaagccatcattaaataataatgagtcataagttatcccaatagtgtgctaatgtttctaagcatggctaagcaatcataactaatatctagctgaaccaatatgtaaagctcaactagtcaagttataataacccaaggtatcaaggaataaagtaatcaatgcaaattggccataacaaaggaataagttcacaccacccggtgacattcgaaaataaatgcatagttgaaataaatagagaatttaaatataggatcaacatgctcaaaggattgtgtttgggatctgtgtgacttgccttgcaataatcggtcttcaattaatcttcttgaatacttccggcgcactcgcgaaccttcgcaacgacggaaacgacaagctaacacgcaaaacgaagaaaaagactaataaaaaccaaataaacaatacataaaaagtaaacaaacatgtagatcataattttagatgaattatgagacttgaacggcctcattctgacttcaaatgaatttattatgaattttacaagattaaatctaattaaagcccatttaaaaagaattaaataaatttaattcaatttatggacaattttaatatgtagatctttattttacacaacttttgcaacttgaaccacattaaactgagttcaaatgaattagttatgaatttttaaagattaaatcggattaaaacacttatattgattttaattgaattatgacgcaataatgaattatttttgaaaaggaaaagaaggattattgtgtcagcggctagggtttgcggtggaccgggtgcacggcagcggttcacgggacgaacggccgagatcgatcggtccacgaccggctcacgggagagggcgacga

SEQ ID NO: 13752 - DNA, 564 bp, Oryza sativa
ccacaaacaatatctccattctccaagaagtaagcgaaagggtattacagaaaccaaaatacatacacagactccattgtccaaccaccacaaaatttagagggtgatagagcatccacaagtatacactacgtttcggttttgaccattttcccaatttctataggcatgtttttcaaactgctgaacgatgtattttgtggaaaaattttattattttaaaaaacaaattaatttacttttcaactatctaaattaatactcaattaatcatattttaattacctttatattccacgtgtgactaatcatctactacttcaaaacgcactttagacgaaataaatctcataaataaattagccagaccatccaagcaacaaacgaacaaaagatccctccaaaaaaaaacgcctttttttttcttgagcacacaagagacgccaatcccaaagcaaagagaagcgcaaagatcatctctttgcttctcgccttctcctcctcctcctcttctccctcctcgtgctccgcccgatccgtccgccgcctccagatccgcgccca

SEQ ID NO: 13753 - DNA, 1501 bp, Oryza sativa
aattcattctagtatcttatggtgtttagtgagcattgatttgtgatgtgtcagtctctctcctttttttttactattagtccttgaaagtttgttaggtagatctagatgattaggtgtcaaatcaatatgaccaacctagttcttgttttgaacaggtaaatttgtaggagggcaattaaccaagtacttctatagtactcccaaatagtcagttgactaaaatttaaaaaaaattgctagggaaataaatttttattagctcgtgatgaacatgtcatccctaacaaatatttttagttgataaaaaatgtaatattggagtggctttccaaagttcagataacttgctgaaattattatggattattcaaatacattctaaacttatttttgtcataactttggccatagtgtgtccccagggttggcatgcttcaaattattgctctccactgacaatctctatgtaaatttgtacattcattttgtagtggttatttagtataaccactacgcaaaattaatgtgacaatccaagcaaaacaagataaatgccatcttcaattgcttcaccttctccctcgtcctaatatcactccaaccatttgcaccatcttaacgtgttgtcgtgtgcaaatacgataaatggtgtactcaagccatgaaacttttctcatcatgacactaaccatattatagcaatttgttacgtactcatgtaaaaagctgtgtaatattagacaagttataaaactttctttcacacgatactatccatcttttataaggttgttatgtatacgactaaaaaaagcacaaaaacgaccatcttatccaccatagctatcgcttcatgcacatttacaactcagacgcatatacaaatttggatgacatatgcctaatatccaacgtaagcacaccaacctttaaaaacataaagccatataacaccgtgctagggtacatacccacatcaacaaaagaaaatcacacccaatgcgtcatgctatccatttgtgcccccaaataaacccccacaagaaaagaaaaaaaaatctcatccctaaaaaaaaaaaaggcaaactcaccttaataaaagagagcaaaaaacaactaaacatgtcaaaaagaaaaggaaaaaaaagcaagaaacaacaaatcaaatcctaatcatccatcccatccaaatctacaaacatgcccagcactccttttttcttctccccctttacactaaacaattaagctcccaaatcacatcacaaacaccccattaaactaacctccatcagggggattgattccttccaaatcaaaccaccaaaccatcttctatcttcctctcctcctcccttcgtcggcgtgggccccacctgtcagcctctggcccccgcctccaccaccacctcctctctctctatagaggagagagagagaaagcgaggcgcgcgagcagtgtagagagagagagagagaggcggcgagatgggggagg

SEQ ID NO: 13754 - DNA, 1501 bp, Oryza sativa
gccgcgtccccaacgacgacggcagcgtgcacggcgccgccgccatctcctcctcctcctcctcctccggccgccgcacgccgaacagcagcagcaggtgcggcggcacgatcaccaccttcccgacgacgctgccgtggccgtcctcctccatgctggcaccaccgtatctccagttccaccggtgtaagcgcgctcccctgcaggggacgtccaccggccgagagtgcttgacgcgcggcgtgggcgcgcgtgtctcgtatggctgcaccggcggcgcaggcgagatcgccggcggcggcgcgtcgtcgtcggcggcgtcggtgtcaggccacagcacctcgaactcgtcgagctcctccaccaccatcgccatggcaaggcgtggcaaccagctgccgagagaaagagagagagagctcgcagctcagctcagctcaaactgaggcgcgcgccgcggcgtcgagcgcgtctaaatataccggggcgcgcggcttgcctgcctgatgggattctaccgcgtctgatcggatcggatcgcgagagaaattctggggcgacggcgaccgctcggcgggcgagctccacacgcgtccgcgaaagagaagcggcggtggggaggtgtacgtgtggatgccgcggccgccatcgcgccgcgggctccggacgcggcgaacggaacacacgtttcctctcgccggcacgccgccctgttgcagcgttgcaagggaatcgacgcgagccacttagtacgtgactgatcgcagtgtgcatggtttgattttttttgtttggtgatgaatttattaagcatgggttgattaattgggcccggggtcgtaatcaaggctgtaatcagtgagcagttgggaattgggatcgacaaaatgcaactagggatataggaatatacagtatatgcttctgttctgctccagtgcactactacgccagtacgtagtagtagttgcgcccgtcaacatcctcactattcatcagcatggatccatcaatgatcaatccgtgtgaacagccaaacagggcaattttggctctggtttctgggtggatttaggctggacgtgtttagttacttttcacaaaaaaaaattagagtatacggacacacctttctttgaattattaaatgtagactaataacaaaataaattacagatttcgcatgtaaactacgagacgaatctattacgcctaattaatccatcactaacaaatgtttattgtatcaccatattatcaaatcatggcgtaattagcctcaaaagattcgtctcacaatttacatgcaaactgtgcgattgatttttttcgtccacatttaattgctatgtatgtgtccaaacatttgatgtgacggaatttttggaagtttgaaatgaactaaacatatccttagttcttatcttcactttcccaactcatctccctcgtttttcacacacacgcttttcaaactgataaatagtgtgtttttacaaaa

SEQ ID NO: 13755 - DNA, 1501 bp, Oryza sativa
aatcaagtgaaatggctctgggagccgataagtaatgatctgacccgggaggtcggtacattaccattcgagttgttgaaaagcatctcttaaagtcgaatcaagacgcaagtctcttttcgacccaaacttaaaaaaaaaggaggtaaatcacttagtgattccaaaatgctttcaaacaaaagatttgcaaaacaaccttacctctcttccaagcttgcattaaacacctaaattcccgtgacttgctgagtacgaaagtactcacccttgctctatataaatatatatagttcctctgccttgaagtgaagatgaagtgaagtgaagattagggtttcgtcctggttcccagccgtcgcctgtggtgttgggtgttagttcgttggttccgctgccgctgttgctgttggtgtttcctcgtccgcgtcgtcggttgcattctcgggccgttctaagctgcaacctaagttaaggtaaataagtcctctatttattttaaggattgcaatgattcatatttgtcaccatgggtaccagcactatgtcctgggactggtactgagatcacggtttcgtaggaagcggttcacgtcgtttttcctacgacacgctcctgtcaggtgccgttgtacggcggtgccggattggggtgtgacaagaacactttcggttcaattggatcgataaatttctaagaaagataataatgcccctaaaaccacatgcttcaaactgcatgatgctatagtaaaaatttagaaattatacaactctaaatttaccatcacattatattccatcttagctctagtttcagctcaaaatattttgaccatagaggcatccttgtttttttgaaaaatttctctctccaattgagtcgaaagtgtcatccaacaaattatcaatttttaagtatcttttagccgtgacatgtttttataatgtctactagtaaattgtacattttttaagtgtctgtagcaaattttgccataaaattatgtattgtatcgggacgaaagacatagagagagtagtgtgttagcaagctctgttgctgtctgatttactatgtttttcattttgctttttctgtcacccttagtgattatgtataatttctctggtacttaaaataaaaccagcaacgtttggcttaggtttaaaaatacttgtaaatcaattctaaaaccttaatttagctatgtcttatatgtcaacgagaagctagccaagccaggcaaagcatgtctctctcttttattttttggaatttccatggtagaatttattaagaatccctaatattgaaatatgaatagccgcaagtcccagcgtgtaaaaacagcttagttaggcagcctgaaccagaagaattagtggtgccccgacttaaaacgacgtagaccgccaagaaacgaaccaaccggcaaccgccgccgccgccgccttcgattcgattccgatcgagttggagaaggccgccgctgcccaa

SEQ ID NO: 13756 - DNA, 626 bp, Oryza sativa
ttgtggtctatcgcttaccaactccaaatactcccattatcggtaagacatggcctcgatcgcatggggcctagcgttttgcacgatagctaaacattttcgctacaaattaaatggaattactgatagatgaggtgtgctgatagaaagtcggtacgtggcctgtcagcctatgagtgaagcagaatgtacagtatactagtggcatcaatgtgtagacggctacacggtctcgccaggtggagcttgctactcaaaacgcgtcgtccctccatcgatcgttgctagctagcttcaacttgatccgcacgcctcccctcacaccaagtcttctttatctacatcttcttctgcttcttccttccagcttgcaaaactggcttaattgattccatatttccattccacacgtcttgagagctaatcttttggaagaggaaacacgtcttagcttgagttaataattccatcgatcgtctcctctccattgactttaattgaaacgcccccttttcttcgctctgcggctacctatctcttgtatttatatcccggatagctacctgtgcttcaattcctctgcaaatccatccatattagcttccaacacaaggagatcacaacaa

SEQ ID NO: 13757 - DNA, 1501 bp, Oryza sativa
ctgttggtcgtgataccacctttgggactgccaccagtatcaccttcatggtgcgccggcctacaggagaagagctaaagagagagaaggagagggagatagggaagagaggggtagggattttgttgcgtctgacacgtgggtcccactgtatttcatttctttttgttgattgtaagtgccacctggcccacttagatgtcacatcacccaaaactattctcaatactgcctggttttgagagtatatttacactggttctaagaatagagtgaagcattgtacttggtttcttgcttaatggacgctgttgaaactggatgtcgttattatgtggtgggctactggcacctggtatgatttggccttcaggctcctcatgggccttcctggcaaaaacgaacaggtcgagttggaaaacacggtcggtgtacctcggaaccctgcagttgcaaatcaacagagccgtgtccatgaaagtgtagaactgtagatgtccaaaatcgcagaaaagaaagaccgggacacaggacactgccggcacagtcttagcctgcatgtccaagtctccaagatcgatattcgatagcgccattcggtgcccgcatgggccggtcggccgtctgcgccaaagcgcacctcggcgccgcgagtcgtcgctgcggtgcggagccacactaccgtctacaggggctaccgcctaccgaacgcactgattcctcgtcgatgtgcgcagctagccgcggtggtgctcgcgcgtgcgttgcgtgcacgagcgaggaaagagcgcgccagcgctgtagaccaggaccaccactggatacggagtaccgtaccacaccgtccatctgatctctcgatcttacaccggcgcgcgcgtgatcggcgaccacgagacgcagtggcggacgcgccgcacgcgcgcaaaagtccactccttatctctgcctctctcgcgtggtcgcgtcgcgcgccagggcgaggctagctgccacaaagtccactatcccgtagtgtgctacagtaatatactccatgtcatggcgcgtgcgtgcgtccggtgcactactcgcaaccatgcatctgtgtttccggtgcactagctgttttctggcctctgttgagttctcgtcatgggcaagcaagggaaaggagcatacatcgtcctgcagcggcaacacgtaggcgtgcactataccttcatgcgaagttgcgaacgttcctacaagttgcagcagttgtgaaggatgggaacccatgctctctttatgaacgaaattaaattactccctccctttgtttcaaaaattatataacaacttagtacttgattaaattcgtacgattaaaatctgttcaatctagtattaggttgctatataagagtaagtaacaccgtagctccggaggtacgtgttcttcatcagcatggatcaaaatcatagtttcagcaatcagcacatgcaaagtggacagcgatcagaaaatcaaatcaagaga

SEQ ID NO: 13758 - DNA, 272 bp, Oryza sativa
atgagagccaaagcccaatatcgggccgttcactctgggccaacggcccatgcccgacggccgacgtgtctcgccgtccgtcggccacgcggtcggccgccgagacgcttccaggatactacacgtctctgcacacgcgtcagcaagctcctgtgcttgcaccgtctacttatctcaattctcaagctctcagctatggagtaaactatacttgcatcttgggtatttttttcagagcaaatcgagatcgatccgacagaagcgagcgatca

SEQ ID NO: 13759 - DNA, 1501 bp, Oryza sativa
tttgttcgtgtgttgagttaccgacttccctacctcgtttttcaggtacatacttttcaaactgtaaaaatgagcttcttttgcaaaaaaaaattccatacgaaagtcactttaaaaaatcatattaatctatttttaaaaaatatattagctaatatttatttagtcacgtactaatggatcgttcttttttatgtgcgaggagcacacgatgttggttatccttgccttttagtgcatgtactgaggtggtgtttgaatccagggaataaactttattccctattacatcagatgtttggacactaatttggagtattaaatatagactatttacaaaactgattacacaaatgagagttaattcacgagacaattttttaagcctaattaatccataattagagaatgtttactgtagcatcatataggctaatcatggattaattaggctcaatagattcatctcacgaattagtctagggttatgaaatgggttttgtcattagtctaaatttaatacttttaattagtatcaaatatacgatgtgaccaggactaaaagtttttagtcccatccaaacaccacccgagaatcgacaagcttctttgagaaaaagaactctacaaatgcaacctagagatctttccattattaaactgcactattgtggtgtggttaaattatcctcctttttgctttgtagcctaggaaggaattcatgtggagaaatgattgcaactacgcccgtatacaagtagggttggcttggccacagtcataccaatatccacttttatatgcagctcttgcctatcaaattcagcaaagaagaacggttttttctatggacgagccaggccactcgccggaaggagtggaacagcgacatccggcctcccacccgcacgggagattctttggcggttggtggtcccaaccaacgtcgtcctggccctaccccccggatccaccaaaccacacatgacattttttttactcatacagttaactttttaaatatattggatcgttcgttttatttaatttctttttaaatatataaaactatatatatatataaataaaagtatatttaacaataaattaaatgatatgaaaaaaaattaataattacttaagtttttaattaacttaataagatgtacggttaaataaatgtaaaaaaattaacggctttaaaaatatttagcgtcggagaaagtattattatttcttcattctttctttctccctctactccggtgaggagcagccgccaagttattgtggagtgaggtggagagcacgggagatgacgtgggcgctgacacagtgatcagcaacgggaggcggaggaagcggatggcgtttgcatggacgaggaggccagccgctgccggtagaaaaggcagtggagcacccaaaccacacagccgctcttatcggcaggagagtggaggaggccctcacctaaaccctcgtcctccaatctcagga

SEQ ID NO: 13760 - DNA, 1501 bp, Oryza sativa
tgaacggactgtacttttttttctttttttatttgtgaccgtagttttttttcttgctttttattttgagtcagactttctttttacggccgacggaattttttttttaattttttaagtagtagagatgtatatatatatatatatatatatatatatatatatatatatatgcatttgttctcctgatgatgctaaccgaataggacttggtataattcaaaccaactcttattcggcccaaacggaaacggacgggagtttgtttcttatttttgtgaaatcggacagatttattttttatttgcggccgtagttttttttctttttcctttttccttaattcttacttcaagatcaatcacaagaaaattgcatcaaattaaagcatatcatcacaaatcttgagcactactgattaaaagaatggattggcccaagatgttattagaaaatttcagagaggttgcagagttggaaaaaaaaagatggtttcagcgggggttctcaccaacaaggagtagtgcttgaccgtggaaacgagaaaatggtgagagaacctcaggatcttcggctaggggagcgggacctccttgaagagatgtcgatgaacgaagaggttgaagatggcgaagtcaagccgctgggtagggtcgaatccatggacgaaactcctggagaggtggccaagctccggtgtcgacacggggctcggggagcggcggtggtggccagcgcgtggagagggagcaacaccggtgaggctggggaacagcggtggtggggcgcgcaggatagggcgagcggcgccggcgacccgcctgggtgaggagaaggcgaagcggcggcggcggcgcttaggctaggtcacgacaagactcacgagccacgacaacacaagcgctacttccgctccgtattcgatttggagcggtaacggatttgtactgggcccggatctggagtattcgattccaggccacccaaaacaaacaaatgtaacgggttcaattaacgctgctaacagatacgggcccaattttggttttggaaatcgaggggcgaatcctattgaaaataggagctctactcctagcttgaataggagatttttgggtataaatagatgatatgttgaggtgagaagcatatcgacttttgtaggttcgtttgttcttgttcgatcctacattaccatcaccttccgcggcttccgtcctccccgtcttgctcgcctaatccgaagcccaagttctccttgctcgaaaacttgccgcctcatcacgccggagagtatcatcgccaccatctcccaccgcagcaccatgaacgggatcggtgagcattcgcctctcccctacttcgcttttttgtcgcgctcttgctgttttttttgggtgattctgtgattgggtttatggcttactgtttgcggcggcgggtttcttatgcagagctctcatcggaggacaaggctatcctcgtggagacgctcaaggta

SEQ ID NO: 13761 - DNA, 1501 bp, Oryza sativa
tacgagctctccgagagctaacagcggggaacgcgcagccatccatcccagatcgcggcgcggagacggggcgggagggagggggcgataccttggaggggatgcagccgacgttgaggcaggtgcccccgagcgttcccctcttctcgatgcaggtggtcttgagccctagctgcgccgccttgatggcggccacgtacccgcccggcccgccgccgatcaccacgacgtcgctctcctcccccgccgccgccgccgcgtaccccctccacgcggacgcccacgccgccgccggcgcccgccgcagcagcgccgcctccgccgcgcgcctcctcgccaagctcgccatcgccatctcgcgggctcctcttcgctatgttttttttttctttttttctttttcttttttttttctcctctgcttgtctctctggccttctgcgcaagaaaggacaaaggagaggagagaatggcagaaatgtaaatacgaagagtttgggtacgaataccgaattcgaccccgacgggagcgtctacggaatacgtatgcgcatacgaggacagatacggtgtaaccgtgcatgtgcattcattcacaaactcacaattgcgatatagtactccgtatgaaggaactaacccaattcacatgctaactattgataagaaaattcataatgttgtatattatccctccgttaaaaaaaaacaatcctaacaacaaatctggacacacatatatctagattcgtagttaggattgggtttttttatagaacggagtagtacatcgtattttaaagatgccctgagtgatttaaattgacttatctcgattgacaaaaaaaatcatattttaaatatggacctaaattagtcttagccctgtttgggagagcttgtcccaactgcggcttttcccaaaagtttttcccaaaagctgcttctgctagaagctgcccttaacagtccacagcttctgagaatatgtagttacagattctgaaaaataaactaagaagccagaagctggagaagctgagtttcagagcttttccagattctcagaaactggctaccaaacagctgcttctcagaatctaaagctaccccaaacaggcccttagcccccggccatagcttaagtggcatgaggatttccccttatctaagagaatgagagaccataggcaaaaggaataacgagaaaggagaagaatgaatataccccctttatatatgttatggtcgtcacccacttagtgataattgagttttgacatttatagtaactaatcttatgaatatgatagatcatacaatgttattagaaatccacttttcttagtacaaatagcagttgtttttaagtacaaattataagatttgaggaagaggaagctgataaatagaacggttttataagtttatggagtaatgaagaagtaaagccaagtaccccccgtttcataatgtaagacttattaaagattttttagca

SEQ ID NO: 13762 - DNA, 1501 bp, Oryza sativa
cggagaaggcgccggcggcggctgcggctcgaagctcccaccaccgcgagagcgtcgtgccgtgctgtaccgacgagaaggccatgaacgccgcgaagaggaagctccgggaagggtaccaagaagcagaggaggcgaagcggcggcgcacgatccaggtgatccaggcgccggacaggcagcggaagatgcaggcgatcacgcggccgcgaagccgaccgagcttcgtcgccgccgcctccacggcgaagaagagctctggattctcatcgcttcggaggttttagctagggttcttgttctcctccggtgtaacagtgatgtgtccatgatcaactgatcatccccaaagtgtattgcgtcaaaaaaaaaacaaagaaaatccccaaagtgtatgtatgtaattggttatcgagtttatcctgctcgtcctggattactcgcgtgtttaatctatcaaatcaatgatatatttttgtgaaaattgagcaaatttctttatgtgattgtagtatgtgtcaatctgatcgcgatcggcttgaggggcgagagcactgtttctgctcggagtgaagcttcggcttgtttgtcccgaataccaggcttctacatgggcctgaggcttagtagtcgtgggctggaagcccgttataagcatgggccagcgacgcccgtgacaaatgggaatatctgggccggcccatcaagccagctttggtctccgtctcttccgggcccatcacggaagagtcttctcgaaatcgcagccgttcgaccacgatttgacggtcgcgatagatcgccgccgtcgaaacgtagcagcgctagcctttgcgcacaaatgtcgcaacgaaactacgaaagcaacatgtataaaatggaaatgaagccccgacacgattgccatgctcttcaataatacaaagcatcacatcaggatgaaacatgcatcgtacatggcatcgaatcgtgctattattcgcatttagaattgaaaccttgaaggagattggtaggatcaacacgggagattccaagaagattgtaattagctgtcctgctcgtgtcaacacgtcttactgtaagggactcctaaacaaatataaaccacaacacactgcatattatagatcgatcagagattgctggtttggtttgcttttgggtgccttcaacacgcaagtacatcagcaaacgctatcatcacaagcaaagaacaacttttcttcagtaatcagcacagcactctttccagacgcttgcctgatgcgtcgtgagctcaaagctgccagccactgtggctgttcacgggtcaagcagcagaaatcttgtaactgttgtggctaaggccgttttgagcaattgaccagtggcagtggcagtggcagttgcagttttcagttgtacaactgaaaactgtaactgtctactcatcgaaacagaagcaactccaggcaaaccactgggaatgaactcaatcttgttctgggaatgtcctatg

SEQ ID NO: 13763 - DNA, 1501 bp, Oryza sativa
aattaatcttttaaaaatccaagtagagcagtaacagatgaatcaaaaccatgcacatttttaaaatccaagaagacaatcatacaatcttttttggaaaggtgaaagatttatgaagaagaaaaagatagctagcgagacgacattttcgcttcatcgcgactgattgattaatttggttgttcactggaatacgtttgctcttgtaattagctcttggttaattacacttacatttcaccacgtgtgcttggcggcggcggtggctggtgaccggccggtgaggggcggcggctgtacgtgctggcacgacggcgaccacaacgtcaacgtgtactccctccatcccaaaaaaagacaatccctagtttccgtgcccaacgtttgaccgtccgttttatttgaaaaaattataaaaaaattaaaaaaacaagtcacgcataaaatattaatcatgttttatcatctaacaacaataaaattatgaattataaaaaaaatttatataagacggacagttaaagttagacataaaaacccagggtttacctttttttggaacggagggagtagtaattaagccagcagacacgtagtcacgtaacactagtgttgttcactgctgcacctgcatcaaacagagacagaatgcgatggccccgagatggatatgcataagctggcaacgcagagatacagtgcacctacgtacgtacgtgtcagtgtcacgtcacgcgcgcgagttaaagtgggcccgcgccggcggcgtcatcctcagccggtgccaccggagttctgccggcggcggccgtctggtgaagcatcgcactcacggttatgtacatccatccagatgtcatcacaaggcctcgtttgagttcacataagcatataattaattaaattttaattatcttaaatttgataaatgatttatctgatatatagataaatcatttatcgaatgatttatatttgataaattttaagcacgttttttgtagtatcttctatacagaagttttcgctactaccgtttagtagtttaaaaaaacgtgctaacgaaaattaagataaaatctagtacatcttaatcaaaatattcaactaaattcacaaattgtacttaaatttgctggtgtttttctcttctcatatttattatatacgatgtaaacattaaccacttcaggtccattccatccggctactgatcagtgcaaatgaccttagctcagcttagacttaagatgcactccgtatttgatagtgtaatgataagaaatgtgtgattttaattttaacattccgcgcttaatttttaacacgcttataattattttaaaaaatgtttggagggacgtctctcttttttattttctcagcttagtcatcaacacgcacgtacaaaaccgagacggccatggcgatcacacgctgagaagctaagctagagaccaaacactcccacacgtgcagtccatgctcgccgccgccatgc

SEQ ID NO: 13764 - DNA, 1501 bp, Oryza sativa
gagcacatcatttgcgtgttccattttccaaaaaaaaaaaaactttttccacaactctttgttaggttcagaaggtaccttggtttcctccaattctgaacttcccatcttgatatgaactccggttggattgcggctgggcagctaatatgggcacaaggacaagatgtaaatttaaagacttgtcgagatgtcaagaacatgactaagcaaatatcaagatttctgaatgtaaatcagcaataaaaaacacagcacaacacaaatactcaggtatctgaatgcaaagcatgcatttcaggaatctgcagaaaactaaccgagaactatcaagtatcaactaaggaggaggaggaggaagagagtaatacctgaatctgaacagcactagacacttagactgctcttctcattcagcagatgctaagattttttttcgaaagccggccggagtatatattaagaaggagagagtttaagcaaactgtacaagaaaacaatcagagccaaagctcacatacagaacaaactgtacaagaaaacaagcagatgctaagattagcttttataaaacattcgcagggaaacaacaagtggaagcaatagacagcacgggaagcacatgttagcatcaggttttctcttctttaatttttaggtgggtggaaaactacgcagctcacacatcagcgttaattgattaattatttcgatggtctccaatccccatggtgatgcctcttttgttctcttctgtgtggatatcgagatgatgtctctaattcatctagagcaagtttaatagtatagccaactaccggctccaaatcaattatagtcaattttatagccaattcatacaatagttacctataaacatatactacacaattaatacttgggcccacctgtcatacacacatgcatcttagagttcgtgctgtagctggctataaatctgtagttcgttgctcatctctatcctattttatatcctcgaaatgtgtttatagctggtttatagtctgctattgtacctgctcctatagccaatctaatagctcattcatacaatagttatatactacactattaatatctggtcccacctatcatacactcactgcatcttagagttcgtgctacagctggctacaaatttgtagtccgctaccattctttctcttcatttatctctttaaaatatgtttgctgctattgtacctgttctaacaaaaatgttctaccttgtatagtttaaatttttttttggaatagagcacatcattatattaagagaaatatcgaaatatcttttatgtacaagccgaaggaaaagagaaaagagaaggggacaagaaacaggagagcccaacggtttgatgtgaacttttttgatcaggacgtttggctcaatctgaactagaaaacctatgatttatatacgatctgaataatttgacatgattttttcgttggaactcccgcattcgaaactagg

SEQ ID NO: 13765 - DNA, 1501 bp, Oryza sativa
gtttgtgaattgaggaacacacaaacaagaacaagaaagaatacaaccaaattgtgcatgaatgattaagctcacaagttggggttttacaaaccgaaggttggcgaaactgttcttgacagattaatctaagcaaaacccaaaccctaaaggtggtgacaactactaatatatagagtttagggtcgtgcaaataacccttgacgacgcaatcctaacgagctccaacacgatacacggcccaaagaccaaaatacggcgacgcagcatcggaatagattctgaacatcaacttgttcggtcgattcccaatgactcgaaaagaatttggatatgggaccagaaccattgaaaaggttatcttcttaactttccatccatataaagaacgctccaatccgagcacatatgcgacctggacacccgttttagtgtagattggtcctggactctgaaacgtactcgaaatcgacttgatgtggacctccatcttgacttggactcccttgctgatctaggattttagggcaccaatgtcagcactcacttatacttatatagtgtttggaagggcttcatttctaaatattttgtaagctaaggtgtccttgaactgttatttttagctagagccggtagaatattgctgttgtttcaatgagcatgtttatttcagactaactcttaagagtaataagaaatacaaatcctttattcttttggtcagacaacaagttattcaagttgttttcactaatacgtaaaaatatggttaacttttaatagttgataatagaattattggcctaattacatggatagaaacattagctaaaagaaataattatagtcaacggatcaaatattttaaactgtgacattagtggtggctgacggtaccaaaacatatagtccctccgtttcatgttataaacgttatggtatttttatctcttgtctaaattttctaacatacatatgaagttaaacatatatatgtagcacatatggatgtatgaatgaatctattcaaaatctaaaagatcttataatgtgaaataggaaggatgttggaaaatagattcaggctccaacacctaccacaccagttaaactgtttaagttttcaaagatggagctatattgtttagcctctgagcagctgcaatttagcggttggggtcaacaagcttgcactgtcggggtaagtgtgtataaatgctagcaatacactggattggttggatggcatctgtgtcatctgagaccaatgatactaatatacatccgcccctttcataaagtgaggaagcgtgtttgattacaggaaaaagtacaccgaaggtccctcaacttatcatcgagttacaaaatcgtcctccaaccgcaccaacttacaaaaccagtgcaaatcaggtctcttagcggttttgaccccggttttgtctgacgtggcggctgagtcatcgtaggacctacgtaggccccacatgtcaggatg

SEQ ID NO: 13766 - DNA, 1501 bp, Oryza sativa
aataatttcaaatttttttaaataagacgagtggtcaaacaacgcaagcaaaaattcaaaatcccttatattatgggacggaaggagtacacaatagtgtgactgtactataactacattgtaatctctatataagttagatataaagttgcatatagtattttaatacttatatacaagttataatattgttatgatatagttatagtgaaattatattataattatattatagttgttttaaaagttctttttcaccagttcttttcgtgttctcatgttatttttttcaaccgagtttagaatgctctggatttttcctttgttttatctggactcttcacacacgtttaaaatgagcgtgctcttttggacacgtggcacattttaacgatatgtgaacttggtttttggtttggccacgtggcccaatgatttggtagagtttgcaccttgaaatcggtattttagattagtgtgactattcggttcacatgatttccaaatcacaggaataggaaaaacataggaataatacaggaatgcacgtgcaaaacaaaggattggaacacagaaatttttcctccaccgagctaaacaaaagaggatagagtggatgttttcattcctatggaattagtacattttgcaggatttttggaggattggcatagtgttcctatggaaaattttcctttgaatcctacaaaccgaatgcatgaataatgcataaatagtgtttattccaaaggaattgagatttcctttaggaatccttcaaaacgaataaggcctaatattgcacagtgagctgtgcactagcatggtgacgattttttttcggttttagattttttttttaatatttacagaaataatctatcgaccaaaaaaattacagaaatagcccctgccgcccacctctggggcggcaagctgacgtggcaaacgggggaggaacgggcggtgacggagggagggttttttgcaggaaaacccttgccgtcctctggtggggcggcaaggggcccgaatgcaaaaaccagtcggggccggctattttgcaggcggccccttgccgccctctggccgggcggcaggcctcgctgcctataaaaggcctgctgcccagcccccagccctcattcttctctcctcaattccagtgaaaaaaaaagaagagaggggaggagaagagaagaaggggcgaagccctgccggattcagacgccgatttcaggtaatattcatagatcctatatgtgactattgagttaaatagtgtgtattctttaaaaatttgtttgaataaatgcattatatttttagggttttagttgtactaatctagaagtgcgtattgtagatatcggtaactacgtagatctgctagtttggaattaatacattaccgttgcattggcttacacaagaagatattacgttgtagatgtttattgcatgaaagagtaatatgatctagttatttcgttgacagata

SEQ ID NO: 13767 - DNA, 1501 bp, Oryza sativa
ggcctgccgcccggccagagggcggcaaggggccgcctgcaaaatagccggccccgactggtttttgcattcgggccccttgccgccccaccagaggacggcaagggttttcctgcaaaaaaccctccctccgtcaccgcccgttcctcccccgtttgccacgtcagcttgccgccccagaggtgggcggcaggggctatttctgtaatttttttggtcgatagattatttctgtaaatattaaaaaaaaaatctaaaaccgaaaaaaaatcgtcaccatgctagtgcacagctcactgtgcaatattaggccttattcgttttgaaggattcctaaaggaaatctcaattcctttggaataaacactatttatgcattattcatgcattcggtttgtaggattcaaaggaaaattttccataggaacactatgccaatcctccaaaaatcctgcaaaatgtactaattccataggaatgaaaacatccactctatcctcttttgtttagctcggtggaggaaaaatttctgtgttccaatcctttgttttgcacgtgcattcctgtattattcctatgtttttcctattcctgtgatttggaaatcatgtgaaccgaatagtcacactaatctaaaataccgatttcaaggtgcaaactctaccaaatcattgggccacgtggccaaaccaaaaaccaagttcacatatcgttaaaatgtgccacgtgtccaaaagagcacgctcattttaaacgtgtgtgaagagtccagataaaacaaaggaaaaatccagagcattctaaactcggttgaaaaaaataacatgagaacacgaaaagaactggtgaaaaagaacttttaaaacaactataatataattataatataatttcactataactatatcataacaatattataacttgtatataagtattaaaatactatatgcaactttatatctaacttatatagagattacaatgtagttatagtacagtcacactattgtgtactccttccgtcccataatataagggattttgaatttttgcttgcgttgtttgaccactcgtcttatttaaaaaaatttgaaattattatttattttttttgacttactttattatccaaagtactttaagcataacttttcgttttttatatttgcacaaattttttaaataagacgagtgatcaaaccgtgcaagcaaaaactcaaaatcccttatattatgggatggagggagtacaatgtaactatagtgttacactacactatagtaacatttaaaagttttttttgccaaaaaaacttgtgacagctttttagcaattcgaaaaaaaatataaacagcgagctaatattagctgtcgtaaaccggcgacaaggaagacatctaccgcaatattttccggatccacggaagctgttgccaatgagcaagatccattcactcaatggagcaagcggagggcgtcgagccgtaccagctgtga

SEQ ID NO: 13768 - DNA, 1326 bp, Oryza sativa
gttgctgcgggatatttggataataccttcatattaacatttgtattggctgaaaaagaagaacaaaagtacaaagaaaatagaaaacgtgttataacttgacgactgactgaactaaaacaacagatctcacaaagcccttatccagttaaactgagaaaagctaactgggctggataataaggtttgtattcatgcaacgatcaggaaaaaccataggattagatcgaacggcttaaaagtgctgatgacgtggagcaatctttataagagtaaatgctctagtgggtaccaactgtataggaagaaaggataagcataaatgcctctaaattggtaccggttaaaaaaccgacatctatagtgggtatccaaccgacaccaatagggaactacttcctctgttttatattataagactttttagcattacccattttcatatatatgttaataaatctagatatatatgttcattaacatttatatgaatatggacaatgctagaaagtattataacctgaaacggaggtagtatgtactagtggacgacgagctcccatctcccggccgaggccaacgacggcggcgcggggacgacacgcgcctcccggccgtcatcccgtgaggcatagaagtagcagctctgctggccgtgttgccaccaagctcgccgaggaccgttgatgcctccacggctccaacgttgattccccagacgacaacgtcgtccccccaccacaagatttcgccatgtccaccgctcggccttgagcatcaccgtcctcagcatcctcgcgctgtcaaagatagtaaggcgaaaggaaggaatggcacactgacacgtagggccataatattttctcttttcccccaaatataacagtgccactttaaccaaaaaaaaaacgctttgaacgagtcgaggttttgcggcaaggcttaaggggctcaaaatagacttattccattcagagctgtttggggcacagggccggcggcccagagaggcggtggtgcccacgaagcctacacaagaccgatgccctatttaggtcaatcgtggactatggacaaccccacaccccaaaatccccaatcgccgcgccgcactgcgactgcgattctcccaatccccggtggatatcgatcggattcagatgaacactcgattccggcggccggaggtaaatccggagtcgattttttcgcaaatcgcaggtactctacgcaatttttgttcctaatccccaaatccccaattgccgcactgctactgcgccgcgtctcgccggccgatttggatggctgcgggtgggacgcaag

SEQ ID NO: 13769 - DNA, 1501 bp, Oryza sativa
ccgctccaaccggctgacccaaaaacgaaaacaaaacgaaaaaaaaactgagatgaacgaacacctgatccgcgcgggcgaatcggaggaggacggcggagggtttagccacctaccttcgaatggccgccgcgtcgagcggcgcgtcggcggcgtcctcggctagggtttccgccattagcagcagcagcaatggcaatcccctcccctctcccgcccaagaaaaatttcccccgacttcgaaaaaaatgggtggcgattttgagaaatcccccctccaaaaactccgaactgcgatctagtccgcggccacgtcgggccaaacgggcggcccggcccagcaggcacggctcctgttgcgggccgtgccgtgctggcccacgtgctaaggcctcggaccaagcacggcccagtaaggccacgggccgtgccgtgccggcacgggcccaaatatagcacgtgggccggtgtaggcccattagcacgtttggcccacaaaattgaatatgaggccgaaaaataaagaaaaaatgtgaaaagaagatgaaaaaggaaaatttgtgaaaatattataaaaaatgacgaaaattagtgggaaatagaaaacaacatatggaaaaatcgggggaaaacgagagaaatgagagaaaataaacaaaaatatatgaaaagaaaagggaaaacaggaaaaatttggtgggccaacgggccgtgccgtgccgtgccggcccatggtctcatacgtcggcccaagcacggcacggcccacaagcgggcgtgcctgggccggctacagtggttaccgaggccttggcccggcccatttggccagcactcgccccttgcggcatcgcctcctccccgccacacaaacaagaaggcgagccaagccaagccaagcccctccgcggcgcgcgcgttatccatctccccctcgccgccgccctatcgccgctgctcgagctctcgatcccctcctcctcgctccgccggccgccgcggccgcaacccaggtcagaggaactcaggattccttgtcagttcttgcccgggctcgcatttttccttgctgggtcttgaatctttctttctcttcttgttttgtgtttcttggtcagatgatgccgcggcagtgcgggaatcgcgcgttgctagcggagggatcgagcacggtggtggtcgtccatggccgcaagaccagaggtggtatcagcactgtcacctccagcaggaggaggagccatggcggtgtcaggtaccaccggtgctgccccccgagggctcacctatggaggaagggcgatcatcttcctctccatcatgccaagatctctgctcgttgttccgaggtgattgaccgagtcctcattttcttgtgattgcacactcccaattttgctttcttattgacaaggaaaaaaaggggattgggttttgggtgatttgtttgatagatcaaggcccacacggtgctgcaaggttcagatgctctaagcagcat

SEQ ID NO: 13770 - DNA, 795 bp, Oryza sativa
cttctagattagtataactaaaaccctaaaaatataatgcatttattcaaacaaatttttaaaaatacacactatttaactcaatagtcacatataggatttatgaatattacctgaaatcggcgtctgaatccggcagggcttcgccccttcttctcttctcctcccctttcttctttttttttcactgaaattgaggagagaagaatgagggctgggggctgggcagcaggccttttataggcagcgaggcctgccgcccggccagagggcggcaaggggccgcctgcaaaatagccggccccgactggcttttttgcattcgggccccttgcagccccaccagagggcggcaagggttttcctgcaaaaaaaccctccctccgtcaccgcccgttcctcccccgtttgccacgtcagcttgccgccccagaggtgggcggcagggtctatttttgtaatttttttggccgatagattatttctgtaaatatttttttaaaaaaatctaaaaccgaaaaaaattctgcaggcgatggccaccacgcatcggcatcgacgcatcgcgccgcctcgcgtctcgggctctcggcgtcgtcgctgcgcgcgaccgcgccggctcgccgcctcccgcccctgagagtggagacaggggcaggcgacgcgacgcgacgcgacgccgccattctgcccccgccaccccgcgcgccggcgccgggtcccctgggctctccgcctcaggcctcagcgcctcgctcgccttcgactccctgtccctctccagctctcttgctg

SEQ ID NO: 13771 - DNA, 1501 bp, Oryza sativa
tgattgattagcagagtaagatgttaattactgcctactctttgatcagacaaatgtacactgttcatctgatcagaatctgaatctgaccacaatcaggcaagcaattaagcagcaatacttactaaccaatctttctccagatatactagataccagaatgcaagaacacaaaatcaacattcaacaatatcatcaacgcatcaagtcttttaagccgtactagtcaaatcaaaccaaatgggttcaagacggatatatcgacccgaacaaacaaaaacacgcagtggttcatcgattttaccacaacgtataacagaaacaaaacctgacgaaactggcgtttcctccgatccttccgcgagtgtgctaacctgactaactgatgctaagatcatcgatcaaggactccgacgtttgacgacgtcgccgacattcttctgatcggctccagttgtcgtcggcgtcgtaggagacgacggagacccggcctctgccgatggcgcgagagctatgtcggcggcggcgaccgcagcggatgaggacgacgagctgctgctgctgctgctggcggagggtgtcatcgcacgcagctgctgccagaacactcatcttcctgctgctgctgctgccacattgccgccgctaactgctgctgctgctgccgccagatttccatcgcaagctgtagctgctgctgccgccttattgccatcacacgctgctgcttcttcgcctcgtcggaagcaggggcgtgtcgcgaggagaaaccgccaccggcgccggttgagtggctgacggcggcggaggaggagttgatcatgtcgtcgccggcggaggcggatgacgatcccgacttgacgcggccctgggaaggatggccgattgggggtaaggcggtgtcgcggccgatggggacatggacggggtcgcggctgctggggaagaaggcggtggcgctgccggagccggagtagtagtcctcccgatggccgatggggcccaagggattggggcggccgatggggacgtagatggggtcgtggcggctggggacgaaggcggcgctccgcctccggccggtgtcctccaactcgacgaggtggcttgcgatcctgctgctgtcgccggtggaggcgccgccggtcgtggtcgcggcgaggccatcgaagttggagcccggcggggacgacgacgaggtggcgccgccgggctgagactctcgaccacggccggggcggttgcgatcggcgtcatcgccggccatctcgagctttcgatcgatcgatcgaggcgggcgtggtttgtgatgggaacgaagggttcagaggagagaggacacgagaggtgcctctttatatagacggcgggtagcgtgcgctgcacggcagctctccgaggcggcggctgctgctgccgtggtcggagatggaggtgacacgaagcttgaagcagcgagctttgccggccgcctcgatctgctgatctgattttctcgtcg

SEQ ID NO: 13772 - DNA, 1501 bp, Oryza sativa
aagcagcagcgtgtgatggcaataaggcggcagcagcagctacagcttgcgatggaaatctggcggcagcagcagcagcagttagcggcggcaatgtggcagcagcagcagcaggaagatgagtgttctggcagcagctgcgtgcgatgacaccctccgccagcagcagcagcagcagctcgtcgtcctcatccgctgcggtcgccgccgccgacatagctctcgcgccatcggcagaggccgggtctccgtcgtctcctacgacgccgacgacaactggagccgatcagaagaatgtcggcgacgtcgtcaaacgtcggagtccttgatcgatgatcttagcatcagttagtcaggttagcacactcgcggaaggatcggaggaaacgccagtttcgtcaggttttgtttctgttatacgttgtggtaaaatcgatgaaccactgcgtgtttttgtttgttcgggtcgatatatccgtcttgaacccatttggtttgatttgactagtacggcttaaaagacttgatgcgttgatgatattgttgaatgttgattttgtgttcttgcattctggtatctagtatatctggagaaagattggttagtaagtattgctgcttaattgcttgcctgattgtggtcagattcagattctgatcagatgaacagtgtacatttgtctgatcaaagagtaggcagtaattaacatcttactctgctaatcaatcagtagttgatatgcagtttgacattccaattcatggttgcatgcacatgaatcttgttcagccttgatggaacattggaactgaagttgtgaactacggagtatatatgaaatgtcagatattttcagttatattttttatttgtacatctgaaatttctggatttcctgcatgcagccacaccggcaccatgcatgggtacaactaaacctatctcaacaaagctgacttgttcgggctagcaattaatcagttagcgcaaaattgaaatcagaaaagtaatgtttccactgcccgccgaccgacgaagacagagaaagagagataagaggaagagagaaagagggggtatgacacgtgggtctcaccattaaaaaaaaataaaataatgactggactgccacgcgtataccacgtagaacaaaaccaccacagattaggtcgaggggggtaattcggtcaaccgcgatagttaggggtgaagaatatccagttttgtggttcagggggtaatccggtcaaccgcgatagttcgggggtttaattcgtacttttttcttagctatttgctgaaacattgtttttatatagggtaaaacaacgttcgactttttggaaaccgttgtttcatacattgtagcaaaagtttcatgaggagatttgattgtgtttcagccttttacaagattaaaacattttttatttatttagtgaaatattttcgatctacttaattaaatagcgtttgatttttgaaaaaaagaaaaagaaa

SEQ ID NO: 13773 - DNA, 297 bp, Oryza sativa
cacaaaagcacatcttcttttcgcccaagaagagacgtccatgttttgtccttgcaatttgctgggcccaccaggccagtctcagcggccggagaatccggagccccaccgggccgatatgtcagtgacacaagcggatgccgtggtcccactgtcagagaagcaccccgcctctctcctcctcgcgccccgcgcgcctccaagccttctctttctttccaaggcaacccgcgccgcgcagtataaagcaagcgcagcgccaccattgccaggaacacgaaaagcttttggttagtg

SEQ ID NO: 13774 - DNA, 1501 bp, Oryza sativa
accctattacgtaatactttcacactttactataattccaacactcgtatgatacgatattacggtatggtgcgtccaccgtgcacaccattagggtcaggatcaggcatgggcaaactagagcttgagtatcatgcctagctccataaaccttatcatgtcacttttggattgaaaattcgtccaaacaagcttgtcattttgggagtatcttttgtaacatcaatcacctctaatttaaaatgttctccatcttatcctcaagtactaaccatatattacttaatagaaggcactatagtgatttttcctaaaccctaatctttgctaaataatctagaacgatgattttgttggaacggaggtagtatatatataatttatgaaatatttaagcttccattagctcagtccactactaggagaacggtttttctatgtggttaaatttaattttcacgtgcggtgggctacccgcacacacccaggggtctgagaaaatcgtgatttttgcgtgtgggtggcacaccgcacggaaaaataaaaatcctaaaaaattaaaaaattaaaaaattgaaaacctagaattgggcggcgccgccgcctcctcctcgtcctcgtcctcgtcggcggcggccgaggacgccgctcccgcacggaaaaaatcaaaaatgagcttatttttccagacgcgaccagttataatccgtgtgtaaactaaatgcctccctatccaagaaaatagtttctttagagcgggtacaataagtgactaatagctaaccttcgcctacgtggaagagagaaagtgttggagagagagaggaaagcagacgcttgcatgagagccggccaagcacaagcgcctaggccaattccccaatctacgaactgctgcatgtcagtattctaatatggcccaaagggagcaatcctggtggtcccacacatacataaaaaatggttctgtcaagatgctttgaatgacgtggatgtaaattggagctgatgcttactccactattaaacctgctcttagcagtctccaatgtttatgatcataagtagcattaaggtgggtcccattattcttatagttattaccacaatgtttaaagcaagagtaacctttaagatgggtcccacaatatactattctagtacttcttttattagccatgtaaatttttcatcctcacattcattttaccctattattttattgcttgtggtcaagccataagcttaaagctttcttttgcatttaatgccttatggctttgtttcacaatatatatggtcactataaaaccttatggcgtcttcttatggccacattgtggctgccctaagggcctgtttagatccatttggaatagcaaatggtaaaagttttggtggcaaaagttttgtcattgcaaaagtactgcatgttaaagttttgtcattctagcactaaagtgagagagagaaagagagagggagtggtcccaaagcactt

SEQ ID NO: 13775 - DNA, 1501 bp, Oryza sativa
gaattggagggaggaaagagcagcttgaggaggaagaaagaacagaacaagatagcaggaagagagatttgaatcaattgggaattgttgtgtacaatgtttttcatatccctctctctccaatcctgccgacctttatagcaatgtgctcaaggtctctctctcttaccgtggcccggtctctgactaccgggtccacacactctgtgggtacatggtcggtccgatcttttgggttgacttgtgttccgagccgatgtcgtgacacgcacagtagatggcgatggcgtgacactgcgcgggcgtgcacgggaggcggcagacagcagcgggccagctgcaagccaacagtgacgccggcaagcaagctgcaggcaagtctgcaatttcattatcaccagcagatagttgctactgtagctttgatggggttactagctcagctcgggttcgaactcgtagaatgaattgacgagcacgtcgtcggcgagctccagcctgtcgaactgcttcatcaccaagtcgaagtacgccgggtacgggccggggccgaccttaatgaaccacggcaagccctccagctccagcgccggcaagccgatcagcgcgatggcgccggcctccacggggacgtgtacacggccgcaccacgcgtggccgtacaccacgttgacggcgcacgactgcgtgaagaacgtgaacgccaccgccacagcgcgcgcccagaggaggaacgcgtcgtagacgaggacgcgcacggggcgtccacctccaccccccggcggcggcagcggcctcgtcccggaggagctcgtccagcgtcaccgcccacgctgactcgaggcgatggatgcggagccggcgaggagatgaaccccgatggagaagtcggggaggacgacgccagcagtggcgaggtggaggtgccggcagtggcgaggtggaggcgccggcgacagggactcatgacgccggcgtggccgcgtgggggagagagagaaggaagagaaagagggaggataagaagggatgacgtgcgggtcccagatatcagtgggtcccgtatgtcagtgacccacaaaattttcttctgaatgacgaatgggtcccacatgtatgtttttaatttttaatgccacccaaacgccacgtcaacggcagacaaggtgaacattgccacatagacgccacgtcagcaaaaccgctcttcaaaactaccgagggagtcaagttgcaccggttttaacagtttaggggtcaagatatctggttttatagtttaggggtatggattagattcggatcacttttaatggagtcaaagtgaacttattcctaaaaactagccaaaccagctggaggcctggagaagccagcccatcaagcccatcaagccagtccagcggcccagctcaatggacaaagagtacagtacaccaggcaccaccgcaccagctgaccaggaccagcacagcacagtatgtgcctaggggatgtgcat

SEQ ID NO: 13776 - DNA, 1501 bp, Oryza sativa
cacgttcacggctcgggggtggtcgggggctgtgcgtgcagcgtggaatacgtggcgggcagcgtgctgcgtacgtgagccaagggaatcgagtgcgatgccggttgctactcacgtcgttttgcttgctcggataagattctcaaaagctcagacgtcgtcgatggccggcctctccaggacgaagaatattcgtggcactctctcgtccgcccacacgtaaatacaacaccgactagacttcaacatttcttttttgaagtaataaagatactctctatcttaaaacaaaacaaatcaacttctatatatctagatttgaacaaaaagtatgtttgtttttgacggaggaagtactctttgtatatcacgacagaagaaatcatccaatttccaatatggtggcggacggaaatggccgcccagtcgccggattggttcctctacgcaacgtacgtttcgaaaaggacaaaaggctgaataaaatgttgggcttgggccacaacggtgacagcctgatagtacccagctatattggcccgccttatgctgtcagtagcggcccagaattttccatggactggtcgtttggggccgttatttatttacctcccgaacgaagcaacgcaagatcccgcggccgaaagccgaaaaactcgatagtgacgagcgtttacatcagagcttcttctcgctcggacttgcgtgcgcccgccttgttcattgggggcggatcgaccttgaaagctaaggttaaaaaaccagtagaatagttccacggatttaagtaatccatcacacactgtttgcttggtaagcacgaactcatccgtagaagagatggcaaaaattgtgggtaactcatatccacgtcctacccgcgcccgccgtattggtacgttacgttgtgacaacaaccgggctttggcagttgtcagttggcacttgtggttggacaacacaacagaatcaaccaagagtccgagacatttggcgatcgcaccgcacggcggccaaaaatcagaagaacaccgaaaagcgccggcgggaaaacggaagccaacccttgccctacccacgaggccacgacgttgcgttgctcatatggacatggcctccatgcccccaccggggtcggtgtctgtcgagcgcagggcgacgcggcggatcccacattccccgggcagaaagaggccaaaacctgaaaccaacacgcacagggggcacgcgcgcgcgcgcgggcgcgaatcgtgcgtttcggcttgggaaagggaggcagccaaaggcccgcgccgcgcctcctgcttgattggcggttcggcgcgctggcccggcagccgagcgcgcggtcaagacgagtggcgcgtggcgggaccgcgggacctactgagcagacggtcgcagctgggagcctgggaccctatcgtaaaatgatccccacatatatatatatatatatatatatatatatatatatatacatatatatatatatatagga

SEQ ID NO: 13777 - DNA, 1501 bp, Oryza sativa
gaagaaggtggaggcgttcggcggggcgacggcgatgaccatcgagtcgtcgaacccgtaccgcgacttccgggagtcgatggaggcgatggtgactagcggcggcggcggcggcggcgctgatgactggcggtggctggaggaaatgctggggtggtacctccgggccaacgtcaagagcacacacggcctcatcgttggcgccttcctcgatttgctcgtctctgctgccgcctcgccagctgcttcttcttcttcctcctctccggcggccaaaggcaaatattcctcttgctgcagcgcctgttcctcttcctccatcaagctggaagaagaacatcagctacgacattactaatatataattgatccacacatctacggtaattaatgttcgtttaattaatcaattcaatggattaattatatattggagcgtgcattttattaactactccagtggtagtacatcatatactagtatattcgaatttcatacatccacagtttcccctctcaatttgtgaataggcggagtcgatcgccatcaccatatgtacgtgtgatattttaatttgtcagtcaccgatctctccctatgacatgctcacttcgtactaaaataaataaattataagatgaaatgtgatacatcttaattattactacgatatgtccagattggtaaatcagaatatcacatttcatactaagtttatttattctataatgaagggagtatatacatgtgcgcatcaatcgatggcatatgcatatctctctatctactatgtgacgcactacatagtttttcatagagaaaatatataatgcaaaactctatagatactacaaatctttttttttgcggggatagatactacaaatctgaaactactgtaggataaaatatgaatgtctgatatttatccatatctcaatgagtggtatagtagtgtttaggccctgtttagatagatgggactaaaacttttaattccctatcacatcggatgtttggatactaattataaatattaaacatagactattaataaaacccatccataatcttagactaatttgcgagacgaatctattgagcctaattaatccatgattagcctatgtgatgttacagtaaacattctctaattatggattaattatgcttaaaaattttgtctcgaattagcttttatttatataattagttttgtaagtagtctatatttaatactctaaattagtgtctaaagacagggactaaagttaagttcctgatccaaacaccaccttagtgagcgcccagcacagctagcctagataggccaggcgtgctgccttgctatgttgatttatatatcgattgagatctactggaacaatgatgcatgagatgagatcgataattgtatatactggggcgagcagctagcttgtgatcattggacataagacggtcgatcagacatcattaattacagtatatcaatgttgt

SEQ ID NO: 13778 - DNA, 1501 bp, Oryza sativa
ctcttcgcattacaaggtgagatattaggtgttgatttagtggttgataaaaaatgtagtcatggataaggttattaaaattataatggatgatccttttatgtattcaaaggtacacaaattgtcaaaaaattggcacataaacaattgccactagttattgttaacttgtcatggtcttcctagtgcctttaccaacacctacttaaaaaatataagagcagaaatcttcaacttcgcttatggtagaaaacaaaaatccagcatgtattgggcagctgggagagtgcacgtgcgtcatatatagatacagcacatgatattggacgatggtgatggctcgagtatctctttcatctgatcaaaggaagtacgtggttgttcgtggcacacatgaacgtttacatactttgatggatgtgattttgaccgttgtttcttaagcaatacaaaagtgaataatatctactactccaacattcataactgtgaatatattttatgtaattaactataactattgttgataaaccgataggtatttgtgagcggagaccgagtattacggtaaattaatgtctattctttgagagctgagagtactggctctgtacatgaaaaagttacttaacctaactccacgtgtacaagaaaatgacgtctccatcgaaaaggaaatggaaactgatagtgctcattggtcatggagcacgccgcgcgaagcgcgatgcatcatcacacgaagaagagacgacgcaccacgaggaaaacgcggccggccgagagcgacttcgcggccccatcgcgcgaccgcgaccacggcgtcatatatagcgggccgtccccgccgtttgtacccggaataagttcactttaggtccctaacttgacagcgagttcaattttcatcctttaacgggtccctcaactatcaaaaccagcagatcccatgacagttttgacggtggtttcagatgacgtggcacctacgtggctaatttgactcggtatttcgtctgacgtggcattgacgtgatgaatgaagcaaaaattaataattttaaaaaaataatatgtggatccgcatgtcagttaaataataaaattaaaaaataatgggacccacatgtcaattggttcaaggatgaaaatcgaactcgctggcaagttaagagacctaaagtgaatttattactctgtatccgggctaggccctgtttggaaggcctcagttccggcccattccccgcgaatgggccggagaaggcattatgggcctgaaagcccgctagatctcgaggcgtcagcaacaacagtcagcagttcagcacgctgccgccgcgagggttggcgacgccgcgggcggcgcgcgaagcaaatggagcgcgattttggcggataaatttgggcgcgcggaggcgggaggagcgggaaccaaatcgcggagccgcttccaacctcaggtctcaccccaaactcgccgccgccgccgccgccgcca

SEQ ID NO: 13779 - DNA, 1501 bp, Oryza sativa
tcggcggtctccggctcctgcagcagcggagcatgccgcggcgtgcgctgctcggcggcgaacaagccttctccttccaccgctccgggcaccgaggtaaggtagccggctagccgccccccatattcttgtttctgtgttgatcggagctcgatggctggggtgctctgggctcgtcgtcgtcggtcgatcgtcatggcttgcttcgtttcttgcagctcgacctccatggcaaagataaggagtgaggtgctgtccccgttccgctccgtgcggatgttcttctacctcgcgttcatggccagcgccgggctcggggccctcatcgcgctcacgcagctcatcccggcgctgtccagcccggcgagggcggccgccgcgggggagacgctcaagggcctgggcatcgacgtcgcggcggtctccgtcttcgcgttcctctactggcgcgagagcaaggccaaggacgcgcaggtggcgaagctcacgcgggaggagaacctgtccaggctcaggatccgcgccggcgagggccgcccgcccgtcccgctcggcgagctgaggggcaccgcgcggctcgtcatcgtcgccggccccgcggcgttcgtcaccgagtcgttccgccggagcaagccgttcttgaaggacctcatggagcgcggcgtgcttgtcgtgcccttctcgacggacggcaacgcgccggacctgcagttcgacgaggccgacgaggaggaggaggaggcggcggcggcggctgggaagatgaagcggaggctctggcagctcactccggtttacacttctgaatgggccaagtacgcgcaaagccgggatcccatgaatttagctgcttaaatttcttcttcatgtcaatcgaaattcaaatgcaaattagtatctcattttcaaatcgattgctgcttcttgcagatggctagatgagcagaagaagctagccaacgtgtcacctgattcccccgtgtgagtatcaaaaactactctgaatttgtctgaaaatataactgaagtttctgcagctgctgaactgaaaccgcatcactcttgcaggtatctctcgctccggctggacggccgcgtccgtggcagcggcgtcgggtacccgccgtggcaagcgttcgtggcgcagctgccgccggtgaaggggatgtggtccggcctccttgatgggatggacgggagggtgctttgaatatttgactgatacagaccgtgaaaacattagttgattggagaaaaaaaaggacggccgggttcgatctatagcttatactagaacaagaacaggaagagtttgatgattgctttaacttctgtggggttgattttgcttcctgcatcccagcgacatcgcccaagtgaatgtgatatgccatgtgcccatgtacatgttgttttgcagcctacgtgacttgattattaacgagaatcctgtgtcaaagatcgctttttccgtggtaggcttctccattttattttattt

SEQ ID NO: 13780 - DNA, 1145 bp, Oryza sativa
ttgttcttcacaaaattgacgggggatggcatattatgaccaatggtacccaaccaattggtattggcgggaccttgaatcttgactggtatatgatgttactgattgggtgcatttctgagagggtattcactatctccatgtcagccacctattaaaaaaaagtcaaaagttcagaaattttcataggagtgttcgacttgtttgtgcccagcaactaaatcccacttcggtgaagcggttgaaccccacaatcggtgctagtgatttcctccctgtacaagtggaaaattccatcctaaaatacagttagttctttttctgttttgtttagttatatgcatataaggatgcctccgttgggctcaagagctctagtcgtacatgaaactgagatcttatcgaatttaagtgcatgttatggaagctgatttatttagagggagggacttctgactttgtcatccaggatttggaaatgtaatgctttggataaacatgagttagtggctaaacaggagtgtcacattgttctaactccacactcttaaaggcatagctctaaaggtggagagtgctccttcagctttttgtaatgggtgcctttcttttttgccccctctcttgctgatagtagattcagtcacacatcatgagtttttgaagttcgttttgttggtgagggcttaagtacaaggttggtgattaacttgctgtatctacagttctacagaattttctttcttttattagaaacacagatataggttgttcattaaatgtcaatgaactaatagtgaaaatcaaggcagatatagttagatgaagtgtgcacactgcaaaagagatgcacagattttagaagtatataggtttttcaggaaaaaaaacaatttacaagtatatattccctgggaactggaactggatctttgtacatcttcttgttatataatataggtctataattgttctgttaagtaaaatactctggatagtattgggtttgtaagtggaatgagaatttctctagagaaggaatatagttagaattgacatgatgagggaagaacaacctcagtgtgaagtccagcaaatgagcacttggcacagtttttactttcattgtcctttctccactaagc

SEQ ID NO: 13781 - DNA, 1501 bp, Oryza sativa
caagccaaacttgcgtgtactatagatggtctgatattttacctgcaatgacgttgtgaaaagtgatgagctcttgttaaaatctagaatagatgctcttgatcctgcagtccagcgaaacccaatcatgaaaatttctgctgaactgtataagcatgatcaaccagaaaaaaactttggaatctgcactagacctggttttaggaccctaaatatctcccgcattgctttgggtttgtcaaccacattgcgtaacccataaccaaccgtaacagcatcgaagtagcagtctgtgaaaggcaaatcaagtgcatcgccttcgatccacctgcaaccatagaggtccaaagcacgcatctgtcagccacgcgcacgacctgtccacttcattaacagcaatcacaaaactacatatcacaggttgttcttaatctacaaactctcacattgaggatgctcacttgatgttcttgtagcaaggcttccagcgttgatcctgacggctagcagccgtttgcagctgctgacttgagaaatcaacagccatcacctgtaaaatatgagagcttgggctagaacattcaagtcgatttttttttctttctgaaatctaaagcagccaagcaaatccaacaccaacctgtccatccaagccaaccttctgagacagaaggaatgccaaatccccactcccgcagcagagatcaagaacacgatcccctctccttgccctgaccacaataattcaaccttttccatcaaccaattgcagaacaagagtatatgcatgctgccactagtggcgtacctggaccaagacacgcagatgcgcttccatgtccggtgctgtccgaggctgagcacgtcgttcagctacaaggaacacggcactgcgcccgtcgtcagtacgatgctgctggtagtatacatatctccagtggaattcaaaattttgcgagaaggggaggaggagtgggaggtaacggacatggtcgtagacgggggcgatgcggctgaagagggcctgccgctcgtcggccgcggaggacgagccgcagctcacggcggcgaacccgcggcggcggcggcggcgagcggcgggggcgggcgccgcggggcccgccgaaatcgcggcggctagggtggccatgggtgtccgccacgtccccagtcaggataggtatatagtgaccggtatggactaagtgtttgactattttgcccccgccgccgccgcctcgccgcggaagtgaaagcgctctcgactctcgccgccgccgccgccgccgcgaaccgcgtcgtgcggaacgcgagggtttttccagggcgatggatttggggtcgtgctacttcggcggcaaaactgaatcggtggagttatgcctgcacggccccttccgccaggtcgttgccgccgccacctacacgctgcaggagcagggcggggagcggcaggaccgcgcgggcagcgtgtcgctcttcgccgtcgacgccggcgagg

SEQ ID NO: 13782 - DNA, 1501 bp, Oryza sativa
ttcgtaagttttttgcccccaaaacttttagatttgtgatcatcggatcatctcgagatctttgcatgaaggaaaaaaaatgttagaaattttcacacatgtcacgcgtaccatcctaatactaaccaatctatagttgaatgcaagatctatataagttatagcatagttatagtgcaattataatgtagttatagtacaggtacatgtaattacaatggacacaactacaccgagagtgctagctggatagtgctaaagagagacaccattctttccaaaaaaaagctactagtacactcaatatctatggttttttttcttcttagagaagtttctcttaaattactcatccgatttataatccgattacaccgttgtgttcgtaacaattaaatctttacaacaagatctcacatgattatattttgataaaaaatcacatattacttttatgatatgtctaaattacttctagatttcactaagtcacttcttagacatataaaagtaaatttagtaaagcttaaaagtagtttacatatattatagaagtaacttataacaaaaagaaagtaactttaatttagaactatatctagattcattaacatctatataaatgtgggcaatactaaaatgacttacattatgaaacagggggagtaactctctgtagtagaaataattatattgtgagtgagcttaaataagaaactatgtagagtgaattcgcaagtacagtgtagagaagatttataaagtccacaaaatatagaattaactaaaaataataataataataatcaacttagagaattatgaatgtacagaagtaatttagtcaaatatgaaagtaacttatatatattataaaagtaacttagtatataataaaagtaatttataaatataaatattttttcatcgtaatataatcatgtaagatcttgttgtgaagatttaattgtaacaaacacaatagtgtaattggattgtaaatcggataagtaatttgagagaaaactttataagaaggaagaaaaagacacacatgtctaagaggaaaaacagcgcgcacatcagcacgtgtagcagtaattcttctcacaattggatcgtcgttggttaacactaaaccgagaggcttctcggtttagattttaccaattacaatgcagttacacttcaattatactataattatatctaaaagttttttattaaaaaaatttgcggtaatttttttagatacaatcgctcgtattaggccatgcctctggtattcctttgcatttcgatcgtgtagcccaatacgacggcccaaacccaaactccaatcccagcgggcccagcaagtcagcctcacatcttcttcttcatctccctgtctctgtctctgtctctaacctaaacccacacctcgcgcgccgccgccttgctctcctcctccccgaccccgagtcctcttcgtgtgagctcgcactcgcagtcgcagcaa

SEQ ID NO: 13783 - DNA, 1501 bp, Oryza sativa
cgctaaggacgtttacaccaactactggatgaaaacaagacaccacgctcgttttgaagatgtattctcctaattattatgttgatcgagaaaaataaaaaagagatgcgtgatttgaatgcgatggtttcacgttaaaacggcagggactatcgatatatttatgtgcaaaaaacgaatcatatctatagaaaccaaatcaacagttacatatgaaatctccaacatcaatatatatccgtccggtctttagatatgttcatcgaaataggatgtgcgcgcatgtacgtaaggacgagtgcacacatgttttgagtccctctattacgtgtttctagaaaaaaatgtttttaaaatctatctctgcgtaaaatcagttactcggacagaagacaagtagaaacacataataggaatgtctttatatgtgcttataagaaagcgaagataggacaaatttattataaaagaaatgagattttgagggagagatgaccctccaaatatttttttaagaatagatcatgagcgtgttagggattgaacacgagacttcggggttaaaaccacacaccccttaccactgcatgcatctccaaatttactagcataaattcttactataaaagacctgcgtgtatgtaagatctgaaatagttaaatggtagaagtatagaatactagagaatgagtggatgtcttgcaagaccttggatgatagatattctaacaacgatatcgccttggatattagtagtagattggccaacatcaccatgtcaacatcgatcgccgtcgacctaattattccgattggaaatgattttgcccaagattatggaagagcgacataggaattaattatcggcttcaaattaggcaccagcaaagttgagaacaaagatccaactccgcatacaggcccatgttcttattacgtggacacgttgagtctgtgaaactaaaatggcccattagcgtctccaagtggtagtccggaacgtactctgtcctctgacatgtgggaccaataagtaaacgccgaataggtgggcccagacgaactctcttccgttcccgaagccgccgtcgggtgcatggacaacggccgttgaactgacgtggactgggccccacattccgaaccgtcctacccttccaacccccgcttccgtccggcccacccgacgtccgttccgttccacccgggccagctcaccgccagcccaaaccccgcagccgacgcgcttccccgttgacgccgtcacctcccgtctccttaaccgcgccagccacggccgcgccgacacgtgtacccgcgtcgcaggtgggtcccacctgccagccattcgagaaaagccacgtggcggacggcggtttcacggcgtcggaaagcgggactgacaggtggggccagcacgccacgtctgacgtctccctctcggcaacccaacccaccccaagcatcaaccgcttgctgctactagccgccagccaaaag

SEQ ID NO: 13784 - DNA, 1501 bp, Oryza sativa
aaatggaggaagaagtatctagaagcagcgggcggctgctgttgacaaacttttgtgtcgtgaggccgagacgggcggagcgctcgggtgcccgggatttatgcaggggagagatccgcggccgagtctgtttccagaagcgtccacccgttctggaaccttcccaacaccgtaaaagagaaaaagaaaaaaaaaggaaaaaacggaaacgggaccggctggcaccgtccgttccagcgtgcgcgcgacgcggtcccgccggaagcatggaagaatccggggcggcgccgctgtcgggccgcgcagtagcgtcacggcctcacgggtggaataagtccactttgactcccttaaaagtgacccgaatctaatccatgaccctaaaccgtaaaatcggatatctcgacccccgaactattaaaaccggtgcaatttgactctctgggtggttttggagggtggtttcactgacatggtgttgacgtggcggtgttgacctaatctgtgtgattgacgtggcgcttatgtggcatttgaattaaaaagtatacgtgggacccgtttgttattcacacacataaaaaaaatgtgggccccactgacctctctctctttcttcttcctcctctcttcgtcccttctctctttctttctctttctcttctctccccttcggccggccgcggggagcacgggctggagcggcggcgggtgggggccagagtggtggcggccggcgggagctgaagcggcggcggctacgtgcagctctctggcgagataccttcccagatcggcgcaatgcggaagctcagcttgctccacctcaacaacaaccagctcacgagtcaaacttgagctcccgacggcagcggcgcggccggtgaaccccatcgagctcgatgtcagctgcccgtccgtgggaagggaggaaggcggcggtgagttggggaccgacaaaactactcgagctcgagctacgagcccgacgtgcacatgacagagtaacggaccgaggaaggcgtcggggaagacaaggagaggtggtggagggcgaaccagaagacgagtcaacggcgatggagttggtcgagtcgggtggtgattgttgggtttagtcccacatcggtaattgatggtgggggagcacgacttaaaaggtgggggcggtcctcacccatcagactagtcttttgggttgtgtaggcgcaggacctaaagttgtggctccggttgggcctgtggtggagcaggcccaatgtgacctgggtggcccatagttgatgggccgggctgcgtactctaacaagtggtatcagagcccaaggtttgaaacctggaacaatttccatgggtcatatggtggagaggccaggtaacaagtcttcggggtcacatgggttgatgtgacgggggagattgttgggcctgaggccaggtaacaagtcttcggggtcacatgggttgatgtgacgggggagattgttgggtttagctccac

SEQ ID NO: 13785 - DNA, 1501 bp, Oryza sativa
tctccggataaactgcccatgtttatcacagagaataccgaacggattgcgtagttttctcgccatgaacccgtgcaggtagattcagttgctcgcgcccgatggtttgtacgagccaatactcgtcccctatccgttgtactgccaccgttgcatacgctacaaaacgccgtgcgtcccatcagctgctgttgcgtatcctactctcgtttcgtcacggagtgggtaaaaggactaaattaacagcaaggtaatccaggattacgcgagttccataccgcatcagtgcccttttttacctagtaggcgccaactaggcgaaccggacaggacaaagccacgaaacggagcaccgaccacgctggccgatgtgggctgtgcagctaaccatgtcaccaggtcactagcccgttacgcccgcgtcgtgttccggcccaccttacgcctcccggtagatccacgagccccacacgggcggatccactgtcacacgggcccaacggttcgctggccccactggcagcctaacgatggtttctcggttttacatggggggaaagccggtggctcggcacccgaggtcagtggaattgatggcgcccaactgccacgtgagaccgtgaccccacatgtcatcctcccgtaggacggcctcggacccacaccgagcctcagggacgaactagccgtttgcgggtcggcactaaaaaaatcggagacccatcggttcaacgggagggacgcgcgagcgccgccaatgaggcgaggggagggtggccgcgtcgtgcttcagtagtagtgggggcagtgggcgagttcttgctgcgagttcgtcgcgagagaggaagcagcagagagaaagagagcaaaagcagcgagaggttgtggggagagagaggagcgaattgattagtgtcgccacatcgtctccaccaccaccacctccgtccttcctcgccaagccaccatcattgcgccaccgccgcaagatctgagctcgactcctcctctcctcgcccccgcacgggcgcacgacgctagcttcttaagtatttttcttcttaccgcgcagcgcgcggcggctggctggctagctagcttctcggcaaaggcttgttgcggttgcggttgcagtacaggggcgtgtgtgcgcgcgagcggcggtggtacggtgcccgcacccacccaccaccacccccgccattaaaggcgctcacgcaccgcctccagcttcttcgtccacgagaaagcgaggtgatcagagagagagagagagagagagtgagtgaagcggagctcacttcctcccctcacgggagcagccaacgcccagcgccgccaccacccacgccgttcgcgcgctttaaagaaggcgcgccaccttcgcataagcttaaaagattccccacaccacctcctctcacctcgcgccacgagcgttgatcggtgcttttcattgttcttccttgctgcagaagagacagagagagggagaggcaga

SEQ ID NO: 13786 - DNA, 1501 bp, Oryza sativa
tgtcgtctcgtgccggcttgtggttgccggcggcgccgccctgggcgcctctgcgagcgccaccctcggcgcgtcttcgcgcccaccgcagctggacacctccacacgccttgcgcggcttgcggccgcctgtcgagggagaagactcccccttcatcccgtcaccttgagaggcctcccactgctcccgagtgaaatggagcttcccgccaatggtgataggccccgagaggggctgtggctcatcaccgtcgacgaccttgaggcgacctaacgcctcctcgatcgacatcgtggagaggtccagcagagactcgatcgagcgagcgatctgcctgtacttctctgggacgcagcggaagagcatctcgacagctctctcctcgtcgtaggtgtcgtcaccgtactgcaccatcttctgcaaaagagtgttgagacggagggcaaagtcatcaacatcctcacctggcttgaaggccaggttctcccactccttgcggagtgcctgcagtgtggacttgcgggcgcggtcgctgccgatgcgtgccgcaacgatggcgtcccaggcctccttggcagtccgcttctgggaaagcgagaactgcatctcgggcaagactgcagcgatgagggcatccagtgcccgccgatcctcgtcgtagtcgacgtcgccgtaccggactgcctcccacatgtgctgcacctggagcctcaccctcatcatcgcggcccactcaatgtagttggttttggtgagggtaggccacccacagccgggaccaaagtccctgaccaccgtctggacgccgtggtggccatggcgtcggtcaggggagggagagccgcgctgcctgcgaagccgcgcgtgggctccgggctgctgccggcacgcccgcgcccgtctgggttcccatcggcgggcgcgcggtcccttgggccgccgccgtggaggtgggctgctgcccaccgctctgcccgctcccgtacccttcctcttgccagctcctcaagctccctgtcggcggtgctgtcgccggtgatggaaccgttgatgctactgcgcaaggtttcaacctctacctccgccacacgtgccgcatcttccgccgcctctgcttccgcctccgccctggctgctgccaactccattgccgccagtctggccgccctcgctgctgctgcagcggtctaagccgttgctcgcctgcgctcttctactgcggcgagctcggcgtcctgctgacgccgagtgctcgaggcgaccgaacgccgagaccgaacgtcggacatggcgcaccttcggggggctgctgcctggagagggggaagggaacggggaaggaggagcagccagtgctgctgctgctgctggctgagagctcaaccgagcttgggaaggggtggaacaagagatgtttagcctacaggaaagtgtggctctgataccagatgttagaatttcaatggttactctcattgagaagaggatggcactcgagat

SEQ ID NO: 13787 - DNA, 1501 bp, Oryza sativa
gccgccgctgtcgttgacaaccaacggcagccatccgcgtcgccgccgccccggagttctaccattaaaagggatccaatgtggactctgatcacaatccctaattcctccgctttttcttcaccgggcggcccatataagtcggccttagggcccggattgccaatgcagattacggaactcatatgggcggaataagatcactttgactccctcaactgaccaccgaatctaaattgtatccctcaaccgccagaaatctcgaccccccaaacttgcaaaaccggtgcaatttgactccctcaccggttttgggaggtagtttcgctgacgtggcgccacgtggcgcctatgtggcgatattgaccgagtcttcggtccacgtggcgttgacgtggcacttacgtggtagtagaattaaaaaatatgcgtggacccattagtcattcacacaaaaagaaatgtgggcccactgacatgtggggcccacatgtcagtcctcttcctcctctctatctcccttctctctctttctttccccttcttccccttcggccgacgggcaagagggcggctaacggcatcggaaccggatcgggggaggcaatcggcggctaggacggcggtggctcgcggtagtgggaggacgaggggaacggcagcggcgacttgccgccgctcgtcatccccgtcctcgcggttaccggcgtggtctctgacggctcgcggggtcgtcgttagtgacgaagcgactggcacggggggtgatgaggaggccgctggagaaggccgagggtcgtcctgctcatgtgcgccgcgtcgctccactgcttgaccgccgccaactcggtgctggcggcgcccaagaagctccgatggccgccgccgctctggttccactgcgccccaatggccgccgccgctcccctcgtccgtgcgccgttgcgatcgtcggtggaccccagcggtgcgccgtcgcctacccaccgaggttgagctgggctggccgctcgctctcgctgccctctcgcccaccggccgaatgggaagaaggggagagatggagagaaagagagagaagggagagagggaggaggaagaggactgacatgtgggccccatatgtcagtgggcccacatttctttttgtgtgaatgactaataggtcctacgcatattttttaattctactgccacgtaagtgccgcgtcaacgccacgtggaccgaagactcggtcaatatcgccacataggcgccacgcgccacgtcagcgaaaccacctcccaaaaccggcgagggagtcaaattgcaccggttttgcaagttccgggggtcgagatttctggtattgcggttgagggatatgatttagattcggtggtcagtcgagggagtcaaagtgatcttattcccatatgggctgcacgtaagccacaatccacttccggcccaaacaaatggaattccccaattcccatcaacggacggaaaggttgatcg

SEQ ID NO: 13788 - DNA, 1501 bp, Oryza sativa
ccgtgcccaccgtcaaggataacactgcctctccatacttcaggtcgatcactctcactccagctagctgcttgaactgcattttgttgcatcaatcaaactgaatagtacttgcatctcagctaattaagtctggattagactgaacatgtattaatatcactgtgattgtgcagagtagccaagttgatcggggacaagagagcagtggttgcagagcgagggttcaaccgcccatacaccaagatcctaatcaccaattgtggagtcattgaacagcagcaggagcagtagagtgctttgtttctgccttgcctttcatgtctctagtttgtgcaaagggtaattattattggaactctgtttgcaagaggattttgattactcatggactgatataggcgatggagaggattaaaaaggattgtgaagagatgagagtctttgtaaaacgcatgtcacactgtgcttacagaacaccaacttatgttattaaaaagagatggaggatatattgactaattatcacttggggggaatttaatgagaaggttgatgagatcacgggcgacgccgcatctgtctttcatcttctggtcgacgtcgaccatcaccgagctcaccttggcggcggcgaacgccgcgtcgcacgtgtcagcggcgccactcgccccggacaccaggcgcgacgcggcggcgtagtcgccggagccgaggctgtcgtgcgcgtcgatgtcgaggtcgttggcggcgtcgaagtaggcgccgctgcaggcgcgcagcgcttccccctccggcgcgccgccgccgtacctgctggacctgtcgttgatgagggccccggcgtcgctggctgcggcgacggcgaggtcgagcgcgacgccggcgaggtcggagacggtggaggcgtcggcgctgtccgggttggcggtgagcacggcgacgcacttggcgttgtgggttttgttgcaggtggtggcgatgaagccggcgtcggccatggccacggggacgatggtcgaaatggacagcacgacgacgagcaccatagtcgtcgtcgtcgtcgttgcgtaggtcgccactgccattgctacggcatcagtgtcacttccatggtgcagtgcatatatagtaagtaaggtcaagaatggtgatggcgcggtaattaatcccgttgattttgtagaacgcgatcaacctttccgtccgttgatgggaattggggaattccatttgtttgggccggaagtggattgtggcttacgtgcagcccatatgggaataagatcactttgactccctcgactgaccaccgaatctaaatcatatccctcaaccgcaataccagaaatctcgacccccggaacttgcaaaaccggtgcaatttgactccctcgccggttttgggaggtggtttcgctgacgtggcgcgtggcgcctatgtggcgatattgaccgagtcttcggtccacgtggcgttgacgcggcacttacgtggcag

SEQ ID NO: 13789 - DNA, 1501 bp, Oryza sativa
catatcggcgactgtcataagttgtccttccattcttccatggcaggtgaaccgaaggatttggccaatatatgctggcagtgtcagggccattgtagacgagagtcaaaatattgttactgtcgaagagaaagttgtagaagcctgaatataacaaacccctggcagatgcagataccagctttacattcctagttattggttgcaacggcagaagtgtgtctgttggcgagtcgaagctcctccatagatgctggccttgtaggtccatgacaacaaggtttccattgttgagaagctctgctcgatttgcttgagtggctgttgtgttggtgctccatacaactttgccattgtagtcaagaagggccaaggtcccgtcgttctggaaggtgagcctggagcccttgccattcaccggagcatcgcggttcgccgtccaagcgacagtcttctctgacgacctggaaaaccagatggagaaggtgaaggcgttggtggccaccttgtagaagccacaggagaaatcgtcattgggggacactaggatggcggtggtgtcatcctgggttgaaatggatgaacgcctagtaagaaagctcttttgatcttttgcaacagcagtggggagcatgagaaggaaggatatcactgtggtgaaaatgcagaagcctctcacggcgacggtaagtatttttttggtcatcatccaagttggtgtgttttagaatcaatatgtcatatattgtagtgttctatcacccttgttgagtcctaagcttgcaaatgctgtggctgtttcctgttgcagttttgctacggcatgcatgaacttaaacatgaatgatgaaagcgagcaaacggccagtcgttgattcagcatgtccaggacggcgttgccgagtaccacatgcctgcttggctccgttgctgtctgattcccccaggtgtctggtgacaaacagaacgttgtattggacagggttatggcattcaaaccagaatatttgactggtaatttctatgtaatatgttaggaatatttatagaaccgttatacttatgatagataagtattatgaaagtgatgtctgagaaatatactgggataatttccctgtaccaaatacgaatgtttactccattccatccgtttgcaaatacttctcaatttttaccaagactgcatgttgagtaactatagccaggccagggccacttctgtttgtacagcacatgatagccaaactaaatctttgcaacccaaatatcagcaaattgaacgtataaacactggctaattttgaatctggctggcgttaccaaaaaatttagcaggaaaaaaaaatctggccaaagctgtcaaaaaaatatattggtagtactagcactaatacactaccctccttcccgttataagtgcatttttaaaagctagtgaggaaaataagaggaagaaagctagtgaggaaaataagaggaagagaaaattaccaaagcg

SEQ ID NO: 13790 - DNA, 1501 bp, Oryza sativa
atcttgacgggatctaaatacaccttagtaggaaaacactgttctcacgggtactgttttcttctgtggtactccaacgagcaattattgtccgttcatcgtcgattggacgggtgtgatttacgcaaagctagtatatatggtgcgtagttctttgagtttgctcaatggagtttgatcaatctaagtcagaccatgtatggtttttcttgttttggggacgaaatgcaagcctagggagatggcgaaattcgtaaaaattgattgattttgttcaaaattcgacaaatcctgagcagtttgggtgacgaaatcagacatcgttttggtaggtatcgttttcttctactctataatattattacttacacagttcgggaaagtaaaatccccgatccaccgcccaaaacaaaatatcatacataacaataccctaaccctttatccttttagaaggtaagggtaaacggactatcaaaacaaccttgcgaatgaaacagtacaacagtaatggatgtttcttagggtgatcactactagagaaacaatttttctgaatgagaaccctataggtggaccataattgttgccgcctgcaaaaatcgttttccaggggagtgtttcacgagccacatgtgaaatacattttcatatgcaactccttaagaagtccgcttatgcaaatagacttattttttcagatgagcattttaaatgaataaatggaaaaaatgtattttagaaatctaacttacctcctatttttctagtcgacacttcaaattttttcaagtcatcatccttatatcctcaccttctctctcgcatcctctcctgtatatattatctcccactcctctctctccctcgagttcccctctcaagcgacggcggcaggtggctagctagtggtcggtagcaagaggtggggtggcttagtgacctcgtgtcgtagattggattggtctggcagtttttgagacggggagttgactcagatattaagagttttttctttttcaaggattatcctttctcatctatctcgaaacaaaatacccttaaaatgaggcttttcctaatcttacctaatctgttcctccaaccaaacacgtgtcagagtttcgaaaaagatacatgcatggtttggtatacagcatattgggccttggtaagggacagtggcatactcgtgtacatggctgggccttcagtgaagcaggccgtacgtgcgcgtcaacggcggcggccgccgagaccttcggaattgccctctcgggtggcgccaaattggaggtcgcaggatcgcagcctcgcaggtgataaaatcaccagccactagcgcccgcacgtacgtgtcgcgaactcgcgccacggccgcgccgctcgccgccgtcgagcgacaggcgtccacccctcacgcctgcatggctgccacttcgcctcctcctgcatcttccaacgttgatataaagaccagtgtcataccacgccaagattc

SEQ ID NO: 13791 - DNA, 1062 bp, Oryza sativa
tcaccaacgagaacaagtagctcaagggacaaaaaaggacaaccacaaccaacaaatcaaatcaaatcaccataccagcgccgcactcgaggagcgtcacaccggttgagcttttcgccacgggttgtgaattacttgtggagcaagagaggagaggtgcatggcgatggccggccaggttgtcaccgtcatcgtgtggtgcgattgcaatgtggatagcagcaccctggctagggacgacgtctatggcatgaacgataagcatcctgtcgggtcgacgagttcctagacccaagcttgcctgacggagcgaacgacgggacacgctccttgacaggttccatgagcgcactaatcctagtgctatgccgctacgctccgccgccactctcgtccgccatccgctccgtccacagccagccacctctcagctacctccgctccgccgccgcgctcgcccgccgtccgctctgcccgcaacccgccgccgttctgctaccgtgctcgcccaccgctgcacttgccccgccgctggcccaaagaagggaagagagaagagaagaaaaaagatgtgcggttgacatatgggccccacgtactttttttaatttttttttctaactaggatgccacgtcagcgaaaccacccatatatattgccatagaaccttgtgtgcacggtttgtgcaattctagaggtacacattttttgttttgtggttaagggatcttaaaaaaatctcgctattaagttgagggacctccggtgaacttattccgaagggctttgaattagcaacgctcctacatagtgaattttttttatttttaattttttttattaaaagttttacaaaaataattttccattttgaaaattgacggaagtagtcgcctaccgccctctgggaaggcgatttttaaaaatcgccctcccagagggcggcgaaaatgacgtggcagacggccgttcgctctcgggcgacggccgtcaacgaaatttgcaggcggcccccttgccgccctccgcgagggcgattttgtactgtgcggggggccgcc

SEQ ID NO: 13792 - DNA, 1501 bp, Oryza sativa
gggcggcgacggcggtgctggtggtggtcctcgccgtcgtcgtggcggcggcggcggcggcgaagccgaggaggatactggtggacacggacatggacaccgacgacctcttcgcgctgctctacctcctcaagcagaaccgctccgagttcgagctcaaggttagtgtggtgatgctgcagccacgtacgtctcagcacgtagcgtgtatagcttcttaatttctcttgcatgcatggttgatgacttgattggtggtagtagtagtagtaatggttttgcttaccttcttgcatttctctgcaagtccgcattcctgcctaactaggattatcgtcatgtggatcatatatatccaagcaaagaaaatataggagataatacgttggttaggcattgcctttgatcgttccttgcagtgacaactaatatattgctgcttttgattggagctccatactcttgaaagaaaccaaaaattgctgtttccatgaatgaagcacatgcagctagctagctaatactggcaaacctcataactgttcttcatttctactattgctcttctttcttttttttttgtcgaatgcgtatataatagccatacagtacgtactcgtgagcgatccatattaacatcttcggtcctatcatagttcagtcgatgtctatggccgacaaaacatttccaaacaaaacggtgcatgtcacgactaaccatgtactgcagcagcagactagtagagccgacagttggacctgacaaggaaaaggatcccatgcatccacatgtacggtttaccaagtccctttaatttatcctcttgttttgtgttcaattttggattttgagtaactcgtagtggcttaacataaacataaacaaagagtataaacattggtttagacgattgctatgtgtataaacatttttatgcaatatttatataatatacaaacaactcttataaattgtttgcttattcatttacaacaaattcatataattactggtataattatatatatatatatatggaaatctatactcttttaaaagacactatttttttttgaaaagaaggcaagaaatttgccttatatattgatagagaagggatttaaaagacactattggtggcagtgaatttaccatctacaccatttgttttgtagttttttataagttagtatgatattttctgatatttaacatagtttagtatttgttttaaacaagttaataccatatatttaaataaataaacaagtgatactaatatatttaataaaaatatattttcaatgatattattataatatatatatttttttatccatagtaaagcataagtattttgctagtatggtgtaaaattgcctattaaaccgtgtgctgggatcaacaaaggacattcatattaattctccttacatcctccgtcccaccaaatatcctagcatcatcgcgtagatgccaccaatattgttcatgcctttt

SEQ ID NO: 13793 - DNA, 1501 bp, Oryza sativa
cctcaagatgcgcgtggataaatcctcggtgtttgatatcgacctcgtcagcggcgtcctcgttgaagtgttgccacaaaaaccttatgcgctgtttaattttgttgtctccgaccgtgatgagaggctatttggtatagaggcgatgttcacaattgaggttgctagtgccatccgaacaaacagtgacgagtgggaggactggaatttggcggagaacagtcccgactggtcgcaacttcaggcatcgccgggcaccaatccagttctccataacagcttgctataccttctagctcaagatggaaggttagcagtttatgatccttgcaggcaccatgaaggatttaagattcttgacaagcctaatagcttcggtttcaaatgtgaagacagctacttgctcgagtccaaccaaggtgaattaatggttgtagcgattgaacgacgtgggaagaaggtccatctcgtcaagcttaacgagcaaagcatggagtgggagaaggtagatagcttgcatagccagacagtgttcaccgggtctctaacaacgatgatgaagaagaccaagtttaactggatgcagaatatgatattccttccaagattctaccagtggcctgagaccgtccacgttgaccttgttgctcgcgatggcgaattggcatttgtaccaaagttaccgttctgcgcagatacgtaccttgatacatgtggtacaaacatctggtcttatgaattagcacacggagcagcaacaaaagaattttgggggacagagagggcagattacagtatatgggttgactttggtgataattgatttatacattgttttctatagtatatgtaaatttgtttatatactcccttcgtttctaaatatttaacaccgataaccttttaatatgtttgattgttcgtcttatttaaaaaatttaagtaattattaattttttcctatcatttgatttactgttaaatatacttatatgtatacatatagttttaaatatttcataaaagtttttaataaacgaacggtcaaatatatacttataaagtcaacggcgtccagaaacggaggaagtatgttgtatagagggttctagtatattttaattagttagccgggtaaagttatttttaatcagtataacatgcatacttaacatacagtagtttattaggaggcgaggcctaaccactaattaatccgagctttagggggaatagccttgtggagattatggatatcccatatctacacggcgatagtatttggactgggtacaggatacctaatgtagatagaatatcttatttgtatctcgggtttgtttcttaacttgtgtatcaaggaaacaccctgagacttagtcggtcacgactgtgttttatctgtatcttcctattccgttagggatatagattatcttttgtaatacggactccttcccatatataaggggggtccgggtgcctctaggggcagaggttg

SEQ ID NO: 13794 - DNA, 1501 bp, Oryza sativa
gattaatcatttaaaaaaagaacatccgaaatctcccttcctcccggctcgcgtacagcgtgcgccattattttctctctattttttatctccttatcaactaaaattaaaattatctatatgtaaaaaagacacaaatggacctccatctattacttatatcctgtcaggcgtctaacgactttctactaacttaattaatttctcttaacatgcctatgagggctatgtacatacaaattgaccttgatacttttaaaacgatcttattaggagataaataaatattcataagaaagatgatcatagcatcccaattacacatatgatctatgaagtcactaatcataataggtattcatctaccaatatagacaataggttaaaaataaatgtgtggccagttgaacatcataccaataagcatgtgggttgcacctaggaatcttagcagtgaaacaaccttgaggcagcctttacaattggaaattgagcaaatgttgctagatttaaaacccactgtaaatagaaaaattcaaacattttacgagttctgtttgaatgaaaaaatatataaaaagtaaaatacaatcaatcaaaaaattgatattattggattttttggttgtaagatatcctactggggagttaaatatcctgaattttcttataggaaccacctcctttgtttcgacacaatattttctcatcaattcaaaaccgcatgttctcgagtaattttattttagaatttaaatgttacaagggtaattataagaaaataatcagggttcaaatcacacaaaatacttttaactttataatataataaaaaatattttaataaaaaacacccacatataaatattcataataaaatttcactcattatataagaaggtgcccgcgcatgtgcgcgggctatctttctagttgaaacaaaagttgttcaacctagctagggtcaggcatcaccagtgtcgtcgtattcgccttcgatcggggggctgtattccgtacgtttcgccctacaaaccacgtcgccactgttactatccttgtcgacgccggcgccttggatttgtccattactcagcgccatcaatccagccacggcgtcttgagcggcaagttcgttggctgctcgccggtgacaggtgaactgcaagacatgcatgtctttcacattgatctacttatgtctttcggtgggaggtaacaggtgcccatgcatacgtttagctaattaccattgatcagctgctatatacattgtgttcatacgtactttatcaggataatggaattcaacggtctcccaggagtcgagcagatagcagcagcagcctccggggaggacaacaaccttcggcctcccaaattggaagccgccaatggcagtgtcctctggaatcgatgcgggcggtcgtgagggcctcctgggggcgggcgtctgctacagcctcccgatgttgaggcaaacggtggaaggaggcaacgg

SEQ ID NO: 13795 - DNA, 501 bp, Oryza sativa
tttattttaaaatatgaaattacgattgacataccattcttttttttatatttgtatagatgcattagtattttacatataattattttgattagtcaatatatacagttataatctagacccaccatgattgacaatactgggccttttgccccctctgattaatgtactaatttctaattcttggggtgaaaattgaaaatacacggcagacatatgtagataagatagacaaaatgatagatcaattgattaagagaaacatgtggatatataccaacgataacatataattggttagaacacgtggtaggttttcttataaaatttgtagaacccagtttaatttatttcttttgtgaaatccatacattagaaatcacttgtaatcgttggacctatgtcgatctcttgagcatgtgctaactgctaagggtgcgactgtggcaaatgtgtgcatttgtgtctttcatttaatcgtaaaacatactttggcaaaaa

SEQ ID NO: 13796 - DNA, 1501 bp, Oryza sativa
tgatgctaaaagtacgtatcatgaagttcactttagttactagttagcggtacacaatatataacaaatgacagtccaggatattctgataagacatgagaagatcaaaattaagatgctaacctttccatctctcagtagtgcaagagagatcaaatttccaatgacctgcataattcaaatgtaaatagtcaaagacaccttgtatctgtagagcccacatgtgcagaaagaaatagatgctacacttgagttatgaagaacagatactaaaatatgtcttggcaagttttggtggagaatagctttgtacaaccatacctgtgtgctagcaaacattccccagaactctccattgaagttccccaaagtttggccttcaggcaaattattgtctcttgcatgactgagggcagcagacgtgagatatgtaccctgcagtgtgagatatattatgtgagctggattactggataccagagaagacttatcaagcacactgtcaagtaaatacctgcccaacccagatgatcgatgcagtaaaacccagatacagggaggctggcaccattgtgtacctgataatttgttgcacaaattaaaatccgtatatagaatctcagaatatgttaaacataaaggattcatttctaatagtattttgtgtacctgacaatttgttgcacaaattaacatccatatatagaatctcagcatatgttaaacataaaggattcatttctaatagtattttgcacagctgaaatatttcatagtataatagaaagcacatcaactagggccagaatccatcggccatccatatttgtatgagagtgctatatattaaagaagaaaatgaaacattgttgctggtaaatactccctacgttttttaatagatgacgccgttgacttttgaacacatgtttattcattcatcttattcaaaaattttatgcaaatgtataagatataaataatgcttaaaatactttgagtgataaaacaattcacaaaaaaaataattagataacattttttgaataaaacaaatgatcaaacgtgtgacaaaaagtcaactacgtcatcaattaaaaaactgaggtagtagcatagtaaaaaaaacttgtcgattgttttaactaatttgctgtatgggctctcagctacaccaaaaagggtaacagagcatttaattatcagaaaatgaaaatgcattccgtgcacaaccaaacacttacagtagactggtgagacgagctacactgcaccgccaaattaaaaccatatgatcgattaacaacagtagtacccgtgtctgagcaaaaggagcatcatatcaacacggtctagctaggcatttcatcaaacaggcgtgaggcatccaaaccagcacgcccaattaggcaccagcgataccatgcggaccatgtcaaaaatcaaaaccatgggatccgtaggcgaaggcgtcaaaacccaaaaccatgggatccgtagg

SEQ ID NO: 13797 - DNA, 587 bp, Oryza sativa
caccactctgtgataactatttattgctggaatggaaattttcctatgttttggaggcaaaatcaaattggtggaacaatcctgactgaaatacaggcaaattaccaaatcattggatcagtatttctccttatgtgttgagaagtagtttaattgtattatgtcaaggtccttgaggttaactcctgcatgctaagatatgacacatcgactctgctagtctgcatcctaccttcaatggatgaaaaaaaatgcaatgatatctcaattattgtccagttgcatcaatgtattgcgtaaagcatcagtatttgattccgctagtaaaattgtgagtcctcttcattagtaatgattttcaagccatgggacagaaatcctttttgtcttcttttggtagacataactggttattcccttctgtttgttaatccagaacattatattcttgaacaatctgtgtttgttagctccgtaatcttatattcttatgtcctttattttcttgagtctgacttctgctcctttttcctatgctaacttatgaagacttctgtcctatgctaacttatgacttgtctgggtgc

SEQ ID NO: 13798 - DNA, 1501 bp, Oryza sativa
gctccacccaactccactcctattttaggtggagctgaaactgtttggctgggctctaggagaggtggagctggagttgtgccaaacaaaccatttcttttcgttttaatttggtccattaatttgacttccttttgacatatcgaaatcccgatcgacccatccaaatttgtgggcttaaagaaagcctgctttgatggagttcttttttcctatcgataagattcagatatatatgatccgagaaaaaaataaaataaaaagattgagctagatactttccacgcgaggtaacaaaagtcgattaatcggatgtcatcgacggtgacattttaaaagatggactttttatcctaaagtgaacatgtcctgtatatcatttgaaatagttttgattttttttttataaaaatatagtttgataagatatatcaataatcatcatatccctacacacacaaattcattatacctcaacatgttgcttaaaagaataaattatactctaactacaatacgcacaccatttcatgatcgtatttttttttcaccaaatttaaacttgtatgccgtgaagtaataaatcgtatattaatctgccttgtccttgtccattttgtttaaaaaaattcataactgttttcactgacttgcaagaaatgagagatggtatatatccttaaagagagagaaaaaaaatgctttcactcttttttcttcaattataaaagaaactatttttttcttattattatattgaaagataccacgtgcgcacactagcgcaaccgaaaatagaatagtcccaattaattcccaaatcactagtagtggaaccattttaatactaatccagtacaaacagacgaaccattggaaatatttggaaaataataagatttaagtcaaagaccagtaacccctatcaggacacgacacgctaaaatgatctgatcgagggcttattttaagccagatagcggtggacgagccgacgaatcagctgacaaacacgtcctattcgagcccgatatctcttgatcgctttccctctagttgctgtcagccaaactcagactcaaccaactactgcactagacagtcaaatttaatttgaaataatgcacaaacttagcaagatttaaggagaaatttaacacaaactcacgaaggacaaagtggacgatatatatgataatggcaagtgtgtacagtaccttagaagtgacgattgacaacgctgtattttttttggacgggagagtaagccctgtttattttccaaacaaaatttttgactctatcccatcaaatatttagacacataaatagagtattaaatgtagaaaaaaaaccaattacatagttcgccagaaaattgcgagacgaatcttttaaccataattgtgcaatgatttgacaatatggtgctacaataaatatttgttaatgatggattaattaggcttaataaattcgtcttgtagtttcctggcggaat

SEQ ID NO: 13799 - DNA, 1501 bp, Oryza sativa
gtcaaaattttggtaggattttttatatagctaccaaaatttggcagcaaattaaatatagccacttttttggcaactttactaaaatttgttaaggttgaaaatgacatcaaagtgaacaggcccacgcatccacgaagcgtgcatccacactgagtgaaggtgtagcagatgaatccctgagtgcaccgctagagatgaggtagcagttctgcactacaggaatatcttccatctagattgcatatgagtgaaggtgtagcaattttgcactacagacacctcttccatccagactgtatctacaaagtgtctaatcttaaaggaagaaaaatcgtctaccatcaactgccgctggacctttatctccccattgtcacaagtgagggaaagttgtgagagggaagaaggggatgagctgtagttggagtcagcgtagcttgcaaggtaaccgtaccgattaatccatctccagtggtgtgagaatgtatgcctgatccttaaatgacagagggttagtgttccctaaacctaacctaaacatgcttgattcatgattaactttgcgatgagtaggttaaaaaaatttggtcaacaaaaatataaccttaaggaaaattagctatgaaaccaaattgtcacataagaatttgtggtgtacaaatgcctaccataaaaaagggagaaaaaaagtcatccttaatttggcatcaggcctaccatgctagatgaatttaggtttcaaatgttgtgacattaaaaaacaatatgggcatgttcagtttattgccaaaataaacattttcaaatttttttggtaaagccaagattttgcactaccaaatttttgtcaaggtcaagatgtagaggtgttgtttggctttgacaccttactaaattttgatatagttttgtgaataaaaattattggatttattaaattttggtacaaattgacaatgttacaatggtaaagtctcgttgagtttgttgcactaacaaaattatattaccaaattttggtatagtttgttttggcaacaaattaattgaacaagccatatcaatcaagtcgtggtgtgtggaaaaggagtagctatataacatttgacatttttttaaggagaaaaactttcaaatgcaactatagtgtcattagataatatcattagtgcaattacttaccgtgtaacttgtatataaattataaatacttcctctaccctataatataataatataagtaccggatgaggaagtatatgattaaactgtgagctggcctagcggtagtgttaatcatttcccctagcagtagcttccgcagtcgcaagcagcatgctgtgagtttgattccccttgcccccatttctacgtgaatttttttcttttccccctagtatgcatctcaaaacaaatccgacggttgaaaaatcgaaagtttcctactattctagtgtggaaataccttgtcccatcgctactatccaccaaatcctca

SEQ ID NO: 13800 - DNA, 1501 bp, Oryza sativa
gtgcatctattttattgtgtatttagaatgtgttgtatcgttataaatctttaattttacacatgtatttaaagacgtcctgcgaagcaatcggagaagacaaaacggaacaccagggactgaggaaactagaagccgttaaagctcattctttttaagctagccattttatttgttactataaaaatcatttttccgggcatgcagtcaaaaagatttgcacaaacaatgaacaaaccacccctaataaaagacatgcgaaaattatcaaaattttcacaagcgatattactcgcatgtgaaaattaatttttgttggttggtcatctcaagacacctgcctgtgataacattgttttggaaataaatgaactggtgctcacaaccatcgcagcggaatgcggagagccgttgccgtcattgctgctgtcagggaggcgatggactagatacatcatacaagagccttgtggtcgtcctcacagacttggttcccccaactccagtacgccactgctagatccatgagactcgtagtcattgttgcagccttagctcccccacatccactatgataccgccacatgcatccaggagagcctcacgcgcggtaattattgccatagcctcgactccctctcccctaatgcgttactgccagctctaggagactcactcttttcgctgtagcatcgactccccatcccccatggtgccagctggtcatcgtcgtagccatgactccccctcctccactatgctaccgccacaagaatccagcagagcctcgtgtgcggaaattgccatagcctcggctccctctcctctaatgctatgctgccagctccaggagactctatgttatcgccatagcatcgactccctatcctccatggtgtcggccgatcatcgtcgtagccatgaccccctctcctccactatactatcgccacatgcatcaaggagagcctcgtgcgtggtaattgccatagcctcggctccctctcctttgatgcgttgctgctagctccaggaccatctctgttattgccgcagcatcgactccccatgctccataatgccggccggtcatcgtcgtagccatgactccccctctcctccactgcgccctcgccgtagcatggtgtaaaatcacttattgtcatatagtctcaactttgtactctgtatccattttttccccaacacgtgggagacctgatagtttaagagtaaaacttttactcctacaaattctatacttgaataaaactagcactgtggccaaacatgaagtctatcttgattgtatgtttagtttatatagataaagccttcccaggggctagcttaagaggcttgcttaagaataagaaagatatatatataatatatttcaaaatagtagtgtggaatgtatttatggtgattccataaatattctatcctaaaaatcgaaataatagggacttttcaaagatttggtactgttactaattca

SEQ ID NO: 13801 - DNA, 1501 bp, Oryza sativa
accaaaaacgaaaatatgtaatcactagggagttatttaccataagaaggaggggacgccccaagaattcgccgagtcggcgccatcccagcgcacgaggcgatcacgtcagatcagttcgtaggtctgaattactaagcgcaccagtttgggatgatctcagatcagcgtggctcatatatgatgccctcgcaaccggcgcagaggcgatgcagttttgctgtgcactcgctgctagccaccgtcgcctctcgatctgttgaggtgagtaaatcacggacagaaaaacagaaccaaggcacatatattttttgctgtgttaaaacaaaagaaccatttagaatataaaaactagtaggaggttttttgtaaaatgagatgggatatcactctatgatgctgatgctaacgtgggactttgtccaagatggaaagctgacgtggcaaaaaatcttatgtggcagccttttgaaccataaacgcacccacctagccaagttgttgcatcggtatgtccaattttcaagttctcgcacttaatcgcacccacccgccaagttcttgtaccgtcaacgcaatttactctttaaaatatatggaagtaaaaacattactaaacactaataagtattatagggaaaaatatgaagtgcaaaccctatatgtaatgcaaacgtagaaaataccgttggatcgaaaaatggacgcccgatattcgtccacgtcaacatgagttaaaattttactcgtaaactgtacagcaaaagaatccctgtgagttaataaattgctctagatattacgtttatagaagaaatattgatcagttaaaaatttactatcacataccgaacaaaaatacccattagtaaaaatttcaccaacggcatgaagattttttcactggaaggatcgcctgtcacgtgtatatttcattgaaacgtacaccctccgtcccaaaataagtgcagttttgcactattcacgttcaacgtttgaccgttcgtcttatttgaaatttttttatgatttgtatttttattgctattagatgataaaacatgaatagtactttatgtgtgactaaatatttttaattttttcacaaaattttcaaataagacggacggtcaaacgttaggcatgaatatccacggctgcacttattttgggacggagctagtacgtaccacggcagccaacccctatgagtaattttttaacttcaattacgcccgctccaagtcaaattttataatgagtaatttttttactcagttgtctgttgctgtgggaggggagcagggtggtcgataatcacgtgtttctctcataaaccaactactgtaactgatttagcccacggtaatttttttactctgtttgcacctgcaggatggggatgggtggcgggtctgtacgctggggatgcgggctcccgctctgagtggcgccacggtttagctggcgcgcatcgcctgtgtctcgcgtcacgtagcgt

SEQ ID NO: 13802 - DNA, 1501 bp, Oryza sativa
accaacacttagacgttttcggccgatcgatctcactcggcctctctccttcgccgccactgcctagggcaaatccccgcgccgacgccgccatatctcgccgtcgtctcgaactcgtcgtcctcgccgccgcctccgcctcctccgctgccgccgcatctctggggtgagagccgcgccgccagatctcccttcatctcgatctctctccgtcgcgccgcccgccacgagacgccgcgccacgacgacgacgcgccacgccgacgccgcgccaagccgccgccggcacgccacgccgccgccttcgccggcgcgcgcgcaatgccgccgccggcacgccacgccgccgccttcgccgccgcgcaacgccgccgccgcatgccaacgccacgccgccgccgccgtcgccacgccgccgccgccgtcgacacgccgccgctaccttcgccgccgcgccaaccggcggcccgatgccggcacaccgccgttaacgaacgagaacgagaacgatcgaacgaacgagagcgagaacgaacacgtcaacgtacgttgccgcgagaacgtgtacgagaacgagaacgatcgaacgaacgagagcgagaacgaggacgaacgttaacgtgaaatgcaatatatatatatatatatatatatatatatatatatatatatatatatatatatatatatatatgttacttcgcatttatcctaatacatctttttgtatcttgcagaaaagacgtgttgtcggagtcgtctgtcaagccggagtggaagagctagccctagaaggaattggagcaggcaagtgacgtaataatataaacgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctagcaattgactattgtagtcttaattagacttagcatatacgcacgaaacacttagcatacatgactattttagtcttagcatgtaatattatttgagttttaatataagattactttatttgtaattagacttagtatgtaattattgactacggaattggtgcgacaagtagcaattgactattgtagtcttaattggacttagcatatacgcacgaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacaga

SEQ ID NO: 13803 - DNA, 1501 bp, Oryza sativa
gaggaattcgagagggggagctcgctgcggaggggagaaatcgaggcgcgcgcttgcctgctcgccgagctcgacggcgcgctgcgcggcctggccgcgctcgcgggcgagcttgcgcttctgggccttcttctcgcgcttgagcttcgcgtgcacctccttgcgcttgtccttgttcttgatctgcgacggcagcaccgggtcgggcctctccttcctcggcttcttctccctccggtggtccctcccctcgtcgtcgtcccccggcggcggcgcgtcggcgggctgcctccgcttcctctccttcgccatcgccgtcgccgtcgccgccgtcgtctcgggggaggttgaggtgtgtgttcgtttgggaggtgagggtttaagcgtctagggcaacgtggcatttgatgatatagtgggccgggtttataggcctggttacctagatgggctttcctttccaagatgtgggcacggtgcccatgggctgtatgttgcttggtttgactatggaatcaatcctacaaaatactccctccattccataatataaggcacaactacttttcttatactcccttcgtttcaaaatacttgacaccgttgactttttagtacgtgtttgaccattcgtcttattcaaaaaatttaagtaattatttattcttttcatatcatttgattcattgttaaatatactttcatatacacatatagttttacatatttcacaattttttttggaataagacaaacggtcaaacatgtgctaaaaaatcaacggtgtcaaacattttgaaacggaaggagtattttataatataaggcatgcatgcatgtaagcccttaactatgaccatttctctattaaattattactttttaaaatcctttactctcatgttctctaattctatttgatacatgcattgtatttattaggataataaaactacgagatgataataataattatttttttgtctttgggttagaggtggttatgcctttatattttggaatggagggagtatttgacatttttattagatttcttatttctatgactccatctacatcagataatagtcttcaaaatcgtattatccttttagtgcctttccagggcacgatgaaatttacagagagaaatttgtagaattttggcctgaatgggcaagatgattttgctggagttttcttttacaaccagaactgtataaaatggattgcactaaactcttcttaaaatcgtctaaaatgctttcaaataaaacaaaactaaaaaaagacgcgagatattgttcgattcgacacgacgacactatcccctcccacttccccgactcatcgtcttccacggcctcaccgcgaagccgccggaaaaccaccaccgccaccaccgccaccgctacactcgcgtcgaggtgatcggcgatgttcacctgccggccgctggtgtcccctccgctgccgcggcgcctcgccgtcgcgtcccctc

SEQ ID NO: 13804 - DNA, 1501 bp, Oryza sativa
ttcgtcggcgagggggtgtagaaccaatcgctcttccagtcgtcccactttttgcggaggacgtagggaatgtagcggttcagcacctgcccccgcggctggaagtagcagccaccgactaccgtcggcggcgacaccggctgtacggtgaagaaccaccggaacagccggagaaatgggcgcaccccgataaacatctcgcacaggtgcgcgaagatggccaacgtcattatcgcgttgggggtgaggtgcgccatctggagatcataaaactccagaatatccatgaaaaaaatagagaatggcgggaccagccccgccattgcgaaagagaggaagaagacggaccgccccgggtagtgtggcgccgggcgtccctcgcccagcgcgaccacctcccggccggtggcagattccggcatgaatcggcgcggcagcctggcctgcctctcgctcacgatgcgggaaggcggcagcacgctaccgtcgagcggtgcggagccccgtgccatgacgccggcggaggaggagcttgagagcgagcgagtgcggcaagggtagggcacaggaaacgaagagttagagcacaagtggcgaaggcaaggggaagagtggcgagaggaaagaaacgaatccctttctcggcgtctttacacccttgccaacgctatgcccggctcctcgcttcccgtgcccactacctcgccccctcgtttctcgcgcccacgcctccactaaccccactcgcccgtttgcggcgcacgcggcaaatgtgcggccgtggcggttgagatggggcagattgtgcgcgcattaactacggttgccaaccgtgaaaagcgccatcatcatgtctccaggcgaaacgaaccggctcatcccgattcgcgcgctgctcgagtaatgtagcggtcttaaagaggccgctcattattgtcggtcggttttcccttgccgatgcgcgcgatttgcgaccgctgggtttctgtccgcctgtagggaccggccccacctgtcaccgggcctaaggagtggcgtcacgcccgagcgcttccctcgaggggggcgatcgccctggcgtaacgccgggggctactgtcggtgacatggggccggaggtatcgtgactagaggcttgggtagccgcggtcacccacttggcctgaccccctcgggggggtcgggcccgaggatgacgtggccacccctccctctgtctccccgaggggtcggaccgctcccgtttcggccccgagggctggggcgccccgaccccctgtggttttggcgccacgtgtgtgggttaggtgagcgcagcggggctcacctcgccgcatttatagcaggttggacgagtgcaccacgccgcatttaatgcggcgccgcgcacgcttatccggtccgtgaccggtcgcggtgtgtgaccggtcacagaccggtcagatcgcgggttaggtggcaacaggcggcctgtcacacgcctcgccccgtcccgtcggaa

SEQ ID NO: 13805 - DNA, 1468 bp, Oryza sativa
caaatttacaatctctctatgactcgctaagcgaggggaagcgtcgttggagaattaacgcaggaggcagtgacctggaggtcgttggagagctcgacgtcggcgatggtggtgagggaggagaggtactggtcggcgccgagcgcggcctcggggaggacggcgcgctggaggacggggtcgcgggtgagcatgtccgcgagctcccgctggatctgcttcgccaccatccgcacccgccggtccttcgccatgcaccgcaccacgcgcagcgacgacgccgacgagggaggcggccgcgcgggcgccagaggggacgcgacggcgaggcgccgcggcagcggaggggacaccagcggccggcaggtgaacatcgccgatcacctcgacgcgagtgtagcggtggcggtggtggcggtggtggttttccggcggcttcgcggtgaggccgtggaagacgatgagtcggggaagtgggaggggatagtgtcgtcgtgtcgaatcgaacaatatctcgcgtctttttttagttttgttttatttgaaagcattttagacgattttaagaagagtttagtgcaatccattttatacagttctggttgtaaaagaaaactccagcaaaatcatcttgcccattcaggccaaaattctacaaatttctctctgtaaatttcatcgtgccctggaaaggcactaaaaggataatacgattttgaagactattatctgatgtagatggagtcatagaaataagaaatctaataaaaatgtcaaatactccctccattccaaaatataaaggcataaccacctctaacccaaagacaaaaaaataattattattatcatctcgtagttttattatcctaataaatacaatgcatgtatcaaatagaattagagaacatgagagtaaaggattttaaaaagtaataatttaatagagaaatggtcatagttaagggcttacatgcatgcatgccttatattataaaatactccttccgtttcaaaatgtttgacaccgttgattttttagcacatgtttgaccgtttgtcttattccaaaaaaaattgtgaaatatgtaaaactatatgtgtatatgaaagtatatttaacaatgaatcaaatgatatgaaaagaataaataattacttaaattttttgaataagacgaatggtcaaacacgtactaaaaagtcaacggtgtcaagtattttgaaacgaagggagtataagaaaagtagttgtgccttatattatggaatggagggagtattttgtaggattgattccatagtcaaaccaagcaacatacagcccatgggcaccgtgcccacatcttggaaaggaaagcccatctaggtaaccaggcctataaacccggcccactatatcatcaaatgccacgttgccctagacgcttaaaccctcacctcccaaacgaacacacacctcaacctc

SEQ ID NO: 13806 - DNA, 1501 bp, Oryza sativa
ataacatacgtacgcgaatagtagggcaacttgttgcatgcatgaatgacacggttggagttaaagaatacccgtagtcgctttcatgcatgattgatggattaaaaatcaaataaaaacatacagtattcaattgtccttgaagaaaaagcaacagatgagtatacatgaagtataaactctagtctgccaaaactgtcagcaagtgcagactaattttcatctcgagtgttcagtttgagaccggtccgtattggagaattatttgaaacaagtgaacaatgactataaatgtggtacacaatgctctttagatcataataagagcaagtttaatagtatagccaactactagctctaatttatctatagccaatctaatagcttatccatacaatagttacatactacactattaatacttagtcccacctgtcatacacacactgcgtcttggagtccgtgctacagctggctacaaatctgtagcccgctgctcttctctctccttatttatctccttaaaatatgtttgctattgtacctgctctaaggaacactataagagcaagtttaatagtatagcccactactagcttcaaatcatctatagtcaatgtaatagccaattcatacaatagttgcttactatactattaatatctggtcccacctatcatacacacattacgttttggagtccgtgctgcagctggctatagatctgtagcccgttgctcttctctctctcttcctttatctgtttaaaatatgtttatagctagcttataacctgctattgtacctgctctaaatgtggtacacagtgctcttgttgcaaagattatacattacccaattttatctccgatcatttggccattgcagtattttgattatatatttcgaaaaaaaaatctgttaaagaacaatcaatacactgaacaggaataacaatagcagtgccactagtgatttctgaacattatcactgcagtagtgttacatcttttacatgcagtaattagtatttgtacaagataggagtacatgcgcgtatgtatattcaggcgtggttaatgcctaagcaagagggatgagcacaccactactctacagaagcagctgtaaattaaattaacggttcgatctgcaggccagggcgtacttatattattatctataccatcttaaaaagacagcaaccgtggtgtccgttcccacaactgccatgctgacttgtgggcccacattgtcggtgagagggggaaaggatccggccgcgtgcgtgtggggcggagaggtggcgaaatacgagcagcctgcagggagggggtgccggttccgcccttcccatcgccgacgccggcggaccttcacggttgcatgccgctgacgcccgagctcaccgccgccgctgctcttgcttcgcccgctgctcgaacccgtcgcggacaggcggcgggatccgtcgacgagaggggggatagagaagggtggg

SEQ ID NO: 13807 - DNA, 1501 bp, Oryza sativa
cgccgtctaccgcccttcttccctccagccgctggccgccgttcttctctctcttcgcgcgcgctcgctggccatccacttccgccgggaggcctctccgccaccctcgttggcctcccctcgtcctccctctccactatctcatctccaactcgtcatctcccggtggggcggcggcgtgtggtgctagtagtcgtcgtcgtcgggcaaggagggagagggggccttcttgccaccggcctgctccgaccaccacccaacctgctatgcttgccgaggaagggagaaagagagaagaagggagaaacagagaggatagagatgacatgtggggctacatgggccctaccttttttttcattattttgtgtgaaactgacatgtgggccccatagggttcattattatatttggatcaaattgccacgtaagcgccacgcaagtgccacgtcggacgaagacctagtcaaacaatatacgtaggcgccatattggtcaaaaccggggtcaaatactgccgagggatctcgattgcacggttttaaaagttggaggacgtgctgtacccggttttcctgtctagggacgaaattaactgagcgacaaattaagggacctagagtgaacttattatattcccggccggcatcaagtggaccggcacatgggccgtgcttgggctggcccagcccatcggattattaggccgtgctcggccggcgtctctgaggaaggcggcaagtcggcagtcggcgcgacaagctcggcacagcgtgtgcatccacaagtcggaattccaatgtgcatctgaggctaggaaaacataaggcactactgctactgtgctactgtcctaccgtgctgtaccttgcgtagttgcgtgggagcaagacgtatccccaaaaaacaggatggtatacaaaacaaccctaagatgaatccaaaatctgaaactaaatatatatttcgaaacgactgtatactccccaaattccgtcatggcgatggcactgttctgcttagggattaactaacgatcatcaagtgcacctaacagccgtacgtacatagctgccaattaattaatccttcgtcctcaccatccaaaatgttttaattaactcctgcacgcgtacgtacgtaccctgtgccggatggcacagtacgatcgaaccccataccatacgcttccaaagagaaagcagtcgcttcttgctaatcaaatccatcatgagagacacgctccgctggactctctcgtcctctagcttcacatgcgatgttaggcgtcctgtcgctgcctcagttgcttgatcctactctttctccataaaaaaataaactaattctgagtttcaacctagacacatatatatatccagatttaaactaaaaattagtttttttttttgacgaagagagtagctctcgctcttctctctccctgccctcaaccaccaccacctcctcgatccagtaccctccaatccagtcccacctc

SEQ ID NO: 13808 - DNA, 1501 bp, Oryza sativa
gcttttagcccttgcactggtagatgttgaggcagctgcgtccgctgtacggctggcccctgccggggcaggagccgtagcacgccgccttgctctccgtgagcccgttgtagctggcgtaccggctgtcgtagaggatcctcctccgcgggtacgctgcctcctcctcctccaccacgctcgccaccacgtcctcgacgtcagccacccggccgcgcagcacgtgcatcggcaacaaggcgccgctgctgccgacatccaccgccgccaccagcaccaacgccgcggcgacgacggtggcggcgaagaggagcatcagcttcatactgtatgtcagtacttgggctagctgctagctagctgagacgaataaaaatggggtggtttttgtgctgtttagctatgtatttaagaggaggtgggactggattggagggtactggatcgaggaggtggtggtggttgagggcagggagagagaagagcgagagctactctcttcgtcaaaaaaaaaaactaatttttagtttaaatctggatatatatatgtgtctaggttgaaactcagaattagtttatttttttatggagaaagagtaggatcaagcaactgaggcagcgacaggacgcctaacatcgcatgtgaagctagaggacgagagagtccagcggagcgtgtctctcatgatggatttgattagcaagaagcgactgctttctctttggaagcgtatggtatggggttcgatcgtactgtgccatccggcacagggtacgtacgtacgcgtgcaggagttaattaaaacattttggatggtgaggacgaaggattaattaattggcagctatgtacgtacggctgttaggtgcacttgatgatcgttagttaatccctaagcagaacagtgccatcgccatgacggaatttggggagtatacagtcgtttcgaaatatatatttagtttcagattttggattcatcttagggttgttttgtataccatcctgttttttggggatacgtcttgctcccacgcaactacgcaaggtacagcacggtaggacagtagcacagtagcagtagtgccttatgttttcctagcctcagatgcacattggaattccgacttgtggatgcacacgctgtgccgagcttgtcgcgccgactgccgacttgccgccttcctcagagacgccggccgagcacggcctaataatccgatgggctgggccagcccaagcacggcccatgtgccggtccacttgatgccggccgggaatataataagttcactctaggtcccttaatttgtcgctcagttaatttcgtccctagacaggaaaaccgggtacagcacgtcctccaacttttaaaaccgtgcaatcgagatccctcggcagtatttgaccccggttttgaccaatatggcgcctacgtatattgtttgactaggtcttcgtccgacgtggcacttgcgtggcgcttacgtggcaatttga

SEQ ID NO: 13809 - DNA, 1501 bp, Oryza sativa
agcttctgccctcgccgcccgtgcaccgcttctcccccgccgttcggccccaaccgcaccgtcgcatccatggcagatgctgggtggcacaagattgtggcaacaacggtccctcctgccgtgcgatcacccgccgccggcgctctactccgcctgccacacgctcggccgacatcgccgctccgcctgcttcagccgccagctccgctccgccacagccgacgccctgctccactctgccggccgccatccttgccatctcctccgccgcgacgagctcaagccccggcgaccgacaccgccccatgcgcctcagagagagaacatatatagagagagagaggagaagagagacaggagatagagctgacatatgtgtccaagggcatttttgatatttcacgcgatttctctctcatcttcaaccagaaattattattttaattgacgcggtgtccactggcaaattaccacgtttatagagtgttttcccccaaaagtgagtttgggcagtgtcgtaggactaaaaccatacataagcagtattctgtagcaaaaattgccttctaaaaaatatcaaataaaataagttgttaactatagtaatcaagatctatcatttttttaattttgtagttgccaaaaaaaaaccaaaaagtattctgaattttaataagcatctatacactctgcgcacccaagttgcaagccaaactatttttttcatgaaatacgcacgcatgtgccgtgtataagatttgaacttgagacttcttagtctacacacatcatcactatcaactactatcagatacttgtgatgaggctcctctaacgtaccatagagggacatacgtttctgatgtgtgggtccatgaggttggtcccaccggttagggactcatatccctcggattttaagtcagaggagctgtgttttaaatacttattgtttagaattaagatgctattattttaacttcatatctcaaaatcttattgtgcttatttagtcacctaaataatcttgagtaaagaagtcatcaattacaaagttgatgtagctagccagagtttttgaacatgtaaaacaaggattcagaatatatatatctccttgcgaacccagccgcggccgcacggccgcacagagaggttattcgattacgcaaacatatcgatcttatcctcaaagatgatcttcccaagtcaaacgactcgatctcatgaaaacaaccagcaagactcgacccataatttttacatatatactccgtattactgtaattaacttgctgcatgccccctgcatgagaagccgataatatttttgtaaaagccatagggcaccgatcgatcagccgaggggcatgaaatttcttgcgcgaatcgtttactctagttattttaggtcctcgaccgagaacaaacgcgttgtcttgtaacatagaagaaattgacattggcacgccacttctcaaaacttgcatgcatgctactg

SEQ ID NO: 13810 - DNA, 1501 bp, Oryza sativa
tgtgcatttgtgctgtgcatatatgtctgtatgattaaacttgataactactaataattacacctgtagtgctcgtgcaaatgagaaaaaaaataattgctgaaactatactccttgtaaagtttgcataaacaaatcaagatgggcatgcagtactgtctgcctgatcatcatgggtgctctctctgaagtctgaaatattcctagatctagctgaatgaggcagatgaactcaaattaaattaataattaagatggatggatggatcatgggtcggacagccaggttagctgggttaatcaattagcatgcggctctccccccaatgatttgctcatgtcatgggtgtggtttgcaaatctgcagtaaggaagcagccagcgagcgagcgaggcgacggttgatggatgggtggatgctggagaggagaggagaggagactgcgcgcacgggggctacgcgacgaatccgccatgggaaatgattggttttgatcggtggcgcgcgcgcgagcatgtggctcggccgccggatcgccggacatgccaggtgcgcgcggtcgcgggagccagagggatcttctctctcatcttttcctccctctctctctctctgtgttttttttattactcctcttcttcttctttcctctctggcggcggcggcggcgtcttctccggcgccggcctggtcgcccacagatttagttgggattcaaatgggcccattttatttctgcagcccaacacgaacgggattgcggcccatataccatgttgggctcgagcgggattttcaccaacgtacagcccatatgtatttgggctggaacgggataggagacgaggggaagagaagataggagaggaagaattaaaataccttattaagggtctgtttggtacagcttcaactcctaaatataactccaggagttgaatctggagtggagttgtggagctgcctaaaccgagatccacaattctagtacattttgtgagagagctccacccaactccactcctagtttcggtggagcgtttggctgagctctagctctaggagaggtggagctggagctgtgccaaacagaccttaagatttgccacttacacgtaggcactatatgtttttttatttattttgtttttgctaactagtatgccacgtcaacaaaatcagccatccatattattatgggatctaatttaacccagttttgcaggttgtgggttaagatttttggtattgtggttgagatgtacaaattaaaatcgacgaaaacataacgaacgtaaagtggacttattcgaacgggattaccagctacgtgtggcccgtataatttgggccgggaagggtttggcccacttatgcgtggcccattctagttgggtcgatatattgctcaaggcccatttaccccttcgtttccgttacggcttctcgtctcctctccccttttcacgccatggccgagcgatctcccggccgccggaa

SEQ ID NO: 13811 - DNA, 706 bp, Oryza sativa
tcagcgatcaaaccaacggcggaagcgccaccgatgaatccaaggtggagttcggccggagcttactgagcgtagtgaagtccttgaaggagagcgacttgagggaggggttgtgctcgacggagttggcctcgtagaaccagtgcgcctgctccagcaagaacaggatccgctcgaacgactccaaatcctctttgggcacgttgagcacgaagcggctgttatttttccgtttccaccggcgattcgattcagtttttttccggggggtttgatctgagcaaaagccgagaagactctcgcgagatggatgggatcgagggtttgggatgggggctacctgcagagatcgtcgagaagctcctgcggcggcagctgccccctcgacgacgaccggtagagccccccggcgcgcgctatcgatatccaccgccgccggggcggcgcccggtctcccaccccttctttcccttttttggttgccctcgggaatccattgcttgttaggttgcggcccagttcacaaggcgcactttaatttaacgtaaactcttttcgaagacggaaaggtgggccgtgggctacaccctaataaggcgtaattttattttacgtaaacgagtttggaaggcggaaagtgtgggggcaaacagtagtagattaaaaatcggaggagagagacagcgaaggagcggaggagccgagg

SEQ ID NO: 13812 - DNA, 1501 bp, Oryza sativa
gctccggtcggggggcagcgccgaccacgcccaccgctgccgccggagctcgcctgctccactgctcacccgcgccgtcctctgcccgggaagaagagagagaagggagagggaagaagagaggagtgaggctgacatttggggcccatatggcaccaccattttaaaattatttctttttgcagctgacatgtggggccacacttttttttattttgctgagatatagttgccacgtgagcgccacgtcaagctacgtgggacggagacctagtcaaacaagccacgtatgcgccacgtcagctaaaaccgccttcaaaaccaccgaaggaccttgtttgcccggtttccgtaagttgggggacgggtcatgcccgattttacggtcaaggggacgaaaatcggactgggcgacaaatagagggacccaaagtgaacttattccatatccaaatccaaaacttcacttatttgtgtggcccaataggaccgattttgctcggaggatagtatggctttgggtgggccggattcagcccaattaatggctcattcgccgggaagaaaagctgggcttccttttcctgagaagaagaaaaaatgcagaggaaaatttctccttagcgacgacgaggcggcgggcggccactctccagtgtcatttgcccgcctcacctgcactctctccatctctctcctccggcgaaggcgcggcgcggcggcgttctccccccgcctcgcctcctcctcctcgcgcgcgcggccgcggcgagccaggctcggaggcggcggcgttgacgggacgggctcctctcctctcctccccgaccacaccctaccttcgcccccgcgctgcctcctcgcgcgcacggccgggagacaagccaggggcgacgcggccggcctcgctccgctcggctccatctcggttccagtcgaattggaggtatccattctccctctctcagtctctctcctgctgcctcgcgccacctcatgagccggcgtccgcctctgatgctgcggattctgaaatttttggtttacactggtgtccaattcttcaatctcaagttggggtttaatacccgaccacccaaacctagaccgaagggtagatgcaggatcgtactagagattgttgagttgctgcagaatttaacttctggataggtaggtagtttgtgcagtttggaagaggggatggacatttttgggcatgggttacgttagttgtttgtcctagggggaaactgatcgtttgttgggttcgtggtggctactccatcaatgtaagtggaaggatactgtggcttcttacttctattatgttcatggtgcctgctcatttgatctgacatcatgttcacttcttcaagcaacctatctaagtgtacatttgaagtttctggaagaaacttctgatcttgtctactgtttttcttggataagtttcgctgccaacagttgctgattgtactattcccccagaatgcttaaa

SEQ ID NO: 13813 - DNA, 1501 bp, Oryza sativa
gtatagcatgattcattatggagtgccagactgagaagcggcgagaagtccgtgggggtcgctggggagtccatgcctctggttgtagagggtgattatgatccaggtacggtgcactgtggtgagttgtgttatgcaaggggtattgtcacagttcctttccgaggtatcgtggtggtactaaggcgcatggtaacatgttgtgggaatgtgtcttgtgggtacagtggtacacctctgatcagagtttaatctattcgaataggcgtacccgcggttatgggtgagttgagcaatgtttttcgtgattagtcccatgttattcattaatggtaattgtgataatcaatttgactcctggtttggaatggtatattcctggtatggaggttagatttgtacaaccggggttggttgttcatatgaggttggccctatgcaacatgggtgtgttgtatggtgttatttaatactgattaattattcaactgtttttaccattctcttaaatatttattaaatgctgtttctacaaatgagctatattatgccatcctttgttatcttgtgcacttgcatatttgctgtgtgacttgttgagtatgtcatatgctcattcttgcaatattcaatcatcagaagaggagtatctcagtgaaggtgatgatctggaggattaggcttgttctggttaagttgcctgtggagtggagtcgccatagctcttccgtagtttgttatagtcttatttttccgctgcgtagaaggttattctttgagaggaactatctacctctgtaatattttattgtttgcgagtattaaatagttatttacttgtactctattatcaatttgttattgtgtgcctcggttgattcctggacgagggtttaacacacatgtaagcgtttggaattttggatagaaattccgggcgtgacaagttggtatcagagccaccttgaccttaggataagccaaatggtaaaccttaagtagccttcaaaatattttgaaaaaaattagaactgctcttctctattctcttacaaattaattaagttggccgcacatgcaaggttatgcacaaaattaatttaattcattttcttttcttttaaaagaaaaaaaaattttcttctcaaaatgtttcttattccgccttagtaaacttcattgattagtcagcactgtacatctattatggtatcgatacaatcatgatagcactagtactactcatccttcttatggtgacactgtaccgtgcttataatagatcataagtattttagttttattttagttatttgtcaaaaaaaaaaattatttgtctctgtccaaaaagttaaattctaaatatatatatatataatagcttagtatgtgtcttttcttttattttttcttcctctttggtcaaatcagttaagtctagatggtgcagctaacttaaaaaaaaatatgcattaattcctctcttctatgtttctttaga

SEQ ID NO: 13814 - DNA, 1501 bp, Oryza sativa
ggcaagtcacacagatcctaaacacaatcctttgagcatgttgatcctatatttaaattctctatttatttcaactgtgcatttatttttgaatgtcaccgggtggtgtgaaccttttcctttgttatggccaatttgcattgaatgctctattccttgataccttgggtaataaattgattagcttgaaccttatgtattggtttggttcagctaaatgttatatatatataattgcttagccatgtttagaaacattagctcactaatgggatgaatcatatatactacattattattatggttatatttaatggtagctcacgatggttaatcgtgttatgataattaattggtaattaaaatatgattaatggtgggttgtgagcacatggttttgaaggtcgtgctcatggcaattaaggaccggttcgcgagctactgttgtgaaacatttatcgtgccaaccacaagccagcgtgggcaacggctttatcctttgtatagcatgattcattatagtgcgccagactgagaagtggcgagaagtccattgtcgcgaccgggaaaattgccttttcccgaacgctagtgtattaatccccgtcccaggaaaagccggggtacaccacacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacttcttctccaaagcttctcttactgaagaggggaaagattgagcaagaatgagtacaaccacagtactcagcaagccacaccggggatgcacaattaatgcaaaggagtacaaggggataataatatagaggttaagttttgcagtaaacagcatttaaaagccacttagttgcccaaagccattttgtaaagacgatcctagagctacacagtattattaatcaaggccgtgaaccctcacgaacctgccttaacccaaggcctacgatgattcggaccgaactggcaacccgaccctgggtcccagctcgtcccaagccaacccaggccaaccattccatattttagttgttgagcaaattttaagaattaaaacactgacttgggtacattgctaggcttgcccatatccgagggctcggctattcgaatagatttactctgatcagaggtgtacatctttacccacaagacacatctttactccgcattccatggccttggaacccgtcgtaaagatgtgacataacccttcacccatcctagccgtgaacaaaagtaccgacccaatcccacctacggccgggatacccgggacaggcaggcagaactgagcccctagcagcagggcaccaaccctctgccatacgacatctcgactaccgggccgcagctcgtgtagccttcatttgccctggaga

SEQ ID NO: 13815 - DNA, 1501 bp, Oryza sativa
tttgaaggctacttaaggtttaccatttggcttatcctaaggtcaaggtggctctgataccaacttgtcacgcccggaatttctatccaaaattccaaacgcttacatgtgtgttaaaccctcgtccaggaatcaaccgaggcacacaataacaaattgataatagagtacaagtaaataactatttaatactcgcaaacaataaaatattacagaggtagatagttcctctcaaagaataaccttctacgcagcggaaaaataagactataacaaactacggaagagctatggcgactccactccacaggcaacttaaccagaacaagcctaatcctccagatcatcaccttcactgagatactcctcttctgatgattgaatattgcaagaatgagcatatgacatactcaacaagtcacacagcaaatatgcaagtgcacaagataacaaaggatggcataatatagctcatttgtagaaacagcatttaataaatatttaagagaatggtaaaaacagttgaataattaatcagtattaaataacaccatacaacacacccatgttgcatagggccaacctcatatgaacaaccaaccccggttgtacaaatctaacctccataccaggaatataccattccaaaccaggagtcaaattgattatcacaattaccattaatgaataacatgggactaatcacgaaaaacattgctcaactcacccataaccgcgggtacgcctattcgaatagattaaactctgatcagaggtgtaccactgtacccacaagacacattcccacaacatgttaccatgcgccttagtaccaccacgatacctcggaaaggaactgtgacaataccccttgcataacacaactcaccacagtgcaccgtacctggatcataatcaccctctacaaccagaggcatggactccccagcgacccccacggacttctcgccgcttctcagtctggcactccataatgaatcatgctatacaaaaggtaaagccgttgcccacgctggcttgtggttggcacggtaaaagtttcacaacagtagctcgcgaaccggtccttaattgtcatgagcacaaccatcaaaaccatatgctcacaacccaccttaaccaggttttaattatcaattaattaacatcacacgatcacccatcgtgagctaccatttaatgtaaccataattaaaataataatgtaacatagtctataattaatccctttagttagctaatgtttctaagcacggctaagcaaacttacatatagcatttagctgaaccaatccaacatataaggttcatgttaatcaaattataacccataggaaaataagatcatcttcggccgttaattaattgggaaggttcaccacccgatgacattcgaaaacaatgcatagttgaaataaaataatagctttaaacgggtttaacatgctcaaagagttgtttgggatctgtgtgacttgcc

SEQ ID NO: 13816 - DNA, 1501 bp, Oryza sativa
cccaatgaatccaagaggcacaagtccattaatgtggatgggtgctcgtaaaaaaaatggatagaaacatcattgagactagtttcctagcctaaaaattgcatagaaacatcatcaatggccacctctccacttccttctcatccttgattatcccatgagcaaggaagtcataggggatagttaactatataggaataaaataggtatgttgagaatcactaaagaagttttgtattgctcggcattgactaaggaccacgaaggttcagaaaaatagcacgaaaaaatatcagttaacacatggtatctcgtttacgaaaaggtaaggagatattacccaagacacatttatttccaaccataactgtactcatacatccatttgtaaactcccatattatagttatagctacaaataaagaccccctactcccctcaaaaaaaaaaaaaagaccccctacttcaatatattatagttatagttgtaactcccatttggtaacagtggtggaggcttggagccaaattaatgggaggggtctttaaggtagattaaaatcaatctatttgtgtctctactattataaatgaatctagcctagtgaggttgcgatcccagtaccatgcattttaccaacgtaccatggaatcttttgtacatatacatatatttattatttgaataaccttttttttcagctcatgtcaattagcaaaactatattggctgaaatagattttcaatggcggttactaactcggaacctcatgttgtattttcgctgacagttttcgcgtatggtcgccagagaaaataataaggtgatgtcaagaaaaatcgattttgtggtagtgctatatgcaatttttcaagtacagaatttatgatacactgctaatttcatatcatggcacactggtcagttagcaaggcacggataattgtctagttgcattgaaaaatttacaagtgcagctcaaaatagcacgttggtcagtagatggaacagattaaactacttgatcatccacatgagcggtggaatatataactaatagcctctgtacttacactgttttttaatccatctaacaccaaataaatatggagtagatattgcatgttgacttgatgccaacaaatcaaaaaaaaattaaaccattctgcctgatttgcaggagcctgatcatgccacctacaagcaagccatttcacacctcaagggtccatgccatggaagatcacaaacagctcatccatttgacctaattttgttcccaaatctaaccaagcattttcctatgcccctgcacaggcttgtctcacctctaattgcatcatcaggagaaaggaagaagaggaaacaaacaaatcttctgcaagaaacaaaactcagcacacccccctgctttgtcatttgttcatctgtcccagtggacactatccaatgccaaaagctgatagatcttcaggctgaaatggacatcttcagaaatg

SEQ ID NO: 13817 - DNA, 1501 bp, Oryza sativa
ggttgtgtcatgcactttttcttaaaccaatgtgtatcatatcagatatgtcctcgtttagatttgcttgattatcatatatcttcaggtggtatacctatgcgacttcattggcaaatgttggtgttaacaactcgagtgtgctcatttcatcagtactactaagaggggatcgcagagagttaacctttgtacctgtacctaaacactagaattactccctccaatgactcaatgagtaccgttgtgagtgaaaaaatctaagatcagaccccggccatttgtcatcttgagaagggagatgaacattggcacattgcatggtctgggattttgttactcccttcgataaaaaataagtgatattttagaggacgtgtagtcagcacgtttaaactttgactatcaatttttcttcaaatattttgattcaaaatttgaaaataatatggttaaatttttcaaaaaaaaggtttcaaaatattatgactgtgctttatttattggtggtagtaattaataatcaattttttggttaccatgccactgtccaacacgtcactaaatcactaatttcgtgaccgaatggagtacttctttcattataaaataataaatcaacttttgtatgtgaagccggatcctatctttttctttagctaaatctctagacaaaaaaaatgtagacttcttgtgtcagtctaatgtgacattaatttcctagcttcggtggtggtcatactacatattgaattattgatcatgctctaagacgatttcttactctcgtttttcctttaatatattaatgctctatcaatgtttgataggagtagctttaatttccgtttcttaaacacgtagtagtgtgattgcttttgttcagtgttttcttgttgtttgcccttcagtacaggtgcttaaagccttaaattaaccctagtcaacttaatttatcgcttaaaaaatgacatatttgtgccagggtttggtgacaagggacatgcttaccagagatgtccccctgccagcttaattatctctctctatcaattcttaatcaagtcaaaccggatcaaaaatcagatttaattaattaattagcttggataaaacacagttgctgtgattgttaggctgtgttcacaactcacaacttcacaagtccatgttcccaacttcccaactttactcggtcgtttactgcgcacattttttaaactgctaatcggtatgtgttttgtaaaaatttctataaaaaagttgctttaaaaaatcatattaatttattttttttttaattttttaagctaataataattaatcacacattaattcattgttccgttttccattatacaactccagtacatattttaagttggtgcaaatacgaatttatacttccatatcgtaaaaataaactaagataatacacagagatgatgattaaaataccggaaactgcagaaatcaagcagatcatctgggccatggactc

SEQ ID NO: 13818 - DNA, 1501 bp, Oryza sativa
ttggttggctgatgccttgtcctgcgacgtcgtgcatggcgtggcgtggcgtggcgtggcgtgacatggcaggaagggtacatcgtgccgcgctcgccggcggtggaggcggtgcccatggacaagctgccgcggccggtgatcttccacgacggccgcctcgcgcggcggccgactccgctggcggcgctgctcgccgtgctctggttccccgtggggttcgcgctggcgtgcgtccgcatcgcggcgggcgcgctgctgccgatgccgtgggtgtactacgcgttctgggcgctgggcgtgcgcgtcgtggtgcgcggcgcgccgccgccgcgcgcggagcgcgccgcggggcgccgcggggtgctcttcgcctgctcccaccgtacgctgctcgacccgatcttcctctcggcggcgctcggccgccccgtggccgccgtcacctactcgctgtcgcggctgtcggagttcctgtcgccgatcaggacggtgcggctgacgcgggaccgcgccgccgacgccgccatgatcggcgagctcctcgacgagggcgacctggcgatctgccccgaggggacgacgtgccgggagccgttcctgctgcggttctcggcgctgttcgcggagctcaccgacgaggtggtgccggtggcgatggagagccggatgggcatgttccacggcacgacggcgagggggtggaaggggatggaccccttctacttcttcatgaaccccagcccggcgtacgtcgtcacgttcctcggcaagctgccgccggagcacacctgcggcgccggcggcaggtccagccacgaggtggccaactacatccagaggctcatcgccgccacgctctcctacgagtgcaccagcctcaccaggaaggacaagtacagggcgctcgccggcaacgacggcgtcgtcgacaacgccaccggcaagctgccatcgccggcgacggcgacggcgaacaacagcaaggacaaagcttgctaggagaagggaaaaaaaagggggaagtggatgttctagtagtgtaaaactataatgttattaatttttacctgtgtcgatttgcatggggcggtaaatttcctctttcttttggttatttgtactgtgtatgcacttgcaatgtaccaacggggagttgaatgcaatttgcataagtaaaagcaatgggccaggacaagcaaactattcttgtgagtcagaaactcagaagcatgcatctttctgcaggcaacagctaagaacataaaagcaaatttatttggtttggtagattgggtatcacacattacacataggccagggcataggtgttccattcgattcggcaactgaacaacaacccaacaagtaaaacgacaccagacattattgatatatacatactacgagtctacttatcaaatctggtccagatcaattgagttgtctctcgtttttgtaaattgcaagcaaccagtttcaccagaagaataactttcct

SEQ ID NO: 13819 - DNA, 1501 bp, Oryza sativa
agggagaatcggaaccttgctcggcaaaggtccaatatatttaatttttcccaatctttcatggaccccaatatcacaactaaagttgattcatttacctaatccccaaagctgggtgacaaatgaaaatcagtgttgatgtgcttttgaataaagcaacacttttatataagaaatttctggataattatgaaatggcaagcatttggtagccatattttcgatgacatgttaggcttttagagagtaaacatattcaagaacaaattcatatttcagtaacacgacctttacaaagtaaatacaagttgatctttccaggtaataagaccccttgcaaacttgctcatgatcctgatagaagtttcatacagtggttgttttgtaagctatggatttgtgtcaaaatagggggggaaatatagggaatacatccataaattacacttcaataggcatatgtaccgtttatctggctatcctaaaccagatctgttactaaggtgtaacacattttccccaatttgtcatcccaaccaaccacaaatcctgaacgcagactcattgcactgtaacaaggtcctaaaacaaaatctcattgataatgtgaaccacacatgacaaaactccttaattagcaccggaaggcccaagggtttgcttaatccatattgatccatgggctattgctagagaacaaacattgctaccgaagaacgcatcaaaagcacaatcaagaatagacgccatcaacccatttgctatgactcatgagagcaaccacggcccagcctgagtcatccaccacaccacagcaacaattgggtgtgtttggttgcttgcattttcctagcctggctcatctctttcatcctggttgagtctagcccagatgaagagatacacatgcaactgttttggttgtttgcatcggtttagcccggctgagatgagattttgtttggttgagtgcatgagagatgcggtttggaaaatattttgtttggttggttggatagatttgagtctggttacctcttcatttaattgggtgaggttacctctataatatcccatacaaaaatttcaaatctagacaataggtataaacaatttttcacatacaaagaataatattggtattaaaaatcagccagcattctttgcaccaaagcgaaatttgttgagttctcaaaaaaaaaaagtcaccaaaatttccccaccatttgactgcaaagcgctggaaaaaaaaagaaaagaaagatagaagcgtttgtcctcctcattgtcgtcgaggagaggagttcttgcctcatcgctgccagccgttcccggctcctctgccgccggccggccagtaccacgctcctccgtcgctggcctctcatacggatctgccacgcgcgctcctccgctcttctctcaattgaaaatagaaaagagaaaacaaaaaaaaatcccctcaatctcatcgttgacttgcttcaccggcgctcccagc

SEQ ID NO: 13820 - DNA, 1501 bp, Oryza sativa
cttaacgttttcggccgatcgatctctctcggcctctctccttcgccgccactgcctagggcaaatccccgcgccgacgccgccgtatctcgccgtcgtctcgagctcgtcgtcctcgccgccgcctccgcctcctccgctgccgccgcatctctggggtgagagccgccgcatctcccttcatgcatctcgatctctccgatctcgatctctctccgtcgccttcgacgccgccgccttcgacgccgcgcaacgccgccgccgcatgccaacgccacgccgccgccgccttcgccgccgcgcgcgcaatgccgccgccgccacgccacgccgccgccgccacgccacgccacgccaccgccgccacgccacgccgccgccgccacggccccacaacgccacgccgccgccgccgtcgccacgccgccgccgccgtcgccacgccgccgcgccaaccgccgccccgatgccgccacaccgccgttaacgaacgagaacgagaacgatcgaacgaacgagagcgagaacgaacacgtcaacgtacgttgccgcgacaacgtgaacgagaacgacaacgatcgaacgaacgtgaacgagctagggaacgtgaacgagcgaacgaacgaggacgaacgttaacgtgaaatgcaatatatatatatatatacatgtatatatatatacatatatatatatgttacttcgcatttatcctaatacattttttttatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgctcctaggaattgactattgtagtcttaattagacttagcatatacgcacgaaacacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttagtattagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacaga

SEQ ID NO: 13821 - DNA, 1501 bp, Oryza sativa
gatggaggcataccacttgatttgggggactggttgttccagactccccactgtatgtcatgaggcgcctgccaccggctctcgctggcactttcccagctcgagactccaatgctatggcgtggagcttgggtctatccgggtgcatccccagttggctcccaaacagcctcatacatctgtacgggtgttgaggacgttgaaccttcatgttcattccttgccatgttgtgtgtcttcctgtatgtgcacgagattcttctatggtatgcaggggaatagttagttcatgacagttgtacaaatgatatcccgcgttaggcaacgtgatttcatttgtacaaccagggaagaagtatatcaaagatctatctactccaggtttaagaatatgccctttcactagataactctcatcaacacagggacgagcggttggaatataagcaatttggtcattggtaaataacccctagtccctttgctatacgagtaatcaaggaagtgcactcaacaagagcagtaaatcttatactctctaaccattaccttatcatacatttcagaggagcaacgttaatcttcctaaccatggcaaacatgataaacatgataatcaattcatcctctctgataggtctaagatcacctctaggaaacaaagtcatagaaatccatttgtgcataagcctaagtgtaggattagggatatcattagtcctaggtttcttgcaaattggagcaccagaaatgtcttctcgaaatctttttttctcaaactcggaaattcctttccgaagatcgattttactgcaatcgtaaaaaccaagaagtgtacttaatcctttccatgaaagtgtatattcatcatggaaaaagcgaaaggaaattacatcttctatttctttcaaagtgcttagaaattgcaaagtaagcaaacgagaaccacgctcatctaccacaacaaatatctgccatccaacagctttccaaatagcacgaaagtcagtatccatacctatctttttcagcagcgccggagcgtatactcgcgtgtgagcatactcccggtctttcagcatgtagtaggcttgtctttcccgatcaccgacaaggtcgaggtcagcgtcgctcaagagacgttacgaaacgtcagcatcctccattgagacatcgatggatgaacgattgctagcctcatcatgatgacttgatggagagccgtgtaacttcttgaacagacggaatagttgtctcttcattctgcacaaaggaacaagaacggactaactcggcgggggttagaataacaagagtttcacccgctgtcatgccccgattttcgttcgggattaaaaatcattaaataatgcattttgtagaaattaaataaaatttaaagcaaattaatcaagtgaaataacgggagaattaaagttttcccctaaaaatcattggccgagaatatttggtaatattataatgatacaaagttcattta

SEQ ID NO: 13822 - DNA, 1501 bp, Oryza sativa
ggttgctcatggtgagacgggagtgtttaatcgcggccttcgtcaaggacgccgaccacacccgcagcgtggatgtctctaaggccgacatggacgccggcacatgggttccggtcaccggcggcggtctaggtggccaagcaatcttcctcagtgaactcttcaacaagtccatgcctgctcccgcacacggcgaggttttagaggacacgatgtatttcgtcgacacaccggacgtgtgggacttgaaatccggtactaggaggccgtttacacgaagcatcgggttctttgatttggacagaacgtgggtttttcctccagagttgattgtttaatgaatgtggaacaacgaaaagaaatttaatacatgcatatgcatatgcgatttgtgatgaaaaaggggacaattagattattattattagtattcctagtaaaatgcccgtgcgttgcaccgggtaaaattgatcgcacgataaattttactccttccttagttttgatccaaaagcccattacatcatttttttttcagccctgcctagtccgctaccttcctccgctcagcctgcctttgttcgatccagtccacaggaactgcaggctcaactcgtatagattgccgtcttcaacctcctggaaacagtctcgtgcatgtacgataatggagctgatactctccatcatatccaaggctgtcgtcttcaacctagatcgacgcacacacgtgccagggttgcgcacaccctttcgcatgcaaataaaaagagagtaaatttcactttaggccacatatataacctaagttgcacattgggctacttaggtcaatatatgcaagttctatttacataaggaaggaatcagaaaaaaaaaactgctacgaaaggttttcaagccataatttccaaactgatgtatctacttctcttgctctactgcccgatggccgccagccgctagccgtcgcccttctccttctccggttctacgcgtgcgctcgtcgtggagatagagggaaggtgagacccacctacatgtgggtcccactacttttttcttttgccttactgacatatgggtcccacatttttttcaaaaaaattaattttcatatttggcttccaatgccacgccgaggaacctcatatgtaccagttttgacaattaaaggacatttgtatctggtattttggttcgagggcgaaaacccaactcgctgtcaagtaaagggacatagaataaacttattcgtccaggaaacccacgtacttaggcctaaacagcagtagcccacatacgctggccaactagcactcccactaagccacagtcaggcggcccagtaagcccacatattctggcccatggagcagatgcattcgcactcccactaggccactatcaggaagcccaggaagcccacgtacgccggcacccatccgtctgctccacgcgtccgatcagatcggatcgccctagcgaaatcagaaatccc

SEQ ID NO: 13823 - DNA, 1151 bp, Oryza sativa
tgaactaagcatggctaagcaatccctagtcctaactctaatcatgttagaaccccaagttgacaaagaaataaggtacaacaatagcatggctacgacattaggtaaacaacccatagtaacattataaaacaatgcaatatttgaaagaaaacaatagagcatttgcaatataggatcaacatgttcaagtggcaagcatgacttgccttgctctgctgctggaggaacctcggcgactatctcgaagtacaccggagcgtcggaggaatcggaatctagcgacatacaaagaaaacattgcaaacaggctataagactactgaaacagagaacaaaaccatttttaatggattctacacatttttcttgatttactgagacttgaatgggcttaaacggagctcggatgaattagttatgaattttagaagattcactgtgtttattactataaaagaaaaaccttaaatcatttattgcgcaatataatccagggctgacgtcatcaaggcggggcgcggcgccgacatgcgggccccaccggtcagcggctcggggagggaggaagggcgccgacaagcgggccccaccggtcagcggctcggggagggcggtccacggcggatcaggtccacggaccggggaggagcggcgcgccacgcggcggccgaaccgatggccccgatctacccaagggtagatcggacggcggcgggagctcgcggccggtgcgcgtgggcacggcgcaaaccggcccggcgaccatggcgcgcgacggcgcggcgcacatgcggcagcggcgcaagacggcggccgacgacgaccgaccggcgacggagagcggcggctagaagtgaaacggcagctacgcggctaagcggcggcgcgacggctaaacggtgcgggagagagagaaagaggaggagaggcctcaccgacaacggtcgacgacggcggccgacggaggacgatggcgacggcgggacgagctccggaacctcctaacgaacaaaaggagaggggttagagggagagaggagagtgcgagagagcgagggcgccggccgaaggcggcggccatggcgtcactcaccggcgcacgacggggatggggctccggcggcgaacctcgacggaggaggggtgga

SEQ ID NO: 13824 - DNA, 695 bp, Oryza sativa
gtgaattttttttttagttacactcaaatttcttgccgtacgatggagaaacgtgcacgatctccctatcccgaacgagaccctccccgatcgcctcctgcacagtgcgtgcggaactataagtttgtaacccatcattattgcgtgctcgttttgttttgagaaaaagccccgtagatttgcaggttcgatttactgagcccagattgcattggcccacattgcaggaacaaactggacctagatttgtagggaaataagttcacttggactcccatagctagtgaccgaatctgattcgtatctctgaaccacaataccggatatctcgatcactcaattatcaaaacaggtgcaatttgactccctcgacggttttggaacgcagtttcactgatgtgccatctacgtggcggtgttgacttggttttcatcatacgtggcgcttaggtggtattagaattaaaaaatatatgtggaacctatttttcattcaaaaaaagtattgtgggacccacatatcccatatgtcagcctcgctctttaaccccccctctctctctctctctcttccccttgagccgtggcgacaacagagtggtggcggcgggcactggagcggtggcggcggttggcgggcgagggaattgcagcagcgagcggtggcctgcttatcgtcgtgccattggactgaa

SEQ ID NO: 13825 - DNA, 1501 bp, Oryza sativa
ccgggagggcactggcgacgtcctggagcacggcgccgaggggcgcggcgggcgcgccggccagagcgccgcacgcccgggtggccgcggcgagcgcgccgggctggtcctcggcggtgacggaggggagcacgggcgcctccccccacccgaccgcgccgctccggagctccacccggacggcaacgttggacacggcgtccagccgcgacgacgcgatggtgaagggcgcggccaggggcacgttgagcggccgcgcctcggccgccaccacgtcgacggagaaggcctccttgagggcatcgaacccgaacgtctccgccggctgcggcgcgggcggtgtcggcgacggcgacggcgagacggcgcggaggcgggtggcgccgccggcgggtggctgctgctgctgcctgcccaccgggagcacctgagccctggtgctaccgctcatgatgctcccatgattctgagacaacctgagaggcgagaaggacgaggaggtggagatggcggagtccatggccactgccactgccactgactggagcactggattttgccgaattttgtggaatggctcgaggaggaagacgaccacgagtttttcctttatagagtaggagttggtgcgcaggtttgacatggtacactgacatgtgggcccacgtgatctgtccccgtcactgctactgggccccacatgccaggacaagatgcccgctacagccaagtactgtatactgttcgtgaacaggtgtgttcgcatgaacatgttcccaacccaaaaatgaaaacggagcggtacattaataattgctataattttttaaaaaataaattaatataattttttaaacaattttcgtataaaaacttattaaaaatttaatatttagcagttttaaaagcgtgcagaaaacaaaattaggaagccggcaacaatgtcttgcaaacagtgccatgggacctcctgcgggtcccacctgtaattgtggtgggccccgatcgatgccgtcgaggacacgtgggccacgcggatgacaggtgggcccgcgctgcctgtgacctacagggccatctgacgtggcctttgtccgtcgcgcgtttcgtcgtggagcgagccgaacctgacgtccgggttaccgtcgaaacgtggcgattagccctgaacagctcgatgacaggtgggccctcccgtgatactcccgccaaaacgtccgtctcagttgacggcaagtcggcaaccacctcctcctccgcggccagtcgccgtcggccgaaacaaataattagcagtttagcactaacaaagtgtaattaagtactcgggagagaaaaaacagtgtgattaagtcgttaattacgctgtcactggcactgtgcctgtgtaaaacctgccccttgcaaacgcccaaggccagattaagggataagcagataagaacgcactgatcaacgatatactagtagtactgcaactatacaatgcaaatgacccatt

SEQ ID NO: 13826 - DNA, 1501 bp, Oryza sativa
  unsure (1)..(1501): unsure at all n locations
gcaaaaatatattttcagatgtggaggttcctctccgccctacctccccctcacctccactcttttatttcgttcgtcccactcccaattccctcacccactgctccgttccccctcacttaccctctctttcccaatcagccggccggcctcctcgcctctccgagcggcagtggcgggattcgagcttggagcagcaacggcctcggacagccacaggagcagtagtgttggcttcgtgcagcggtggtgaccacgtcaccatgagcggtaaccacgatcacagtggcagcgtgcggtggatccactgttggcaggctcaggaaggatggatatgctgccagcgggctcgggaaggacaaatctgctgctagcagactcgggaaggacgaatccgctgcctggctcgggagcggctgatccgtcctcgcatgtggcggaaaggaggccgaaggacagcatgtgaccacggcaccaggagcagcgaccatgatcacgatggctgcgcgtgtgggctcgggagtgacagatctgtcgccggcgggctcaaaaagggtggggccngggccccttggctcgaaaatggcggatccacgctcacgttccatataaacaacggtcgcgtggtgacatttgacgccgataaacctctgcaacatttgcctcattgccacctagctatggctttggttttttttttaataagaccttcaacttggccacttgcaaaaattcgatctttgcaagcgcgccttattaagatgtctatatgcaaattatggtatcgcatgcggttttggcagtgcacatgcccctgaaaataccgattttcgcagactccttgcgcccgacaagtggagcactcaattgtgaagatcctttatgtagtaatgcaacctcgtcgttggaggctgtaggtggagcatgagagcatgatatgttccttttgccttgattgataccaggcttgttccttaagtatcatgctgacatcaatatggtacataggtaatagaatatctggtatctacggtatcatatcttatacatgtatcatgctaacgtcaacacataaagtgttctattggctgaacggtataccgttctctactcacactcgaacaataaacccaattgtaagtacaaatccggcacctatggtaatctacgtgtttccatatatatatatatatatatgtgtgtgtgtgtgtgtgtgtgtgtgtgtgtgtgtgtgacatgataattcatgttttccattttcggaaataaattaatttagccatatataccgcggatgcaccaaccgagcacgcattcccgcacatttaattcccggtttaattcatacacatgtctactatgtactggcacctgcctatatatatactgggatggcagcaaagggcacacacgtacgcacacctgtcttgcgttgcattccgttgctttctcttacgagcactgcgcaagaagcgagagcccaagagcagctagctagcaa

SEQ ID NO: 13827 - DNA, 389 bp, Oryza sativa
ccgcctgcgaagataggaggcctataaaagcgcgaccaccccggcgccaaattctcaaagtccaggcgggaaccctagaaaatttggcgccgttaggctaccgaaatttttggtgcttccgaccgccggctctcatccgaccgccgcctctcctccgaccgccgcctcccttgccggcgccgaccgcctgctaggccaccaccgctgggcgccgcctcgtaaccgtttggccgccggcgccgcccatctcctcgagccgggccgcacgccgcgacctctccatccggccgggccggcgcggcctcctccccggccagcgccgcctcgtcctccagcgccgccacccgcggctagcgccgcctctcctccggccggcgcggcctcctagc

SEQ ID NO: 13828 - DNA, 233 bp, Oryza sativa
ttctcattcttcccctctctctctcacggtcagcggcaggcaggggcagcggctgagggcggcggcctcaagagggaggagagtgagagaaacagagagaagcgtatgacatgtaggccccatattttttttatatagaatgctgactagactgccacgcatatgccacgtagaccaaaaccaccgcggattgggtcgaggggggtaattcgtccggtttgtatagttcatga

SEQ ID NO: 13829 - DNA, 539 bp, Oryza sativa
tgatcaaatttaaagcagtcaaaacgtcttataacctgaaatggaggtagtatcatggtgtaattgaggatttcggcacaacaatgacatgtatgctgagattcagacgagattccctgtgatgtttttatacacgtgttcttatgaccagttcagaattcgttgtagaattatctgatctaatctaattctgaaatcgaagcaatcacatcaatactaccagcgataaaaacgaaaactagagggctttacgtttgacttcaacatatggcagagatacaaaaactcgtaaaggataagaattcagaagtgccaaattccttgatggttaacgttataatcacattaaaacagcacggaactcggcgagatatttttgctcactgattgaaaggtgaaagggatgtatgatgtttgataggtttataactttgtacctttgctacaactatcttcaacccctgcaattccttatccccccttctgcttagagctatgtgagatccaaatttccaggtactccataaaaatggccaaag

SEQ ID NO: 13830 - DNA, 1501 bp, Oryza sativa
tatagttctggcctttactcaaatatccacagccaattattacatcaattcaataaaaacctcacatacgaataaacaaaaaaacacacaaaaactaataaaaactcccacggtataataagatcataaaaattattgaattctaattttcaaccaaagttcacgaacagctgtatagctataaaccattgactctagatgacgacacgcaacgcagctgccatggatgaatggcgatgtgagagcacgcaccttgaagcgccttcctgaggctctcggcgtcgtcggaggcggacgggacggggctcgggacggcattgatggacatgatcgatcgatctcttctctgcgctctgagtggcaatggtggcgaacacacgacacgagattacacggacaaatggacagtcaagctagtactaggaattataaagagcagggatttttcgaaagagctggagaaaaacttgcaaagttatgggcacatttgcagcactttgcacaaatgacaaatcactgatgaatatatgtgctgcacagctaacttccttaggcattaagctttcctacaaaatttcattcaagaactcgtgatctgcattactattgttttgtcccaagctttagcaaagcttttatatataaaacatactctaattcttcgcgacaatagcaaagaatcaacctgtacgtgtatcgagtttgtaaagcaagggcagtagaataatcgcaccaatgcacatatgctgattatcacattagtccgcaaagatggtatttgcactttgcacaagcatctcacaagcatgattaattacaaataatcggatcacaacaaatgcaagtgggggagcaacacaaaaggggagtaaagctttccgtaaccacatttttcgcactcacacacaatcgtacgaagtatactatatactccctccgtttcacaatgtaagtcattatagcattttccatatttatattgatattaatgaatctacatctagattcattaacatcaatatgaatgtgagaaatgctagaatgacttacattgtgaaacggaagaagtatgtttttcagtcgaaaacaccgtgcattcacatgcgtttgtttgacacgtgcgaataaatttttttataaaaaatacttttgcagaaaattcaacaatttaaaaaatataccgacagaaatctatgtgaaatctgcattttaatcagccaaaaaaagaaaaggattaaaaacccaaacagttaactgggcctaaagactgtaattcgtccacttttatggcccaatatgggcctggcttaattctagtccaagcccatccgacgcagcggaggcagccacgtggacaggcccgaccaaccgccatctgacaggtggggcccgcgatggcggaaaaaatcgtggatccgtcgaggcggcgagatatcccccgtgccgcgcgtgcagctgccgttgccgacctcgcgctcgccgcaggccaccgcgccgccgc

SEQ ID NO: 13831 - DNA, 1501 bp, Oryza sativa
aaattaaactaagcctattcctgcaaaacataaattagacaaaacatggcagagcactatcaaacctacatacatgaaagctctatgtcaaaggaaaggctatttgtagtctcaattttcagcataaagcaaattttagttcacaaaccatttgcaacgtaatttaagcaaaacattttagcaaattgtgaagcatattaatcatggcatgatatcaacataaatagatagacatcattcccttacaacacaacgggaagtaaggcaatcatatcacatatatcaatcttatcatcaactcaaatcatttagtttcagaaaaagtacgaattaccgccccccccaaactatcgcggccgtccaaattacccccctgaaccacaaaaccggacattcttcacccctaactatgcaaaccggacgaattactcccctcgacctaatccacggtggttttggtctacgtggcgtacgcgtggaagtccagtcagcaatttatttattgaaaaatactgggacccacctgtcatactcctattgcacttttccccctctctctctcctctctctcactcttcctctctctcttctctcactctctcacgcgcacgcgcacaacagcaggcggggggtggcgagcggcggcggggtgtggtggcagcggcgaggcgaggcggcggtggaggaggtgaggcggcggcggaggagacgaggcgaggttgtcccatgggttttttctggttgtctcatgctctcacgattggtcagtgtgtgtcgtgttcgatcgatctacatgtacagatgatcgatcaatcttcgaatcgatcgccgtgtttttgttgtgtttggtgatgagatgatggttaagtggtatggttagtgtgcgctaatggcggtggtttggtttgggggtggttgtgtgtgtgtggttgcagggtggagagcttcatagagcaacaggatgcgtgtaactctggacgggtgcgcggcaggccgtgcccgtggtgacgacgctgccggtcatccgtcacgcagcgctgcggcatcatcatcatcatctgccgccgccgccgcctgagcagcagctcctcccggcgtccaccacggcaccgttggccgccgcgttctcgtccaactccacgaccaccacgaccaccgtctcctcctcccacgagcaacacgccaacacgcgattacgatgaagctgcagctctccatcggccccgccgtcgtcattgtcacggcgtccgacggcggcgccgcggccgcggcggcaggaggggaggaggaggagcaccggaaagaggtaaggcgcgcgctggaggacaaggcatccgcggcgcggcgcgggagcgggcgcgcgaggaggccgctgacaggtggggcccacctattttactaataaataaattgttgactggacttccacgcgtacgccatgtagaccaaaaccaccactgattgggtcgaggggggtaattcgtccggtttgcatagttgg

SEQ ID NO: 13832 - DNA, 1501 bp, Oryza sativa
cgttcattagatattttatcctagtttgtatgcttccagccaaaaactaattaatcatattttaaattcaataacagtttagagaactcattaaaaaaaactcccgccaaacacgtacgtgtactcacacgttttgccctatttttgcatgcctaccgatgtacgtgctcccataaaaaaacttgaaaagcgcgcagaaaatcagtctctcccccatgtagcctccgggagggagaaccaatctgatactgtactacatacagtactaaacagaaccctaccgagggcaaaacggtaaaccggcctccctgcagcccctggagggcctggacacagtacacctagctattagctctctgatcctgggaccccacatgtcacggacagatgcctgtgtttcaccttttcaccctcccaaagcaacgcagttaccggcttaccggagcgagccgccgccgccgccgcagcgcagcggcgcagggcggttcgttcgtgggaggaagactagttttagggcgggattataaaagggggagggggaggagaaggtccctgtcgctgttgcacccaagccaccacccatttcggcacacccttccctccacttgccgattacttttttgccccccggcgcgctgggcgccttggctttggccctggctttggctccgctgttcttatcttccccactcgtgcctggctctctctctctccctttctcctctcctccaaggtcatggcaaaggagaaataacagctagcgggcttggggaagggaaaacagcaagtgggagatcggcagggagaggtagggagctcgatctcgcctttgcttgcttgctgctatccccttctctttctgttgtgggcttgctgttctccatgtcctcctgttgatggttgcttgtgttcgagtttttttctttttttttctttttttttcttggagaggatgtggttgtgttcatgataggttggtggtctgtgatctgtttgggtagatcttttgtcctctttttcagatatttcgtggatgctagagctgcctgcggtagccaattcctgtttggctacttcttcgttgccctttattcccttccaattttattccgtgattttctgttcttgtgcgtagaattgtttctgccaagcttgagtaaatccatggcagaggtcaaagcttagcttttttcagattatacgatttgctgccagccaaaggagaaagggaaaaaaacttagaaattttctactagttttctcttgttgtgttcattagatctcagagattaacctaatttaaggaatacatgttgtaaatcctgctctggaaatgttaagtggttgggtgtaaggaagcatcttgttttgcatcgagtttatggccaaaaacaatcattgatgcttcctctaaggcggtgtatgttttcctctgttctccatttgatgtgttcttgatccattttcgtctcttgttttcttctgttcttttagatggcct

SEQ ID NO: 13833 - DNA, 1501 bp, Oryza sativa
cataagcttagactaattcgcgagacgaatcttttgaatctaattacgccatgattttgacaatgtgatgctacagtaaagttttgataattatggattaattaggcttaaaaaaatcgtctcgcggattagctctcatttatgaaattagttttttttattagtctatgtttaatactctaaattagcgtccaaacatccgatgtgacatgggctaaaaagttttagtcccaactgaacacccccttatcccccgatcccggcccttagggtgggtctccgaccccaacagggaaatttccgcctctagcaagaacttgacgtagccgatcgatgatctcatccaacatcgacgccttgatcatctacaagcaaaatcaaaccaaatcaagggcatgtttggatcttcagctccaactccatctcttctaaagttggaagtccaaacaaaaagttttagctccaacaataaaaaaaaatagagtggactaaagtgctctcacaaaataaactcaagaggtgaagcttgatttagaaagacttaatttttagagttagaactctatcaaacatgtcttaattgttcaggatcacataggttgacgtgacgtagattaaggtggtgtttggatccagggacttaactttagtctctctatttaaacactaatttaaagtattaaatatagactacttacaaaactaattacataaatgaaagctaatttatgagacaaaattttaaagcctaattaatccataattagagaatgtttactgtagcatcacataggctagtcatggattaattaggcttaatagattcgtctcgcgaattagtccaagattatggatgtattttattaatagtctacgtttaatatttataattagtgtccaaacatccgatgtgataggaacaaaagttttagtcccatctaaacagggtctaatttggtgagggttttgataacgaggctgaacccaacagtccactcgattcatgtgactttttttttaaaaaaaatgataattttattgccacaacacaaacacttcttccaggaggaatattaactccaaggttcacacaattctcactcacttccctgtggaccccactccactggtcccaagcctccccagccccacgggccataggtgacagccctacaccagaacagtgccatcccatccagcccagtgcctcctcaaaaggccaaaacagcaacggtaaggtccaaaacagaagcatcctttcccagtgctgagaagcagcagcagcaagccagcaacagcctgccactcctcccatcccatcccatcccatcccatcccatcccaatgccagtgaatgctgtcgccacgcgtcttcgcggcacccgatgctactctactgcctcccctcccgaacgttcgaataccccaacggctacctccactccaccaccctatttatatccgcctcccatggccgccacagcatcatctcctcctcctc

SEQ ID NO: 13834 - DNA, 1501 bp, Oryza sativa
ttttgggacaaaaacatttgtacgatggcatttcttagaactcacacttgtcgatggtatttctgggacttagatgtttgtcaatagcatttcatggattatctctttgtttatcgtagtgtatttgggtttcatagagaaatgctgatcgtgctgatatatctagtttgctttagccccatcttgatgtaaatcatggattcgccactggttgctgatcctgcagtgtcaaagcagtcactatgacacgtctaatcgatccttagctgccatcagcatcagctgagctcaaatcaaaacgcacaatcgatgagctgcaagaactaggtatggcaagggggcgagacaggtgcgggtccaccctgctccccctgcgagtccacccggccccatcctactagaagagatgaacccgggcctcgtccctggcctctttgatgacccgcaccactggggcccgcacagcgtgcctcactcacaggcaataatagcgattggtgggagatgaagggtgcggtcggctcgcccccgttcacccacgggtgataattagggggctgtttggtttccaggacttattccaagtacctgtcacatcggatatttggacactaatttggagtattaaacatacattaattataaaacccatttcataagcttagactaattcgcgagacgaatcttttgaatctaattacgccatgattttgacaatgtgatgctacagtaaagttttgataattatggattaattaggcttaaaaaaatcgtctcgcggattagctctcatttatgaaattagttttttttattagtctatgtttaatactctaaattagcgtccaaacatccgatgtgacatgggctaaaaagttttagtcccaactgaacacccccttatcccccgatcccggcccttagggtgggtctccgaccccaacagggaaatttccgcctctagcaagaacttgacgtagccgatcgatgatctcatccaacatcgacgccttgatcatctacaagcaaaatcaaaccaaatcaagggcatgtttggatcttcagctccaactccatctcttctaaagttggaagtccaaacaaaaagttttagctccaacaataaaaaaaaatagagtggactaaagtgctctcacaaaataaactcaagaggtgaagcttgatttagaaagacttaatttttagagttagaactctatcaaacatgtcttaattgttcaggatcacataggttgacgtgacgtagattaaggtggtgtttggatccagggacttaactttagtctctctatttaaacactaatttaaagtattaaatatagactacttacaaaactaattacataaatgaaagctaatttatgagacaaaattttaaagcctaattaatccataattagagaatgtttactgtagcatcacataggctagtcatggattaattaggcttaatagattcgtctcgcgaattagtccaaga

SEQ ID NO: 13835 - DNA, 1501 bp, Oryza sativa
gttgtcgccgatgtggaagcgggtggcctcggcccacctgttgagcgcgtcgggatgcgccggcaccttccacccgccgccgttgttgccgccgaccacgaggtccctggcgttcgccacggccacggccgccgcgaaggccagcgcggcgcagagcacggtagccaacaccttcgccatcgaagtagggtgggaggactagcaaaagtagaacacgagagcacgagaggagggaaacaggggaacgaggaggaggagatgatgctgtggcggccatgggaggcggatataaatagggtggtggagtggaggtagccgttggggtattcgaacgttcgggaggggaggcagtagagtagcatcgggtgccgcgaagacgcgtggcgacagcattcactggcattgggatgggatgggatgggatgggatgggatgggaggagtggcaggctgttgctggcttgctgctgctgcttctcagcactgggaaaggatgcttctgttttggaccttaccgttgctgttttggccttttgaggaggcactgggctggatgggatggcactgttctggtgtagggctgtcacctatggcccgtggggctggggaggcttgggaccagtggagtggggtccacagggaagtgagtgagaattgtgtgaaccttggagttaatattcctcctggaagaagtgtttgtgttgtggcaataaaattatcattttttttaaaaaaaaagtcacatgaatcgagtggactgttgggttcagcctcgttatcaaaaccctcaccaaattagaccctgtttagatgggactaaaacttttgttcctatcacatcggatgtttggacactaattataaatattaaacgtagactattaataaaatacatccataatcttggactaattcgcgagacgaatctattaagcctaattaatccatgactagcctatgtgatgctacagtaaacattctctaattatggattaattaggctttaaaattttgtctcataaattagctttcatttatgtaattagttttgtaagtagtctatatttaatactttaaattagtgtttaaatagagagactaaagttaagtccctggatccaaacaccaccttaatctacgtcacgtcaacctatgtgatcctgaacaattaagacatgtttgatagagttctaactctaaaaattaagtctttctaaatcaagcttcacctcttgagtttattttgtgagagcactttagtccactctatttttttttattgttggagctaaaactttttgtttggacttccaactttagaagagatggagttggagctgaagatccaaacatgcccttgatttggtttgattttgcttgtagatgatcaaggcgtcgatgttggatgagatcatcgatcggctacgtcaagttcttgctagaggcggaaatttccctgttggggtcggagacccaccctaagggccgggatcgggggataa

SEQ ID NO: 13836 - DNA, 1501 bp, Oryza sativa
gacctgaccagtttttaatcaccataattaacacgcgtaacagcgaccacaaacttgggattactactagtataaacacgttcgttgccgccctgacaagagagagaaaagagagaaaaaaaaaaggtgactcgctgccgagtcggacacgtgacaacacgttggtgccgcgtccggctcaaccgcttgctcgcgcggaccttatcgctccggtccgacgcgcgggtgacgtgtaccgagcgaccataccgtgccagccttatccccaatccgggcccacacttttgtcgtcgctcggtgtgggccccaccctgtcagtgtacggctcggcgctcaccggcgtttacctccccagcccacgggaaggaggcggcgcgcacgtggcagttgcggtgggtgaggctgtgagggcggtgcgcgagcctacgtggcacgccgcgtccacggaggccgtagagaggtggcccccgtgagcacgcagttcgagtaggcgatgacgtgtccgacaggtggttcagcgagcaataattacggggtaatataataaaccgctcccgccaaactaacggcggcagcccacggaaaaggcgtccctcgctgctgtttcctccgtttttcgctcacctccggtcatcctactcggctaccccggcggcaaaaacatgaagttctacagatctacgacatcagtttactagtttgtcttttgttctactttgctctttctttcttgcgaatttctttttaatcacgttttgtgtagaccatgtacagcatcctcacttgtgcagggtaggaatttcacaagaaaacagtgctcgtgcagcgactcgatagaaacggaagaaaaccgtatcaacaaccaacacgaggaggtgtgtaatactcctttcgccttgtaatataaaagatttatatagatggataaattttaatactataaatttaaacaaattttctatgtagattagtagtatgtgttatatctatttaattttttttatattttaaaacggaagtagtaaacaattacttatgtaggctttgggtgcagggtaccgtagggggtgagggcaccgcacgtcacggttaaggtggccggttactactactggtgtcacatcggcagcggcaactggtattacgtgatgatcttatcctcgtcgtctcgccgtctttatcccgttcgctgcttgctttggcttctcacatcagcactgactccaataacacgctcatcaaacagcgcgcgcgagcgagggatggataggatattttcgttcgcgttcgtgccatcctaaatcccgtctataaagccgtgcacatctctatcctcacctccattccattccactcgccaacccgacacgtctctcatcttcacgcaacgaacagcagcagcagctcaagctaagctaagctaaagtactacgtgttctttcgtcttcgtcggcgccggagtttgattcgtcggagctagctagcaagaggaagaagaaaa

SEQ ID NO: 13837 - DNA, 1501 bp, Oryza sativa
ccttgagattttaatagaaaaatcgggcctagcccatttattctaacagaagtttcctagcgaaagctcagctcttcgaggcctgttcttgagcattgtaacctcctagaggcattatcgtggcttccgttcttcgctggtgaatctttaggtgaaaaccatgtcccgtttccctgggacgggcaatggcagtgtcctcgcgcattgtgaacttcttggaggcatcatttgatgctccattcctttaatctttctccagacgatcatcttcttgtagtgccacttctaaccttcacaagatggccacgttgtttgtatgaggtagaacgtatccattttatctctctcactctctccctctccaaccaaaaggtatggcgtgccagcgattcaacagccatgatttggggagagactatgataccatgtgagagaaggcggggattgaagatgcattgagttaaccctagagggtaatataatgtacatgagggaaagggaaaatacttgaatgcctataacacacatgtatagcactcatactctaacagagaagaagatggcgatgactaactaaagcgcaaaaattatataatgtcctattgtgtgttaaaatgctttaaatttaggttattgttttggctgcctaattttgtccgagatgtgcccatcaaatccaacgaataaatgagtcatcggttgcatttactcttagctcaatcgtttaccctttagcttatcagtcatagctaaaattcgaatttcatatagtttattttttcatcgggttttaagtagctaatataagactgcatatataattttttttagtcacaagttacttactcactctctttttttaatatatgatacatcatacatttaactttttaacacatgttcgactattttcatcttattgaatttttttttgcgaatgtataaaatgtaaattatgcttaaaatgcttttagtgataaaaccactcatgacaaaattaatggtaattacattaattttttgaataagataaatgatgaaacatttatcgaaaatcaactgtgttatttatttatttatttaaaagaaataaggtagtataatcaactagctatcgagactgttttgttgatggccttacgaaaagactcaagtgtaacccagaaccagagccggcgccgccgtcccgggcaccggctgcgatgcacgagctgcacgtacggcatgcgtacgtgcatgccacacgcggcggcattcctggtttctctccccctccctttcctcttgcccgtccattgcccaccaccaccaccctgctctccccccagacgcgcgccaaatcccaaaatgccccactacatgcgccacgccgcgcgcttcccgccaccgccatggccggcttcctgcaccgccacgtgctccccccgttccgccgcccgcctccgcctccgccgccgccgccgcccccgcgcggcggcggccgtggacgccgcggcggatc

SEQ ID NO: 13838 - DNA, 1393 bp, Oryza sativa
cggctactcggcccgtcccggcacggcccgttactgtagcaggccgtgccgggccgtgcctgctacaggttcggccgtgccccgggcggcccgtttggcccggcccatttggccacctctacacaactctactaactactacaaatgaacacagccatagtttgccaaaaagaatcacatcatagctaaataaatgttttatgtaatatatatcgagagaaaaaggaaatagggagaactccaattgccccgagagtggtgatctcacttaataggaatagccctatgtcaatatggtataagtgaactcaggataattttaaaccaaaacaaatacttatagaacctacgtggataaaataaaactgaaacgactaaattgaacttttggtgaaacttaaggaattagatctattcaccctaaaaaatcagctaaagaaatattttacgaaataatatatcaaacaataataataataataataataataataataataataatgaagaaaaaataaatatagggaggagaagtccaatccccaagagagcggcgaagaaagaagaaagagaaacacgggtgcacgcgctttcgcacccttcctttttaaaacgccactcccggccaacccggcctctccccatcctctccgtctcctctcctcccttccaccacgacgcgaccgacgcggcggagaaacccgcgaagccgcagtccagccagcgaggggccgccagccgaagctgaagcgagagctagggtttgctccaccccttgaacccgcccgcgcccccgccgccacgaggccgatcgaggtgcgtgccaccgtaatctccgcgcgtgtttgtcgtggggttgggttgggttgggtggggtggggtttggtgtggatcagggaatgcgggatctggtggggtttcgtgcctcgctcgctcggggatttcatttggtggggtggtggtgatcccatcctcccccactggattttgatggatgcgacccccttccgctgaaatcggagggattttggttgccatgcgctgctccttctgtccgtacggttcggtgaatcgggagttgtagattggtggtgatgatgacccagtagttggttctgatgctcaatactcgctgcgatttcgctcccctttatccaagggaagggaagggagaggggcttcctttgcgttcaaatttagcaaagtaggaattgtgtgagattggtggtagcgctcacttttttcagctctagatcgttagttctgcataccatgaagattcttgtatcaggagaagattattatatttattctgtggagaacgatatcagagatgatttgtgggggtgatttttggctgatttctgctctgcagggttctgcttctgaggct

SEQ ID NO: 13839 - DNA, 1501 bp, Oryza sativa
ggcgacggcgcaaaaggcgacgcgaaggcggctgcgctaagcggcggctaggaacgggagggaacgggcggcgataaaggcggccgccggcgcggctcggcatcaaagccgaccggccggctaggtctaacggcgacggcacgcggccgacgacggcggcgaccggcggcacgggaggcggcggcggcagtcgaaggcgacggcacacgacttgaagcggcggcgcggcactaagaggagaggaaggggaaaaaaaaaggggaaatgcctcaccgagggtggccggcgcggaggaagacgatggcgaacgacgacaacaagccacgggaggacgacgtcggctagcggacgagcttcggggtgccctaaggaaggagaagagagggattagagagagggagatgaaccacggcgatcggaaaccatggccgaaggcggcggtggaggtggtgctcacccgtgcgcgaggggatgagggctccggcgacgaacctcgacggaggaggggtggacggggtggatctcggccacgcgaacccgacggcggcgacggtgcagcctggcggcgaccctaccggcggctagcggcggccggagcagcgaaaaaaagcggcggcaaggggttgcacggcgcgggagcgatgggaggctcgagagagtgcggcgaaatggggaaaaagtgagaggggacggcggcgatgcttaaatagggggagagggaaccggacgtggccgagagaggcgggaatcgccggccgacgtgggggagtggggaggagagagagcgggattcgattttcgaatcccggccatctcgggcgcgggcgcgagcgggagagagaggggagtgggcgcgggaaacgcggcgcacgcgcgggcgtggtcgacgtggcccgggggaggcggagacgtgggcgcggcggcggtttcggcgcggcggcgcgccgggatcggcgggaggagggagacgggcccgacaggtgggccccacctgtcggcgaccccgagagaggaggcgggcggcctgggtgggcttcggcctgcggccggcccagcaaggaggagggaaggaaggaggggaatgggccggcggcccattcgaaaaaaaaggaggaaaaagggagggaaaagaaaaagaaaaaggaaaaaggattttccctggaattaaaaatattgcttgctcaattttaattggttaaaattatttctagagctctaaaaattccactaaaaatcctgttaatgaatttcgacatgtagaactcaagaaaaattccacatgtcaaatccgattattatttgcattactttcttagggttttctcctgatttcaccagcattttcttagggtcatttataaaaattacaattttggcttgggaggaaaacttcggggtgtgacaacatgcccgatttgtaaggcactacgacaaaaaattagacaagatgacccaggtgatgttgacggacaaccttcaaaaaagagagttccaactaagt

SEQ ID NO: 13840 - DNA, 1501 bp, Oryza sativa
gacgtttgcaaaccttgttgtggccgcgactgtacttttcgtcgcagttgaagcacaagccgaggcggcgacgttcctcctgttcggcctggttcaggcgcctgaccggccggttatcagcagcggtggcggcgggcggcgcgggcttggcagccccagctggagccggcaaggcgagttgcggccgaggcgcaggtgccggcaggacaccccgaccaggagctttggcgggaacggcggtgtactgctcgatcagctcgaactggcgggcgaggctcatggcagccgccagcgactggggattctgcatctggacttggaggctgagcggaggaagaaggcctccggtgaacagctgcactcgctgttcttcgtcgaggcgaccggcgcgggggagcagggcctggaaccggtcctggtagtcctccactgtacccgtgcggcgacaggaggacagctcgaacaggggagcggaccgcagaggtggcccgtagcggagattgaggagctccttgaagcgagtccacgtcggcgtgccgcgctcgtcttcttggacctgcatgtaccaaagttgggcgccctcgaggaggttgtgggaggccatccaaaccttctcctcttgcatgattcgctgttgcaggaagaaggattcgcagcggttgatgaagattagcgggtcgctcttgccgtcgtagtgcgggaagtcgggtcgccagtgcttgggcggccggtctggcggctgatcgccaaagccggggcgggcgccggacgtagatgaactggtggtggtggcgagcgcagcgatcgccttggcgttggccgcgatggaggcggcgttggccttgatcgactcgtgcatcagcgccatgtccttggagagggcctcgatggaggccttgaggtcgtcacccatgtggtgggccgagcaggacgcgactgagggtgaggacgcaggggaggcggcggcagcaggtgggaaattgggcggagcgacagcaggggcggcggctggagtggtggtggagtcgtagatgggatcggtggtggctggggcagaggtggagtcggcaacggaagacgaagatcgacgtgaccgcgataccaggttgtcaagggcgttgatccctagggtagctggcccctggctacggagttcgtagccacggtccgtcttctccggcgaggtttgcccctccgccgcaggcttgagagttacgagagaagggaagaattgggacaataaccaaattgcttaatttctggaatgtgccgattacagagatatatggcctaaggcccaactaaccaaagagctaattgctcctaaatgcaagggctaataacaggaaactaattatcctttccatcctagccactgaccgtggcctgatctgccgcagccgcgcgttctgcctctgcgcgcgccgcgcgttccgcagctcggcgaacgtctcgcgctctgcggcgtcgcacatacgtgcgcccccacatgacatctaca

SEQ ID NO: 13841 - DNA, 1501 bp, Oryza sativa
tatggagcttgtacttgtcgatgacatttcttggaattcgacgcttgcaatggcatttattagattttctatatattcaaataagtaaacaagcaatactagcatatataaatatattttatcaatgacatattattatgtgataagtccattttacaccctttaactcttcagtttgtctaaaacacaccctcaaactgtaaagctgggtatctaacaccccaaatatcaaaaccagatactttaccccagttagcaattttaggctggttttggtacaactggatgccacgtcagatgccacctctactttaaaaatccacgtcagcaagagggaaggagtcccactactcacttccacctgtcttcttcttccttcccctctatctccctctcccctccctccctgcttgataagctcaatggaggaggtgaggttgctggcaaactccctccgtcccggtctccatctcagcatccactgttctcactccctcctcccctcgcagagctataagtggagtggttggggatctcgcatcgaccacctcaaagaggagctcaccggagtcccttcgatactgcctagatctgacgaggcactcagggtatgaggacggggaggtgggtgcccctagagcacatccttccgtcgtcgctgcccggtcaggaggctcgaggtgtgcttgagaccgagtccctcatcctcgagcttgatgtggaaagacgtggtgttagtggctgagctcggcgctagcgactactgaggcaagatattggtggaggtagcgaagctagagctcgactgctagccaggaggaggagaaagattggattgggggagattggtgtgggcggcgtggaggtcggtggtgagcaagtgagcttgagcttgatttcttcatccgttttgtgctggaggatattgtaggcaggcacccttctggtcaccggtctcctgctcttcttggcggtcgttggtctagtcctttgtaggtgatgggggtgaggtggtggggtgtctttcgctggtgatgggggtgagggtcaggtggggtcgtggcgctagttctctaccgccgctctatgaggtggcggtggtcgagacgcggagcttaggaaagacagagcacgagctcaactaggcattggagctctggggcgctctagtctggcaatggtggcggtggccgaggaagagacgaggctgagagagaagagaggtaagaggtgttccctaacatgtggatcatctggatcatctcgtcaacacaaaaccaccttaaggggcttattgcacggttttaaaagttggagggtgttaggatatctggttttagagttggggggtgtaatttaaaccaatagttgaggggtgtcaatggacttatccctattattatataagtttttttcccataacaaagcatacggacattttgctagttatgcgaaagacgtggaatataatctgatattttcatgaactatttcagaaagt

SEQ ID NO: 13842 - DNA, 1501 bp, Oryza sativa
tatggcatgttctagactgtgccaccgtttggagctacagcgccatccaacttaattatggtcgcagtcaggatggagctacgtgtaaaaggaggtgcttaagaacttgatcaagaaaatattttaagcaatagtttatcaatttttatcatagatgcacccactaaatataaactcagatacctgatttaaaacagagtaaaccaagtggatgacaccactctccaattcaatctagcttcgtctaggatcctagtgtacttagccaaaaattattgatttaattcttttattaacgaaaaacattattgtacgtttttttgtttttcactgtaactttattcaacggaatactattactgtacggagtattatccatgacgagtataggtacagacgcaacaaaatcaccattcgagaagcttctcctctcctctactgctcctccatttctcgaacctcgctcgtcagtctctcgatttctcgaaccttcttatctgacgttgacgcccctcagaaaaatccactcccattttaaatccccaccaccatatatccctcgaattcatcgtcttcctcagctcaccaaaatccccagtcccgcgcaaccttcagctctcggtctgcgttagctcctgaagaatcgaagcaatggcggacctcttcttcggtggccccttccggcgaatcctctacgggcggcccttcccgccggattgggcgtcggcgtcggcgacggcggcgatggactgggtcgagacgccgacctcccacgtgctcaggatcaacgtcccgggactgggcaaggacgacgtcaaggtgcaggtggaggacggcaacgtgctcaccgtgaggggcgcggcgccgcacgcggcggcggagaaggagagggagagggagaaggatgtggtgtggcacgtggcggagcgcgggcggccggagttcgcgagggaggtggcgctgccggcggaggtgagggtggagcagatcagggccagcgtcgacaacggcgtgctcaccgtcgtcgtgcccaaggagcccgcgccggcccggcccaggaccaggcccatcgccgtctccagcaagctctgatcctgatcaagcccgaccctttgtgcattgtgcgcaagtgtttctgtgtttgtgaactgtagtcgattatagcaaccatcagtcgaatgttgtgaagggcgaatgtgtattggaagtccaaatcttaatgttgaaaattttgaaaaattttagaggtttgaattactagtatatctatgtaataatctaattaataaaggtgggtcttctgcaagcttactagcgcacttggcatggttaaagtttcacatcttaactcttgaaaagacaaatccaaaacagaacaagaatgcaccacattatccaataaataatagccattagatcaactagcaaacaaaacaggtagaataaatcttagccatttgataaaagaggatgttcaagaactttccggtgtatcctttat

SEQ ID NO: 13843 - DNA, 608 bp, Oryza sativa
cattaggaaaattaagaagtgtgcacacagtaggtgaattgcattgttatcatgacgtccagatgggcaagacacaccattcactgcatgtgcagaccaacataaccactacatcctcgccatacttatgtattaccattgaccagtaacacctttgaatacatattcatggatgtatttgcctggaaaaattgtagaatgcctaaaacagcatggtgttactcctctaaacgatagacaattgatatgttccaaaatagtaagagcaatctaggtcacttgttcacaactttgtgcacacctgatacatatggaacgcacattggtaaaacaaagatgcccacatgttccaatccaatcatgaaaaggaaccctattttatagggcagattaacgttagcatgttagcatccaagttaactcgaaccacccaatacaactctcacgtttacttaaactttcgtcgtgacatgtactagactaaatcttgaatgtcccaagcaggcaggcaatctaattactctgcatagatgaaattttccagatagaaactaataaagaacgaatcgacaacaccaacaaattacaaagtgtttccacaaagtagg

SEQ ID NO: 13844 - DNA, 1501 bp, Oryza sativa
gacccggaggtatgcgaaatgagggaaatctaccttcccatcctgccacgtgtccctacagcctggtcctgcccccgcattccgcgaaccgcaggagcagccgagggggtcggggcctcggggtgccacgtcatgcccctcgggcccttgcaccgctttgccccgaggccctcgcccagccgccatttggcagggggagcgagcgaggagggggcccaggctgaaccccctttaatgcgcgcagcgccccaactgccccctgtcgcatttaatgcagtggggtagacgtgcggcgtgctaaactgacgcgcaatagtcaagaatgaccggtctgtgaccggcctgacgccggtcacgtctgactggacggacaaccgtgctcccatgtcgcatctgcttccggcggagtagaggtaggtatgacccgtcccatcggagggtcattcggacggcggccaccacaagtcttcacccattaatgagggaatgacagggttgtcccccgtgtcaggcgagggacagcgctgggccccgctcaagggcaagctgtggtttagcttccaggcgaaggcacgggtcgagttccggtcaagatagggtgggtccccacccgaaagaagagtaggtagaggcggtgcatgtggtatccccttaagatataaaaggaggacattgcccaccgagaaaggggacgactctcagtgaacttgagctctaggagaagagtgttctcctgagtttaggaacccttgtaactctcagtctaaatcccatacacaggagtagggtgttacgcttcatagcggcccgaacctgtataatttggttgtgtgcgagctagctaggagccttagggacagatacgtgatttctagaggcgagcttcttcccccggctgaactcacgaaaggggggtctcacgacctcccgctagagaggatcatccctcgacagctggcgtgccaggtagggggaagtcgcgcgctttaaagagaagtcgtttccttccgtcccaagtttcccttggccctcgacgatcatggtcgaggtcctggaggaggaggcggtgatgttcacccccactccgtctgggagtgaggatgctagcgagagctgcggccctcgtcaccgccgccgcaactctccaactcctccccgccgcgatccctcgcggagggaggaccccacccattcgggtggttcggccctctccccgcccccgggcggagggaggccacaacgcgtcagggcacggcgccgcctcacttatggtgacggcggctcgccccgaggcgcgcttcaagcagtgggtgtccttctgcggcatccccccgtgaactcggagccagagacccctgtccagcgctggttgggcgacgtggccaacttggtcactactgcccagtggcagttggccgcgggcggccgacccgccgtcaccggtacgtcgcgtacccccattaccctctcctcgtcagcaaggaggagggcccgtcggtcc

SEQ ID NO: 13845 - DNA, 1501 bp, Oryza sativa
tgtgttcttagccctatatattgtcttgtgcactagatctgcgcttttgcttttgtcttctatatgaaaattacagaacatgatgtggttgtagttgtggactagatctgtgcttttgcttttgtgaactagttatgtgcttttttattttgttctagaactgtgttttatgcttttttctgaactagatgtgtgcaaataagggagtaatgtacatatgttcacctatctgtatgcactgattgtttttgtagtaatgcattcaggatgtttttattctagaaatctgcaaatgctatatgttaattcaatgacaaccttatatgagcagttaaatttgttattgatattatcagttgttttttgcatgactaagatatgctggtttgtactaagtttcaggttttatatctttattagaatggtattatggttgttaatttttttttgtctctgatgcatgttccatgttcatgttcagtattcaaaatgagaagagtactgttatgtttatggttgcgatttgtgttcttagccctagatattgtttatgtggactagatctgtgattcatttcattttagatatatctttttgtgattgcttttttgcatttgtgaactagatatgtgcttttgcttttgtgaactagatgtgtgcaatgtacatttgttgacccttctgtatacccttgatttgcatgttctgtgcactgattgattttgtagtaatgctttgatgtcagtttctaaatctatgcaagagaatgctatatggtatttaggtggatgtttatgcactgattcaggatttttttttctagaaatccacaaatgctatatgccatttgcattttagtttggtatttttaatctttcaatgacaaccttacatgagtaaataacacaagttattgaagatttctgtactagaatgttttttatagtagtcaatttttgtctctgcattttgcatgctcaggtttagtattcagaaggagaagagtattgttaatacatttgttcagaaggagaagactatagtattcctagtcatcactatactctgatatatgacatgagtttgtgctacacatttgacactactctatggaaataattatttctactatatgaaagtaatattattttcatatgacatggtgcatttaacttgtatgttttattctgttttgttatatattttagtccataatacttatgttttgagatcttttttctctccttgcagtatgggtcatagaaaaagatcaaaagtggatatttccagtgaatctaacagtgacaatgattgtagtttgagttcagataatcatgatggtgatgttcatttatctaatcatgatgaaagttctgataatcatgtaagttcatttgtcatgttcatttatcatggaagtttattttttatttcaatattttttttgaatcttcttgtttttttattaaggaccaacattttgaggaaaatgatcctttgc

SEQ ID NO: 13846 - DNA, 1501 bp, Oryza sativa
ctctctcccacgtgctggtgacctccggcgcggcacagggcaccattccctccctccatgggcgcgtcgtcaccgctcgtcctttgtgcgctggcctgcttcctccgcacacgtgatgccgctgcccaccctccacacatcgacgagctccttcgccacacagggcgctgcttcctcccttcccgcgccccggcctccgtcttcctctgtttgagccccgccgccgggtcggccgcgacgacgacgacgccgtggcaaagaggatgggtggttgacaaatccaaaattttgttatattttatttatatttttataaaatagagtcaaataagcaagggtagaaggggcaatttttgctccgattaaaactgttacatgctcttaatggaatagggtcagattgtatcttcaattttgagaaaaatggtcaaataagcaaagttgaaagaagatagtcaaattggtagttagtcctcaaaacatggtcaaatgcacaattgccccaaaatcttattattgtgtgtgaggcaaaggtccgattggttggtaactaagagcatcaccaacagattatctataattttctcctaaaaatttggttttgggtttcttaaactaaaaatagaagtgaaaaaactcctccctccaacagatagcctaaattaaatccccaaaacttaaaaagtgggcccttctgttaaactactaacataaaattccgtttttttcttttatgtgcagaaagatcgctatctcccacgctcgggaacggaggagagaggcgggattgcgagattgggagcgacttccgcgcccgcatataaacggagcaaggaatggggagaagggaactccaaaactcgggtaggagagtaggggatctgttggagttgtttttttttttttttgactaaaatccctcaaaattagttttagaaatcatataggtagattgttggtgatgctctaagggtgggttttgatgggaggttttggatggataggacatgacgacccttttttttattgtttattacctctctcctaaaataaatttatttttcacccatctcacacataccaaaagactaaaatactcatattttttttccaatctcaatacaattatttttcactttatctacttccaatataattattctttgttttcacaaatttcaatgcaataattacttaaaaattaaatttattttaagacaaatgagatgagtaaaaaaacttaatatgaataggaggaaataatttatattccaacctttgcttcaaccatactccagttgtaccaaatttcagatctcactgtccatcgctgcccgaagacaaatcgtgtccacggcggaatcacaaagcccccgatcggacggccgataaatcgccggcgatttgatccgacggctggtaaatgctcaagcgcgactcatctccccccaaccttctcaacccacgaggtgggatctcacggcctcatcggcgggcgaga

SEQ ID NO: 13847 - DNA, 1501 bp, Oryza sativa
gcgggggcaggtggggttcgtgaggcacgtggtggaggcgtgcgtggcgctgcggcgcgtcgtgctggtgaggcgcgggcgcgtcgtggtcggcagcgaggggcggtactgggactggaagctggtggcggcggaggcggcggcgccgcgtgagggggaggtgggaggtggcggcggcgacggcgagcgcccgacggcggcggcggagtggagcgaggtggagaagatggtgatacggagccaggtgaagagcgcgtcgaggcctgacgtggaggtgttcattggatgacgtatgctatcacgagtccacaaacactttttggacctagtgccgattgtatgcgtaattgcgtataaagggtgtatatgatattttcacatctaaaatcttaaatcttagggataattgcatatttgcgctcgtttgaagcttatctattaaatgaccctactttcttatagtttgcttatttggctcggcttttcaagaatgaataccctgtctgaccctatttccactacaacgttacggtttcatttttttaaaaaaaatataattattattcgtaatgaccaaactactctcaaaccctatccattccctccccctctctcgtattccggttgaggtggcggcgcacggaggggacgagccggcacggccactcatggagggaggtagcggctgcggcggagggaccggacccgcggcaacgcgtgtgcggaggaggctgcgggtgcagagaaaggagcggcgacgacggcggtggtggcctctctcccacgtgctggtgacctccggcgcggcacagggcaccattccctccctccatgggcgcgtcgtcaccgctcgtcctttgtgcgctggcctgcttcctccgcacacgtgatgccgctgcccaccctccacacatcgacgagctccttcgccacacagggcgctgcttcctcccttcccgcgccccggcctccgtcttcctctgtttgagccccgccgccgggtcggccgcgacgacgacgacgccgtggcaaagaggatgggtggttgacaaatccaaaattttgttatattttatttatatttttataaaatagagtcaaataagcaagggtagaaggggcaatttttgctccgattaaaactgttacatgctcttaatggaatagggtcagattgtatcttcaattttgagaaaaatggtcaaataagcaaagttgaaagaagatagtcaaattggtagttagtcctcaaaacatggtcaaatgcacaattgccccaaaatcttattattgtgtgtgaggcaaaggtccgattggttggtaactaagagcatcaccaacagattatctataattttctcctaaaaatttggttttgggtttcttaaactaaaaatagaagtgaaaaaactcctccctccaacagatagcctaaattaaatccccaaaacttaaaaagtgggcccttctgttaaactactaacataaaattccgtttttt

SEQ ID NO: 13848 - DNA, 1501 bp, Oryza sativa
cgccgccgccactcccgcgtttccgctgctcgcagtgacatgccgccgcgccactcccatgcctacgccgcccgccaccgccgccgctccggccctcgccgcccgccgcaggagagaggaagagagagagagggagcggcgaggagggagaagaactggagggagggcagagagaagggacacgtgggtcccacaattttttttatgtgccactgacaaatggtcccacacatatttttaaactctaaatgccacctcaacgccacgtgtaaagaagacccggtcaataccgccacgtaggcgccacgtcaacaaaaccgtccttcaaaaccgccaagggagtcaaattgcaccggttttaagagtttgggtgtcgagatatccggtcttgtggtttagggttatggattagattttgatcgcttttgagggtcactaagtgtacttattccttttctaaaagaagaggccgaaacaacaaactatgggccatgatgggctgaaacctgaaagaagatctagaactccacggattgtggcccatttatctaatgttcctttgtgggtttttcttttatgacgaacttaaaaaaatgcccgtgcgttgcaacgggtgaaggctattttaatcttattatcgttatacggtttagttaatatgaaatttactgtgagaattcgcttgtatatatatttttctagaaaatcatgatctgagaattcgtttggatatatatttttctaaaaaatcatgagttgcaattaggagtctgatcatctcaagttagcatgcgagtttttttaaagagatttcttatacgactccatccatatttccaaaagcgaacgaacttaaaatcccgactcaaatacggatctatattttcaaaagcaaacaaacttaaaaaccgactcatacacggatgtcgtatcattatacgacagtaccggcaaaaaatcttcaattttaatttttatataaatagtagagataagataaagatacatgtgcatagtagcttgattgaatatttctctgattaggttttcgtatttctcttggcaaccgtgatcgatcggttgctgttcttgatcgtcttgctgcacgcgtggattttcgatatgtgggtagtaatagatctcggctttaatatcatgatttttttaaaatctttttgaaacacgtataaacagcagatcgtattggattgagtttctgataaacacagtaggaattcttctcgatacagtgtgcgtgtagagaaaaatcaacaaatcaacaatggtatgtcttgctgcttgcctcggtgcacggcgacacaactgactgctgctggttggtgttgatataggtgcgcgacagcaggttccaaaccgtgttgccgaacagatcgcatcggcaagatgacaacttcgcgatggtggttggttcgtgacaatgcactggacgaaacacaatcggccgaaggcactgatccgaacaagcaaattttggaaaatc

SEQ ID NO: 13849 - DNA, 1501 bp, Oryza sativa
aaaaaagagttgttaaggtgtactgtaggggtggtgtacaaattaagatatggctatagagtgatactagatactagagaaccagagaagtaagttgaagaggtatgtcaagatggtggtagttcgattgcctggtcaacaatagcgctgcagccaacagaaacagtcaagcaagtacggcagaagcaatgtgcagccgtagctgcagccttgactggcaacagccccaactatcaaagtgaaaagtgaatcatgtgataattctagaataacccacgtcatgttgaataatagtcgtcactcgtcacatgcaacacaaattcaatatataccgttggatatggtcatgcaaattaaaaaaaaaaaagatgggtcaacaagagccttcccgaaaatcaccgtcaaatccacatctcactaaaaacacctagactaaagagtgaggtcaggactcgggacaagccagaacaacttcccaagaaaaaaaaattagctaggaagttgacaaataatactctggaaaaaaaaaaacaccgtgaacatcctatctctctgacattgctatccgcctcgcacaatagaactagagatggacagatgacaacaggcaacaccttatcgccgtgaattgacaagccatggagggaagcttaccaaagcccggtccggatccctggcttcccgacacacatgaaggttgatgtcgtcggtcgttgtctggatttgacacttgaagcttggggaagatagatcgagatgggcaacgccagcgactgcacactaggggggatggcagtaaaaagtgtgtggtttcaggtggtgtttgaatccagggacttaactttagtctctgtctttagacactaatttagagtattaaatatagactacttataaaactaattacataaatgaaagctaattcacgagacaaattttttaagcctaattaatctataattagagaatgtttactgtagcatcacataggctaatcatgaattagttaggctcaatagattcgtctcgtgaattagtccaagattatggatgggttttattaataatctacgtttaatatttataattaatatttaaacatccgatgtgatagggacttagtgttagtcccatctaaacagggcatgaagattgcccgagctcaagtggcagtcaaagccgagacattgaaacgtatcgacagcagtcaaagcggtggcgttatggagagtgagacgagagagggagataaagggctctggacatctcatgtcgaatttttttttatttttaattttttttattaaaagttttacaaaaataatttttcattttaaaaattaacggaagtagtcgcctaccgccctgccctcccagagggcggcgaaaatgacgtggcagacggccgttcgctttcgggcgacggccgtcaacgaaatttgtaggcggccccccttgccgccttccgcgagggcgattttgtactgtgcggggggccgcc

SEQ ID NO: 13850 - DNA, 1501 bp, Oryza sativa
caaccaaattgtaaaaaaaaaagacgcaaatattatagaatgatctaatatcaaataattagaattggtgagacttcgaatctatatcatttagcccattaacttatgagggcattcccaacccaatgactagaatggtgtccatagcattaaatgagttgccacctagaaaaaaaatgatgtgacaagtgaataaatgaggaaagagaaggaaaccatgtcttgcatgagacatggttcctacacaatatccaatacatcatgtgagataagtagcattaaattgaagttatggaatagtggtgtttgcattgaaagagtagtgtctagtactattttcttaatgatgtggagtttatagaaatcatgtctagtgttatgggttggtactgtcctgaagctgatacgaaacctttagacgtttcaatccaattgtacagactacaaaaaatacacagctagcccaatttgtctttcgttggacgcactggcaaggtaagcaactaaagtagtaagcacccaccacgtatatatgtatgtgaagcatatggattatgaagtttattattcaaattcatgcacttgccacgtgcaatcccaactatactgttttgacatgctgacgatgatgtaaagttataaacagcagatcgattaagcttagtcgtactaattaattcctcgcaaaaaaaggctaattaattaattaattaatagtcgtaattaaacaaactaattattatcggtctcacgctagcacgtcattactgtttctcaccgatcacaagggaaccgggcgatgcgtatcgttgccacgtccaagtaggctagctacttcttcagcttaacaacgcaacagacgtgtctacgaatgacgccgacgtctcgaccgtttaagcatacataaccgcttctgttgatcggctcaatcaacgaaatccccgaaaacgagcgggtgcactccacttattactattatgctaccaatattattaagaataaaatagttatttactaataaaataattaggagttattttgcatttatattttttccgggtaaattgattatgatcatccattgtgtgctagcacaattcgtatttcatacaaaagccgaaaaagagagaaaaaaataaagtttattcactatgacaagacaattatatccctctatacttattttataataatactttttaatattggtggtagtataaataaatccaaacaattcaatcatttatgagataaacggttgttttctactactgaaccgtttgggcgaagaaaacgctggtagagatttaactcgatgatgatgtcgccacgacgccttgtatatatttagcgccgctcgcatatctcagactccagtcctcaccagctacagatgattcttgcgcttttgattttccctacgcttttttgactaaaaccctcgattcctcctccaagatcctggagagactagcagcagccgtcgctgtacgtgtgtatc

SEQ ID NO: 13851 - DNA, 1501 bp, Oryza sativa; identical to SEQ ID NO: 13836

SEQ ID NO: 13852 - DNA, 997 bp, Oryza sativa
agtatactaatttttggtagaatgatattgctaagattttgttttagattattacccctatcaaaatttagcaaagttaaaatgatgataaagtgaacaaccgaacatatacaagcttatagtatcgcagatcgcatagcctcacttgacactgcctccctcccagtacaactctcccaagtcccaacacactctgactgccacaactgcctgtgcacatgtgaaacatgcaatgcgaaaaaaaaaaagtagaaatagtactaataccagttctaaaaaaaaaagtactactaatagcggatagagcagaagtgtcacgtactgtaaataaaatacatgctagttgttcgcttagattatttgtgcctactagtctgttctaaaagaagataaaaccctatatacaacctgacacgcatatatctaggtttataattagaattgattttttaagaatgcaggggtacatacgactttgattgttcaaaaccacagctgacatgtacgtgaaaagaagcaaacaaaaatatggtttaatatttttattagcggtttgaaagcctatattaaaaaattgttttcataaaatgacttcaaaatcaaactcttctaaattcaacttctggatgtggtagaaaagcaggcgaaatctttatatgtatctagtacgcatcgacggcatcgtaccttggcgcaaactcatcttgttgaaacaaatcgcagtactaaaaactatatcaagtctcatgaagaattaacctatattgtattgacgagtgacggagtgagtataggaaatactagagtacaaactacaaagtgtttgattcctgagggagctcgtgactcttataatatgtatatggccagcattaaggaataaaattgttcactctttagtcaagttgccttttatttttcttgtcgtatcctctctgcaccgcctaaagaaatagttagaaaaagcttggatcttcctcgggtactgatgtgacca

SEQ ID NO: 13853 - DNA, 1501 bp, Oryza sativa
gatggaatcggagagacatctgccccgtacccgtacgtacgtgcgggcgtgccgcggaaaaactccccgattccgtcgaggagtcgatctcctccaccgcgccacacccacatatacaaaatctcgatcccgctcgttcaataacgcgtccgcgcacggcgacacacccgatggatcgcgagcggcggcggctgcgcggccgcggcgggaacaacaaccacccacggcgcgtcctggccgacgtcgtcatccgctgcgaccccacatggctggtgacgatcctcctgttgtcgcttctgctactggggaaggcgacggggaccacggcgacggtggtcgtctccggcagcatggagccagggatccggcggggcgacatgctcatcgtacgggagcggcgcaacgacggcgacggcgacgacaacatccgcgccggggacatcgtcctcttcagcaccgaactccaccccgtccccatcgttcatcgcgtcatcgagctccacgagcgacacgacggcggcgcgaggcagatgctaacgaaaggtgacaacaatggtgtcaccgatagaagctccctctacacggggcagtggctgcacgatcaccatattttgggaagagcagtcgggtttttgccttatcttggttggccgcgttgcttgatccaagattttgtacttgacaaactgaatttgtgacgccggtaggcaggtttagtggaagctttgagcttgtttcaccgatgattgactggcttgtgacttgtaatgcgagccatttgaagttgtcgtagtgcttgtgggtagagatatgcaagtgtaccggcccgtgaatacaattgtaggccaaaaaaagtgggtaacctgtaggttctcagtcgtggttcggcttgctgcacggttatgggcaattagaggttaataattagttgtgtttctttctataaggtgaaaccccacgcattgctgcgggaatttagtatgataacaataaaaaaacatgtaagatagctagataacatcagattaagtaaattaatatggtttataataatttaaatttaaatagtatgtagaatggtgattcaaacgtaaaaagtaaggtggtatgactttatggaagaataaaattaggaagatagtttggaccgtagattaatcatctaaatgctaaaaacaattgatgtgatatgacttatttagaggaaaaaaggagaaagataatttagaccatagattaatcatttaagcactaactaagtgagaatgaactatataagtatataggatatcataaaacataataaagatatacattgaaacattattttcaattatgtgaattatgttggatgataatttaacatgtttgtatttgaaaagctcttaaattataaaaactataaagatatagcatatttgcatgatgtttaaatgtgatgattgttagtggatgatgatgtggcatcttgttaattagtggatgatgatgtagcatcttt

SEQ ID NO: 13854 - DNA, 929 bp, Oryza sativa
  unsure (1)..(929): unsure at all n locations
cccctgcctgctgcagaggttcgccgccgctccggctgcggtcgccggcctctcgttcttccttgcagccgtcgtgcggcgctgctgctactgctccggcggcgacgaccaatgggggagagcagaggctgcagctctgggactttaaggtagagtgggtagccagtcggctgggtccgcgccttggatgatcgcggagcaaggtcggatggacgccgcgccgttcagccctggccagcgcccaacncgtgcgtcctgactgccgatgtcccttacgtcnctcgtcaccgccgcgcgcgcgatccgtccccgtaccagcccgtggccgccgccgtcgccgatctggctcccgctcctcgcgtgcgtccgaagggggagagaagagagagagaagggagagagagagagggaggaggaagaagaaagggaaaggatgacacgtgggctccagatgtcagtgggtcccacaatatattttgtgtgtgaatgatagattggtcccacagatatttttttaattgtaaagctacgtcagtgccacgttagcgaaaccgccctccaaaaccgctagaggagtcaaattgcactggtttcaataattcggggagtcgtcctacccggttttctagttaagggtcacgaattagattcggtgaactattaagagagtctaagtggtctttttcctttactcaaccagctgtagcaaggcccattaggcccaattactaggcctatattctgggcttctggccgcgccctcgtttgccgccgcctctgcctttccctgcgatgggttttcctcctctcgtctcgccgccacgtcgccgccgccgccgccgacgagcagccgcggcgaggcgacgcacagctcacagctgcgaaccctaaaccctagctccgacccactcatccagtcccttccgcca

SEQ ID NO: 13855 - DNA, 1501 bp, Oryza sativa
tcgaagtcgaaatcgatgtgcaatgatttaacagacgagagcacaccggtgcttagatttccatattgtttagtcaactaacagccggtaggattcgagtaatttcaactaactgcatgtttgagaatttccattagagagttttgttaccattacatcgaagtcctgtttagaaagtaaaattaatgaaccagagattgtgttccaaacaggtctcgatgaatttggttacaaagaatacaggctgcaatttaagtagtctaattttaactcttaaactatgctcgaagtctatttattatgatgaaaagtaaaagataaactattttttatatctttgggttaaacgcatatatgtattaggtttcacctattttacattctgccactttttttttgctaattgctatataatcccactagtttagcatgaagatgatataatgccattctgttgtgttagatgacaccaacaccattaatttattgtgaattgactttgttaggcactatgaattataaacgcacattgctactaccttcgtcctagaatacttgattctttagaattcaaattttatcccaaaatacttgtcattatggagtactagttgtcccattaatcactttctattcaaaagttttcccattttaccctcaataaccattccacttcctatcatatattatttattaagggatattatatttttttattaaaccttaatatatactaaacaatctagaatgacgactattgtgggacgaagggagtaaaaaatatgctcctacctcagtttgagatgaggggtatttatgtcgtaatagaatgccacggaactttcaacaatttttacttttcctaatttcaaaatttaaagatacattctccaatccaaggacaccgtgacagttagctggttttcggtggtaaattgacaattacaacatgccctaatagcaaatatacaattgtttctacaattattacatataaaaatgttgagtcatatttttgtcacggaactacttttacgtcacatgtctgatacgttttacaaatgtaaaaaaaaaaaacaatggccaatggttactacagagaaccgagctactagcagtttttctcccggtgagacaggaagtaaaagaaaaaaaaaacgacccactgccaaatggttgtatcaaagcatcaacaattcaccccccgcatgtgctggtagtatgacggcgtataaaacagcacatggaaacagatgaaccacaatcatatggtaaaaaacaaaaacggaagctcaccttcccaccgccacgtcccggctccccatgcgaccgcgcctatggacgggcgccctgcccacgccactgcccccaccgtcgcacgacggccgcgtcggtcgccacgtctccatctccctccacaccacctggtttcctcttcagtttcctcctcattattcctcctcttcccccctcgccgcttacaacatccatccccaaaccc

SEQ ID NO: 13856 - DNA, 1135 bp, Oryza sativa
gggatgggagaagtgagagagaggaagaagaagaggggctgtagttgaagagaggtagatgctgagaatgacatgtggggcccacgtgggcccccaccattttttattaatttatgtgtgagactaacatgtgggtcccacgaagtttattattttttcggatcaaattgccacatatgcgccacgttaatgccacatcagatgaagacaagtcaaatttgccacgtaggcgccacgtcaaccaaaaccactctcaaaaccgtcgagggacctcatctgcactagttttgataattgagggacccgttgtatctggttttctggttgaaggacgaaaatcggactcgttgacaagttaagggatctcagatgaatttattccttatttttacgtgacttgcatagataggatattctagtaattgccccctaagaaaaacagtaaatcaacaccatgaaaatcaaacgatttagttaccatacaaatattaaaaaggaaaaaaaaagtaaaatcaaatatgaaacctgagatcgttgccctagtaatgactgaatccagaagaagggacaagcaatagaaaccaccggggaaacagacaagaatccgagtcattcatcacgttcgtcacacctcaccatgttttgcaactgctcctctcaaaacgtagctacagtttttttttcttgttcttcttttttttttttagaaacacagtacaaacgcaggcgctcacaacgtgcgcacactcaccccctataaacacacacacgcacaccctacccctgtaagcacctccggaagactgggccggcaaatcttaagatttacgaagtcaccacaggcgcctcgctgtcgacgggtacgtcgcctaccactgaaagcataattagccataaatacgagcacccgcgtcaaatctataatttaaatctaggtgggctggttccaccacaagaaacctagccagttgagctatgctcacttcgctttcttgttccttttggaaagcctatgactaggcgtcgcggccgtacgtgctcctgatcatacatttagttgctgatagctgcattgcagaagaacaagtgcagataattaagcagattaattatcatgtaatcaagcctggacatg

SEQ ID NO: 13857 - DNA, 1501 bp, Oryza sativa
tcaaataaaaaaagaaaaacttttcacaaaacggtagctcttccaatggtatcgtacataatcttccctggttaaatcgtccattataatatagtagtactactgccacctttttgaacggaattgagggtgagagggtgtgtcgtaaaaaggtggcgatgtgacaggcaagatgaactgatgatattttaccgcgcgtgcgccgacctgaccgtggacggtgacctctgatgtggacgccactcgggtgtactggatgtgggccatgagcaaccgccccgttgctggtgtaatcaagcactcgatcgattctcagatgctgcttccagaaagatctggagctccatagtagcgctatgtacatctaaaactgggttctccgttctctgatgcgcttgtgcggttgcgcctaacctttgatcggtccatctcatctcctcttcaacccttaaccatacggggattgcttctttctctgtcttctttcggtgaacatgtataaatccaagtacaagaacaaagtgaaaggttctcaaaaaaaaaaaaaagaggcatcaatctttttttatgtacgattcgattcattaaattgtttattagaatatttactttgatttctacctaacaataccaaacaatactttgtagtaaaggtattcaataaaaataaaacgcatatattttactagttaattactccactaccaattattttgtatcttgcccctctctctcgatcaaacggtccacattgctccatctctcaatacatgtctcgaacgaaatacattaacatggaaggacctactaatatagcagatggttacgaaggaaattattgttgacatggtgtcatgggtggacataagtattatgcgtattcaaataaacttactataggaatttagtaagattataattgattttcatctcttttgactggatgtgtgcatgtgatgttgcgtgtatagtgatgcgtacgtacaccttataatgcaatgataaaaaaaatatagtggattgtcatgaaggcagtaaaccgggtcaggagattatagtccttgccttacagcctcacgtgtgaggtggaggatggcagctataggaagacaacggtcgatggataggtaaaagcttttacacttattttagcaactaattgaccatttaagcgaacactgaaatcttgaattggtagtgtaaccgttatttttaggaataagtacatatgacgtcccttaacttgtcaacgaatccgattttcgtccttcaaccggaacaccagatacaacgggtccctcaactatcaaaaccagtgcagatgagatccctcggcggttttgagggtggttttggctgacgtggcgtctacgtagcaaatttgacttggtcttcttttgatgtggcattgacgtggcgccatacgtgccaatttgatccggaaaaatagtaaacttcgtgggacccacatgtcagtctcacacataaatcaataaaagaa

SEQ ID NO: 13858 - DNA, 1501 bp, Oryza sativa
gtgtgggttccagcggctcagtatcgaaaatatgccaaattaggctgtttttggttggctagtctgtggatgtcatgttttcggcctgttttaagcagggatttgctttggtggctgcattatcatagagtttgttgtctagggcttttgcatctcaaattgtagcccattgggcggtgtttctgattcttccagagaggaaatgagccgtggtctctgttatttaggattttcagtatttgagatattgctgatccgcccttgcaatagaggatgtttgctatcggcatgatggctgttatcgtttgcgcctcttgagcttctgagctgaaaccttaacagagaaagtggtttctgcttctctgttggctggaagtatatttggaaattgaattatgccgaattgtatgttagtgtgactagttatcagtgggttaccgtgctactttgtagcatcttatcttatactccctccttccctaaatgtttgacgccgtcgacttttttaaacatgtttgatcgttcgtcttatttaaaaacttttgtgaaatatgtaaaactatatgtatacataaaagtatatttaacaataaatcaaatgataggaaaagaattaataattacttaaattttttgaataagacgaacggtcaaacatttttaaaaaaatcaacggcgtcaaatattttgggatggagggagtactagttagaatagggttagaatagggtggtgtctttagtattgtgtatttcactttaagttagggtaagtgaaccaatttaagggttcttttatcctattgtacgttggcattaatctaaaatttatataggtttcattattttggtgttggacatgtcatatctgcatgtgtactaaatccttacactaatgcgatgcctgacatattagttttcagcaatcagcatcattctattgtctaacaacactgttctgctattatccaaaaaataatcctttttaggaaaattctaaaataattagtccatctattctggaaagcttgttgataccagaagatattaccctgttatgagctattttacctttttccttttctaaaagaccagcctctgatgacgtatggtttcttatttttgtgaatgaactggacctgaacagtactggttacagaaattagcgtgacatcttctatattttctatgtatgttaagagttcttgcttagacatttcctgtttggcgttcttaaatcaccctgaattcactggtataatttaagtgccatcttgatttcacaattgtcctatttgtcttacatatgaccacttgcttctgttctttccagtgtgttgtgtgtactgacatgcctgtagctttttggttttgtagttctctgtatttgcatttcaaattagttaatctgatattgcaaataaggcattagaaagtgagcactatttatgcttaatgtcatctgtattcttgtagtattgaatatgttatcactgtttttt

SEQ ID NO: 13859 - DNA, 1501 bp, Oryza sativa
ttcacgacgactcgtctttcttttcactcgcgtgctgcgcgccgagaccctctaccttcgacatcctgcacaaggagaaggcggcaataagttttttgggaagcgcttcgcacgaatactccctgttcgttcacgacgactcatcttcctctttgctcacgtgctacgcgccgtcgtcaacgcctgcaaccgtgagtaattcctgctgagcaactagtcttccggtaccctcgatacgtgttcaatatattacgcatatttgatctgttgatgctttactgcctagtatacatatgtagatctaatgatggatttatactagtttacatctacaatatcatgatttatttatggaataaattaaattattatatgcttataaattcaacagtacccgcgctgcagggaggagtgccacgccgcgtagtcagcggtcttgttgatcagctccatgacgcggccgccgaacttggcggcgccaccggcgccggtcacgttgttcatgttccacgcgacccacgccggcgcgttcgttaggttggcccggaagtcctcgccggagaaccggagcatgtactggtcgtagtagatcgtggcgtccctgaacctgtcgcagaagaggcggttctcgacggcattctcgaacgccttgcggaggccgttggcgcactcgtcgccggtgtagtcgccgcggcagagcgcgatgccgtacgccgcgtccggcgcgctgccgacggtgtgcgaggcgaagttggagaccctggccacaccgacgagccgcgcggccagcgccttgaggttgtcctcgtacgtggtgttttgaccgtagcggccaccggacaggctgcagttgtagtatagcgggttcacctccggcgaggccactgccaccgcctcatcttcaccacgggccgtccatgccgacgacgagaggacgaccaccggagagaggaagaggaggaggaggggttgcatttggcagtggagagaatatactacgtcttcggactagtgtttgattagctattatatatgcatcagtagtgctatgctgttgctagctagtgttttggtttaatggtattgctttcgctttgctgggccatatatataggcacagtagcatgcatgcaagttttgagaagtggcgtgccaatgtcaatttcttctatgttacaagacaacgcgtttgttctcggtcgaggacctaaaataactagagtaaacgattcgcgcaagaaatttcatgcccctcggctgatcgatcggtgccctatggcttttacaaaaatattatcggcttctcatgcagggggcatgcagcaagttaattacagtaatacggagtatatatgtaaaaattatgggtcgagtcttgctggttgttttcatgagatcgagtcgtttgacttgggaagatcatctttgaggataagatcgatatgtttgcgtaatcgaataacctctctgtgcggccgtgcggccgcggctgggttcgcaa

SEQ ID NO: 13860 - DNA, 1501 bp, Oryza sativa
ccgcctgcttcagccgccagctccgctccgccacagccgacgccctgctccactctgccggccgccatccttgccatctcctccgccgcgacgagctcaagccccggcgaccgacaccgccccatgcgcctcagagagagaacatatatagagagagagaggagaagagagacaggagatagagctgacatatgtgtccaagggcatttttgatatttcacgcgatttctctctcatcttcaaccagaaattattattttaattgacgcggtgtccactggcaaattaccacgtttatagagtgttttcccccaaaagtgagtttgggcagtgtcgtaggactaaaaccatacataagcagtattctgtagcaaaaattgccttctaaaaaatatcaaataaaataagttgttaactatagtaatcaagatctatcatttttttaattttgtagttgccaaaaaaaaaccaaaaagtattctgaattttaataagcatctatacactctgcgcacccaagttgcaagccaaactatttttttcatgaaatacgcacgcatgtgccgtgtataagatttgaacttgagacttcttagtctacacacatcatcactatcaactactatcagatacttgtgatgaggctcctctaacgtaccatagagggacatacgtttctgatgtgtgggtccatgaggttggtcccaccggttagggactcatatccctcggattttaagtcagaggagctgtgttttaaatacttattgtttagaattaagatgctattattttaacttcatatctcaaaatcttattgtgcttatttagtcacctaaataatcttgagtaaagaagtcatcaattacaaagttgatgtagctagccagagtttttgaacatgtaaaacaaggattcagaatatatatatctccttgcgaacccagccgcggccgcacggccgcacagagaggttattcgattacgcaaacatatcgatcttatcctcaaagatgatcttcccaagtcaaacgactcgatctcatgaaaacaaccagcaagactcgacccataatttttacatatatactccgtattactgtaattaacttgctgcatgccccctgcatgagaagccgataatatttttgtaaaagccatagggcaccgatcgatcagccgaggggcatgaaatttcttgcgcgaatcgtttactctagttattttaggtcctcgaccgagaacaaacgcgttgtcttgtaacatagaagaaattgacattggcacgccacttctcaaaacttgcatgcatgctactgtgcctatatatatggcccagcaaagcgaaagcaataccattaaaccaaaacactagctagcaacagcatagcactactgatgcatatataatagctaatcaaacactagtccgaagacgtagtatattctctccactgccaaatgcaacccctcctcctcctcttcctctctccggtggtcg

SEQ ID NO: 13861 - DNA, 1501 bp, Oryza sativa
aaagccccggtacgacaaacgataggccggtaggaacctagggttgcacctacggctagacaactcgagtaggtttaagtggcacacggctgcgacacggcgacacaaagcggcggctaggctcggcagcaagcagcggcacacggcatcggctcggtaagcggtggcggcgcacgacagcagcttggcaagcagcggcgcgcacgacagcggatcggcaagcggcggcacggctcggcaagcggcggcgtggctcggcagcaagcagcggcagcaatggcgtggcggcgagcagcggcgcggcaacggcggcggccacgcggcagcatagcagcttctaggacggcacgggctacgacgacgacacggctaacaacggaaacaaaaccctaaaacaggagggaggttctcaccgggaagcataaccggcgagggaacacgacgacggcagcggcggtccggcaagatcgacaacgacggcagcactagagaggacacaacggccaggttagacgggagataattgacattggattaaccaattcatttaagagggaaaacagattaccggcgacgtgacggtgacgacggcggggacgatgatagctaggactcggggaaaacgtaaaaaactaggggaggaacacttctaaaggggtggacaggattaggaaaggaggagtcctagaaggagtagaactaggagggaggggagggagtcggactccagggggaagaggggcacgcgcgcgaggggagggggagggcgcggccggctggggagagagggagggaaaaggaaaactagggaactaggacttcccaaaaaggaaaacaatgcggtgcagctttaggaatggaaagaaaacggtcctgcaaactgacacgggtacggttcgtcatgcaaaacaaaaccgcggactgagaggggagtgaattgggcacaattcatgaccaaaggcgaaggaaggagattaacttgacacttttaacttagcaacattgcctccagtgatctgatatttactctttaagtcctgttagtgattttctagagcaaagagaattcgtaaaaaaattctccctgacaattccgattattaaatacattgttaactggggttttctcctggttaaccaaagtaaattcttgaagtcatttattaatgatttgaaacctaagggaagggaaaactccaagtgtgacaggagatgatcttcagtcttacaaaaaatttctatacaaaattaagttgctttagaaaaatcttattgatccgttttatgtgtttggggagagagtttcccaactcccactcacgattcgttttatgcgactcacgaacacagcagcctaaaaccataaatagacgtcgcctgggagcatcttgatgtagatcgactcaaatagtttcgggctctcacctcccttgaacagttgttggaagtgtaagactgacatggccaacgatccaaagctagcatttatggataatcatta

SEQ ID NO: 13862 - DNA, 1501 bp, Oryza sativa
gaggatcagtgaggatttacgattgatattttaggccaggattgaccaaatatattgtatagtatatattgtgtttgtatctaagtaataaatttaagagtgtgttctaaagagcttataggattagatactcccttatttgtagcgagcacgtttctcgaacagctaaacggtataaaaaaagttaacaaataaataataatattacttattaaatcataacattaaaattattaatagtatagttaataaaaaatagctttccttattttttatgaataatgtggtagtgcactaatatttgtcaagttatttttatcttttttagtaattttttaattattaggtatatgattggtagagtgtaattatgataatttaataatattattccgatataacagtattttcttatagtagggagcgaatcatttttgcaatgttactcacaactggagttgtttttatttttcaaaatgcaattctaatttaacaatacatgtcattaagtgacatacaattatataattatataatgtatattattcatttatttagatattttatgaatatttcaatgatgtgcgtatagtacaatacaactcaaaaataaatatatttgtacaactatgggttggaattattaatgtggtttttatcttatgtgagtgaaaaaaggaaaatgaaaagaaatgtggggacgtggggccctacatgcaagtacatactccgaactatatgggctggaatatgaattttgttttttctcatgtgttagtgaaaaagaaaaaaaagaaaagggggcgtggggcccacgtacaaaatatgtacgtacatgcacgtacacgtacggcgcatgtgtggatttttaaagataataaatctatttgacattttctatgctatatatctaacggttaaaaataatggatccaccagattaaatgaaaaccaactagttcacatttgcttaattcttctaatttattagagtgccatgtggcgacgtaggagagtttgtagaggtgccacgtggtggcttaggagcgttcataggaagtttaatggacttttagtatataatagatagatagatactccctccgtctcataatataagggattttgagtttttacttgtagtgttcgaccactcgtcttattaaaaaaatttggaattattatttatttctttgacttactttattatcgtaagtactttaagcacaacttttcgttttttatatttacataaattttttgaataaaacgagtggtcaaacactacaagcaaaaattcaaaatctcttatattatgggacggagagagtagatagatagtacatccaatgttgtttgtttttgtatcctctttctgaggctcgtagtcccggccttggattatgggtaaaatatatagcccatgtgcagcccaattaagttcctagcatagtggcggagcagatgaacctctcataagacgtgtttgtttctatacaac

SEQ ID NO: 13863 - DNA, 1151 bp, Oryza sativa
agaggggagggaaccagaccatacggacgaaaaaaaagtgacgaaaggaaaaatacgaatcttttaataagttaagattaagataagatatattattattaggtaggtatatatgtactatggggtgttcttgtggtgtacgtattagggcgtgatctgagcgtagtggacctgaacgtgacatgggctttttttttttgggaaacatgacatggggctattaaggaggaatcggacagaaaaaatcgtaaactacacgcggagggaatcggattaaaaaatcgcaacaatcacgctatatacgggagggaatcggactaaaaaatcactcgggacgatgtacgaaaattcatgggcaaaaacatcttaaacttttataataggaaaagatttaatgataaaacaaatcacagtaaaataattaatacttatgtacttatactacatttattgataaaataaatcacaaaataattgaatcctaacgttcacaggcctctcatttaagcatcaaagatttccaaataattaagaatttttggggaaaaaaagtggcatgaatcgaacaatccccgccttgcatctcttatttacctccaagcagctagccaagtctagtttttctccctcttatcttgccccaacacctccccttcctccctctcccgtgggcctcttggcccgagaggcccagcccgcccgtctgtttttgtccctccctcgttgccaagtggccctcgctacagtgtcgtcttcaagctcgcgacaagaccggactctgccatggccgccatctcctcctctaaaaccgacgcagccattgccccctaattaaatccgagcccaaaaaggaatcccctcaaacacctcttccttttggactcggaatagacgcaagagagcgaactgggagttttttttttctccaagtcgttgatgaatcagacttttttttctttttatatgtttgaatcggactaaaaaattgggacgacgtacgaaaatctaagggcaaaaatatcttaaacttttataataggtaaagatttccagccaaaacggaaagagaaatattggttaaagacaagtttgcccatgggcccacttgtcaatccctctttctctctctctttctctgctcatcttcctcc

SEQ ID NO: 13864 - DNA, 1205 bp, Oryza sativa
acagccggttgcagatcctattagtcaataaattaaactaaattaacaggttaattactactcctctacccaaaataaatcaactcatatattttaaactattttgcaaaataaattaggggtgtttagattcaggggtgtaaagttttggcgtgtcatgtcgggtattatatatggtgttgcatggggtgttcgggcaaaaaaaaaacaaattatagattccacttgtaaactctgagacgaatttattaagcctaattaatccatcattagcaaatgtttactgtaggatcacattgagatcatggagcgattaggtttaaaagattcatctcgtaaattagtcgcaaactatgcaattagttttttagcctatatttaatacttcatgcaaatgttcaaacgttcgatttgacagggtgaaaaattttgtggcgggatctaaacagggctttagtaattgataacttcttacctggtcctcgaatggagaagttttatccttcaatatccattacttatccaaataaagaatattattttattttattttcttaatgcgagggattaatttattttgagacacatggagtaaataataaataccctaataatagttaactactatatccgtcccaaaatataagcatttttagcatagtgttaggtcaaacatttttaactttgactgttaatataaaaaagttaaaaagatcaatcatataatatttatgttactagatttatcatgattaaatttcataaaactacatatactttgcacgatctatcacaaaagtacagatttaagaacttgtttcacaaaacattcaatgtcttcgtttatcacaaaactgcaggtactttgcacaatatatcacaaaactacagatttaggaacttgttttacaaaactacagatttaatatcttcatttatcacaaaactacaagtttagtatcttcattatcacaaatctacaggttttagcattattaaaaaaatatagttttgtgataatggagacactaaatatgtagttttatgataaatgaagacactaaatgtctagctctgtgataaacgaatacactaaatctagacatggatgtgtgttgtttctgatgacaaggaatatgagttaaattttaacttattgtaaactggtacgagtagatgaaaaactttgagaaattaggcggtga

SEQ ID NO: 13865 - DNA, 1501 bp, Oryza sativa
tcaatcatgtattcatgtcggggacttgggtcgatgttcaggcctgatatttctcaagaaccggtggtggctcgcgttcggttcaactgctcgagcagaaagacgaaggttgatatatccatcccatttgagagcatggaatgtattggtcgatttggttcctacaatcgagtataccagccgtttccggttcagaaatgtagtacagtactataatgctgcagtgtcgacgacttgtttattcagtactactatcactagtttatttcgaattgcacatgagagaatggagtttatactttataggcaagtgtattgaacctggacagacagcacgtccgtctacgataaggcggagcaacatattttttccatccacgcaaacaacgtgattcaccttcagacgcattggattgcacgtgaactcggaaaacttctgatctgattccagcagttcagccttgaagaaaagctgctgcttgcaggcagcgatgcttggtctaacccaacccaagcacgtaatttgggaatcataaccctacggacagacagacagtaaatggtttacgccgtggaattgttcatttgttcttgctactgtagtatgaaaagggcacgtcatcatgtttatggcttttttggatcggagctacatgggtgtttggtttgctacccatttttctctcactagtcaaattttacgctagtgctgtattaaatttggtagtgccaaaatattggcagggaaaaattggctccaatccaagcttctgcagtagggcgaattcggggacatgggtgttgcatgaacaaagcagcaagcaagaagaaatttttgcaatagagaaccgatagaggatagtaagtaacgagttgctgaaacggccctatgtccacacaaggcccggtgtatcacgaaaagggcccattagtcaacacaagacccagtccattaggaaaaagggcctatatgtccactgggcccagtctatttaggagaaaaatggcccatatgtcaacacaaggcccagcccattaaggaaaaaaggtttccatttggcaacacaagacccagtaaattcggtaaaaatgatataaaaaaaaggaataagttcatctgaggtcccttaacttgtcaacgaatccgatttccgtccctcatccggaaaaccacacacaacgggtccctcaactattaaaaccggtgcagattaggtccctcgatattttgagggcggttttggctgacgtggcgcctacgtggctaatttgacttagtcttcatctgacgtggcactgacgtggcgcttacgtggcaattcgatccagaaaaaataataaaacccataggacccacatgtcagtctcacacagaaaataataaaaaaatggtgggacacacatgggccccacatgtcagtccaactcacccctctttttcatcctctctcccccatctcccctctcttcatctctctctcctctcctctcctctgtcatc

SEQ ID NO: 13866 - DNA, 797 bp, Oryza sativa
aaaaatatgagaaggaagagttaatctaggaagagggtggtgtaataataataataatacatgaggtatattattattattttcatatatagtaggtagttgtatatgagatataagtacgtacgctgggtggggttaggtttgggtggttaactttttctataagataaatttaatggttgtaaataatgggtccatcaaatataatgaaatcaacggttatatattggagtggcatgtggcggcttaagagcgtttctaggatgccacgtggcgacttaggagtgttcatagaaagttttatggacttttagttaatatacagatctaataacgacgtaaaataatgtgtccatcgattctagtgaaaaccaatggttggacgtttctctaatttaagagtggcacacaacggttagaaacatttatatgatatttaatggattttaacgcgtttgatgtctatttgtgggggtattcttttctataaagataggttcaattttaattaggattggaaaaagaaaagaaaggaacaaacgaaaaaaaaaagtactaaacagaggtggtggggccggtgggaggtttttggtttttaaaatagatctaacgatgtaaaataatgggtccaccgatttaaatgaaaattgatggtcagatttctctattatattagagtgccacgtggcaatatgagagcgttttgagggagccacatggcagcttgagagcgtttatagggagtttaatggactttagtatataatagatagatagatagatagataatagataga

SEQ ID NO: 13867 - DNA, 1501 bp, Oryza sativa
ttaattcttctttcgatccaccacaagcacatcggtcttcagttcatgacaatagaccagggattctatgtgcggactttcattgagatcaaacaattcttccttccattccctacgctctttcttccaagcaaacacctcaagcgatttgaactgtgaacccaagactatttccagatatgtttctcattccacctctccattcaaatctaatatgtacttatgcgacactgcaccggtacctacatcgtatctcccttgtataccaacagactcatcactccaatccaattcatccttcgtgcgtgaaattaactcctcaaatgtgggtttggcgcaaaacactaactgcctgacagacatcccctcaaattggctaccaccagtactttcatctaccacactgccatcaaaatggagtcgtaccaatctatccatctacatcaaattaccgatgaaatatgtgcattattctattataatacgtcgctataaaaatagaaacataacatgggtactccagacctaaataaaatattttttaaaaattctatcgattaaccaccggttacaatgttcctacgatctatgcccttcaatatcaacattaatcaatatgaatccccaaaatattcataatacaacagctctacacatccatctcaacttcacccttaccaaaatagtgcataacatacaaaaatggtatgaatcctctgtactatcaatatacaactataacgtcgcatccttacccacatttcctaatccacaacacaacccgagcaacatttaacaacccacgatttcaaccaaaatactctacgaaaatgagggaaaactttgggggaaattagggtttttagaggggatttactttgcaaaccaatatcgaaaacaatgcccactaaatagccttcgatttgaggtggatttgaggggatttttagaggggaggagagagggtgacgcggggggaagaaccctagctctgtgtggggggaaagaagcagggctcgggcaggggcggcgcgaccgcggcatatatgccgctacctcagcgccaacggggctggcgctgagcttggccacctcagcgccaaggcggttggcactgagactgccgccacgtcagcatgggggaaaagatgggccgccgcgcttgcaggcctcagcgccaaagcggttggcgctagcttggccagcgagtgccaggaggcttggcgttgaccccgcggcctatttttggttgaagttttttgcacgggctagtttcgctataagtttatgaaaagggccaatttgtcaaaaaaaaacggccagggatatagaccttatgtattgttctcttaaaaaaacaaacagatatccttatgtaggaagataaaaaagccaaaaaaaacctatatgtacgctgtaagaacgatagggtctttaaaataggatttcctatattataaataaaatttattactccgcaaatttgcacggttaaactaga

SEQ ID NO: 13868 - DNA, 1047 bp, Oryza sativa
ccgccatcactgcctgcatcttcgtcttcctcctcgctcccaccgcgcagcaaccgcggcaagcagccggcgacgacgacgtggagatggccgaggggaggaacaacaaggtcgccgacggtggcgggttcggcatggtgctgctggagatgctgacgggaatgcgggcgctagacacggggaggccggcgctgcagcacagcctcgtggagtgggccaagccgtacctggcggaccggcggaagctggcgtggctggtggacccgcggctggaggggcagtacccgtccagggcggcgcagcaggcggcccagctcacgctgcgctgcctctccggggaccccaggagccggccctccatggccgaggtcgtcgcccagcgccccccagtgctgccacgccgtcacccgctccagccgacctcctcgtcgctcagccgccgcccgctccagccggcctcctcgccgctccgccgcccaggagcgggagagagataagagggggaggaggatagagagaggggatagagagaagatagtgaggacgacatgtgggtccacatgggcccactatttttattattcgtgtgtgcagctgacatgtggccccacaagttttattattatttttttatctaattgccacgtcagcgccacgtcactaacacgttggacaaagacctagtcaaaagaagccacgtcggcgccacctcagacaaaaccggagtcaaatactgtcgagggacattatttaaacggtttcgtaagttggggatccgttgtacccggttttgcgattaagggacaaacattggactgggcaataaatagagggaaccaaagtgaacttattcctctcgtgctgggccggacttcagtttaggcctgccgaagtacctaattgggctctctgggccagattatctgtaaattggagaacaggctccttgtggaaaagcgttagcttgagggggggaatttccaatttaactcgttgaatctgattggcatccctaaatcaaaacagatagaacagttcctccaagtc

SEQ ID NO: 13869 - DNA, 783 bp, Oryza sativa
ccttcctgtcttttccaggctagcgcttacacatgttttatagttgcaaagcttaattataataatccgcaaatctccatatgacagcattaaacttcggatgaccatgtcttggtcatacgagctccgaatcgacccgttcaagtctcttaatgtttgttataacctaaagaaccctgtgctttctttttatgtattgttattgcttctttataggcttgtagctttgcttgtgtgcttcgcgtagtcttcgtcgttctggaggttcccgaagcgtggttcgtggtcgtcgccgaaggttcggaagtccgttctctctgagcaaggcaagtcacatcatccttgaacatattgaatcccagtttataaaattattctgatttaaattattgcgttatcgctctatttaaattcccgcgttatcaatgttttatttagccatgcctatttacctttgttatgaccttattattattgctattgttattattaccttgttcaccctaggttaaacaaaaccccaactagtgggtactctattcatggttccactagtatgaatttaggtagatgcttcgctgattaattaggcaatattaggtggttttataactttagactttgggaattctcatatcatctggacagtatggaatggttggcttatgttggaattggacccacatctccccctctattcaaaacccccaaaatggttttaggctgggctcgaggtgcgtggttgggtttggttagtcgtacctcgggtactataaggtttaa

SEQ ID NO: 13870 - DNA, 1501 bp, Oryza sativa
caagcatgggtgtcaagtttaaaatttggatccgaatgaacaagtttcatcactagaagcctaatcagttgcgctgcatttgttttgcaaacagcaataaaccttgtgtgggagcgctgacaaacacctcgctttgatgcgccccctcggttccatttgtgagattcctttacattagtaccctttttttttaccaagccttcacactagtacttagtccctgtttagatgggactaaaactattaagtccctatcacatcggatgtttggacactaattataaatattaaacgtagactattaataaaactcatccataatcttggactaattcacgagacgaatctattgagcctaattaatccatgattagcctatgtgatgctacagtaaacattctctaattatggattaattaggcttaaaaaaattgtctcgcaaattagctttcatttatgtaattagctttgtaagtagtctatatttaatactctaaattagtgtctatacagagactaaagttaagtccttagattcaaacaccaccttaatttaggatcctaaagttaagtccttagattcaaacaccaccttaatttaggattcggatcctctgcattaccgcaggcaggcacagtagctacagtgataagtgggggaacagtgttttatgtaagatcaacgtgtgttttgatttttattctgtgatgaacaattggcatctgtgattattggttttgatatttggagattatcgtcgaagtggttttggagataatcaattttcaggagatgaacagggtttgctgttttgtcgggaccggtcagaccaggcggtggttgccggtcagaccggctcatgtgtaacggtcagaccggctggcctgcggtctgaccggccgacgctgtgtcggttttggtttcaggttgtttgtttggatatccgtgattgtttcatggttatggcttctagatggatactatacatatgtaatactgttgtttgctaacaatgagtcaaattggagatagcttggtctcggaatatggtttctttgattgtttcatgtgtaggtgactcgatggctcgggagagaatttgcgttgatggaccgggagccggcttggtggtaagacgatgtccgtggtggtcagatatcatgcgggatactaaggctagagttgatgcacgtggttgatggagcttccatatggcatacgatggagatattgtgtgcatatgggatacggagtcgaatttggaaggagtccaaatttggtgcgattggttatgtaaagtttctttcttgtactagagggtttcctaaggtgtttagtactcttagtatgagtttggttcgtggctttaagctgcctacctcatgtataaatagagggggagcgtgaggcttcccggtatcgcttttatattgctttgagagcaattgagttgctagtttagctagggtttcgagtttagtcgagatttttgtaaggagt

SEQ ID NO: 13871 - DNA, 1501 bp, Oryza sativa
tttgcccttaagagttggtatacaaccaataataaatatactaatgtagctactggatacaacatatgaaaaatgattttttttcatcgcatgcaattttagccatcaccatcacaaataaattttcaataaaagcatgaaacatgcagttttccaacaatatttttaatacaaagagcattttccactagttctgacaaaattttgttcactcaaaaaggattaaaaataaattagttatgatgttttgaagtttacacattttttacttgagagggtatattggtcatttacgaaaaagtaacgtttaactaacagtcaactaacactatagtgctgggagtagcataaaatggtggaaaaacttaaaccagtggcatacaagggagaagccaattttaagtggcatataagagaactggccaatttctagtggcatataagggattctcccaaaaattaaaacaggagtaaatatcttaatttcctggaagcgcacaacatccatcctgccgagaggcacacagccgagcacgggcgctccagcaacaagctggtggtctcttgcgggcaggaacccggcctccatcttcgtgtagcctcatcgacgtgcgtagccacacatcatatagtgttccacacatgccgagctgatcgctcgagtcggagccacgataaactagcgccgacctccggccacactatagccgccgggccaggtgcccaagttggctcgatgaccacgtgtgcgggccgggacttggcgccacggactccggtaccgtggtgttggacgtcggtgccaaacaactctagtgccgcgatagagtctaaatctaaaacatgtgttttagaggatttatttataaaaaatgtttctgaaaggacttaatgtgaaaaattaaggcctaaaaacctggctatatgaaaaaaacaacaaagtacggggctctcgcgtcgtcctcatgagggtggcttgggggcaacccttagcggcccacgccaccacttcctcaccccatctaaccgcctcgccgtcgctggaaaccgcacgggcggccagagtgttcggtgggacggatccggtcacgccggaggcagatcccctcaccccccctccccacgtggccatatcgggagtaggtgactccgacaagtggaggagcccatggctgcgcaacccggtagaggcgtggggcagtgcggtctggtggatgcacggggtggcgtgacggctgtactggctgatggtggaggaggccaaacgtcgttgccgggagaaggcagtggtaggcccgcgccgtgaggaggcgcggccggtggcagcgaaggccggcacagaaggggggcaaagccagcggaggcgaaggtagacgaggtgtggcggccggtagcggaggccggcactgcgcgatgagggtggtggcacgtggagactggccggcgaggggcgccggtgtagctgtgcccgcgagccgatggaggttagacggcggtggag

SEQ ID NO: 13872 - DNA, 1501 bp, Oryza sativa
ccgcctccccccagaagatggccggcatccccctctgcttgaggagagcccgagccatccccacaaccgtctggttgtgccgctcaacgacgccgttctgctgcgggctgtacggcgcggtgtagtggcgctgaatgccctcatcaacgcagtacaacgcgaattcagccgccgtgaattcgctgccgttgtcggtgcgcagcacgcgcagcttgcggccgcactccacctctgcagcggcctgcgcgcgcctgatggcatccgcagcctctcccttgctgccgaggaccatcacccacatgtagcgggagaggtcgtcgacgagcagcaggaagtaacatcgtcctcctggtgtggccggtgtcactgggccacacaagtccccgtgcacgagctcgagccgctccttggctcggaagctcgtctgctggggaaaggagagccgccgctacttcgttaccatgaagacgtcgcagagctgctccacatggtcaaggcacggcatgcctcgcaccatctccttggcactgaggtgcttcagggcctcgaagtggaggtgcccgaagcgctcgtgccactgccatgcctcgtcgtcccgacgagcggtgaggcaaactggttgtgcgacctgcgcgccgaggatgtagagtcgattagtgcctctggttaccttggcaagaaggcgacgacggcgatcccaaatcctcatgagtctgtcctcgaccaacacgcgtgagccgttctcatccagctgtcccacgctgatgatagaattcctcaacgcggggatgtagtaaactccggtgagcagcctgtgctcaccggacttggcggtgaaggtgacggagccaacgcccttgatctccacgccggaggcgtccccaaacttgatggagcctcggacgccggggtcgaactcggtgaagaactcccgtcggccggtcatgtgatgggtggcgccggtgtcgaggtaccacccatcagccttgttgttgctggagctgttgcagagagagacgagtaccttcggctcatcaaggtggaggaaagccgctgcggccggtgccgctggaggaagctcgatgcttgcgtgtgccaggagcagagccggctcttcctcctccacctgtgcgacgtgggcctggccacgtcgtggctgtcgacagtctttggcccaatggccaagcttgccacagttgcggcaggtgtcgtctcgtgccggcttgtggttgctggcggcgccgccctgggcacctctgcgagcgccaccctcggcgcgtcttcgcgcccaccgcagctggacacctccgcatgccttgcgcggcttgcggccgcctatcgagggagaagactccccctttcttccgtcactctgagaggcctcccactgctcccgagtgagatggagcttcccgccaatggtgataggccccgagagaggctgtggctcatcatcgtcgacgaccttgaggcgacccaacgcctcctcaatcgacatcgt

SEQ ID NO: 13873 - DNA, 821 bp, Oryza sativa
gaattcctgcagcccatattagagtagtatctggtagtttagatgtggtgtctagattacgggatatcattatttggggttatatattgcggatgagaggtgggccgctgatggtgacagctcagtacgggtattcctccgcgccggtatataatcctaagtaattccctggggagggtatttctccgtatttagccccggttgtatggtcatgacaggctgttgtaaggaactcggtagtcaggggtggcttctcgaagtatcagtagggcatcggatagagggtattagctagtatatcagttaactagaatgtatggatactatgtatgttagaagtataggaatagattatctttctcttttcttcccacttagcttagataatatattacgagaatgagtagttaatgcttgtgtatcactctacccttggattatttttgacccctgcttagaatatgattatcacaagtaatatataaattattagtcaagttctctctacatgatcttcttacggaataaaataaatacgatacacttggaatactctcgggtgaaatgctacaatggtatatccgtgcgcttgcggatgaactctgtaaccataatatactagaagtatttctgcgtcattgctgggacatatatttcttttaatgtcgttaagaaataccaacaatcatcccctctcatctcatccgtccatccaccatctcatctgatcttatccatccattcatcagtgatgagcgattctaccaattccgctcccacgcgatgactcagccgcagtgccacacaaatccccgctgcaa

SEQ ID NO: 13874 - DNA, 1501 bp, Oryza sativa
ggtctgcagatgagctccaagaaatcagtgacaccgacagaagcagcacttcaggaagaacttgcagctgaaaagcaaagttcagccattctccatgcagaagttgtcgaactaaaagaacaagcaaatcttgcaaatgaagcactggcaaagactcaaaaggagttggcagagttcaagcagcagcaggaagagaacaatttgctccttcgacgtatcttgagcctttcccagggtaacttaaatctatcctagtctcctttatgatcttctgcactgtgatgaactccatctacttatattagttgtttgatggttctgtgaacttattgtcatgtggtggacttgattatgtgaaatgatgtttggtgctatggtggacttaatgtcatcctatggcaaacttttgtggacttaatgtgaacatatgtgtgctaggttctgtgaacttttttgtaatatggtgctatgtgaagttggtatatgtgatatatgttgatgttgggcctatttgtaatgtgctgtgaagttctgattgtttgtccatgtgatcaatcttgatgttgggcctattttcttatgtgctgcgaagttctgattaattgttgcttgaaatgggtgaatgctaaaaatttcctagatctcatagtgggatgggccacaacaatatgtgaagtatgtggccaaatgggctgggctaagaaaaaaaaatgagcgggccttcatccctactgtgctaacgtgtcatccaaacaaatcaacacgtggcaacatcaggtaaagacgtgtgtcacaaatcagatatgtacacgtggcgcttcaaaatgagagcacgtggtgcctccaccttcggcaatgtggcgttagcgtacaccaccacgtggacatacaaaatgtaaacacgtggcgttaaatatgactgccacgtggtgtctccacctttggccacgtggcatcagcgcgcaccaccacgtggacataagaaatgccaacacgtggcgttaatatggctgccacgtggcgccaccacgttcgaccacgtggcatcagcttgcaccaccacgtggacataccaaatgccaacacgtggcgttaaatacgactgccacttggctctagcgtacgggagatgatgatccagcgtggcgtacacgtcatccgccacatcacagccaacatggactccacgtgtgatagccacgtggcatggacgacgtctgtcctagccagctggaaagcagttctatgacgagcaccttcgtcatggatataagcatttctatgacgaaatctactgtttagtcatagaaaaacatatgtgacgcgacttctatgacgaatcccatttcgtcataaattcgtcatagaagttactttatgacgatttgcgcgtcttccatgacaaaagtagattgtcatagatgtgcctatctccactagtgtgcctacctgttctgccgcccaccgccggaccgccgcctcccacgactatagatggcca

SEQ ID NO: 13875 - DNA, 1501 bp, Oryza sativa
acagagcaggagtaagggtgtccatagctttagaattagcagaagcattgtctaatgtaatagagaaaaccttatcagtaataccatattcttcagcaacagcaatcacacgctcagcaatattagcaccagtatgtgactcatcaataagcctaagacccaagaccctcttttctaattgccaatcagaactaacaaagtgatctacaacactcaaataatcttccttagcatgaccagaccatatatcagatgtcaaagcaatagagctagcagaattgagacgatcaataataacagaacgacgatccttaaacaacttataaaaatctctggtagtagtttgtctagagacaggaacaaatctagggttatgagcaaccttaatatagttcacaaaagcaggagattgaccaaaactgattggaagatcctctctagcaatcaatctacacaattcaaacctagcaacttcaggactatattcccatggaataacagaaccatctgcactaaatctaagcatggactgaggcaaagcattagacccaagctttctaggtttgcatgacttaatatgcctaagcaaatgtccagtgccagcagaagaacgagcactcaaagttttatgacagtaattgcatttagcagagactcgaaccctattaccattggtcgtttcataaagttcctcaaagtcatcccataccttggaggttttggtcttcttgttggtacaagtcgcactagagccagtcggcgtcccattgccactgtcgtcgaccggcgggtcgtcgtcatcgacattcacatggatcgggatgtcggaggtattgccgaacacctccacacgatcctcctccacatcatcatcgtcatcaccgcgcatccccatagtcctcaactcgtagttgacagaggtaggatcgtcgtccatcgcaggcactctggtccctcaacggcggctgccgctaagcaacgggcttgcgacctgcaagcagccaacaacactcaaggttagggtcggaaatggagaaaaaaaaaagaaaaatgatggttccatgcttgtaactgcgcagccggagcaccagagttgccgttgaagacgataggctcagagatctacgagaagaccaagggatctggcgaagaagaacaaaagggaaagagacgaagaggaaggctggatctggaagagtggaaggacgatgactcaggcgaccatgcgtggccggtggcccccatcctcatgcgcccctcatgcgagtcaggcgaggcatcgatcggagacgaagaggaaggctggatctggaagagtggaagggaggcgactcggtgagtctcaccggtgcgcgcctgaggccctgagtgagtgagcggcggacggtggaggaggagatctagtgggcggtggagcgtcggaggcggatcggcggaggcggttgagcggtggcggctagggttagggttaggcggagaggcggagaggcggagagcgaga

SEQ ID NO: 13876 - DNA, 1501 bp, Oryza sativa
tagattacatatagtagtaaatagtattatgcatgtttaattactgtttctgattctgattgagagcctgcaatttggcaggaacaagatcgagctactatacaaacggcagagacagagacagagacaggggcccccatttgcaaggcctttcctgtcaattcatcctgcctttattattatcgattgataattccaagataagaaggagaaaaagaagaagaattaaaaacgcgggaattattactgtaattaataatcctccaagagaagagacgaccatgacatgacatcacaggagctgggcgtcgcggctggccggagaagggaagacgggcacctcggcgaagcggaggcggccggagtcggccgcgccgccggcgaggcggacgtagtagggcgcccgcggcgacgccgacggcgactcgttggtgaacgggttgccgatcggcgtctgcccgccgttggcgtagtggacgatcgccctgtacaagaacggcagcaacccctccatggcttcttcttcttcttcttcttcttcttcttcttcttcttcttcttcttgccaagcaaaaacaatggagctaagcaaagcaagaaccctctctacctctgtctctgtttggtggtgcaactgcaaaggataaagaggaagaaagagaggcgtgtgggtatttaagggcacaactgcagattagtataataaggtgagccttgagattttttttttgactaaactaatcaatgctgattagtggataacaactggcttagctttgctcagctaagctactagctagctagcacaaggaaatggtcaaatgagagagccacatcaattggagaagatgatgatgggatgcatgcacgcatgcctgtggacttgtggataggaaaatggattttttgtaagcagaacaaagatgctgtttacacttcagggggacacacaaggtgcattagttttttgtgatgaaacagctattggaatttaaggtgtcacacaggaacaaatcagggggcaattgggttttgtggtgactgctggtttctgattggaattaggtttaaaataggacagcttctgctgattctggtctgggtgttaggggagggagaccaatcctatataatcatataaagaatatcaatggctttgtgcttgaaggaagggaaagccacaaaaaaaaagggaaaaaatgatgcacagatgtggtttgaagacaagggacatcttacctgacctcaaaagggtatattgtaatggagtttgttgtgttttccctcttctttttctgtgtttgttagtgaagcttgcaattgaggcctcaactaaccctataattaagacaaaaaagataaaaggctaaatccgaagtctggtgaaccatcgttctcaggtatcccaatagaaagaattgggtcgactttaagcatcatccaagtcgtgagaatgacaccctactaggtcagagtagcagacaaagggtagatatatatt

SEQ ID NO: 13877 - DNA, 1501 bp, Oryza sativa
ctgagttatcatacccaacctaccaacgaagtctgacgatctatctcatgtatagtgacggccacggctagactatttgggaataggttattaacggataattcttcacgaacgttgtcggcctgattactcgacatgattgtgaacagacgtccggatatgctataagttgggtatgtgagtcatgctggccacatgagatgcatatgtaatatccaactctagcgcccctataggtgattaagagatgcctactcctggttatcaaccagacagttgcagcgacatatcgccgcctataaatttaaattcacttgtggaccgttgaactccatctatcgttgtcaaagactccatgtctctacaccgggatcgaccaagtgagtatggcaaatattgataaaggaagtcgcgggtaacaagagaagctttcgcgaatacggtttgtttccgtatgcctatcagttgcctataggtgatcgagatacgcctacacctggtcctcgaccagtagatcgtagcgatctctcaccacctaaaaattcatcttcagatgatcgagatacacctacaccttgtcctcgaccagtagatcgtagcaatctctcaccactgttatagcaatctctggacatctaatgcgacaatcaacattgtcgtgatagcgacaaccaggactgactagatcgccgttgtcaccaggacgacaacgtccaggactaacgacatcaggacgacaaccccggacaaggttaacgacatcacgacatcatacaacaacgatgaaactcgaaatccccatacttctagagggcccgaggatgaggtagtcggtccaggagctgaacctccgactacgataattcctcattgtcttcgtcgtcatcaggaggcagttctcgcaagttgcgaggacgccgtccatctattactctagattccctttaggtggtcgaggtacgactacgactggtcttggaccagcaacgcaacgatcctcacaccacgacttcaagcgatcgaggtacgactatgactagtattctaccagcaacgtagcgatcctcgtaccacgacttctaatggttgaagtacgactacgactggtcttctaccagcaacgtagcgatccttgtaccactacttctaatggtcgaggtacgactacgactggtcttccaccagcagtgtagcgatcctcgtaccacaacttacaaaggtcgagttacgactacgactggtcctcgaccagcagtgtagcgatcctctgtaggatcgagatgtcgactagaggggggtgaataggcgatttaaaattaaatgacacctaatcaaaactaacctaagttgctaggctcggtgagggacaagtctaactaagcaactaagttatgttttgcaatcctagggtgaaagtggctcaagtatatcacaaggaaaataaatcacaattcctaagtctagtttagcaatcctagggtgaatgatctcaagtatgtct

SEQ ID NO: 13878 - DNA, 1501 bp, Oryza sativa
aagagattgctacgtactggtgcgagaaccagtgtgcgagcggaattatctctcgaacaccaatggaagttgcgatgcgagagattgctaggtactagtgcgagaaccagtgagcgagcagaattatctctcgaacaccaatggaagttgtggtgcgagagattgctacgtactattgcgagaaccaatgagcgagcagaattatctctcgaacaccaatggaagtgctagagttggtttattgcaagtgtatctcatgtagccagcatgactcacgtacccaacttatagcatatccggatgtccgttcgcaatcatgtcgggtgatcaagccgacgacgttcgcgaggaattatccgttaacaaccttttctcgagtagtccagctatggccggtgctatgaggtaggtcgtcggtcttcgttggtaggttgggtgcgataactccgcatttgtcgagaatgttctcgataatgttgtgtactcgaccacaacctactcaagtgctcaattgttcctaaaaaatattttctagaaggcaagacatatagcagagaatatcgagtatgtactcaaaaaactacatggatcttctagtattatcaggatacaacaagcagatgtaaatatcaagtattatgtaaactgtaaacaagcatgatttatacagaagaaaacagagcgagcccccagcgttagaccgtagttggcctaacatcggaagcactcgcgcaatatatattgtataaaaaacatgctttaggtaaacgtaataaattatagatctgacaatgctgtatggtctgaataggtacgataaattgcatataaaatattgcgtacctgtatagatacatgccggatgtatctacgaatttagtagatcaattaagaaattaatcttactacaataccttagaatttgtaatgtggcctgatgggcaggtgcactgttgggttattgttggggccacatgtacatattcccgtatatatactgatttgcttttgtcttttgtcatcgggatgagcagccaggttgtcgacttggaattgaattccagtgtccgactacggtacaggccaatgaacagatcaatgcggcgctcaactccaggtcctcagagatttgtcggcagatgatgaacacacgagcaggcctgccctcttgggaatcacgcgctgcaagtagtcgtgcgtagtggatgccgatcctgatttgatccggttagaattctggcaacagatgtcaatttcggagatggtcgattggggatgaaatctcgcgatcgacgatcttgtattgatgtcttccgtcgcggcgatgtcttgatagatcgagttactggtgacgaattccgatcttgtcggaagacatgctccgatcgggttagatcttcacagttgaagtcgttgagtagcttgttgttggagaatccatctattgaacccatctcgtcgaaatcctagagcaccaaaatccccctacctggtgcgccac

SEQ ID NO: 13879 - DNA, 1501 bp, Oryza sativa
cccctggtgggtcctcatgtagtcttcggacccggtgtactcccaggcgccccgagcgcgccgctggagcggcgcaatccggcgacgaaggtagtcgccgaacaccatggcccctgtgagcccctgggatcgcaggcccgccaggcggtcgaggacggcgtcatagccatctcccagatctaccggcgcccgccagctggaggcctgcgccgggggctggctcggaagtcggaggcgcgcttcgtcggcgaggggtgtgtagaaccagtcgctcttccagtcatcccacttcttgcggaggacgcagggaatgtagcggttcaacaccggcccccgcggctggaagtagcagccaccaaccaccgacggcggcgacaccgactgtacggtgaagaaccaccggaacagccgaagggatgggcgcaccccgatgaacatctcgcacaggtgcgcgaagatggccaatgtcattaccgcgttgggggtgaggtgcgccatctggagatcgtaaaactccagaacatccatgaagaaagaagaaaatggcggaaccagccctgccattgcaaaagtgaggaagaagacggaccgccccgggtagcatggcgccgggcgtccctcgcccagcgtaactatctcccggccggtggcagattccggcatgaagcggcgcggcagcccggcctgcctctcgctcacgatgcgggaaggcggcagcacgctaccatcaagcaaagcggagccccgtgccatgacgccggaggaagagatgtttaagagcgagcgcgtgtggcgaaggtagggtacaggaaacaaggagttagggcgcaagcggcgaagacaaggggaataatggcgagaggaaggaagcaaatctcttcctcggcgactttatacccttgccaacgctgtgcccggctcctcgtttctcgcacccactatcttgccccctcgtttctcgcgcccacgcttccactaatcccattcgcccgttttcggtgcatgaggtggatatgcggctgtggcagtcgagatggaacatctcgtgcgcgcgttaattacgctcgccgatcaaagcgccatcaccatatctccaggaaaaacgaaccggcttgtcccgatttttagaccggccccacctgtcaccaggccttaggaagtggcgtcacgcccgaccgcttccctcgaggagggcgatcgccctggcataacgccgggggctactgtcggtgacatgggaccgggagtatcatgacttagagacttgaggcagacacgatcacccacgtggcctaaccccctcgggaggagggggtcgggcccgagggtgatacgcccgcccttctctttgtctccccgaggggtcgatccgctccggtttcggcctcgagggctggggtgccctgaccccttgtggattttgcgccgcgtgtatgggttaggtgagcgcagcggcgctcacctaaccgcatttattgcggtttggacgagcgcgtcacgc

SEQ ID NO: 13880 - DNA, 1501 bp, Oryza sativa
cccctttgccggttcggccgggggccctgggtgagattctaagctcttggtctgagtgtggaaggttcgcgagagtggaaacacacaagacacgggcgatgtatacaggttcgggccgctgagaagcgtaataccctactcctgtgttttggtggatctgtgtatgaagaagctacaaagtgcgagccagcccccgatcgttcccggatcgtttttttcctcccttctctaagtgggcaaggtcctccttttatatctcaaggggataccacatgcaccatctctccctctcacttctcttctcttcgttaatggacggagatttgtatggctgccgtccgaatgaccttctgatgggacggcccatacctacctccacttccgccggaagcaggcgcaacgtgggaacatggctgtctgctgacgacatgaccattgtcagaccggtcacaaatcggtcactcttgtccaccacgtgtcatttaacaatctgcatgttcgcccttctccatacaatatcttgcctgtaatggttaggatgaagcctggcgtatatctgaccggaaccaacgtgccatctccaggaggtaacacgccggctccggctagggacgagtgcttggaggctctcgtcctgacgggatggggcgaggcgtacgtcagaccgcctgtcgccacctaatccacgatttgaccggtctgtgactgatcacagaccggatgaacgagcgcgctgcactgcgttacatgcggcgtgacgcgctcgtccaaaccgcaataaatgcggttaggtgagcgccgctgcgctcacctaacccatacacgcggcgcaaaatccacaaggggtcagggcaccccagccctcgaggccgaaaccggagcggatcgacccctcggggagacaaagagaagggcgggcgtatcaccctcgggcccgaccccctcctcccgagggggttaggccacgtgggtgatcgtgtctgcctcaagtctctaagtcatgatactcccggtcccatgtcaccgacagtagcccccggcgttatgccagggcgatcgccctcctcgagggaagcggtcgggcgtgacgccacttcctaaggcctggtgacaggtggggccggtctaaaaatcgggacaagccggttcgtttttcctggagatatggtgatggcgctttgatcggcgagcgtaattaacgcgcgcacgagatgttccatctcgactgccacagccgcatatccacctcatgcaccgaaaacgggcgaatgggattagtggaagcgtgggcgcgagaaacgagggggcaagatagtgggtgcgagaaacgaggagccgggcacagcgttggcaagggtataaagtcgccgaggaagagatttgcttccttcctctcgccattattccccttgtcttcgccgcttgcgccctaactccttgtttcctgtaccctaccttcgccacacgcgctcgctcttaaacatctcttcctccggcgtca

SEQ ID NO: 13881 - DNA, 1501 bp, Oryza sativa
tttatgcacgatcttgatcttgagtatgtctagtcatctgctctagtctaaagttttgacttagtaataaatgcaagtatgctatgtttgatacctaccaagctccacatactaaaccttagagtaggaatcaactaggctactttggtgaggaattcatttatatacactctgagtgatcgagagggtcatttgaggaacttggatttcttttgaaagatcatttgaaaacttccggaataaaaggttgaataaataatgggtgactagtgcttgattgctgttctatcttccaaccgcacaagacaaggtaaagcaatgtctcgcgggaatcagttgtaagggtaagacacgtgtcaaaattatttgatttgagagagtatatctaccttgcacttgtacatttgagaatatacagcatagtagcaactcctgatcaacaatcaagttttgtttccttttgtcctttactcgagacgagcaaaggttcaagcttggggggttttgttgacggtcgttatcgatcagttacgtccgtcaatattactagaataaaagaactagttatgcttgcaatgcatatagtgtaataataaaataaaaactactagtacttggttcactaaccctctgcagagaatgggccataaatggagaaaaatcggcatcaaaaccgtacctctggtgtcttagctttatgaggtgcccagtttcaaaggtacaggaacaggtgtcttctctttaacctgccatacctcctttgtttttggtgcggtcaatggcttcttcgaaactgggaacgcaggttgaccgacttgtgttcctggcttcttgggtgccagcctaaggtatcaacggatcctcatttcttcttgatctttaggaaattcatcatgaaattgctgaaactgtcacgcccggaaaatctatccaaaattccgaacgcttacatgtgtgttaaaccctcgtccaggaatcaactgaggcacacaataacaaattgataatagagtacaaataaataactatttaatattcgcaaataataaattattacagaggtagatagttcctctcaaagaataacattctacgcagcggaaaataaaactataacaaactacggaacagctatggcgactccactccacacgcatcctaaccagaacaagcctaatcctccagatcatcaccttcactgagatactcctcttctgatgaatgaatattgcaagaatgagcatatgacatactcaacaagtcacacagcaaatatgcaagtgcacaggataacaaaggatggcataatatagctcatttgcagaaacagcatttaacgaatatttaagagaatagtaaaacagttgtaataattaatcaatattaaataaacaccatacaacacacccatgttgcataggcccaaccacatttgaacaaccaaccccagttgaacaaattaaacctccaaaccaggaattatccattccaaaccaggagt

SEQ ID NO: 13882 - DNA, 1501 bp, Oryza sativa
tcggttggtgttaccaattgagactaaagatcaaaaagtacccctggcttttgaaccaggactaaagatattctttagtcccgcactactcaaaccaggagtaatgtgatttttgcatgacacagcaaagatcatttctccattagtatctcctttggctatacaaaatgcccaaaccctacacaaagtacacaaatgtggaggtgatctatatcatttcaccacatgccacccttgcatttttgtcaagttagcttgattaattcatcgccctactcgcatggactaatatattagccatatacgtacattctggtgttttcaataatctatgcaccttcgtgcatgatacttctgacttactgagcttatatcatgatgtctgaacaaattaaatttaggggaactccattattttgtagaatatgttttgaaaaaaaactaaatagacaaaactcatatttatacgtgtccgttcatgttttattacattaagcctacttaatcgtatttgtacgtgtccgttgcatgtttttacattattaagcctacttattaatcatgattatataaatttacatctagcaggggcagagacaggccagcctacggcacttaattaggcttaagcccggcctaggcctagcttcataatcccattaaaatcttatgaaaacaccatgtaattcgtgaaaaatatttaaggtcatgttataactcaaccctttacttgagaatttccaggttccacccctgtcgtctagtagagagatcgagaaacggtaaagcaaaactctaacaaaacagtcttttcagaagaaaatgtagctcaacaagatccaagggtgtgtttagttcacgtcaaaattagaagttttgttgaaattgaaacgatgcgatggaaaaattgaaagtttacgtgtgtaggaaagttttaatgtgatgaaaaagttaaaatcttgaagaaaaagtttggaactaaactcggcccaaatcaataaaaattcaatacggtggaccgaactaaagtcttctctctctctctcactcaaggagagggatggaaaggaatcatccaaagctaagctacactgtggcacactataaaagggccatcaccaacccagtttctcctcatccgatcacacacacaccatagccaaaaaaaacacaatcactcgaccaaaccacacctagctactacaaagctagtgatcataagctaaccttaattagctttaattagccaagaagagacaaagagcaagatcgatcatgtaccaccaccaccatggcggccatggcgaggtggcgagcctccacctcctctcgcctccaaaccctcccttcttcggcgccgccgcgcaccaccaccaccaccaccacggcctcatcaacatggcgctgccgcctcaggcctacttcgtccccgccgcgccgccgccgccgttccaagaagccactgctgcgctcgccgccggcgacgacgccaccgccgcgt

SEQ ID NO: 13883 - DNA, 1501 bp, Oryza sativa
tactggcagtgggagaaccaccaccaccggccggagctggccaagggcaccagcgcgcggcggccgcctcgccatctccatcagcggctacagtgacagctagatctcctctccgctgtcggccgcgtcgaccctcttccccgccgctgcatcggccgtcggacctcctctccgtcgcgctcctccttcgccagctgttagccgcgccgcccgcgccaccgtgcgtcgccgcctcaccccgacgacgaccgccgcactcctccctgcgcgacggcagccatcagcggcgccgcccgtcccatcagccctcctctccgcgccgctccttccccgtcagctgccggccacgtcagccctcctccacgctgcgtcgaagacgctgccgccatccacgcccagaggaaaaaggagagaaagggagagaagaggggaaaaagagaaagggcggtgacgtggtttatctgacatgtgggacccatgtggggcctacataggtcccacgctgagtcagccgccacgtgaaataaaaccggggttaaaaccgccaagggatctattgtgacaggttttataagttggaggacgccagatatccggttttgcggttgggtgacgattttgtatctggtttacaacttgagggaccttcggtgtactttttcctaggaattcgcacagccacagatagcatccgtgccacgacgcaaccttcggtgtactttttcctaggaattcgcacagccacagatacatccgtgccacgacgcaacaagaagtttcgcattctaatacttagctactaattggtaaattattactactacttgcactatgcaaaaggcaaatcagatcttaattcacatggcatggacatgataaaagcaacacaaaagaaccagagcacatctggatgagatgaagatgaagttcatccatccagcaagaagcaatttgggacgagtccggtctctccctcaatcagcaccttcccctgtaattaagcaagaaccaatttgatcagcacagagatcaatccatcatcacgaaattggatgaataatttagttttaagcatcatttacacatgcccagatgtcaaaaggataccttactgacatgtgaactgcagaagagcactcttcctgtttgagttacaagtaagcatgttgccatctcaactgaagaactggcagtacccgtgccaatatatcaccaacacttaaaatttcatatggcacggcacacctattgtggccttcaatctctttaacaaattcctcagaaaagaaattgttacatttttgcacaaggactagttaatgaatggactctagaagtgaaatttgtatgatggtggattgtgcgttgattcatggagaattacctgctactacaattttgcggaagaagaaattacattttgacactaactgttaattagttgtgaatcaatatttgttgggaacagagaaagaaaaggaacattggtgatgatcctgga

SEQ ID NO: 13884 - DNA, 1501 bp, Oryza sativa
cagagcttggaagttagagttgagacaagaaagttttaagagtgaatccggattactttgcttaaactgagttaatactggatcatagaaatgtacctggttgatcagtacgtcagtgagcagcaagcccaggtcaagcttcctctcggaatcgcgcgacgccgaccactccttctgcagcaagctcgtcagctttcccctgtcgccgatttgctgcgcatgacaagagacacgcagttggtagaagcacattttcttgatctagctaagattgagatgagaaatgaagaatcaagaaatggatcgggatgatggatcaggaagacctccttggtgacttgctcaaagacgaggtccatcagtgtggcgcggtccctgggcgcgtcctcgcgccggaacagcgagtcggagagcgcgtccacgctcgtcctcatggtggccgcggcggcggcgctccgttccgcggtggcgcgtgacgcgctgtccgtgacgacgttgagggagcacaccgcggcgggttgcatgaggaccgggccggcgctcccgccgcgcgccctccacgacgcgccacccagagccagcgccagcgccacgccggcgcccaccttcagcgcggtcgtgggaaacgccgacggccccccattcgcgggcgcctggtgttccgggtccggctgcgtcgccgccgcctgtgcacgcgcggtgagaggcctccactggcaccgcggcgccagtcgaacacgagcgacgcggcgacgcggggcgaccggagctggagcaccacgtgttccgggcgtagccgtgcaatccaatgcgcggatcaacgaggatgccattgccatccgctggtctgatcggtcagcttggtgtctggtgaagccaggttgcaatcattctcatatctcaattttgctttttattgggagcttcagagcttgtgctaccatgcttctgcatgcatggtgcttgacgtcttttgctatcgcaagcaaggcatccggttcctaacgcgctcttcttttttactcaagttgattagcaatttaacataggctctaagcttggttacactcatgggctcatggtgatatagccaaataagaatgtgtattagaacatatgagttgctccctctacaagcaaagcgttattccggttgtactaccgtctactactagtagagtgctagactgctagtatctattcactgctggaatcatgccacattttgtagtgctagactgctagtatctatgatacctcctcatgtcaaaggaaaaggaatactcttcctcattcaaatcgattattccagtctcacatcaattcgtttgagctcgatccttcaggaaggccgtgtttagttgcaaattttttcttcaattttttaatttttccatcacatcaaaactttcctacacacacaaacttctaacttttccgtcacatcgttccaatttcaatcaaactttcatttttggtgtgaaaaacacagccgaagtca

SEQ ID NO: 13885 - DNA, 1501 bp, Oryza sativa
caacgagatgcccagctatatctagtaagaatcacctgatacctggtaggtatcatccgatacctcgcaagtatcacgtgatacatggtagaaatcgtctgataccttgcgagtatcacgtgatacgtggtagaaatcgtctgatacacggcaggtatcgcatgatacctcgtgagtatcacgcgatacgtggttgaaatcatatgataccttgcgagtatcacgcgatacgtggtagaaaatcgtatgatacctgataagtatcacatgatacttgtagttatcacctgaaacgtgtgtagaatcgtctgatacctgatatgtatcacacctgatacctactcgggatcatcctgttgtgtagaatcgtctgatacctgataggtatcacacctgatacctactcgggatcatcccgtttgaaaacaggattccgttatatagcagtccccttataaaatcatctcagtcaatctatatatgtagcaccagtgcaccacctgatccaactgatcttgtcctaacctagtttccatgtgtatcttttacattagtaaagacaaatggggttccgtaggaattaatgttcaactttgatcaaccttacttagtcacatgctttattttttttttaaaaaaaagaaggtttaaaataggggcgatctaatctaaaaggagtgattttacagtttgggagatatcatattttctagtgtaaaatatgatacctctcggtatcttgggtactagaagctacggaaattcgcaataaattttttggtacctctttctccatcttcaatataattcagtgcttgcctaattcctatcatgacttcggctgtgtttttcacaccaaaaatgaaagtttgattgaaattggaacgatgtgacggaaaagttagaagtttgtgtgtgtaggaaagttttgatgtgatggaaaaattaaaaaattgaagaaaaaatttgcaactaaacacggccttcctgaaggatcgagctcaaacgaattgatgtgagactggaataatcgatttgaatgaggaagagtattccttttcctttgacatgaggaggtatcatagatactagcagtctagcactacaaaatgtggcatgattccagcagtgaatagatactagcagtctagcactctactagtagtagacggtagtacaaccggaataacgctttgcttgtagagggagcaactcatatgttctaatacacattcttatttggctatatcaccatgagcccatgagtgtaaccaagcttagagcctatgttaaattgctaatcaacttgagtaaaaaagaagagcgcgttaggaaccggatgccttgcttgcgatagcaaaagacgtcaagcaccatgcatgcagaagcatggtagcacaagctctgaagctcccaataaaaagcaaaattgagatatgagaatgattgcaacctggcttcaccagacaccaagctgaccgatcagaccagcggatggcaa

SEQ ID NO: 13886 - DNA, 1501 bp, Oryza sativa
tcttaatacaatgagatagctacttaataaattttaagtaaaatcatactaaaaaatatatgattttgtttaagtgctagccgcataattgcgcgggccaccagcaattgtatatagagtagggagtttacatggcgctatctttcacgtttatgtttgtggagccattgaactgaaagtggtcgaggaagcgtaattgtgtcgtagtcatctctgctctttttcttcctcctaagagcaagtttaatagtatagcccactactagctctaattcatctatagtcaatctaatagctaatttatacaatagttgtttactatactattaatatatggtccaacatgtcatacacacattgcgtcttggagtccgcgctgcatctagctacagatctgtagcccactgctcttctctctcatcttttatctcattaaaatatgtttacagctagctaatatctgctctaaggtctttcacagtactcctacctgcagcgttatctcgtttgccagctagaccaaattctgacgtggatgaaaaaaggtagtgggaccatatctttacaaaggtttacatctcctagcaaggatctggtttcctcatgccaaaaaataatggacatgctatatttatggcgacacaaaattagcttgatcacagtcggttaatctgacccttcgatatcatgtagattcgtgttgcactttaatgcttgacttaacgaacgtttgatttgctaagtccgtagttatttgatctctctgtactacgaacatgttgctcctgttatatattagtttcccattaaatttgcactagcatctctcttatttatatttacttatatatgtaattttagtgtattaattagaacttacatggtctaaaattacatatgtaattttatgacctacatatgtaattttagaatttacattgtaaatacactaaaattacatatgtaattttatgacctacatatataattttagaatttacattgtaaatacactaaaattacatatgtaatttagacacttacatttaagtgcataccgactattttttttacacttactgtgagtggtcccctactccataaaacttccaaattcatctactctgtccgtctgtcgtcgccgaggttctgcgcgggcttggagctcgccgaccacgctgcctagtccgacgaggaaggggagtagccggagcacaggaagaaacggtgggggctggtcgggggcgcggcgacgccaaggaaggagtgggtggtgagggagagccaccaacggaagagaaaggcacgacgaccggtggcaaggagagccggggtcgccgccgtgccatctcctcgtcgccacgcttcttttccgtctccgcgctccgtctccttgttgccggctaagagaggaggggcccggcgccgctccagatccacgtcgccaccgccgtcctcctcgctccgtctcctcgtcgctgccgagagaggaggggcctga

SEQ ID NO: 13887 - DNA, 1501 bp, Oryza sativa
atctttgtcgaaggagaagtttaatgtggttaataaaagcataagagttacatagtcctaaacgttgtaaaggtaaaaatatctaatctggaataaaaatatgagataatgggtggttcaaactaaaacttggatatgaatgtgatccaaagtataaatcactctattttatatcataattacggtacgggtgtatggctaatactttacattctcctatagtcacgtatagtcacacctcgtttgtcgaaggctttaatattggattggataaaccttcgtgacgtctcttttccttttctacgtttgcacatcttcttcagagttatagatatgtttcaagcattgatcgatcctaaatttttttaagcaatattcttctttattaaatattagaaacttaagtacggagacaaaaatccctttgaattaaatctttgagcatcagagataaacgaaagagacattgggctatagagtggccctaatcatggttgctaatataggatatgacttgcatatgcattgacattataaaaaacacaattagttataatataatagacctataatacaaaataatataaagttatattgattattacgtcgaattcacaagccaaattttttttctctcaatagtacgatagacccaagattgtgtttgagagggaaggaacgaagaagactgaggaatacctaaaacgaggtgaaccattatcatatgattaattaaatattaattattttaaacttgaaaagttggttaatatgatttttgaaacatttctatagagtatattttaaaaaaacataccgttaacaattcagaaaagcgcgtacatagaaaacaatgaagttttcttcgtaatttgttaatgccaaacacacactcacaatctctaaagatccgagtttattacatatctattttacgttgaaatgaatttctaaaacttatattggagaggatatgaacaattatttcaaaacgaaaagacaattgaggccgtgtttagttccaaaatatttcttcaaattttcaactttttcatcacatcgaaattttcttacacacataaacttttaacttttccgtcgcatcgtttcaatttcaacaaaatttatatttttgatgtgaactaaacacagcctaaaacaccttatcgtttcaaagttcaaagttcaaaccattcgaaaaaaatcccaagaaatcataggctgcagtggctgcaactgctgcgcgtaccgtgctctgccctcggctcggccggcgcgacctctcctcctcgacccgcctcacttctcggcttcccccgccgccgccgccgcggcgggacgcgggcccagcgccggcgcgcgccatagaaaccgcaagagcgaagcgcggcgagatccggagcccgcgccgctcgccgccatgcagccgccgatcctcctcaacatcggtccgccgcctcttccaccacccgtagcatatccgtttctgctcgattcgatc

SEQ ID NO: 13888 - DNA, 1022 bp, Oryza sativa
tccccccacgacgcgcgctgccccctgggccccaccacatgtccctgtccccacctgccacgtatctccaccacatactccattgcaacaaatcacccatatattttgaaaatccattattaacggaattcgaatcacccatatattttgaaaacccactattaagggaattcgtttcattttttgttccaccaaaaatgtttcacctaatgtactcgcaatatttcactatgtatagatctagtgttgcagtgaattgaaactgtcagagttatggataccacatacctaatagtagttgactaaatctcgacaggatccactacataccatgtcttacacggaaactgaccttgggggagttccggataaggaaagacaaccagagttctacatggaaacgacaagtactactcggattgtatccatatttgtttccctagttcaacttggacaaagggatacctatgggtataaatacagggccccctaggaggagagggggacaagacaatcaacacccaacgggatcaacacccaacataatcaacatagaagcctacatacgccaagacacgccgccggatatcgacttcagggaaaagcacggctaataccctacggtgtctccggatactgtcaggagaaaatctctgatctcgccgggcacggattcgaggaggaaggctcccctgttgtcgactacgagtcagatcgtctgaccgccaagacgacaacagttaaattggctaccccaaatattgtacttgtgtgattatagtgaataagagcaataccggcttcggccaacaggatgtagggttattacctgacaactcaggggcccgaacctgtataaaaatccatgtctccatctcttttacctcagtcttgcgtatatcctagcaccgacgatccccataccatacaaataccagaattacgacatcaaacgtcgacagtggcgcgccaggtagggggattttggtgcttcaggatttcgacgagatgggttcaaaaga

SEQ ID NO: 13889 - DNA, 1501 bp, Oryza sativa
ccgaacgagtgggatcctccttccgcgaaggttcgcggtggggaggagttggagaaccattgtcacgcccggaatttctatccaaaattccaaacgcttacatgtgtgttaaaccctcgtccaagaatcaaccgaggcacccaatgacaaattgataatagagtacaaataaataactatttaatattcgcaaataataaaagattacagaggtagatagttcctctcaagaataacattttacgcagcggaaatataaaactataacaaactacggaacagctatggcgactccactccacaggcatcttaaccaagaacaagcctaatcctccagatcatcaccttcactgagatactcgtcttctgatgaatgaatattgcaagaatgagcatatgacatactcaacaagtcacacagcaaatatgcaagtgcacaggataacaaaggatggcataatatagctcatttgcagaaacaacatttaataaatattgaagagaatggtaaaaacagttgaataattaatcaatattaaataacaccatacaacacaaccatgttgcataggcccaaccacatttgaacaaccaaccccagttgaacaaattaaacctccaaaccaggaattatccattccaaaccaggagtcaaattaattatcacattattaacattgatgagtagtgtgagactaatcacgaaaaacattgctcaactcacccataaccgcgggtacggctattcgaatagattaaactctgatcagaggtgtaccactgtacccacaagacacaatcccacaacatgttaccatgcgccttagtaccaccacgatacctcggaaaggaactgtgacaataccccttgcacaacacaactcaccacagtgcaccgtacctggatcataatcaccccctctacaaccagaggcatggactccccagcgaccccacggacttctcgccgcttctcagtctggcactccgtaatgaatcatgctatacaaaaggtaaagccgttgcccacgctggcttgtggttggcacggtaaaagtttcacaacagtagctcgcgaaccggtccttaattgtcatgagcacaaccatcaaaaccatatgctcacaacccaccttaactaggttttaattatcaattaattatcatcacacgattaaccatcgtgagctaccatttaatgtaaccatagttaaaaataataatgtgacatagtttataattaatccctttagttagctaatgtttctaagcatggctaagcaaacttacatatagcatttagctgaaccaatccaacatataaggttcatgctatccaaattataacccataggaaaataagatcatcttcggccattaattaattgggaaaggttcaccacccgatgacattcgaaaacaatgcatagttgaaataaaataatagctttaaacgggttcaacatgctcaaagggttgtttgggatctgtgtgacttgcc

SEQ ID NO: 13890 - DNA, 1501 bp, Oryza sativa
tgatcctgcagagcagaagattgtgaagttgctggataatttgagcttggcttgattatatatccctatggattgttgtcactgtactggttgtttttctgatctgccacagtagtttactgatttaaatttgatgactcttgagtaattatcatgggaaggaaagagatacaacatcatcaatacgaggagtttgtcattaaaaatacatgccaatctaacatcaatggtgcattcttgaagcaaatgaagcaaggagtcatagggatgattgcaagtgatgatacagaccaagtcttatttttcataacgctgccgtcttcagcaatgattgcaaacagagtttgagcatgcaaatatgctctgtccttggcaaagatttggatcaaccgcctaatcatcgttgagtaaggcactgcaaatccagttgagcttctatttctctacgatgtggcatggagtccatccaaattttttacaccgaagaaagatgtctgaaaacttgcagcggagatatcaaaattaagaaaaaaaaaactcggtagagtaggacatgaaattgcctggaatgcaaaattatcaggacttaatgctgttatgttgtattttcagtccaagttcagggttgtatatagcaatatgagctccgggattgtaccccctatacccgtgatatctaatactcctaaagatctctcttttcccataatgaggtaactagccgagatcagcgaaaagaagaacaacacgagtgcaacagatctggtgacatttttgtcagtcgctaacatcgggaaaagaaaaagagatcccgaggcacattgaagttggatgaaatcatcacagttgccttgttgtcgagggtacatcgattatcactgaaagaataaataactacgaggaccaatattaaatctaattggttgcaccataggaaaccaacctagccagcccataggaaacatagccagttgagctcactttgcaaattaaggttttttttatatgtgaatgaaatgagcagtaactctaaatatagttaactaaagttcaaaaaaatatatagttaagtaagtttggtccaagcaggggaaggcctatcagtgactaatcctagcccaacaaactatctgggccaggcaagtcctatcacggcccaaataacaagtcccaaaacagagagcctaaacaacaactccatccgagccgtccattccgcgatcagagcgctctctccgccacccccctcgctatataagcacccgagggtgcatttctagggtttccgccgccgaagccaccacacctaaacccttcttccctctcctcctccgccgccgccgccctcccctctcgccatggtgagtgaacccctcctcccccctcgacgccgccggtgaaatgctcggcttctccgtccatcatagtgtgacggggtttcgtggagattggttggttgctcacgccgcgtgttttttgttttttttttggggggttttgc

SEQ ID NO: 13891 - DNA, 1501 bp, Oryza sativa
ctccgggatgatgtcgacggcttgatctaccaatctaattggcattcatgaggacatacattgttagcgaggtctcagggatgcttcatgtgcaaagtatcggacaatggctcaccagaggagaaggaatcggcgacggcgacgattggccgaagccagagaagacaataccgatctccgtccatggcccataaatattgggggttcttgagggattttggtcgtagtgatgagacgatgatggtggcgcgacagcttggcctggctgaccacagaagcgggaacggcgatgatgtcgctgcggcggtgcacagagtgcgctccagagctccggtgggcatggcagcgttcccatcgattggctgcatgaatcgagaggttgtcaaaacgagttttgatcggcatggagagaagataatagaacgtgaattatatagggatgttgacggcttgttggtgatcggtggcgccctctttctcggcggccgacgatgaaatagaggtggagtgggagagctggagctctcaccctcggttggatcggcactgggatggaaagtgaagagtggcgacgcgtctgggagagtagagaaggagctcggcattttgaaggcgtcgacacgtcgctcccaacacgtcgagcactgccagcgccctcgatctctctctttctgtctactggtcggttggaagagatggatagggagtgggcaagcccaagtagctgccaagtgagcccaagtcgatgtaagctaggtgggtccgtgggtgagagtggtgaaagacttgattttcagagattttcaggaatttttcaggattatttctcttccccatatttgttaattcatggattaatttgtggtgtagataaattcaggtggatttttctggaggtaggtgtatgtacctagtttccattttcttgggttacactcaaaaagtatgtgtagtttgctcttagaaaaatggagaaaatgggctcgatagaactttgtttgaatttttaggaggtctaaacagaagaaataaattctggaaaaataatatttattctttaaaattaacctaatatttgaataaattatttcccttatgctcttccatgcagttaaatgcacttttagacaaaatatggttttagccgattaggaattataattagtctattatttgactggtttgactgatttatttaaggtatcaaatttagttattaaattgtaccaaaattacagtgagttctacgtgttaattagagcctacatgaattttcccatgattttatcttgcacaaattattttagataattagcaaggtctttctttatatgtgcatttccaatttttagatgcatctaaatagttataagaaatttatttagactactcttgacctgaagtggtaatattagacttccttttcatgtctttaatattattactcatgaacacttttaggttttgcttagtgaaattatcttttaatcatgctcatgag

SEQ ID NO: 13892 - DNA, 1501 bp, Oryza sativa
tcttgcatcatagtaaattatatagcgagtgaattgacagcctgctaatttgttccatgctgcaccctgcattttttttctcagctcatccattgtctgattgtttacatggaaggcttactctgttttggttgaaaaagcttagttgggagaatctgtcttttctttgtatgatataaaagtaacatactctttggacgtgctttttctgcattttttttttgccttacacacgtccagatgcaatctaaccaatagacgaagagagagaaggacggcggccggcgccggtggggagaagggccgcgatggcgaccaacagggatgagggcatgaccagcgggaaggagttaggtgacaaagacctcatgtcccttcgagcggcgacggtggatccgcccatcgcctttctcccctctccctcccggcatccttcctccctccccgagctccctggcttgccggtgagcgcacgtagagagagaaggacggcggccaatgaccggtggggagaagggcggcggacggcggccatgggggagaagagcgacgacgacctcatgttccctctccctccctacatccttctgcctcctcccctttccctcctggcatccttcctccctcctcgagttccctggcctaccggcgagcgcgcgcaagaaagagatggccggtggttggcggccggcggccgacggggagaagggtggcaggaagcggccatcggggagaagggcgacgaccttgtctcccttcaagtaacggcggtggagccgcctgccgctcttttccatctccgccgccgtcgtcaccgctggccgcatctggtgcccatccgcccccctctccggctctctgcgctcccaccgttgatgccctccccttttcccgcgtcgccgccgccaaacctccccgtgacctcatggcacctagagaaaagaagaggggagaggggagaaaggaggggggggggggggggggggtgttgagaatgacatgtggggcccatgtgggccacatcattttaattattttttttaactgacatgtgggatcatagttgtattattttccaaatcaaattaccacgtcaatgccacatcagatgaagaccgagtatatttagccacgtcagctaaaaccgccgtccaaactgccatgggacttatattgcactgattttgacagttgagggacgaaaatcggactcgttcataagttaagggacctcagatgaactttttccattcagtcttggggagtctaggggattatcggagtatatgggcctgtgaggtcacgtgctctggtgggcttttttctttttcaaaatgggcctgcgtaaggtttattgatttcatttcggccttttactaatttatgcccaacccaaaactttgtatgggtttcttttagatataagttcagttcaggtcccttagtttgtctatgaattcgattttcatctttgaacccaaaaaatagatatgatgggccc

SEQ ID NO: 13893 - DNA, 511 bp, Oryza sativa
acctacattgggtcacacgccccaacatgatcgaatacgtcacactcgtgcgttcaatcgattggaagctagctagccgtgtttagtggatcgaatgatcgacgtacgattgatcgatcggtacgtacatgggttgatcagctcggtccggtctgccttacgtacgtgtcgctcggattgctgaggagagcgcgcccaaatctgcgggacaggccggattgctccactacgcgacgccctccgccggccgcggccacaacctcgcgacaccgacgcaaatcccactaaaaccttacgacacgacgagccgcgctagctaccgcacgcatgcgtaccaccacaaccgcgcgcgctccctataaatttcaccgctaaatcccaccacgaactcatcaatccatcaagccatcagttcatcacaccacacacagcagtacagcagaggagcactggtcaccggaggttgagacacctgcgtgtgcacggctagagtgtctgcgtttgcgcgata

SEQ ID NO: 13894 - DNA, 1501 bp, Oryza sativa
ggcttatgagcctatgtcgtcatgtacttatatggattattttactttttagtggagttattaatatatcaaattgtaatttatcatctggattttgaagaattgaatatatgaacttgttttaattttacatgtcaataatttgttcttgctttcttaatgattacaaattatacatgaagagatgcttcaacaggtaggctcacaagccagctcaagccagaaaacaagccaagacgagctcacgctttaactcgtttctctaaccgagcgtccgagcctagccaagcctaatttgttacgaccctgtgcaacccgagagccagtgacccgcccgctctaactatcatgtacagccaacaaacacgtgcgcaattgcccttttttttccctacgattctaagaaatgtttgaagtgctgattgggggcttggggctttaccgctcatcgctaaaagtcactctagcaaacctctcggcaaatcaaggtagaggctgacctgtagtgtaccatagtacatggaaatacgataaagtgtgcattagtgtgggtgcatgtcatataaagaaaaggaacctgtcacgataaatatcatgatggttttataggcagtgactatggtacacgtacgtacactgttgtatttggttcagctgttgtaccaatatttgtttgcgtgctaggtaatttgtccagattaaatagtttaagagtaaattccctgtgtgcccctgaaaactcactcaattcttttcatacctctgaaatttacctgatcccttatatacccctaaaattttaacttgatcccttccatacccctactattacattttcctttggttgcaaatgtcttttttgcccatgatgctttaggtttgaatataaggttgaaaaatgattgaaaattttgtttaagtgcacaatatgtgcattttataaaactaatgagactaaataattagtgcgaaaaattttgacataaattttgaaaataaaaataaattaaattttttatttgaaattttaataggacaatggatatttttgattggcagcattcataaaaaaattattgtgagcattggtagtcctatccttatacgaatgctcatcattttttatgactttttttaaaaaataaatacatattttttatttctttatctaaaaataaattgtgtgataaataatgcatcgcacaacaaactcataactataatagtcttatgcgataaacttttacatttttaataatgtaatttatgaatttctatgttcgtccaaagggtaaaatggtcattgttatagaaattagacggtcaactgacgataggggtatggaagggatcaaaatcaaattttggaggtatacaagaaagtaagcaaaatttagggacatagaagggattagctaaaaattcaagggtatagaagaattttcttatagtttaagggtgtcaaatatctgaaattgttgatagaagggtatgcttttgc

SEQ ID NO: 13895 - DNA, 1501 bp, Oryza sativa
gtctacatgttggcgcgctcatgttgtggtggtgatgtctgcgtcgcttatcttccctgttaccatcaatgaagacgaggcaactattgttgtgttcatcacatctaaaagctcgttgtcatcaccatcgccgtacgtgcccctccgaagcatgtcaccatcgccaccgctattcctgtggtccctgacatcgttgctggaccgtacccatggaggctcgaatgcatgggtatgttgtgttcagtacatataaggccggatcagcataactttagatctttggatctgaatatttgattacgtcaataatatttacataaattattttatttctattttagatgaaatgtgaaattttaaaccactgcaatgtgactacaaacttgaaatgcagcgcgtatttgaaatctacaactatatctgtcggaggtatgggcccagaggtatgcgaagtgagggaaagttacctttctatccagccgcgtggctctacagcctggccctactcccacgcctcgcgagtcacagaagtggccggggggcctcggggtgccacgtcgtgcccctcaggctctcccgctgcctcgccccgaggccctcgcccagctgccatatggcggggggagcgagcaggaagggggcccaggctgaacaaccatcaatgcgcagcgccccaactgtccctcaccgcatttaatgcggtaagggcagacgtgcggtgccgcctagctgatccacgtcaatcggatgtaaccagtctgtgaccggcctgttgccggtcacatccgattgaacgggtggccgtgcccccacgtcacctctgtaacaggcggagtggaagtaggtatgacccgtcctatcatggtgtcattcggggttccctccatgagagaaggaacaccacaagtcttcactcatttatgagggaatgacagggctgtcccctgtgtcaggcgaggggtggcgctgggtcccactcaaggacaggctgctgcttagcttccgagcgaaggcacggatcgtggcccggtcaaggtaaggtgggtccccctcccagggaaggataggtagaggcggtgcatgtggtatccccttgaactataaaaggaggaccttgcccaccgagcaaagggacgactctcagaaaacctgaactctaggagaagaaggggagaaagctctccggagttaaggaacccttgtaactcttaaccataatctcaaacacaggagtagggtattatgctccacagcggcccgaacctgtataatccgattctgtgcaagctagctagtagccttaggggcggatacgcgatttctaagaggcgagcctcttcccccggccgaactcacgaaaggggggtctcacgacctcccgctatcgagggccttccctcgacagctggcgcgccaggtagggggaaggtcgcgcgctctgaagtgaagtcgttttcttccgccccaagtttccctgggcccttgacgaccatggtcgaga

SEQ ID NO: 13896 - DNA, 644 bp, Oryza sativa
atgggacgggtcatacctacttccactccgcctgttacagaagcgacgtgggggcacggccgcccgttcaatcggatgtgaccggcaacaggccggtcacagactggttacatccgattgacgtgggtcagctaggcggcaccgcacatctgcccttaccgcataaatgcggtgagggacagttgaggcgctgcgcattgatggctgttcagcctcggcccccttcctgctcgctccccccgccacatggtagctgggcgagggcctcgggacaaggcagcgggagagcccgaggggcacgacatggcaccccgaggccccccggccgcttttgtgactcgcgaggcgcgggagtagggctaggctgtagagccacgcggctggatggaaaggtaactttcccccacttcgcatacccccaggcccatctccgacagtagcccctggcaccatattggacactgacctcctgaggtcggtctgatgtggtgcctcacgacttcccaagctggggttgtgggcccgacagggaatctaaggaaatgtcgccgagtggccaggttggcatattaaccacggcagcagtttgccgccactgaccacgctgatgatggggatgtttaaggcgtgaaaatcggggggtc

SEQ ID NO: 13897 - DNA, 1501 bp, Oryza sativa
tcctgcgtggcacttacatggcaggttgacttggtctttataccatgtggcgctaaaataaaaatagaccttaaatgggacccacatgtcagtaagtaaaacaataaaaataaatttcaggtccatgtgtcagctacctttaattttcacctccctctttaacccctctctctctctcaggtggaaggcaacagcggcgagacagagcacggcggaggagtgtggaagggagttggtggtgggtaggaagaagagaagatgttgattaggccggagaagtttagtatggtataagccttgaagtaagggtcaggagggtagacggtgggaacaagggaggagaggaggcgacatcgaggcttcctcaccaatactgtttctccgctcccgcagtcatggtgctaatgccaccccgccactctcccaatctcactcatcgtcgacgataaagagggaggagttaggtaactgacacgtgggttcaaaatttatttttttatttaggtttgtttttattttagtgccatgtaagtgccacatcgatgccacattggatgaagacaagtcgacccgccatgtaagtaacacgtaggacgaaaacgccttcgaaaccgtcgggggaatcgatttgcaacggtttgaaaagttaggggatgggttatataccctgttttgcacttgaggggtgcgatattttcaaccaggcacatgagttgaaggaggcaaagtagacttatttccattagcaaatcaacatttttttcttttccaattacatggtggacgcacacacacaaacaccaccatacgtaacaccacgctcacactcctgtaaatgcgtaccctaacaattatgctaagagacggaaaccagttacatatctctaatctcactaaaatctcattaaaaacacgtatatacgtgtaatattcatttacattaggaaaagttatcatcatctaaaaaaagtatgcactcacaaacccactaccacaccagtaaaacttttccaaatcgttaatatgatcacgtagatgtcacctcggtctcggcgccatcgtgtggattgtagccgagggctgttaacctcggcatcgacggcaaagaaagttgatgttgtccggtgtacgggatgatgacgagtttatgtggaggaagcaacgaaaatgctacctcacacgtggatctgcaaaaccaaccgttattttttctctaatcaagatcagtcaaatttcaaacttcttaattaatactaacagatggcttacgttaaaaccatatcaaacacacaaaagccaatagcttatagaacttgattatttcaagaactctcagtggtagtgatgcaaactaggaaactcctttggagaatccgtgttgaatgcctcgattccttgttcttctccccatctaatcacatatatactcacatatgaactgttaaatcctcggaggaccttccaaaatttcttcacaatccaaccaagatgagacaccaaa

SEQ ID NO: 13898 - DNA, 1501 bp, Oryza sativa
ctgaagcgccggtcgtcgcggcggagaatgtgtgtcggtctcgcgcgcgtctcgcctccacctttcttttttttcccggtgtgtgtttcccgcattcgtgggctctgtttcaccgatgcgctccgcctctcctcgcgccggtgatagtggagtttggcgttggattagtgtgtttggccgtggacggtgcccgcactgccgcggcatatcagtgtttttggaccaccgacgaggtgcattgggggagctttggttgcacaggaaacggcaaaacccatcatggcgtgtttgtgctccaggacagcttttgatcggaacggaagcacgcgcctttgctagctatagcttagcttgtcaaacgcccaaactcgcgtcacatgggatgttcaattagccgtgcactttggtagtggaaataggattagtacttttccgctttcaggaattatacctctcgaacagccaagcagctgccattgcaaattcggcaaaatggccgtagaaaagataagcagctagacacgtacgccggcctgtaaaccatctacgggtagcgaagaacgggtccctctgttcatgtagactgggcatgtacgtgtctgcatatggtccaaatccacacaaaagtctgcgcgccgtgctctgtccagggtgtggcccgcgcgccattggcgtttagcgtctgtgtgatctgtgcgttcatggtagctgattccatcaacggacgagcgatcgcagcacagcaacgtgcagaatcggatgccgcgcggcttttttgcttgcgggggggagcacgctacacgcgggccagccgatggcgcggtcacatggcggtgcacgccgcccgccgggggtaggccccgtcccggcgcgcatgtgagcgttcttttcttaggtttttcttggcttccctttccacggattagcggttctctcgcgtgtaagcttgttcggctcttcacgtgcagggcacaccaacaccacccgttatggaaggaggaggagaggtgatattgatgctggttgtcggtactcggtactagagttcggcaatatgaatctttgtttctgaataatcattttcacgattcgattggtgtagagctgcgctcactagcttgccgacgaacaatctaaccacaccgttcagttcaagctttggtttagtttgcattgcaggggattgtcttttctgtttggatttactagaatctacagacaacagacaacgaacactaccgcgtagaccaccaaaaaacgcctgattgactaacagcgtggaaaaaaaaaagtagcatggcattgcgtaaagcagacactttatcgaccggatcaagtgaacagcaatcaataaacaagctgaggaaactggaaaggcgttacctttgctggatctggtaaacgccacacctcacaattggattgagataacatgcagtcctaactagaaccgcaagttagtaacggcatcatatcatatcaatttatttttcagatgaag

SEQ ID NO: 13899 - DNA, 1501 bp, Oryza sativa
gcccataactgcgggcacagctattcgaatagttttactctgatcagaggtgtacaactatacccacaagacacagtcccacgacacgtttccgtgcgccgacatgccaccacaacataccggaaagaggccgtgacaggacccttcacataaccccctctagccaaacacaccacacctcaggtttcacccccatccccagcgggcaacgggcagtcccctctcgtcctaggtgaatccagaagcgacagaggccgtcgtagggcccgccccgctccatcacgcccacccttgcctggatgcgtcaactagaggaaagctacactacaagcccagccgttgcccatgctggcttgtggtaagtacgaggaattcttctagggtttcccgcgaaccggtccttaagtgccatgggcgcgaccatcaaaaccatgcacccacagcccaccatatggtatattttaattgactaacaccaggacggtggctttaatccaaaaccaacactagaacgtgaagactatgcattaatgtgatttcccccacggtgtgctagttgaactaagcatggctaagcaatccctagtccaatctctagtcatgttatatcccaagctaacaaaggagcatggtacaaaagtagcatggctgtaacagtaggtaaacatcccatagtatcattataaaacaatgcagtatttaagggaaaacggtagagcatttgcaatataggatcaacatgttcaagtgacaagcatgacttgccttgctctgctgctggaggaacctcggtgactatttcaaagtacaacggagcgtcgggagagccggaatctaagcgacatacaaagcaaataatacaaacaggctataagactactgaaacagagaacaaaaccatttttaatggattcaatgcatttttcttgatttactgagacttgaataggctcaaacggagctcggatgaattagaattgaattttagaagattcactgtgtttttactataaacagaaaaatccttaattgatttattgcgcaataattaaaatcccggggagagagagggcagcgccaacatgcgggccccacatggcagtgactcgggggggtccgcggtggaccgggtccacggaccggggaaggagcggcgcaccacgtggtgcacacgtggcgccgacgcggcgcacacgtggcggccatgtggcagccacgcgtgcggcggggttgggtagatcggacggcggtgggagcgcgtggccggcgcgcacgggtggctcaagccggcccggcggccatggcgcacggcagcacggctctacgcagcggcggtgcaaggcggcgaccggccggtggcggtgggcggtggcgacgcggcgacgtggacagcgacagcggcggctaagcggctaggcggcggcgtggcggccaagcggtgcgggagagagggagaaaggggaggaggtggttcaccgacggcgataggcgacggcgagcg

SEQ ID NO: 13900 - DNA, 1501 bp, Oryza sativa
gccgccgctgccaccgctccggtagccgctagccgccgctagctgccgcgccgagccgcaccgtcgccgtcgtcgggttcgcaaacccgagggccacgccgtcctcctctccgccaccgctttccgccacgggaaccccgttcgcaccacgcgccggtgagctccgccttcggccggcgtcctcaccctcttccatcttcctctctctctctctaacccctttcttcgtgttcgctaggtggttccggagctcgtcccgctgccgtcatcgccctcagtcgctcgccgtcgcctatcgccgtcggtgaaccacctcctcccctttctccctctctcccgcaccgcttggccgccacgccgccgcctagccgcttagccgccgctgtcgctgtccacgtcgccgcgtcgccaccgcccaccgccaccggccggtcgccgccttgcaccgccgctgcgtagagccgtgctgccgtgcgccatggccgccgggccggcttgagccacccgtgcgcgccggccacgcgctcccaccgccgtccgatctacccaaccccgccgcacgcgtggctgccacatggccgccacgtgtgcgccgcgtcggcgccacgtgtgcaccacgtggtgcgccgctccttccccggtccgtggacccggtccaccgcggacccccccgagtcactgccatgtggggcccgcatgttggcgctgccctctctctccccgggattttaattattgcgcaataaatcaattaaggatttttctgtttatagtaaaaacacagtgaatcttctaaaattcaattctaattcatccgagctccgtttgagcctattcaagtctcagtaaatcaagaaaaatgcattgaatccattaaaaatggttttgttctctgtttcagtagtcttatagcctgtttgtattatttgctttgtatgtcgcttagattccggctctcccgacgctccgttgtactttgaaatagtcaccgaggttcctccagcagcagagcaaggcaagtcatgcttgtcacttgaacatgttgatcctatattgcaaatgctctaccgttttcccttaaatactgcattgttttataatgatactatgggatgtttacctactgttacagccatgctacttttgtaccatgctcctttgttagcttgggatataacatgactagagattggactagggattgcttagccatgcttagttcaactagcacaccgtgggggaaatcacattaatgcatagtcttcacgttctagtgttggttttggattaaagccaccgtcctggtgttagtcaattaaaatataccatatggtgggctgtgggtgcatggttttgatggtcgcgcccatggcacttaaggaccggttcgcgggaaaccctagaagaattcctcgtacttaccacaagccagcatgggcaacggctgggcttgtagtgtagctttcctctagttgacgcatccaggcaagggtgggcgtga

SEQ ID NO: 13901 - DNA, 1501 bp, Oryza sativa
tggagctggattcggggagtgggaaggggatcttggggtggatggcgtttgagcttaggcatttcttcccctggccgaatcgttgcggtttttggagtcaccatgggaaattggggcgtaattaagcaaggcttttgtggataaatgattttaatctagtaattttgagctatattcctctgcaagttttggagctcactcctatgtttttttaaaaaaagaaaaattaccctgtatttttcctggtgatctcctcctccgtcccgtactgcaattaactatgcttggatgattagatccttactgcgtgtaatttctcgtccaggagcttaggccggatcctgggatccgtaggagaaaccttgctcgggttccggagaatgtgaccggagcaaccgcggcttcaaatcagaaaaggctacagcaggggagcaacaggggcggtggtggcgcgcggcagcagcagcaccaggccggccaatggcgcagttgccatcaatgctgccgcgccggcggttggctcggcgccggcggaggtggccagattccactcccaaccaccacaacaggatagggtatatggctctatatgctctgtgttctttctcatggaataacttattatgctttaacttcaatcttttgtgttgcttttttggtacgtggattagtacgtgcaattgctaggccttggcgaccttagatgggcacagacctttttcgtagtactgagtacgaactgtactggcctggtggtggttgcaactttgcaattggggcatctgtaccccccaaataatttttctacccccaaataattagggtttagtatgcattaactacttgctttattatgtgaacaatttgtttaattagcctttactttatgttagttggtgttgaattgcatgcactttgcaagtttccttcgctctgtaatctttgcctagaccccacaacattttctctgaatagcatcgtatggaccgttttgtcaacctcttttttcacatatactatagacatagctcatggatcttgccttagatatgcatagagttgaaattgggagttgggagcaaaatatcttttctctttggctgtattggatgatacaagtataaactcactgtagcattctatgttatttggtcgtttgaggacaaattgaggttcctgccaattacatggtatgatgaaaacattgtctaacttttgttaaccacacacttttatgcttatttgttgttacatcaagttcactgtaagtgttgtttccatggttaagaattagctagtaatattctttgtctatacagatcataaaaagtggagaaaagttaaattgcttttgaaattatagccttcacacagattagcacgctatttcttaactcttattcattactgaagttgactttagtatcttcataaaaatcaaactggatgacttttatttctgtttcttgcaacaactaataattttagatgttctaataca

SEQ ID NO: 13902 - DNA, 1501 bp, Oryza sativa
acgaaacccagttcctctcaggcataccatagaagaagcaaagtgcatcatccaaactcctgcatttgccatacatgtccaccaaagcactcccagtccggacatcgatctctaaccctgtctttactgccaatgcatggacttgaacgccaagtgacagctcttccaaagcgctgcacgacttgagcagaacagcaaacgtcgtccggtcaggggaaacacctcggcgagccatctccacgaatagatcaacagactcctgaaacatgccgcgctggcagtaaccggagacgagcgcgttccacgacaccacgtcagggtccggcatcccgtcgaagagcgcgaccgcggtggagatgtcccccgcgtgcgagtacgcggtgagcatggtgttccaggagacggtgtcccggcggggcatcgcgtcgaacaccctccgtgcgcacgcggcgcccgcgcagcgcgcgtacatctggaggaggcagttggagacgaaggcagtggggacgaacccggacacgaccatccgcgcgtgagcggcgcggccggcggcgagcgcctcccgtcctgcctgggcgcagctctggaagacgcgggagaacgtgaccctggcgggagccacaggaggcggctgctgctgctctgctggcatccgggcatgctcggcgagagcgcgacgcggggggtggaggccatgcggtggcggcggcgtagggcgaggcgagcggtggaggagcggccaccttcactgccgctgccgcgctgcgcatttgcccatttgcgcggcggaggcggtggccgccgacgaggcgacgattcgacggggaatttggtggtcaaactacatgggctaattgggctctcatacgcgtgcttaggaataagttcatctcaggtcccttaacttgtcaacgaatccgatttcgtccttcaaccgcaaaacagatacaacgggtccctcaactatcaaaaccggtgcaaattagatccctcgacggtttcgatggtggttttggctgacgtggcgtctacatggctaattttgacttggtcttgatctgacgtggcaatgatgtggcgcttacgtggcaattgaatccagaaaataataaccccgtgggacccatatgtcagtttcacacacaataataataatagtaatggtgggacccatgtgggccccacatgtcagtctaactcaccccctcctcttctgcttcctctctctccttctcccctctcttcatctctctcttgccctgggtcattctgaggtggtgtttggatccatagacttaactttagtccatgtatttagacactaatttagagtattaaatatagactacttacaaaactaatcatataaatgaaagctaattcgcgagataattttttaagcctaattaatccataattagagaatgtttactgtagcatcacataggctaatcatggattaattagactcaatagattcgtctcgcgaattagtccaaga

SEQ ID NO: 13903 - DNA, 1501 bp, Oryza sativa
cgtcgaacaccctccgtgcgcacgcggcgcccgcgcagcgcgcgtacatctggaggaggcagttggagacgaaggcagtggggacgaacccggacacgaccatccgcgcgtgagcggcgcggccggcggcgagcgcctcccgtcctgcctgggcgcagctctggaagacgcgggagaacgtgaccctggcgggagccacaggaggcggctgctgctgctctgctggcatccgggcatgctcggcgagagcgcgacgcggggggtggaggccatgcggtggcggcggcgtagggcgaggcgagcggtggaggagcggccaccttcactgccgctgccgcgctgcgcatttgcccatttgcgcggcggaggcggtggccgccgacgaggcgacgattcgacggggaatttggtggtcaaactacatgggctaattgggctctcatacgcgtgcttaggaataagttcatctcaggtcccttaacttgtcaacgaatccgatttcgtccttcaaccgcaaaacagatacaacgggtccctcaactatcaaaaccggtgcaaattagatccctcgacggtttcgatggtggttttggctgacgtggcgtctacatggctaattttgacttggtcttgatctgacgtggcaatgatgtggcgcttacgtggcaattgaatccagaaaataataaccccgtgggacccatatgtcagtttcacacacaataataataatagtaatggtgggacccatgtgggccccacatgtcagtctaactcaccccctcctcttctgcttcctctctctccttctcccctctcttcatctctctcttgccctgggtcattctgaggtggtgtttggatccatagacttaactttagtccatgtatttagacactaatttagagtattaaatatagactacttacaaaactaatcatataaatgaaagctaattcgcgagataattttttaagcctaattaatccataattagagaatgtttactgtagcatcacataggctaatcatggattaattagactcaatagattcgtctcgcgaattagtccaagattatggatgggttttattaatagtctacgtttaatatttataattagtgtccaaacatccgatgtgatagggacttaaaagttttagtcccatctaaacatggtctgattctcctcttccccatcttctctgtcttcatctctcttccctctcctctctctcttctctccagttgacgggcggcggggagagggcggtggccggcggggagaaggggcgcgacgcggcggctggcgggagggaaactagtggggagaagggaaccagcccggcggcagaggcagcgccgccgtggccgtggctgcggacgacgtcgatgccgacctctgcatcctcgaaggcggccgtccgcgtgggcggatgagggggccacctcgccggcgggagaggggagaggcggctggccgcgaagacgaccccagc

SEQ ID NO: 13904 - DNA, 1501 bp, Oryza sativa
caaaggtagaagcaatagcaactagtactagctgactggagtatattttgcttcgtcatcatcatttgcttgtggtacgacgggattgatgaatgaatgaatgatcattgttttgggcaagaaaacaccgttccggccggactgacgaggaacccatcgatccgctcgccgtggcccatggaaacccaacaggagatggcggcgctaccttccgccgacggcggctaacaacggtgggtgatgctcgagcacattgaagaactcgaggtcgacgatgaggactccaactacaacttctgctctgccgctgccgacgacaccgccaataccgtgagtccatgatgaccttgctcacctctgacggccacgtcgtcagcgtatacttccgcctcgaagcgcccccggcgacgtcacgcctatgcccccggcacgctgctccctcctctcccaccggtgggaaggagctaggcgagctccctggcctaccggcgagcgcgcacaagagagagatggccggcgaccactcttctccatttccgccgccgtcgtcgactcgtcgtcgccggccgcaagagagagatgaagagaggggagaaggagaaagaggaagcagaagaggagggggtgagttagactgacatggcgggcccacgttggtcccaccattattgttattttttttgtgaaactgacatgtgggtcccacggggtttattattttcccagatcaaattgctaagtaagcgctacatcaatgccacgtcagatcaagaccaagtcaaaaatagccacgtaggcgccacgtcagccaaaaccaccatcgaaaccgccagggaacctaatctgcatcagttttgatagttgagggacccgttgtatctggttttgcggttaaaggacgaaaattggattcgttgacgagttaagggaccttggatgaacttattccgcgtgcttataccgtttcgtttcttgaggcctcgaatggatgggcctcaatctcggcccacccacatatatggtcctaaagtagtaaagtgaccattcaaaagaaattttctgaaagtgatatgcagatgttttctttggggaaaaatatgttctttgacctccttagttgaatgcagcattttttttaatacttcataagatccatcaccaaatttgtgtcaggtgagacattgttaagtccaattggaatataactaagacttttcactgacagatcatgcatgtgattttctcccatgagcttgagtatctgaccaaacactcctacggcttaattagtctccaacatgctagcatcaccagtactaattaattgctaatgctccatggccggctaagtacaaataccaatcacactttcttccaaaggaaaagtacaagacttgatctgaaaacaatatttgtctgctccaggaagacacctacacggctacacgactacacctactgaagaagaacaggagcgagaaaaatcaccaatggctcatgc

SEQ ID NO: 13905 - DNA, 1501 bp, Oryza sativa
attaccttgtggattggaaatggtcttcacaaaagtggcccgagaagggtatatgccatcagcaagatagtaaccaatggtgtatttctttccattcaccataaactccaactctggagctgtccctgatgtaagcctttgaaagagtggtgatctctgtagtacattgatatcattaagaaaacctggtagtccaaagaaggaatgccaaatccacaaatctttagatgcaacagcttcaagaatcatggttggcccatccacatgccctgagtattgtcctttccagcctgttgggcaattcttccacctccaatgcatacagtcaatagaacctagcatccctgggaacccccttggagtgtttatagccaacaaccttgcagtgtgtaggatcgagatgtcgactagaggggggatgaataggcgatttaaaactaaataacacctaatcaaatctaacctaagttgctaggcttggtgagggtgaactctaactaagcaactaaattatgttttgcaaacctagggtgatagtggctcaattatatatctaggaaagtaaatcacgctcctatgtcaatgttttgcaatcctagggtgatatgatctcaagtgtgtctctagaaatgtaaattgcacaaatgtaaatgcgacaatcaaatgagacaatgagacaagagatttttcaccgaggttcgagaactcgccggtttcctactccccgttgaggcaagcccaactccaccgctcaaccacgaagccaccgcacgcccccttcgtcaaggggtgggcaaggcgggagccggcccacggagaggactacccaagcctcgatcactcgggatagttcttccttcactccgaaggtggtgaactccaaaccactcacaaaccggcgccgggcctcctccacaatcttctcggagaggtcaccgggcaactcctccacaagccgtctaggaggcggcaacctccaagagtaacaagcaatgacccggtgtggagatgatcaagtgccacactagatctacaatggaagcaaatgcacttgactcttggctaaacaaccctctaacacactagatggatgaacacaaagctcaagtgagtgtgagagaggtgcaaggagtgtatgcaattgaattgggtgccaagagagcccccttgctgctggtgggggagtatttatactcccacccaccaaaactagccgttgggggcgaaatcccccaactttgtgctctaccggtatgaccggaggtatgtggccggtcagaccgtgctactctgcaacggctagaaaactagccgttgtagccctgtcagagggccccatcggcctagccggtcagaccggcatggggcggccggtcagaccggcctcggctcggtcagaccaccatcagctcggtctgaccgactacggctccgtcggctccgtatcggccatcccgagcagcatcatctcggcctccagggggccggtctgaccgggaaa

SEQ ID NO: 13906 - DNA, 1501 bp, Oryza sativa
tttttttttcaattaatttaattgattaaatgaactttgtgatgttaaaattacttctcgagctccgaaaattcacggaaaaaatctagagagaatattaggacacaaagagtattacaaaaatatttccggccatgattttttaaaggaaattttttatttcctcaatatttcacttgattaaattgctttaccatttaatataaattctagaaatgatttatttattgatttttaatcccgaacgaaaatcggggcattacacgtacccgacaataaaattactgaatgaggtacgtggcttgttttacatattcctgacaattgagaaattttgacgtgggaccaaaaccatatgaaattagactccataagctttctagcaagtactcatgggtcccgagaatccttctagatcaagggctatgttcgtttgaaatggatcttgtcaaaaggcccgaatttgaatctaaaacatggggaacttcacctcttgtcttctatggatcaaaagtgacgcggtaacatgtgaatagacttgggaaaggcaaccggttggtccccaataaacttcattgatcatccaagtgctatgtatgcctgctccacttttcttcacccatgcaagtatttctacaaacaagaagacacataactcatggtgcagtaactttgttcaaatatataacactaaatcctacataacaagcaagcaccttttgttgatgaatacaaaaggtagacatggtcatatttgagctagtgatgtcctcgtcaacaatcctagcagaaagggttgatgacaccattagatggtgatggaagaacaatgcaaagtatagtgcaaagtcagcatacatagcacaattcaatgggaggatagatccagtggccacaaaactaatatggaaagcatgggtacttttataatgcaaaattttgaatagctccaactacaaaataagatatagacggcagaccggctgcaaatctagcaatggcccaataattacttttgctagcaacctcgaaataacacatcatctgttcaaggaccgcaccttcgtatgccaaatatgggagaaaagcatgcaaagactgaggtgtgatcaatgttccaagcacacacaacattgagaaaaaccttgttgaaccgatggatcaaaggggcattccaagttatttgctagtacaaggacttaagaagtgagcatatagttacaacaacttacaaggtgggtatgattttgctacaataacttgaagcgttgtaacaacttaattatttcaagcatttttttctgtattcattttgtcagggttatagataccacatacctaatagtagttgactaaatctcggcaagacccaccacataccatgtcttatatggaaacaactgtcggatataggaggacttccgcataaggaatgatgaatagagttctatatggaagcgataagtactactcggattgtatccatattggtttccctagt

SEQ ID NO: 13907 - DNA, 1501 bp, Oryza sativa
ccactgtacctaaatatagccatatctcgagagaaactttggaggtcaattggctacgtggctgtgcccaataagtgcctaactgtgcagtcactgttgcactagtcagaattgtgtatggtatccattagttagagttgttctaaattaaggccgagtttagtttcaaattatttctttaaatttctaactttttcatcacattaaaattttcctatacacacaaacttctaatttttctatcacatcgttccaatttcaaccaaactttctaatttttgtgtgaactaagcacaccctaggaagggaacgatgggctagaaagttcaaacatcagacagcctaaacagcaaaacgttttccgactttctgtggtggccatccattgacggccgggcagggcaggcaatagttttggtgaagatgtgaagctgctaaggatgttaggattgttgcgtccttgcgtgcacattgctttaattcctagtaagaacggttacgcgtgtaaccctgtatgatccgtcaatagtaagttaggagcgctaagcaacggcgtataagtataaccatcggcctaaacaagctagtgtcccaatcacattgttacaaccagccctaatacagcatgatttaatttaatctccgtgctgccacccccaatccaagtattctatcgccaccaccaaatgcactatgaaaagcgcacacatggttgttcttggaatagggatgaaaacggatcggatacggttggaaactaactttatcatattcattatcatattttttttctcggaatcgaaatcggaatcggaaacccggatacgaaaacggaatcgaatattatcaaatacagagcgaatacgaatcgaaacgaatacggtaacgaatattaatcggaacataaaagccccttaaactgaccttcacaaatcaacgaagaaatataacttcttgtttttttctaatatagcatgttatatttgtaaagatcaacaattaataataccataacgagaaacatccacaaacttgcacatcccgacaaagtcacactgtcacacgtattaccggttacaaacttgcaaatgatgacagtcacacgcattaacgccttggacggtcttaaccaccacctaatccacttaaggtagctaaattattcgtcatcaagaccttcctattgatgccatcaccgcgtccagttgcccaacatgtggcgtctcaggcacggacacgtactgaagtctcgggtcccaccttgccaacctctcccccgtgatcgtgtctttccataccctgcgcgacgcgacgcgacgctgtcgccaccgtcaccgaccgcgcgcgcacgcacgcacactccgtgtccaaactttcctcgaactcctccccgccgcataaatccccttcgcctccccgccgcgccccgcggcgtcgcacgatctcactgaggcataaagtgagagaccgtgattggatcgatcaccggagcgacgatcaa

SEQ ID NO: 13908 - DNA, 599 bp, Oryza sativa
ctgccttgaattgtgtggataaatacaggagtactactatttcaatatatcagttgcacgttgttggtatccagtagcttttgattgtctgtgagtcaaacaaatggttcggaaaatcagacagttcaaggaaagcgtgtgctcttatgaataatagtacagtccttaacccgtgcgattgtgcgaacccgtggattcacatatgggcttttcttgatctactagttcataacccgtgcgattgtgcgaacccgtggattcacatatgggcttttcttgatctactttgcatctgaatctattttatactaaaagtccattaaactttttataaacactcctaagctgccacgtggcatatctagaaacgctcttacaccgccatgttgcactctaataaattatagaaattctaagaaaaaaaagtaaagcatctaaccatcgatttcatttaatctggtgaacccattattttcaaccattagatttatgtaaaaatttcccattaagtacgtggataggtattaaaaaaaaccaaacgtacgtacgtactccggttgcacatctatttttttttctttttctctttcctatttaga

SEQ ID NO: 13909 - DNA, 1501 bp, Oryza sativa
tccgactccttctactctactctcttcctattctagtatacaatatagtacaatagaacctcttataattcagctcaagcttggaagtgtgtgtgagagtgaatgaagtgaggtccttttatagggcagttatgacggttgtaagaaggggaaatctccgaactgccccgcaaccgtcattgggagaacatcaggagcgtccacgccaaaccccaggatcaacggtgatcagggggtttcggccgaacctgggctgggccctcctggcctggccttcggtcggtgaattccctagaccttcttctatccatttcgcggagttttgggttgatccactggtgtttcaatgaagttcacaacccctccttgtatggatacataattttcctcactttagtctgaatttcctcccaacttcagggtttatcatctgcatacaactatacaccaacacttgtggaacatgtgagattaagcacctatcactatgttgaatgttttattatctaaactttatgcagatgttggcggtatagaatcggcatttaacagccgccaacacatgagcagaagttggatgtatggaagtgatcgaatgggcccaaaatttagtactagcattgccaatttcataaatgctgcatagcaagagaagaacaaaaggaacagtcaatacttgacttgtgacatggacattccggtccaaaattttcttttcatttctttcttcccctctaggttcaccaactttttttggtatgtttttattttcacacgaacaagatagaatgagagatgaaaaacagggagaaaaagagataaagaaaatgactcaacgcccatgtggcattccacgtaagcgccacgtaggatcctggagggtcgtggtaatttgggaccagaataacacactttgctaagatcggggacctaaaaatgtatttgagaattcagagacctggatgacacataagagcaagtctagtgatcggcaatatacttctctcttttttttcctttaagcatggtgtattttgaattgtttttcatgcactaatagtgcaaaaacaccaataaatcctgaaaaacaccagggagaactccaagatggttttcaaatttccaagacaattatatttctagaattcaaaattttcaggtacaatgtggagaaataactagtacaatctgaatgcatcgactgcgcttgagtagtacggctatcaagtaggaagatgttacttgttcaccttgacaaatatgagaatctaaagctagagcacgcagccaggttgacaaataggccttatagtgataaagttgacatgtgccattaattataggataacacaggtgcatcttgggtaggtatttccataaagaaattaacaatctagtaaatggcacaacagtatggtagtggcatccatataagttgcatgtgtccttgagtcgaatggccaaagccacctgcatcagtatccaattaatatggaactcg

SEQ ID NO: 13910 - DNA, 1485 bp, Oryza sativa
cgggctacagatctgtagccagctgcagcgcggactccaaaacgcaatgtgtgtatgacaggtgagaccatatattagtagtatagtaagcaactatggtatgaattggctattagattggctataaatgaattggaatactattaaacttgctctaaaagcaagtacagggtataaatcagctacaaacatattttaaggagataaaaagaggaagagaagagctgcggactatagatttgtagctagcttcagcacggactccaatatacatgtgtgcatgacatgtgggaccagataataggcaattgtatgaattggctattaaattaactaggaaggtagcccgcgcattcgcgcgggcacgtaaaataggatacgcttgactaacttgtaaggtggaatatctaccggatgacacctgtcacgcttgaaaagtttaatttcttcataaattttctccatctacattgcttagataatttttacaatatttttgtaagatttgaactatataatatttaattcattactacaagcaattgtcaataattcttcattttctggaaagaacgtgtcaataaatacataggagatatacatattgtatacctcgcttccctattatatatgtgatctatagcgttttctaaaaaaaatatctagccaatatgagtcctaaatttaaagttaatagtagcaatgcataactttttaaccacaactacgtacttctacgcactgctaccttaatgtgtcttgtatatgcaataatacattgagaaactcgtaatgccatggtgtaggatggatggaaggccattaacatctaagcacttaaagatggttatggcaatcgaacattgtacaatggttatccagtttttgaaaagtaataactatttgttttacaaattttttatattttgtccaattgatttaattcaatccctattgacatttttctacttatgaatacagacattttaggttaaaaatacagacattatggatcatgtatttttggtttgattatttaaaagagcaacaattaaattaaaaattagatttatagcttaagaatacgatctttgcaattattattaatagtttgtgttttagtttgatagcttaaattagaaggggggagtagtggagagtggagagtgtgagccaagggggaagggggcgttcagtgttgtgtgaatgcatgttctgggaagggcgatgcattggggactttatttttctaaataatttaactaaaaccaatgatcatatgttttgcttttttcttatagtttctaagatttttctaattttgaagacgtgacacatagcggcttaagattttttctaaaggaagacctaatggttgaaaataatgaatccactgacttaagtgaaaacccattgtcaaatgtttttttcccttggaattttttttgttctaatttttagtacttgacacgtggtgagttaaga

SEQ ID NO: 13911 - DNA, 1061 bp, Oryza sativa
catcccattctaggttgcaatattatgggatggagggagtagctagctagctcatctgttcctacacgtacccaagtgataaattttgaaaggaatacagtaatacagtactagccagacgtgggagatcgcagcaggtaacatgcattgtgcgtgtatatatgtacagggagctcgccgtaagcccacgttgttaatagtcgtgcacatgccttattactttccaattaattcaatgttatctccacctacttactgtcaagtgccatcaatatctgaccgcgttgtgtacgtgcatacgtatatatatgcaggtcttaattagttcatttttactacgtgcgtgcctgctaaatatatgtacatatatacataaacacagatatatccagcttacatacggtcttgacaaaaatacatcatgcacggtccacggaacaccacatctaccggttagccaaaaagaccagcccccttgctctctcgatcgatgaaagatctttaagctggttcagttgtctcctcgatcactatttccatctcctctctaaacaaccttattctttcaccgatggacaccagcctctcccttttgtcttcgttgttagaataggtgtcgaatatactagtcctatttagttacagttggacttggagttgtaataggtgttagggggtggagttagagtcggactctgtaacccgtcatctctcttaaatagagaggggggcaccacaatgtaagaatggcgactacaatgtagcatagacacgcagggagaggatggcggcgtagccatggactcgtagcggctaggagctatattggttggggaggagcgcccataatcagagccccggggatgtaggattcggctgaacctcgttaacaaatatcatgtgttcctgtgtcgtcatctggcatgtcttgggtcatcaatgactgaagcgatcgggagggttagtcgtctttccactatatcgactaacttttataacattcgtacctacctctcattcgcactcgcacgcctctccatttcatctctaacatatatagg

SEQ ID NO: 13912 - DNA, 206 bp, Oryza sativa
gcccccctctccagtacgcgactccggcgacgcggcgaccggtgggtcgtcggcggcggcggcggcggttgggggggttggggttggtgcgagtggggaagaggggaagaagagcggatgacgataggagaggaggttgggttgggttgggtggtgatggtggggtggcgagtccactgcttttggcctgcttttgtggtcgcagg

SEQ ID NO: 13913 - DNA, 1501 bp, Oryza sativa
gtgctcctagtcctcccagctcctgccattctttgctgcagccgatagcgatgacgatctagtgctaattggggttggaatggaagggtttatgtgctgatggactgctactctgctagtgggagtttggttggcgtttacactgcggcgacctcactgacaaagtcacgcacaccctagcgaagtctatgaaaatggcgccttgccacggtgcgtagctagtggaggatcgcacgcgcgcgcgcgcgcgcggggcatggcaaattggcaatgtattgattggaaaatctttggcagatggatgcatgcattggggatgagccggggacggcgagcgtataaactacagcgaagtggcgggcgtgcgtgcggtggcagcggcggtgcgcctggaatgatgaggccgcggcgctagctttgtggaatgtggatgtgggttgattttagcccatcttttcaaaaagctttcgattgggatcggccactgattgactgaccttctcctctctttcacattgtttttttttctcctgcagccctgaaacccagtttgatggttcctctgttttttttccctgcagcacaaaactttttttttatttttctgcagaacaaaacgggcatggttaattgtgcaggtagttatagaaaaactaaatatactcacagcatgacacgtagtgttagcaagaatttaataaaacaaaataagaatttaataaaacaaaatttaacacgtatagattttttcttatattaactggcaattggatggttcctctctttctatttttctgcaaacgggcagtgttagttctatagctacattaaacgagtatatgctcgtctaatccatcgtgacagggctgacgtttggtgacacatcgtgtggtcttttggaaagcttttttttttttgcatgagagaaaaaaaaaaaagccgtgcgcgcacattggcacgagaagtggaatccaaagaccttttcaagccatgcccgggacccaaatgcggtgcacgccaaacgcggctggagtggagtggctgcttacgctgcctcgtcgaatcgcttacatcacattcagattcagacattcgccaacagatcacgcagtaagcgttgcgagatgcacttctatattgatgctgaaaatactatacatgagaaacaaatgcgcccgtgaaacgcctttgttctccctattgagagagagagagcaaagggcagtcatacatgtacactagatatatactctgcaataaagcttgcgaaagtgcatgtaacctaatggttgcagtgacctgagtagtattttatggtcctgagtccatatctctataaaagcgaatttcagattaagttgcttgagggcttggttggatgtataggctgggtaaaaaataccattctctaaaaagaaactctaaagtagtcctgctatttggcgctgaaacaggcgatcgagatcccagtggggacggcggtgtggccggcgcaggagtt

SEQ ID NO: 13914 - DNA, 1501 bp, Oryza sativa
caatcgatgaacttaggaataagttttgtttttttttaataattgagggccttatccggaggagagaaacagataagcctccctgtctcgctaatcacgcagccgtggcgatcggatccgatccactcgcgggaaacccacttgcagcagctcggtggcatggttggtcacggggtggcctcagcgagactgtcaggtgggcccggcgcatcctcccgttagctggggatggcggtgacacgtccggacgacggggacgacacgtggagggtgtggatcgattgatagtttgcggaaagtgtggacttgtacgcacgaacccatgtggcgaccctacccgactttgccggttttgatatccacaaaattatccgcagaccgaaactagcgacgactgatcaacggctcctactcctttttgcagttttgcccgcgggaagattgtgtattagacttagatgcctgtcccttggtgattacagaaggtttactttctgttttgttttgaaaggtactccctgcgttccagaaaaatgaatctggacatagagtatgtacagattcattatattagaatgtgttacgtcgtggtacgaggttaggttttttttgggacggaggaagtatacaaggtttactcgtgtgacatttgtgttgttgtgtgttcgaggatggctgaaacgatgagagttttgaccctcggaatgcatgagagatatttgaataaacacatttctaatctaccatagtgccatataaagaacttttcctcacaacaactacgagccaattcatttatttttttttctatttactaacttgaaaaaataactcattgctaacttttgaatatttaaacatactatatcgatcactgtatcagttaattacttcttctgtctaaaataacttttaatcataggagcactaaattaaaatgaaacaaaaagacaaaaaagtacatcttattaatggagatgtagtattggtgaatggttggatatgtaagagatatggaagaataaaatttgtcaatttatggactgagatagactaagagaaatcttttatgaaacagaaaggtctggcaagaccttccccttttctcatattaaaaaagcatgttaacttatttatgaacaatggcatatgatagaaatgaagttagatgaaaggaatgctcattccgtcccagaaaaaaccaacatcgtatcaagatatgacatagtgtagtacaataaatttggacatattctttttttatggaggaagtatatcttttgctttaattgtagtacgatcatttaattaacagcccaagtcgtaaaaaataatgaaccaacaaataaacaaccgggaagccaccaacggtcacgccggtttacacgtggggcggccaaagagagtaaaaagagactgactcctacccgccaaatacaaacttctgggaggccctttgtcctaaaaccgacaaagaccaaagcggacacggaaaaaaaaa

SEQ ID NO: 13915 - DNA, 1501 bp, Oryza sativa
caccaggatggtacggcggagctcctcggcgcgggcgctaggccgccgccggcggcaaggagggggccgtggcggggttgttggggagccggcggcggagagcacgacggcgagcatcttgaacccacgctggagcgccaccatcgttgtcgaggtcgctagccgctgtcgccgtcgtctgcaccgtcgccagtcgtcctcgaggttgccgttgccgtcgtctggatccggcggcgaccgacctccgttgcctttgtccccaccggcgcgacgtggattcacgcggcctccgccgtcttgccgtcgccgccttgccattcgccgccgccaccatccccatccactgcggtagccgtcgtcgtttccatttgccagtgttgaggaagaggagagggagaaaatctagaggaagaggggaagaaagaggaaggagggataatagagactgacatatggatcccaatgtcataggctcagaatagagagtttagatggagaggttgttatagtcaacaatgagtttgaccgaccaaatcaattggttaactggctatatgggtatttagagagtctattttaattagtctgaagatgctctaacaaaattagaattttccaaacagacagacagcaaggcgaatcacatgagttccgcgagttcgtgcgtaacgtgtagagcgcgccttgacatctgtgttttcccctctgacgttcgtgcagataatcccgtgacgtgcggagcggagtatggcgtagcatctcggtgtgctccgcgcgctgcagccgtttcctccccgtcggatccgcccgcgccgtcgccgatgccgctgcctcctgcgcccggttgcctctgcggtttcccttctcttcagccctcgccacggtacgagacgtgacgtgcggagtagtacgtttacacgggcgtccgatcggtttattagacggatggtcttgcgagttgcgaccgttttgggcggtttgggccgtcgtgtctcgcggtggcccaagtcggcctgcgtaggtttcccattttgcatttcttttcttttctcggcgtggtgaaaaatctgatgttagttctgattttgcctgtcgttgtgcttgtgcagctccgtgctccgacgtacaacgcgcagcctccggaacctggtactactgcagttgacgcgcattgccttgctgaaaagaaagtggccctcagagagaatctggctggttaatgttgtgcagctccagtgctcccattatcgccaactcctgcgccggccacaccgccgtccccactgggatctcgatcgcctgtttcagcgccaaatagcaggactactttagagtttctttttagagaatggtattttttacccagcctatacatccaaccaagccctcaagcaacttaatctgaaattcgcttttatagagatatggactcaggaccataaaatactactcaggtcactgcaaccattaggttacatgcactttcgcaagctttattgca

SEQ ID NO: 13916 - DNA, 1501 bp, Oryza sativa
gctggaattctgcgtgaaacccattccagcgatccagttcatgaagcttccccttgcgagtcgtcgcggtggcgagcgggtggcggtggtgacatggatggccagcaggaggagcagcacgcggggcggcggcagctggagcccgggaaagacgaaaatatccctatgcaaataattttttatggacaaaaatatccctctacaattctactatcattaagtgtgatggtagtagaaatagatctgaaccctatgatcaaatgagatcaacggttcagattattttctactacaagtagaaggcaccggagtggatctcaatcagttaagacttttaagttgccaaatcagttaagacttctgagttaggcagggcgcgcctcggtagttctgttctgtacacgccgagtcgctggaatttttttcatttttaaatttttactttttaatatttacagaaatattgtaccatccaaaatatttacagaaatggcccctgccgctcaagtggagggcgtcaaggtgtgcgcatgttgcactgagatcccttgccgccctctacaagggttgcaagggggcaaatgtaatttcgctatgctaaaaatgtatttttctagtttttttttcatcttatgcgtccctcacgtcaccctgccgccctccccgagggctgcagggtctacttctgtaaatattttcaccggtacaatatttctgtaaatattaaaaaaataaaaatttaaaaatgaaaaaaattcgagtcgctgaccgtctcgtactttcgctcggcctgtttgacatccactggcattctacacgggctcattttccggcccagctaggacggtgcgtttggacgggcccggcttagagttttgggctggcccgtttggcccgcacgagttgtggtccgttttggcacgagggttttgagtttattttctttttcatggtatatatatcttgctggctgaaaaatatgtgctggggtcagccatcggaagaaaagatcaacttggtcgagtaggctgctgcgattgtagtacacgcaagcagcatctctggaaacgaagaaactgtcgtcttacggcggttacagctgaaaaccaactgtttttgaaagaaattcatgagaattcaaacatgaacatgtaacgtttcgtatggttcatagatagagtcaacgcccggactccccaaggttgaacgtattctcactctattacatcgacctaccaactcttttttttattataaaaaaaacaaaaacaaaagcttcgaaacgcaaaagtcgcctctttccttctccgttcaaagcaagcccacctcgttcctcctcctttacaccttcctcttttccatcatctgcacgcgttcgtccaaactccgaaacaagaaagctcaaactcgatttcgaaattttcgaagccccaattctctcctcccacacgcggaatcgatcagcgcagcgcagggtaggctaggcgtcggcgtgctgtga

SEQ ID NO: 13917 - DNA, 1501 bp, Oryza sativa
cggggtggccgtcgttgtcgtggcggagaaggactcgggggcgccggaatcgtcgtgcgttatgtggtggggacggcgtgtggcgtgcgcggcgggatggcggcgcgcgcgtgccgccgccgccgcgctcccgctgcccaggaggtggcacgtacagcagcaggcgaccctggttatcgatcgatgcatgcatggctgcgagcgtgtcgacgtccgtgacgtgcaccagcgccgccgccatgcgcacgtcgtgcgtccatacctctgacgccacgatgtttcacttgagggggctcgcctgtcggaggtgttcgccacgctcatcgacctcaagtgcaacatcgtccttgctgatcagctcgatggccatttgcgtcgcctctgcctccaccccacctccaccctgaccgaccgttccggcacccgaaaactcagcgacccagctcccagcaattcgcctctgctgctacctaggaagagaggtatatgcaacccatatgtaggacccactgcccatgttttgctgcatttcacctacatatgggacccatgcgccgactcagcgaatctaaccacggtctacctgccatgtcagcccaaaccgattctcaaccaaattgatttgagtcggtttttgtagttgggagaggcgttacccgattgagggatgcaattcgatcgagggtaagacaggagggagacaatatagacttattccttaaactcggcctacaattggacgaacgtaaagtggacctttttttttctttggaataagttcaccggaggtccctcaacttaacagcgagattttttaagatcctttaaccacaaaaccagaaataggggtgggcaaaattagaccgaaccaaagaaccgaaccgaaaagaccgagaccgagactgaaaaattcgggtagttgttcggtccctaacatcaaaagaccgaatttatttcgggtatttcagttattgggctcgattaaccgaaatacccaaaataaccgaactggcccaatagactaggaggcccagtaggccagtactaagcccactaaaataaaccctagatcaccaaccctacccccagcctcccacttggctcggttccctcaccctcacagccgcactccccactcctcccgctcgcgccgcccgccttcgcctccaccgcgcctgcgccgcctccgcctccaccgcgccggcggccggcgccgcctccatccgccctcggcccactgcgtcggcgccggcgccgccctcggcccaccgcgtcggcgtcgcctccgcccgccctccgcctccctcgcgccgtctccacctccaccgcgccggcgcgtccttcaccgcctagctcgatttgcttttcagtttgtctttctgaatctgcttgatttcctagttgcatgtgcagatcagcagatgcatcatctatctattgagttgccttttgatttgtcaaccatacatttgttgtttggcttttgtgatttttttgttca

SEQ ID NO: 13918 - DNA, 823 bp, Oryza sativa
ctagtggcatagcaatcagtctatattagccacccgtgggcagagcatagctaagaaaatttggttttgtataggcacgtgtttggtttattaccaactcctgggcatctgaggcttagtattttcagataattcatcatatggttgaaacagattatttgctttacatttttttttaaaaaaactacagtttcttaaaaagaaatttcactgtattgctcagtttattagttttaaactatttttaagtttgtttattacaaatattttatttatctttataattaaataggtagtctagagcaataattcgatcaataatctgttgtaaaatgagtcatagggtagaaccagttaccagtccaaacccatgccttgggctggtctaaaaatctacattttctttgcatctttttgtgggattttaaggtaacccctatgttgaagcctttattagaccactggtccatttgtcatataggagtatactacaacttttggtcaaaacttacttgttgtcaaggcaattctttttctgtgccccaaataagcagattctttatagatttttcaaaatataaatattctagaaaatccataatacagtttattgcggttagaccactataatgaaaaacaattatggttaacagacaatatgcgactcatacaagatttttcatttgcttaactgtatcatgatcgcacaaacaaactctttctgacactgtcataagcagtctgttttttttttgagggaataagcagttactttgtgttcttactgataatctgatactgtgatctgatccgacagactaga

SEQ ID NO: 13919 - DNA, 1501 bp, Oryza sativa
tacatcagtgccacgtcaacgccacgtgggacgaagaccaattcaacaacgccacgtcagcaaaaccgcccttgaaaccgctgagggagtctatttgtaccggttttagtaattggaagagtcatcctaaccggttttctggttgaggggtacgaattagattcggtatacatttaagggagtcaaagtggactttttccaacttattttactaacttgttacggcggcatatgctcggcccaatcctacgcacgcgtccatctgtgcaaggcaaaagtctacttctgaatcctcttaactatatgtccagttcccttcgcatgcctcactgcaaaaccggttataatgcatcctccaacttctaaaactagtacaattcaagtcctccagaagttttgattgacttagcacctacatggtaatggtatgttgatccgatctttatctgccgtgagttgtgacagctatgtggcacttatttacgatggccccagatgtcacatggtggttttcgcagctcaagctcgttgggcgccaccgtcgttgactcctcgcttcttgttgggtgaccaaagaagcgcgcgcgccgggcggtcagagtcagggagcaccgtgacgtcggaatcggccgacggtgggagaatgttggagagtgcgaggatgcggtacctcgcctgcgagactgagtatcataatcgaaggggaatctagtccgcgtcacgccattgattcataaatcattactactggagtgaaattagtactcccttcccccctcctcgagctccctggcataccggcgagcgtgtgcaagagagagatggccggcaaccgctcttctccatctccgccgccgtcgtcgtcgccggccgcgtctggtcccccccccccccccccgagcgcaagagagagatgaagaaaggggagatggggagagaggaggaagaagaggggtgagtagactgacttgtggggcccacgtgggtcccaccatttttttttattgtgtgtgtgaaaatgatatggggtcccatgtgttttatttttttttctggatcgaattgccacataaacgccacgtcaatgccacatcaaatgaagaccgagtcaaactagccacatagatgccatgtctgccaaaaccgcaatctaaaccaccgaggaattttgtgtgcaccggttttgatagttgagggacatgttatatatggttttccggttgaaggacgaaaatcggattcgttgagatctcagttgaacttattccaatcaaggatcacgcattcacgttcacgcccacgatcgtaacagcgatgggcatatatcggccagtccataattccgatacgcaggccttaggcggcctggaatgtggcaggccgacaatcggccctgtttgggctgtgaaattatcagagagggacgagcctatttgggccgcgtgttctgacggcccaacgtgaaagaggagcctgaccataacacggtggaacactggaa

SEQ ID NO: 13920 - DNA, 1501 bp, Oryza sativa
gaatttgtgcgctcttatccttgtacacactagccatcatcaagacaagagaaaagaaacacccaggagaaaagctaaacctgagaattggatgttctctgaacttgttaagaaggattagcagttaagagaagaaccggaataatttgacgtcggaggacaggaggaggaggaacagatgccagcaccaacacactgaaaagagaagatgccctgtgtttttttctttgtcagtgacaaacagtcgctgtggctggaaattgtggttgcagatgaacttgtccataggcctagttagccatttggagagtagactgtacaagcgtagagtattgccatgatcaagcaagaaaagtttttgttcagaccactctcggcgtaaagaactatgagcttgttgaactagttgatggattctccaaattccgtggtaatttttgttgaaatacaagaattttgatgaaacagtccaaaatccgaaccaaaatattctcagttcaaactgttattaaaaataacagctttagtttacaatctttcatgacacatatttattttctccactaccacagaaggaacttttttttttttgcctttcgccactgactcgtgtcaacatctcatttcaccatttgtaacagtttggagtttggaccctacatgtaagcgagagagctgaatggcaaaaacaaagatactaaaaagaactatagatcaccaatcagtgacaaacaaaatttcccagtaattttatctatttgaccatgcatattgtctttagtatatttcttatccttacttgcttcctttctaatgcgggaaaatttgcttttgacttaattgcttataaaaaaattgacatatgtttttttttcttttgatgtagtaactaacaaagggacttcagcaaaatcgattcgttttccattaaattcatctaaatccctcattttctgtgaagtgagcctacctcaactggttaggcttatgatggtggaaccttcccacccgaggtcaagtgctagacttggcacatgtgctcgcgtttattgttaattttttttaatggtaggtgatgtatccgttaacaacgagatgtctatggtgacttcataagtttcaaggtatgccagcccagttttcggaggtacacaaaggggtgtggtggtttcataagtttcaagttatgccagcccagttttcagagtctgtattatgtttccaaaaaagaaaaaaacatctcatttccaaagaggtctacaagtttaaaacaccacaaatagacaaacatctaaatccaatagagaagtagatagaatctattccattccaatgacaccttcctctccaagcttaatagtaacaacaacgccaaaactcaatataaatctccccctggtcacctcctcctcacattctcacgcgtacacgtagtggcagaatagtaccacctcgagaaactcggcaactcgcccgccgccgccgccgccggcggcgagga

SEQ ID NO: 13921 - DNA, 1501 bp, Oryza sativa
tcggtggacggtggtggcacgtactagtacgtatacgtgcacggtgccatcaatcagctgcggtcgatttgtcgagacgacaaaaccccgcagttattacacaagaaattcgcacgccgtcgcggggcccgtttccgcggaggctgatgtagaggcaaaagccgccacgctgcacgtacgtcgccggagcggattaaactagcggagaagaacgaacggccgttgcgccgtacgcgacaaacagcgccggagatgaagatgatgggggaggataggattaggatcgcggcgcgacgaggaggaggaggaggaggaggagggcaagacttgcacgcgtttcgcggaccggatggctgcgcgcaagagtccccgcttttccgtgtgtgtgtgggcgctgatcttggcagtgaactagcgacaactgacaaaggcttctcacgtgttgcagtcttgcaatatgtatgcgtgtccagatctcttgctgcactatactggggctgtgtttagttcagcataaagtttagattttagttggacgatgtgactaaaaagtttggttggataatgtggctgaaaaattgtgtgtatgacaggttgatgtgatggaaaagggctgaagtttggatccaaacttttaatttaaacacagcctagctagcaccgattggggttagcctgaagtactcactcccaccattttaaattactactcccttcgtaccaaattataagtatttttagaagagtgaagttaaactttttaaatttaactattagtagaaaaaagtaaaaaaaatcaatcatataaatttaatgttgctagatttataattaaataaattattataatatataactctttttacttaaaacatattacttttgtagatattatcggttaaagtagtatcgttttatttaaaaatgatcatattttaggacgggtgttttaagtttatcttaagttaaaatatgtttatctttgctcattaatttttaaaaatccgtgttttttaataacttcatctaggagtaaagccacagcgatgcttcagtcagtgtgagcgtcattggctccaaactttcattcattcaatcaatttacagaatggggtccatcaaggtcgtcaaggaattaaaagataagattgggagcacaacaaacaaagttgggcacatcaatagtggaaatgtggaacgtagaaacctccacagaaaactgaggcaaacttacaaattgtgcggcccttcctatcattctgggaatcgcatctgttgcaacttccctccattttcaggccttctgattcaggctgcccccagcttagtttgagaagcaaactgccaataaacacagggtgaaaaactgaatcagtaactgtaaaaattggtaagcctcaggcgctcagttttcttttacctcctcccatcttttatatgccaccggaagacaaagccctttttgtctccagacttcctgctccctctgtgtgtaatgcag

SEQ ID NO: 13922 - DNA, 1501 bp, Oryza sativa
atctaaactttatgctgaactaaacacagccccagtatagtgcagcaagagatctggacacgcatacatattgcaagactgcaacacgtgagaagcctttgtcagttgtcgctagttcactgccaagatcagcgcccacacacacacggaaaagcggggactcttgcgcgcagccatccggtccgcgaaacgcgtgcaagtcttgccctcctcctcctcctcctcctcctcgtcgcgccgcgatcctaatcctatcctcccccatcatcttcatctccggcgctgtttgtcgcgtacggcgcaacggccgttcgttcttctccgctagtttaatccgctccggcgacgtacgtgcagcgtggcggcttttgcctctacatcagcctccgcggaaacgggccccgcgacggcgtgcgaatttcttgtgtaataactgcggggttttgtcgtctcgacaaatcgaccgcagctgattgatggcaccgtgcacgtatacgtactagtacgtgccaccaccgtccaccgacacttgtgatcatacggtacacgacagatttgtttcgacgccctgcggctgcggatcgcgtcgggggcccgacccgatgctacgtgctcagacaccgcatgtgtcacgcggcacgaggcttacgtacacacatatactcgtggagttttcggttacccatatcctctaataataaattatttataaaggtaatttttttaatgtgatctaacgacttaagagctcaatgcttaaaaaaaaatatttaaaaaaatcttaaaataaactttaaatttaagttatctttgattttgatttattagggtagccgattgagctcatgatctcgtggcctagccgcctagctctcgatccatgcctcaagctccctctcatcttgggccaaacagcaccactaaagaaaaggccgattttgttctgaatgggaccattatatgggctcgtgcccaatatttgcctctcactctctgaccgcttgcattactgtggagattatgggtattccatatctacacggcgatggtattcgaactgggtacaggatacctaatgtagatagaatatcttatctgtatctcgggtttgtttcttaacttgtgtatcaaggaaacaccctgagacttagtcggttacgactgtattttacctttatcttcatattccgttaggaatatagattatcttttgtaatccggactccttccaatatataaggggggtccgggcgcctctaggggcatatgctgatttttcccgaatcatacaatcaataatacactcggcggattcatccccggacaggagtagggtattacttcttttataagaaggcctgaacctgtataaatcctttgtctccaaacccatacactttccaagcttgatagccacccccttttattattgccgaaatctagtttcgacagttggcgcgccaggtaggggtagcgtcaagcttttcgccgatcagtgcaa

SEQ ID NO: 13923 - DNA, 1501 bp, Oryza sativa
tttacaggcctagtgcaactaggaagtaagggcctggttgtgggagcttctggcagctgaagattcttctagaagaagctactgccaaaagctctccccccacccctcccaaaaaaaacagttctaattttcacttagtttgagagaaactgtagctgcagaatccaaaaaatgaattaaaagctagaaacaagctagaaactgggtttttcagcttccctatcttctctccagctgtttctcagaatattaaactttacaaacaggacccaaagcagaatagcagatgtacctgaaattgaaatttggtgtccctcttttctgcacttgctgacggttgtctggttgtacgggtgaatgttcatgagccagccacctccgttggcaggcaccactggaacaacactcgctcagctgcctcctactccagcctggatctggatgtgcttgtagcccagcccttttttttttcctcgatgatccctctgtttctctttgctgtcaaactgctggatctgtgcagagaaattaggtaagggaacagatgaatggatagatgatcaggacagatgaatccctgcagaatcgcgacgcgacgcggggcaaaagtgtctcactcgaaacggtaattaacaatcccggagccggaaggcgacgtgcgccgcgggcggtaggggtagggccggcgatcgccgtcggtcgagccacgtacatggggcgccgcgccggccgaggaggcagggcaggagggaaggagggggaaatgtgaaaaggaaaaggcagaggcggcgcgtccgatgctccttccttggccaaaccgcaccaccacacccctctcctcgcgccaagcgcgccacgcccctctcgttttgggcccgaggagggccagggcttttcttagcccgcgcctgttcatgcaggagtgccaggcggcccggcccggtgctatgcagtactcacggatgatcgagtgtttaaactattagggtgcatttgaaggaaaaaaaaaggtgtctttaaaaaatttatagaaaaaatgttttaaaaacatattaatccattattaaaattaaaaataattcatactcaattaaccatgtgttgatgattcatctcctctcaaacacaactctaataagcaaggtgcccgtgagtgcatcttaggcctcattcactttgtaatgccatcgtacgagctagtttgtccaagaaataccattgttgtcgggtttccatctatttttctacgttaaccctatcacattcttacatggaaacacatggtgaaatggatggaaccctgatgatgatggcatttctaagataagtttgttggtgcgatgatattttttggaatagagccattatcagtagtatttgttgtattttctctaaattgaaatgcctatcactgatgttagcactacgtgctgaaaccagggcatgaaatttcgccgccctcccgaaatgctcatatctcgccccgaaactttcagttttt

SEQ ID NO: 13924 - DNA, 1501 bp, Oryza sativa
ctcagaccagcgccgcgagtgcgcgccggaggcaccgcagccggccgtgacgtcgccgtcgacagaggtggccacggtcgcgccaccgactgactcgggctggatcacgacagctgttgagagaatgatgagtttcttcggtggtggccacgcccggcgttcgtcagaggtggcacctacaccagcccatggcaagggcaccacaacgggtcgaacaggcttagcccatggcaaggccggaggcaagggcgccacaacgaatcgaacaggcaaccaagcctggattcaccttcctcaaaagaagcatacccctccagctccaccacaagctccacctcaacctcaggcgcagcgccaacatcgagtggtgaacggggaggaggttccatttgaggtggaagaccagtatattcattactgtagagaatctcgtaccattgttcataaaactatctgtcacatctgcttctttcaagaacaaaacttcactgggagcaacagggtttcaggcagccaggtcagtagtccatgctttggtcttctgttgtgttgtatagtcagcaatgcatgctttgttttattatgctgtgtgtttcttaacaacaattaattaatgttgtgatttgtacttgcagttgttcagtgatgctctgttcttcttttgtgttatacagtcaatattttcttctattcagcgatgctctgttcttacaatcaatattttcttctattcagtgatgctctgttcttacaatcaatattttcttctattgttttgtgtgtttcttaacaacaacttacacggttataatttgcacttgcagatgttgcttcactgccacatgaagcacagcaagtttcctcttgttccatgtgaggccgaggactgccgcatctatgttactacggctcgtgatcttcagttgcacaactacttttgtcacacattgccagctggttggtgggaagagtgatcatttctcaagaaattcagattcgacttcatcatttcctttcatcgtttgttcaccagcatataaagctgagatctcgaggagataactcttagtcatttctctgcatacatatgtttgtgcaataatcacattagcaaattagatacggattgaccaatttttgtgcattaatcatctatacatatacatatgtttgcacattcgagttgtagtcttaatctctatattcgcctagattgttacaactcagatatgtacacttgttccttaaagcttcagctcttcaatgatcactgtagtaacaaataacacgtgtgagatgctcttctgtcatcataaaattagttgccggttgatcaatcactgtagtaacttatgtcatcataaaatgaacaagctaagatagcccatccttaactcctttctgtgaaaaatgactttcgtccagagaacaggagaataatcaggatgtgttgtttaaactgaggaacatggaacaatgggttcacaatggagaattaatg

SEQ ID NO: 13925 - DNA, 1501 bp, Oryza sativa
cgatctttaaagagatttcactgtttagacaggttttgcaacaaactggtactgttcatgaaatgctacagtggccttggtgccatcaaccggacacgtaggttgtgtgtgttcattagagttggcgccatgtgcaagaatactgaagtagcaatggctcggtttttcagacaaccactaatcaccgcactgatctagtactccctatctcctaaattataagacataagacatatattttttatacatggtatttaataatatacttggatcagtattttattttattttatgatcctaataaatataaaattaacatcacatgaaagtagttcaaaataaatttaatgatataacatatatagtacttagtatagttatagttatagttaatatgattattagttaaatctatcgagtttaatttttcttaaaaaggggtgtcgtataatttaggaagtattcttcttataatctactgctccctatcagggtttcaaatttcaaaattagggtttctaccgagggggagcgatagaaccgaaatttcagaaattttagaattttttcgtacgaatttttttgaaattttgactaattttgaatggatttgaataaaatttgaccaaattcacaaaaatttacaaaaaaaccgaaagttttgggcgagatatgaacatttcggtggggggcgaaatttcggaaatttcgaaccgaaatttcaaacactgctccccataacttgattagcttaaggattagtacacgagcaaattaacgtcagaaagtggttgttagccggaaaaaaggctcctcggattgaggtaattaggccaaaaggagacccgctcaaattccaaaatgtttggtggagtatataattagggcaactagttaacagtaattttcaaggtgcaaaatcgaacgaaatgtcgaatcgtatttattacttcagacagaaccagtctctggggtgtttgggagagaggggctcaaaaacataagtcccaggctaaagtttagcctctctcttccaaacaccctctctagctacgtgttgtccatttggaatctgttaacttcagctggcagaggtataccatacccatcattcgcgcgttacatcgtcagtttgcgtgcaatcaactcatcgtccatattacacttggacgcataatcaaaggaacataaattaattcaaaaaatttgttacgacactaaacatatactgtactacttctatgtcgatcgaactgccacgtaaggttaccatgcttattatattcgattattaatttgttgattaattaattaaagagtctggtttaattagacgtacgtgtgcacacacgttgcgactcgtgatatgtttttataaattttaatcaggcagctgctgcctacgtggcctggcacgtggcgtcgtcgccggctgcctcgctccctgctccggcgaccgttcctccgggagacccacacgtgcgcccgacgtgtacaaccg

SEQ ID NO: 13926 - DNA, 1501 bp, Oryza sativa
ggacgcacctgaggacgtaccgcatcggcttcgcgcagccggaccagacgccgccgacttcgccggcggggcgcgacccgagggtcggcgacgggctgtacatgtgcggcgaccactggtgctacgcgacgttcgacggcgcgctggtgtccgggaggagagcggccgaagctctggctaaggacaggggattatccttagcctgatttgagctgagtgggccatatgggccttgtttattttaggccttccatttgtaaatggttggaataagttcactttgggttcctgtatttgtcgccagtctgattttcgcccattgatcgcaaaaccaggtaagacatgtccctcaacttacgaaaccgtttaaataaggtacctcggcagtatttgaccccggttttggctgaggtggcgcctacgtggctagtttgacttggtcttcatctaacgtagcgttgacgtgacgcttatgtggcaattcgatccgaaaaataataaaatctatgggatccacatgtcagtttcacacacaataataataaaatggtggggcccacgtggaccccacctgtcatcctcattaccccttctctctctcctctctatcccctctctctatctcccctgagaatggcgagcagcggcgggcggcgcagaggggcggcgacggagctgtgaggcagcaggccgcgggtggagcggcgggtggagcgctggcgccggggccccagcgtcgccacgtcgatgtcgcggatgttgttcgccaacgtcgtctcgttcggggcggcgtagcaggtcttgttcaggacgttgtcgtggtagttggcattgatctcggagttcggctcggtgaggcggtcgttgaaggagaagcagtgcgccttgcctatggagtacgcgccagagaggatcaccagctcctccggggtgaatcccttcgccgcgaagttggcgctgtgagcttgtccaagtcggccttggagtcagggagcatattttgggcgacctcggaggacgagacaatgccgtcgaggcggccgaccgggacattgaatttgacgccgccgttgctcatgtacctcgatgcgtcgtggccagtgaacgcgacaatgtccgcgcaggagatgacgccggggcacgcagcctcgatactagcaaattaaccatcaaattaaacacagcacattaaaaatcaatcaggcgactgataaatactagcaaattaaccatcaaaaaaattgtgattagagcacgcatggccggccctcctcggccggccgccgcgcgctgaccctcatcgctcggccgactctcccgccgccgccgccaccggagtcggagtcggtggaggtctaggtgacggcggcctccacgcgcgtgttcatcatcgcggcttttcccgcggccatggtgatctccgccgagccgcccccgcctcgaccccggatcccgtcgcggatggcgccgccgcggtggaggcagcggcgtcgagcgctcg

SEQ ID NO: 13927 - DNA, 1501 bp, Oryza sativa
cacaaacccacaacagaatacgctgcagctgttatgaagcactaactcctatttcagctaacgaaatcgggtaaaagtttgtgattgtactgaaactattgagacacgagactagaacggccatttccggccccagcgaaaagcaatcctatattcccatatacaaattcatcactatatcacctcgaatttcataacccctaaactaattgaccatttaagccccagattccctcaatctgaagcaccctaaacctaaccctagaaacgaagcatcctgttgggggcgaggtcgcttacactcggtgtagtggacgtagtactcgtaatcggcgggggaggaggaggtggaggacttccggcgctcgatgaccttgacgggatggagcttctggtcgcgccaccggcacatcacgcgcgtgcccacctccagcggcagatgcgacgcccacgacgcggacgcggcggaggacctcagcctcctctctaccccgccgccgttcgaggcggcggcggcgccgccgccgccgcccgcgccgttgcacgccgtcgaggccgcggccgccgcggcggcggcggtgccgttctccggcgcggtggacgcctccatcgagcccatctcgtcgtcggagttggatcggaagttgtgcggttttggggctgggcctcttgccccggatttgggctttgggttagatctttatcatctccgtcgtgtggtccggttgggacgcatggtttattccgtggggcccacatgtaagtgacagaatgataccgtctcggttgtatttggtctgtttgatcctccccaaatttgaattgggtcaacggatttgaaggcccagctctgttttaactttaaactaatttagttttattgccgaattttttttaaaaaaatactccctctattttattttataagttgctttaattttttactagtcaaattttttttgagtttgatcaaatttatcaaaaaatttagcaacatctaaaccaccaaattagttccattaaattagtttataattttatagtttttaaaaagttctatcaaaacatagaatgaaacggcctacttttccaatttggtgtttgggctaacacactgacttaccaatttgtgaagcagatcaataactattttcaaatccaaacgatgttctcattcctaatgatgttctatttcttcattgggatttacaatttgaaaagagtaaagaaatttacaaaaattttaacgatgtaccttgttggatcgaaaccatttaggaataagttcactttgggtctctctatttgtcgtccagtctgattttcgtccctcgatcgcaaaaccgggtacaacaggtcctctaacttacgaaaccgtttaaataagttccctcagcagtatttgaccccggttttagctgaggtggcgcctacgtggctaatttgactcggttttcatctgacgtggcattgacgtggcacttacgtggcaattcgatcc

SEQ ID NO: 13928 - DNA, 1501 bp, Oryza sativa
gcgcgcgcgcaatttttttcgctaacctatcgtcgttttctttttttttttctcgcagtttgatgccgtatgggtaggagaaaaaattgtaattagttttagtagtgattagtttcctatttttactagtgattagtttactagtaattttttaatttgaacttaaaaattgttaaatttggacttgaaagttttcaaatctcgagttgaaagtttttaatgtcgagttaaaaatttttaaatctcaagttaaaagttttcaaatttgaacttgaaagttttcgaatcttgagttgaaatttttcaaatctgggttaaaagttttcaaaatctgagttgaaagtttttaaatctaagttgaaagtttttcaaatttaagatgaaaagttgaaagttttcaaattttgacttaaaaaattcaattttcgagttgaaagttttcaaatttgggtttaaaattttgaaaaatttgactacagatataaatttcattttcaatttgttagttaaaaaatctcacgaaaaaaagaaaatcctaactactaccgtcattatctctaactagattagttaactgccttaagtgtggaaaaaaacgtgcgtccctgacgcgtacgcgccgactaggacccccctcctccgcgcccaccgccgtggtgcccgcctacgcctggctcgctgcccgttctttcctgcctcgccctgtcatttttgaaaacaaggagaaaagtgagaaagagagagataggaggaagtgagagaagaggggagagagatgaactgttgaagagaggggggagagaggaggaagaagaggagggttgagaatgacacatggggcttacgtgggccccaccatttatatattttttttgaagctaatatgtgggtcccatgaggtttattattttttcgaatcaaattaccacgtaatcgacatgtcaatgccacattagatgaagaccaaagtcaaattagccacgtcagccaaaaccgctgtccaaaccaccgagtgatctcatctgcactggttttgacagttgagggacccgttgtatctggttttgaaggacgaaaattggattctttgaaggatgaaaattggattcgttaacaagttaagggaccttagatgaacttattcctctggataatgacaaccttacccttacccgattgcatccggcccgttgttcgtatggcgtaatagtccgaaagaccaggctgcagaaggccgtttgttttaatgggccaaaatatatcggcctttttcattcggcccaagaagagagagagcgcgtctaccggtgggtgcccccccgcaccgcaccgaacagcccactctttttttctcttcttcgtcttcgtcttccccgtgccgcataggcatagagaggcttctcccccccagatccgatccccgcacagagcccagatccaccgaccactcccccagatccaccccccaccggcggccgtgcagcggcggcgtcggcggcca

SEQ ID NO: 13929 - DNA, 1501 bp, Oryza sativa
gctttaattacctctttctctgaaaaactaaacatgtacatcgatcaaaggtttagaatttaatttttatttaaaatataggtgccatatattttagtacgaaggaatatattacactgcatttttattgttttctgtaatggcatataccaccatctagctaatgtattttgccagcacgagagatatctcctggagttaaacgtaacgtatggtaatttctagtagacatatttttttgtagttttgttatctcaaggatattgccgtgtcagctacaaactcaagcaggtaatttttttttcaaaaaaaaaaagaaaaaagacacaagctgatccactcatcaggtttattgccacaccctgccttagcaccacctaacaatgacaccggagagggtgcgccacaggaaatcggtgtgaaccgactcccacagaaccacgatgtcgataggcacaagcactagtttcggcagtactgagatgcatcattccaataaataaactatatcttttggaagtcacatattcggaacatgactgcaagctctataatcgataattagagaagtagcagcgaaacttagcgcaactagacctaatccacaagcaaagatttagtattaggaaggaaaccctaaccttcaactttacttttgtcttcccaggggagggggaaaactacaatgggtggttacatgcgagtatgtcggcttcaaaggattgatgggtttgtttcggagacttttgaaaacattttcgaaacactaattttggatcgaggtgattggtaactccgttaacaccgcaaatcattagatgagtttcacggaatgcagaagggagcataaggaaatagattttgtagggaagtaggacataaagtgtttatctatgccaagaaaaggccatttgaagccggcccagagagaaaaaaatggaaaaagtttgtccttttgttctcccaaaaacggcgatcaagtttgagaaggagatagataagttccttgtagtcaaagcttcggaaaacctcatggcggccgaccgacgcggagtgggaacttcactactactgttagccaaaaagacgccaacagaaatactataattacattcaatcgctatttttttttacagtgaaaccaatgtggtgcggatagcctgatgtatagatggccaaagggcccgcctggcacagccctgcccaggcacggctgggcacggcccagaagccatcgggccggcacggcccgataggcacttcgtgccagcccatgggatgcacctcccgcccaggcacggcccgacgtgccatgccggcctgaaggcatgggtggcccatcgttccttttttaaaataagtctaattttcttccctcctctttgggctatttcatatttatagctaaaataagtctattttccgtccctcctctttggtctgacatatgcatagctaaaataagtctatttccgtccctcctcttcggctgacatatgta

SEQ ID NO: 13930 - DNA, 1501 bp, Oryza sativa
catcatcggtacctcacaggtatcatcactaataccagacaagtatcgttattggtacccatgtatcatcaccgatacatgacatgtatcatcaattggtacctatatgtatcttcaccgataccttacaagtatcatcaccggtacctacatgtattatcatcgatactgggtatcgaccaaccgatattgttacaactgatattataggtaccatcgagatacttggtacctatatcagcatgattcccatatgtaccagatttgggactggatatcgggtatttggctatcaagtaccttgtacctagattggtctgatacctataggtaccatacctagtactaggtatcagggtacataaggtatcatatacctaataccagctgagtatcgggtactaggtacctggtacctgaattgatgttgaacgatacctgttggtattgggcctggtatcagatattagctttagtatcagattccaactcacatgccacgtcacatgcatgcaactagtaacacagccacgtcacatgcatgcatgtagctagcaacacagccacgagtaatcaatagaacgctcctgagaggaagcaggtggcagggccccctagcgacgcggaagggtatctcgttcccacgggatcccgtggtctagctatcctcattaagtattagctattttttttaatttgatttgattaagcaattttcgtatagaaactttttgcaaaaaacataccgttgggaaaaggggtgcctcaagagtccgggttggtaactcttgcctccagcatagaaaacggagcgatccattagcgcgtgattaattaagtattagctatttttttaaaaaatgaataatatgattttttaaacaactttcgtatataaacttttttttttaaagaaacacaccgaaatagcagcttaaaatgtgtgcgcgcggaaatcgagacggggagttccgaacctgcactctcgaacgcagccaagtatgcatatttttggcccgccaggccacgtgctgtgttttctttctttttcccccaaaatttattcctttttaattacacaggccagtcgtcttcttcgtcatcctcgatcagcgagagaatataatttgcttctctctctctatcgctcgcggttgctcaggcaagctgagagcttaattcagaggcatcatgttcacagcgatgcatcgcatcctcagcaggtatggcggattcttgtagctgttctccgattcggatttcagaggagcagccagctcagtgtgacagtgtgaagcttactgtggaaacaaatggccaaataattggggttggttgttgtaatgcagggggaggaggacacctgcagcttcgtcttcctccgtcactgccttcgccaccgcctccgattcacagaggtgatttgatcgattcatcttggagttgcattgagccattggttggggacgctgatttcatcttcttgattgcgaatcgggga

SEQ ID NO: 13931 - DNA, 1501 bp, Oryza sativa
aaaggttaattaaaataatttaaaattagaaagtaaacaaataaataaggaaaaagtttttaaataaaattttaaaaatagaaaatttggtatcaaaataaagggtttgaaattagatgaatttagatcaaaaggttcactggaattggatttgtggtttgagagatgtggattgctaaagattgaaatggaaataaaaggaaaaaggtttactttatagaagtagggcccactgtcagttccttcttctctttcttttttcttcttccttcttcctgcttccttctccttttctgtttcttcttcccgaataacaacagagagagagagagggagacagggcgtcggtgctccggtggttgaacggcctcgatggcggcgtctaagcgtgttcccgagcatcgcgcacccggggagggtggaggaaggcagaggtagagagtaggatggccggaacggcggcgacaagagcttagctccggccggctatggtggtggcttgtggcagtggctaaaggagaggggaaataggaaaaaaatggaatcaccggagtgaggcaaagcctatggtgaaagggaattggaagaggagctacggaggaggagatcggccggtggcaggcgacggccggtcatggcaggagagagagagaggaagagctcaaggctctgatgtgggggaaaaagaggggacctcgtcgtccttttataggctggggaggtcggtggatggagagaagtcgacgacggcacagctcggcgtcggctcggaatgatgaggggcggcgacgtgtgtcctcgccggattgggcgtcgtcagtggtttggtggtcggtggcggctcatggcaacgcgtggcgcggcgtcgtgcggcggtggcgaaaatggtgggcggcggcggcaaaagcggcgggcgacagcggctgagcagtggcggccgcagcggtggctgtcggggtgccacgagggcccctggtttgctgcggcggtggcgggatggctacggcagtggcgtggcggcagcgggcggcgcgatatggcggtggcatcggaacttggcgaggcggcggcgctcccacggaaggggagaggaggcggcctggcttgggccggctcggctgggcttcggctcagttgggctggcagctcaagaaggagggagtagaaggaaggaaggaatgggccaaatgaatgggagttcggcccaaattgaataggaagctttgataatggaataagttcatctaaggtcccttaacttgtcaacgaatcctattttcgtcattcgaccgcaaaaccagatacaacgggtccctcaactatccaaaccggtgcagattaggtccctcggcggttttgaaggcagttttggctgacgtggcacctacgtggctagtttgacttggtcttgatctgacgtggcattgacgtggcgcttacgtggcaattcgatccggaaaaataataaagctcgtgggacccacatgtcagtttcacatag

SEQ ID NO: 13932 - DNA, 1183 bp, Oryza sativa
taatccgtgtattaatttcaagctcacataagctgagaaaaaataagtgtttgatgtaagcatttgagttctttcaaagtattcatagcataaatcttggagcaactttatactagctcctcccatccatgaaaaatatttgacttttagaactagattcagtcaaacttttctaattctctatgagaaagatcttatcgtaagagttaagccgttaattacttatgattgaaacgagtactaattgacaatctcaatggtgtatttggaacataattctttttctcataaaaattagtttgtttcctttgaatttccataagaaataaaccccatttgaaaggcctaaaaacatagggaacattgttatggatgtgcatatatgaagtagacttgtaaacctttcgggtcttgacacggaagagaagcggttgacgaatccagtcaacatcgtcaaccctgctctgctcttgcccctggcacaaagcacaaataaaatctcgtcttcattttttttcaaaaaaaaaagatccttaccgcctgccactaacttatataccatctcaatcctaaaatagtcaaattattttgacacaaataaagtatacttttctacactttagtatctatatttagacactaatttagagtattaaatatagattatttacaaaactaattacataaataaaaactcatttgcgagacaaattttttaagcctaataaattcataattagagaatgtttactgtagcatcacataggctaatcattaattatgctcaatagattcgtctcgcgaattagtccaagattatagatgggttttattaataatctacgtttaatatttataattagtgtccaaacatccgatgtgatagggatttaaaagttttagttccatttaaacagggtctaaaaagacacttaaaaaatagtattgcgatctttcgtgagcaacacatctcatgattaatcgcaatacacgttaactctacatgacaaggaaagaactataagaaagaaaagatagtgtagtgggcagagtccatgaaggtctgcattcgaatgagccgccgaacgcatttaacctcttctcaatacatatcaatatgaaatgcccctcttttcatatccaaaatattttctaaaatgaaatacagagtgaggagaaagaa

SEQ ID NO: 13933 - DNA, 901 bp, Oryza sativa
caaaccatacacctattttacgtcttccagattggagaggatgttgtgcagtatgtgccttgtggccatatttctagattacaggacaataatatcctgactacactgaacccataaatacaaacaaacaaaaaaaccataaccttgtgaccaactgaacatggtgatgtataaactacacaactgacagcgatctgcttagccgcctggaaaaagaactaagcaactttgagtcattgctactttgatgtcaacgaaagagagagagaactaatacaagcaatagtgttgcatgtgtcttacgtgtcaccgccatgtatgaaaattgacgaaaggttcttcggagtaaaagaggcgacaacccatcaaataattaatcgaattcaggacgaattgggttgttggagtttggccggcgcaaagcacattataatattgttgagataaggtgaaagttggactgacgtgtatgtttgcaatcatgacgtgtaagtatgtttgcaattagaaatgtacagtttttcattttctttcagcttttattgtgtacttaaatcccttctattagtataacgtcgagcaacctgtttggccgttccaaaagaaagattagctcaaagtccacagcgagagatgctcagtttcagagcataaatacactctagaatgctgaattgaccattatcggatcaggaggaccttatgatgcagagaacaatgcagctcgttctcaggtttgatcaccttattagagcagagttcatgtctgttcttgattgctcactaagctgtaaagatgatttggttttctgtttgcgttagggtgaagagatcgtcgggtttactacaccaattctccactgcggcgaactcgcagaggttaatttctttcatgattttc

SEQ ID NO: 13934 - DNA, 1501 bp, Oryza sativa
aagcacggagccgaatcccgtatggggatacgggcgcggcgggcgatggagtaggcggcgtaccaggaggcgcaggcggtcccggcgcggaagaggtcggggatggcgagcgactccatcaccgtgagcagcaggtcggccgggagcgcggaccagtcccggtaggcggcggggtccacgctgacttggacgggcgcgccggcgccgtcgtcgtcgccgtcgccgtcggccaccgccgccctcatcttcatgtgggcgtgtgctcctgatgcgtggcggtgcaagaggcgaaccctagaatttgggaattggggaattttggccgccgcaacggcttctcttcttgtttcgcacgccgcgcgcgtccgaaaactgaattagaatcggaaaagcacacggcccatagactcagcgaaggccgaacagtttagtactgggcttaccgaggcctgcaaaactttgggccaccaagggcctataatatttttagggaaaaagtctatttaggccctgtacaagtacattagtactccggcctattgccacggattatctagaactatatggatgaattgaagttttaaaaacttaacttaacaaataatttaaaatgagtggctaaataatacgtggaagcatatttgaattattgtgttgttaaactaggcatagtatagagtgtacgttgaaacaaaagagaaagaaataagagttgttgctgaagttgaaggtgaaggtattcttagatcctcatcaatttctataggaatattcctttaaaaaattatttatttattaagtttgaaataattaatacacctacttaattaattactacctccttctctaaataaaggatgttgaactaactagcatcataaaaataaatatggagggagtatatattaatggcacaccttattttacgtgtcttccagtacttcctccgtctcataatataagagattttgaatttttgcttgcactgtttgaccactcgtcttattcaaaaaatttatgtaaatgtaaaaaacgaaaagttgtgcttaaaatactttagataataaagtaagtaaaaaaataaataataattttaaaaatattttaaataagacgagtgttcaaacaatacaaacaaaaattcaaaattctttatattatgggacggagggagtattcttctttcctctactttcaaacataaacatgagaagagtacgctgtacataataacctaatacagtaattttttttaatgaacataacaacctactacgacgtactaataattaatcatgtcacctcagcaattgcaaggatttgcttaattaacaaaatgagactacttgtacatactgtatttagcagcatctcacacgtctccaccacacgagagccgccaataaatacacatagaagcagctactatcagctcgccactgagctctagctaataagccatcctcgatcgtttatcttcctcttccctcttccaatccca

SEQ ID NO: 13935 - DNA, 1501 bp, Oryza sativa
catgctactgacctgtagaagagcacggagggagggaactggtagtagacgccgaaggagtggccggcgtcgtggagggcgtcgaagatggtgcgctgcggcaggccggcgcggagctgcttgccgtcgttgctgacgaggccgtgcgacgtcgccgagtggacgaacatccggttcggctgcgtcgacgtcggcaccgacgcgaaccaccggtcgcacacggcgaactcccgcaccagctcccggtacaccggcaccttctccggccggaacccgttcatcaccgtgctcgacatgccggcgcgctccttctccgcctcctgcgcgaacccgctcatcggcggcgagggcacccccggcttcgtcgccggcgaggtggtcccccacgtgtaggcgtcgccgtacacctgctcgtagatggcctggaacgagtggcccgggtcggggtccacgtacccggagccgtcgccgaagtggatcgccggggaggaggggtcgccggcggtggcgcggttgaactcggcgcccgtcacgccgtcgatctccgggttcaacgacttcatccaccccagcatgtggtcgaaggagcggttctcctggaccagcaccaccaccgtcttgatcttgcccgccatggctggcgtcgaggctgggattggaagagggaagaggaagataaacgatcgaggatggcttattagctagagctcagtggcgagctgatagtagctgcttctatgtgtatttattggcggctctcgtgtggtggagacgtgtgagatgctgctaaatacagtatgtacaagtagtctcattttgttaattaagcaaatccttgcaattgctgaggtgacatgattaattattagtacgtcgtagtaggttgttatgttcattaaaaaaaattactgtattaggttattatgtacagcgtactcttctcatgtttatgtttgaaagtagaggaaagaagaatactccctccgtcccataatataaagaattttgaatttttgtttgtattgtttgaacactcgtcttatttaaaatatttttaaaattattatttatttttttacttactttattatctaaagtattttaagcacaacttttcgttttttacatttacataaattttttgaataagacgagtggtcaaacagtgcaagcaaaaattcaaaatctcttatattatgagacggaggaagtactggaagacacgtaaaataaggtgtgccattaatatatactccctccatatttatttttatgatgctagttagttcaacatcctttatttagagaaggaggtagtaattaattaagtaggtgtattaattatttcaaacttaataaataaataattttttaaaggaatattcctatagaaattgatgaggatctaagaataccttcaccttcaacttcagcaacaactcttatttctttctcttttgtttcaacgtacactctatactatgcctagtttaacaacaca

SEQ ID NO: 13936 - DNA, 1501 bp, Oryza sativa
gtccagggcgtggacggagtcgtcatcccgcacgacgtagaagaggccatcgtccttgcagtaggcggcgtcgcagtacaggttacgccaccggaggccggtgccggcgccaggcgagatccacgtccaccgctcgtcgccgggcctagcgtaggagagctcgcacctgggcatgtgcaggagcagcacgacgcacgccgccgcgtcgccgccgccggcggcggcgtgagggccgcaggagagcaccgccctgaagtacatgcaatcccgcacctcgcgcgccgggacgcgcaccaggctgggccggttgtacaggcgatcaacgatgtcgtacgcgaggccgccgccttcgtcctcctcgtcggcggcggcctcgacgtggtgcatcgtggacagcggcgggagctcggcgtgggcgccggtgagcgggttcaggaggcgtaggttgccgatctcgtcggcggcgacgacccacccgtccgccgagccgatcagcgtcaggttacggaagccaccgccgccgccgccgcacgacacggggatgcggtatgtggcgccggtggatgggcagtagagtccggcggcgtcggggccgtaggcgtcgcaggagtagagtaggcacggcggctgcttcggcgacgggaggcggaggcggcggaaggtgcggtacgcggcgtgccaggacgcgcacacggcgccggagcggaggaggtcgggtatctccagctggcaaaagacggtgacgaggagatcctcgggaagcgtctcccagcactggatcacgccggcgccggcgccggtcggctccatggctgatctgacggcgccgccgccggcgatcgtcggtcgacagagcaaattaaaacgcttctatgaacgcgataattttcctgagagacactggaatgattaaaaagatgttttgtgctgtgttagacccgtacgtgctggattaggttcggacgggcctgaacacggcgcacattttccgagtcggactcggcacgtctctcttgccctgatcgacgttcaaattcaatgtctccagatgataccgtgctgtaagatgccacgatgctacgtactgttggaggccataacagtgccagcttattgcgcaataatactacgtttctccgtttcaatataagtacaattttatatttaattacgttatgtttaaaaaaagaagcaaatataagggaatgacctaatatcaaataattagaaggggtgaggattcgaacccaggttgtctagcccaccaccttgtgagctagccggaagactcctgggcgtttctcaattctgattacgttctgtttctggtgctcatgagaatagctactcaaggaggattaaccgatgaaagtaaaataaatcaagtacgatttgctggacatgttgggcctgttcactttggtgccattttcaaccttaccaaattttgataaagttgacaaaaaagttgctacatttagtttgttgccaaattttagta

SEQ ID NO: 13937 - DNA, 1501 bp, Oryza sativa
attcgtaacacggagttgctaccagactcttcgattgaataagtcgataaattatataatactattatatacatagaatgcaacaaaacaaaataagtaaatcacatgacctcatgatttcaagttcctttgatcttatcactcatgtacaatatttttacatactgtaccaactattttgtgtgtgtttagaacggtcatagtactttttaaaagtaattattcgtaaaattccatccctcgcaccatttatttatgatttgcacctatgcttagacttagttatttctcctaaggctcctaactctcatttctcgtttttttactttcacgctttttaaattagctaatatataattaatcatgcgcaaatcactctcaacactatcaactgaacttagccctagtgtaggagcattgctactgaaagagagaaaaaaaaaagaaagaaaaacccatggctagtagtaattccactacgcgcggcgtgtgtcgcggttgggttgacaaatttcgtttcctccgggagcatttgccttgggaagcgaagcccaagccacagccaccgggtggtgtggggtgtatcctatcctacgcgatcaacagcatcggatcgagcgctctggtctactgtactggtactctctctcccgatgacaagtgggcccggagcagcgccagcacgacggcagcacacggaggttcgccgccgcgtcaggcggagccctgttcctttgcagcttcagcagtagtatgttcgtgggccgggccgggccggatccggcgtgggtcagccaatcgttgctcgccacgtcagagaattacagtggttcaaagaaaatctactcctcccgtccagctcaaagacaaactatttttttttaggtttgacgaaatttgtcgaaaaactaacaacatttacgataacaaattagttttattgaatccattattaaacatacttttatggtgtctataaaattgatcaaactgagagtgtattatactaacatgtattggagggaactatttgactcttttaatttggaacacaggagttctctataccttttaaacaattactccctccctcccagaatataaaaagttttagagttaaacacggttattaagaaaaagtatgtagaaaatggtaaaggattgtgatgggataggtagtgaaggtaggtaggaaaagtaaacggtgaagggttgtgattggttaggaagagaatgttggtgaagttattatattttaggacaaatcctgaggactaaaaattgttatattttaggacattttaggacagagggagtactaattacaaggatcatcagggcttcaggaagttgctccttttactctgctggtgctcctgatgatctgtaaaagtgtaaaacatatttctaagcaatgaaattggaccaaaatatagtccataataagaactcacgcacaagattcatgttggtctatatgcgtgtagatctggactttcgg

SEQ ID NO: 13938 - DNA, 1501 bp, Oryza sativa
tttctcgtgtggtaggatagccctcacacactaaatgatctgcgaaaatcgctatttttatatgtgggcggcgcacctgcacgcgaaaatcggattttcgcttgtgtggtgcttatgtggtccacacgcaaaactaaaaatccggaaaaactagaaatcacaaaaaaggaagaccacccaccggcctccgtgccaacttgccgccgagcctgcccagccaccaacgccggaccggccggggtgggtatggttgctgctgccggatcctggcgggggctggctgccgttccccctcgccgccttccacgcgagcccgtcgttgctcctagcagctccgaagaccgctgcccccgtggctggccgccgccgcttctcccgacccttgccgccacgcagctcacggccgggaccggcctctccctagcccgcagctcccgctcgttgccgctgctccccgagcgcgtcgccatcgtcatcgtcgtcgccacccgctatcacacagccaccatggcccccgcagtcaaagtgaggatgagaggagaggtagtaagaaaaagataagggagagagatgcgacaaagagataagttaacaaatttttaataaggtgagagggaaagaggaatagtattagacttgcaggtgggttgcttaagaggcccgcatgctaaaatatagtttcacatatgtgcctttttaagaggcccgcctgtgaaaattgatttttgcgtgcttgttaaggagccatatgtgaaaatagaggtcgatttttgaagacgcaatcagttatggtccgtcctgcaatcaaacgagggctccggccaggaatatcgtttttgttgtcgtgagatgggatggctaggtctgagaataatcatggaagtgatacattatttctgagacagtcctttcaacattttaacttagatattttttttaacgattgtcctctgttacacgaaacttgaaaaatagtacactcgtatttcaatagcttgttccaatggccaggtcaaggtcgtttttcctgttccaatggtgtaaagaaatcttagtgacatcaatgacatctctgcctcttggctaccctaaggagtaaggacctagttagaaggtgatgatgatgagtggcatggttgggcattgggccgactctgttccaactagtaggatgggacaccaacagtatggccctggatcaaactttccaacagccagtttttgaggtgtagtcaaaatgctcctggacctgtactggttcagtagccttctcatgctccacgatagtggaaaaattactatcgctacactgctcgggccaattgtagaccacaatggatctaactacatcaacacccttctaatatttgtctatgcagtgttccacccataatgctctggaacagctgccatccatacaacaagttatagaacaagcagtaggcgctgcgtgactatcatcccggatgccttccattcctatgagctattaccatcagtc

SEQ ID NO: 13939 - DNA, 680 bp, Oryza sativa
ataacttaggtgtacggtgcaaatgtttttcggtaataaatagagctatattgttgccttacctgcctagggtgacttgtttcagggataatttttgggcgtacttgtcatggctggtgataatcttgttggcgtctcgccaaattgaggaggatcgtgatggatttgcttgggtagcagatgaagaacatgagaagtagaggatgaggcaattggggattaatttctttcttctttcttttcggatggaataaatgggttatgcccgatttattctaagtacatcccataggcccacaattaacgttaagaggattaataccacattggaaactttgtgaggtgatctcaatttaaatagggagctattagagagcccctgttgaccggttgaggtgttggtaggattgccacacgcacgggctgaacgtgcagtgatgtagcctagggggagtgaataggctttcctgaaattttctgaacaatcgcagcggttaaattgacagggcccggaacttccgggtggttaaattgacagggcccggaacttccgggtaggatgtagtatcccggaacttccgaagttcttaagccaagaacttccttaagaacttccgggcagcagagataatttgtaaactgagaagaaaagtcctagctaggaagatcaggcacacaga

SEQ ID NO: 13940 - DNA, 851 bp, Oryza sativa
cactgctgcttctttacttctgcattccttcagctttgccattctgtcacttggcaattttgatgatgctgccttcttgctcaacagggaagattattcacatcagcatgatgatgaagaaaatttgatcaaatgtataaagttgtaatgctctcttctccttttcttccttttacggtttcagagtagtgctttttagtaatttacactgtaagcgtgatatagctaacatggaaaatgaatgtgttactcaagcacaatatatttttttgcattattttctcagtttgaaaacaatctaattgtttcccagtacttatatctttaactgacaaattcttccatttccctcccctgccaaattgttgtgacatatacaggaacagcacggctatacacacacgtgtcctcctgtgttattattcatctctcctttttctccatcaagcgggtgtacttcaagaaaaaaataatttcaacaattttcagcaatactgaaggtattcagcaacaatctttttagcagattgcacttctataattgctgctttaaccattgcaacttgttcggcagttagaatttcctgtttgatgaataagttttttccctgtagatatgatgtacaagggtggaattggtacttaggactgattgttcatcattgcaactgcatttcactgaaatattgaagtaactgcactaatagaaatggctgaaattgccgttctttttgtcataaaaaagataggaatagctgtggcaggagatacactaaagttagctatacccctctttgcaaaaaagaccgagttaaagaaagttgagctagtaacagcacttccagttaaca

SEQ ID NO: 13941 - DNA, 1501 bp, Oryza sativa
gacaaggtatatctgtccactgtcttaaagtaaagactgagtgcattattcatcaacattaacctgataattactccgatcagtgttgccaattataaagtcatccgcatacacacatgctaggtcaaatagaccacaattgaccagctagacagctagttaagagtaaccactgacaaaacaagtgttaacatcaaattggtgatactactacaaagacactcaacacaaagagaaaacttgaccacagatggagtaaaagaggagatatgatgatctgataattaattacacacgctctgtatagtcttacaaaaatatctcgatccgcgttgaacagacatacagatttctttcaccaatcaatatgtgatcgatctgttgttatttaacttcttaattaagtaggtctgcaattgcctatcaatttggtgctaatttctgtatcagacatgcactaccacaagaagcactcgaaagggcagttagtcatagagtgagaagactaactgaattttactgattgcattgtgcagtgtcaacgatcgatcggctaaatttattaaacaatgccaaataaatatttacacacttgaagtaagtaagtagagtagcagttgcgagttgctcagcaacttgtagcattgaccagtaacctcaatgaaagatgcatggtatcagataccacaagaccagcttaattagaggcttggagctagtaaacactaacaatgtaacataaaaacacgtgttagcatcagcctaacacctgcccatttcgtcccttttttttttttttgttattgtgttgcgtttcctcctagtaaacagtgtattctacttagtaatttacttggcttgaattttttttctgttcttttgagtcaaatgacttggtgtgtgaccgtgtgaatcaacaggaccaagcagggttcgtctttccaattgaatggtagataccgaccctatcagtatgacattttctgccaaatttcaacaaaatttattattccaaagttgggctctcgaaaaccattttaaatttcactcacagtatacttctgtcctacattgaaacatcgaaatttcgtcgtttttaatccgctttcatcgaaaacataaatctgtgggaccaagagagtcggctagtaactgacgaccagacgagttgcgattgcgagcagccttccggcccacacaatagtccacaccggccataaacgcgagcccactaaaagactcggcccattactatactagcccaagcaaaagactcggcccatggatagcccaagtaaccaacgcgtatgcttggaaggcccatcaaaatcggcccagcaggcgagcgtgacgtggaccggtcgtttcgcgcgcgaaacgtggcgcctcacatgctcgcggtcgccgccgcgcgccacgtcgcgccttcaccaacacgtagctcgggacacggcggcgcgcgccgccgctgcacgcgtccacaaaaaccccacctcgccgg

SEQ ID NO: 13942 - DNA, 1501 bp, Oryza sativa
ccgccatccctagggctaccttcactggaaccaccatctccttcctgaggacatgccgtcaacgctcaggctgccaccgtccgaagagatgtcgctgccttcgtctcgccgctacgtgcccgaccacctttactgtcatcgctagcttgtgcggctaatgagttcgaccgcctccgaccgccaccacaacacctccgcttcccgcagggacgccgccgcctcgccgctacccgcccgggcacatccgttgccaccgtcaacactcgcagccaagcacgagtccggccacctccgactgccaccgcagcgcctccgccgcccgccttcccaccaccgcccggaggaacaccgccgcttcaccgctacccgcccggccacctccgttgccgccgccaacccacgcggccaggcacgagtctggccgtccgaccgccaccgcaacttctccgctgtctgtctccccgccgctgccatcctatccgccgcgtagaccgccggtcagctctggcgatggcagggcggatctagatatggggagaggaaagtttcggccgtgggagaggaaagggcagtttcgcttcaaccttgtagtcggctcgacttggggaagattgccgacagatagtcgatccactgacctgatttgatctaagtctaatcactttgattgtttagatgtgttcctttctcaaaagatctctgtaagactttatgtttttattcctcctaacatatccagcaaatctgctatcgtttgaagtttcttttaagaaaaaatataaaagtaacaactccctctgaaaatagctagctttagagtagttgcttttgagtgttatttgtaaattattcttatcgatgaggatttgtatgtcgaaacaacaacactcttatttaatccatggtatatgaatttatcgatgatcggtcttgattgcgtttctgtggttcgtcgatggccacgtagtgaccgcccggagctggtgcaacgtcgccatcacccaatatatgttactccattttttttcctcgttcggtctcttctaaaataaatttatttttaaccatcatcattgtacccaagtttataaaagtaaagataaatacacttaaaataaataaaagaagaaataattatattaaaatctgataaagtaagaatatttttgtttgtattagtacggtaaaagagtgaaaaacacacactttaacgaagggagtactactccgtaaaaaaatcaatctagtagtagatgttgacacatcttaatactatgaatctcgttacattcgtagtattaggatgtgtcaatatagattagttttttatgaaacaaaggtaatattactttactcgtacaaaccaaattaaggctgtgtttagttccacgtcaaaattggaagtttgaagaaattagaataatgtgacggaaaaattgaaagtttgtgtgtgtaggaaagttcgatataacagaaaagttaaaagtttgaagaaaaaaaa

SEQ ID NO: 13943 - DNA, 1501 bp, Oryza sativa
ttcttctaaaatcattctctatcttttaagcccctttttgctatttttgcattttattttattttctctatttttcttattttttggatttaatttgaattccttttggatttgaattttatatgtctaaccctaggtcttgaggattcttctgactcaatagataatatcaatcaatctcaggacatcgagcaaggcaagttaccatataccttttgatcatttaatcctatattttacaaattatttatttatagccttctattcaatattctattttatatgcataattcaaccatagaaacccagataatttagtatcgcttattttgcttacaatctggttaaaataccttatacttagattgggacagtacgtaagatttggttgattttcgggtggctactactgtctcgatcgatataagttttactaggtacttatgtcgaacgaacgggtacgaccgcagtttctaaaatggggacaggcctagttattatgttaattagcaatatggcacctctgtatagtggttcttatttaagtcctcgcgcaggaggcaactattgctgcgaagggcaactttaaccattaccatgtacaggtaaatggtttgtgatactcgagtataaactatatggtatatttctaaaccctgatcgagatgatgtggtgtcatacgatcagttccccttaaatacctcgggaacgccagaactcttcttgctgctgttaacaatacgttcagagcatatgaggatataagttcatggaacaggtgccacaattgttaatgacttaatactgggccatgactaaagccgatgattatcagcaagtcgtggactgcgggtaaagcatacatctgctgcagtagaatatctttgaaactattcgaatagccgtactcatggagttgagtaccgggactcatatggtaccctggttagaaatctaaagtctatatgtttataaattcctgctgtaattcttccagattgtttattactgctttttgcaaagaaccccactatatgccaatgcataacatattttcatgataacttgctgagtattgcgaatactcattcttgctctcataacccttttttcagatttgggtcaagaggacccctatgactattactacgatgacctcgataatttagaaaacccctaaaggttataccttcctagtcagaatgtactaaaacttccgctgtgtaatattagtacttatgtctaattaggtaagtacctacccttgtaaaacccctagcgttgtaaactttaacgtatgcaatgaagaactggttatattgtatatatcaatatctactgatccagggattgatacattaattagagttggatccaagtaattagttttgagctccgacagggtggcgatgcgccgaaagtgttgttgaactattgttgtttgattacacaggtttgggtcgtatttatacccgagatataaaatatgtccttgccgga

SEQ ID NO: 13944 - DNA, 1501 bp, Oryza sativa
cgctggcgctcgccatggaagagcaacaccgaacggccatgaattcgatcgacggaagctacgaaaacgtgctcgctcgaaaactctgaaactgaagtggtttacttgggagaacaagtcgaggggatgcttacgcacaacggctttggctttataccacccctacgcggctacaccaccacgcggcaaggcctgcagttactttcacctgttttgccgctcgtatcccccacaaaatacttggtgctgtgctgccgcgggtcgagagagagaggcggaaagaaatgcagaatgttttggacacgcgacgcgctcgggaggaagacggcggccgccgacctgtgccggatatagaggctggaggactcgccaccgactgcctggacacgcgtgcgacgcagggggagacagctcgccccacgtggcagttactagtagagctttgttcgttaattgcgtaattgtggttttatccatttgataatcctgctgagtcatcttgattattagtatttgttttaacagggtaattaatctgggtgagtcatcgttagtggatttttttttctttttggccctggaaggcttatgccttcaaaaggcgctggatttgaggggaaagaaaggcaggtgtgacatgggattgggtgatttggatttgatcatttgaggggataagaccagcttagcttttgcatgacgcggatcgagcccattccagtcatgtcacgtccaccgtccacgccgtgccggcggcggcgtcagtcgcgggctcgccgcgctgcgccaccgccgggacaaaaatctctgtgtattgattacgtttacatcggtcttgatccagacacgtcactgttctggtccatccaggatagccgtttcggtttggataactacgactcgctctttgaatggacagatcgatgtgttcatcgattcaaaccaaaatagtttgagtaggccatggttgtgaaaggcgtgtgcttaccaaacttggagcggcttaagattaagctcggtccaaaagatatccgcatttccgtcgttttcttctcgattcagaatatataggagtatctgtttattccattttgtgtcagtgtaagagctaataaggaaccggatagtcaaatattgtatgtacagatcattttccccctcttatagctctttatttggcatccagctgattaaagaacaagttaggccgttgcttcatgttcacctgatgcccaaggcttgtgcttatggatgacaatgacgtattgaaatggttcccaatcaacaatcatgctaaaagcccatcataactgtaggccacttgtgtatcttaatgcgaaaatgaccagacctaacaggggcatactactagcaccccaacctgaaatccttgtataatttaaatcagaatcatcattaattatagggaggaaaatagaattattataatcaagttagattggagtctcattctcaattgaatggaaggtagggttcacaa

SEQ ID NO: 13945 - DNA, 1501 bp, Oryza sativa
atatcgagattgtgaaccctaccttccattcaattgagaatgagactccaatctaacttgattataataattctattttcctccctataattaatgatgattctgatttaaattatacaaggatttcaggttggggtgctagtagtatgcccctgttaggtctggtcattttcgcattaagatacacaagtggcctacagttatgatgggcttttagcatgattgttgattgggaaccatttcaatacgtcattgtcatccataagcacaagccttgggcatcaggtgaacatgaagcaacggcctaacttgttctttaatcagctggatgccaaataaagagctataagagggggaaaatgatctgtacatacaatatttgactatccggttccttattagctcttacactgacacaaaatggaataaacagatactcctatatattctgaatcgagaagaaaacgacggaaatgcggatatcttttggaccgagcttaatcttaagccgctccaagtttggtaagcacacgcctttcacaaccatggcctactcaaactattttggtttgaatcgatgaacacatcgatctgtccattcaaagagcgagtcgtagttatccaaaccgaaacggctatcctggatggaccagaacagtgacgtgtctggatcaagaccgatgtaaacgtaatcaatacacagagatttttgtcccggcggtggcgcagcgcggcgagcccgcgactgacgccgccgccggcacggcgtggacggtggacgtgacatgactggaatgggctcgatccgcgtcatgcaaaagctaagctggtcttatcccctcaaatgatcaaatccaaatcacccaatcccatgtcacacctgcctttctttcccctcaaatccagcgccttttgaaggcataagccttccagggccaaaaagaaaaaaaaatccactaacgatgactcacccagattaattaccctgttaaaacaaatactaataatcaagatgactcagcaggattatcaaatggataaaaccacaattacgcaattaacgaacaaagctctactagtaactgccacgtggggcgagctgtctccccctgcgtcgcacgcgtgtccaggcagtcggtggcgagtcctccagcctctatatccggcacaggtcggcggccgccgtcttcctcccgagcgcgtcgcgtgtccaaaacattctgcatttctttccgcctctctctctcgacccgcggcagcacagcaccaagtattttgtgggggatacgagcggcaaaacaggtgaaagtaactgcaggccttgccgcgtggtggtgtagccgcgtaggggtggtataaagccaaagccgttgtgcgtaagcatcccctcgacttgttctcccaagtaaaccacttcagtttcagagttttcgagcgagcacgttttcgtagcttccgtcgatcgaattcatggccgttcggtgttgctcttccatggcga

SEQ ID NO: 13946 - DNA, 1195 bp, Oryza sativa
cattccgatgctaacaaagatataggcctgctataaaattgcagtaaactttaattaatacccgataataaacttaaagaatcattgctgtatgaatgaatatcatagaaaaaatagtggtcgtatagggagcttagttgctcattgccatgaagcaatatcaacaggatcaatatccatataagcagtagaaaaactgaagaacttcagatcacggtgagcaaaaaccaatcaacaaagaacacatgagaaagaaagaaaatagcaacgtgaatatttatgagtaaaataaaaaaaataatttaaattgtaggccgaggaaaggaacacaccacaaaccaaattaccatgaagaaatgactgtagcatggcattgacagcataatacatcaagaaaaccatcagtaatttgaagagatcacagccattgcatccactggtatcacaaagaatatgttttgatcctatacgatggctaagacatgccattgtggagatcaggcatataaatagtgaggtgaaagggtagatgaaaggaaaggtcgagtcaagaaatgcaattgatgaatatatgcatgtaactgtttagtttattggtggtagtaattaacatagaaaattaagcgatgcatacaacacaattatcatgggagttaattggtttggggcctgcctcctcgctgggctagactcacttgatagattgtggtctgcagactgaagctatatctagactaatcacagccttggaaataaaatctaacggtggtaaacaattttggtaacgtggatgcaccacaaaacagaaaaatagtagtaattgcagttagtggggatcaactttataggtatataggattacttcatatattctaaaatataaacaatttgttggaaatttggtcataattcggcatattttaatccaaaataacaagataataaacatgatatttacaatgggatttgatccagtgatagtggtgaatgtaatcaacatgagcatgcttaacgttgaataagcatcaataatcacataataacacaatgttgacattgcgatgaacattaacagtaaaacttctaattgaaataatgtaataaggttataccccaacaatggtcctctgctggagtttgaggcagtattgcctccgttggtgttgacgggagtctccttctccttgtctctagt

SEQ ID NO: 13947 - DNA, 1501 bp, Oryza sativa
aagatttgatcttaaaaaggctatgtgagtcaagtaacataagtatacaaataaatttggattgtaagttggaagtcccattccaagtcgaaagtctattgaaaatagcttggccaacgatatgtgtacattaactttagatggacacattgaacgttgcaatccaaaatatgcgcacacaaaaaataacttccatccggtgaaattcaatagcttcggccactgttacattgtaccagcagatgccttaaatttcaagtccctccagcccgtttccacgtaaggtttgacagcgcaaacgcacaattccatccctgctgcgacagtgtgcaaccgttttccgtccccacaaaacgggagcagaaatgacgccgccgcgcggaggttggagggagcaaatcatctcgtctcgtcaccaaaaatccgaaacgccacagcagcaccggccccgatcgaaacgctaggccggccggccgccctccgaaacggcgcgagatacgttaactcccctgtcgcggggaatgaaaattaccgccatgtggacaccccactgacagccgggccccacagcgccagcttacatccatcgggtcaaggaggcccaggacgtttccacgcatggcctttgcctccggcttcgccagtttaccgggcagcgagcagtaaccggcggtaacagcaccggccgccaccacaccattggcacggacaagcgacaattaccgcgataataacaacgacggcggtggcggcggcggcagcagcagcagcagccgcaccaaccacccttaagtaagacgagcggaggcgggccgcgggcgagggaaaggaggaagccacgggtcgctcgctcgtggtagtggtggtggatctgacacccacttcgctacgacttcccccatcccttcctccctccctccctccagtcctcttctcttctcccctcctcccacacctctcccctacctcgtctcatcgtgctcttcgcacccgcgcgattccgccccacgagcgccggcctccgcttcgatctccgcgacgggggccaatgccggcggcgcgatgagcgtggaggaggaggtggtgggggaggaggaggaggaggagctgttctacgagtcgctcgatcgcatcctctcgtcgtcgggctcctccacctcggcctcggacgacgatggggaccacccgcgccgccgccgcgggtacgacgcgggggcggcggccgcggccgcggcgctcgacctgtggacctccgagccggcgcccatccaggagcgacggcggcggctgctccagctgatgggcctctccggtgacccgtcgctcgcgcgattcgagaggggccgatcggctccatgcgacgccgtgggcccgctgccgtcctcgccggttgcgcggtccagatcgagcggcgccacgccggcatccgccgcgaaacccccgctcggaggaggccgcttgcgcggagcctcgtccgatgtgtcagatgccacgttggagg

SEQ ID NO: 13948 - DNA, 508 bp, Oryza sativa
atttaacctgctttgcgtgcacgacgtccaggtatcagtgccagatgtttgccattcgcatgatcgctggttttgttcgaccgcgggggctgcatggtgtttcagtggtgatgtggttcgacataacgaaactgacgtgactcggggtggtgtttgaaccaggttctagaaggagtacgatcttagcgtagccacgtaggattgttcccgatcccgtcgatcgaatcgccaccgttggttctactgggccagaagtggcggacagtaggctcagtgattctccgcctccagtaggcccagccaccatcaatccccacgtcgaattaaaatggaataagttcatcgagcatccctcaactttgcatctgagtatgtatgacatgcctaatccccaataccataaatctccacccctaaactatataaaaccatacaaatgagatcctataggaatatagatatctggttttactgacgtggcatactagtcagcaaaataaaaaaaata

SEQ ID NO: 13949 - DNA, 1339 bp, Oryza sativa
attagctaggtacgtgcccaactttgtccatctgcttcgctgccgatgcgtacttgtgctcccgaattccggatctagcttggcttttctctccctctccactctccagactccagaggcgtccattcgatggaactgaacccgtgtgctggcagtgctatgtacttatgttgctgcaggcatcatgattcgagccggtatgtattgaagatgcaagatcagtagtatgatactctaatacaatgagaaaagtagagagagacgggtgacgtgagttattacaactgttaagtagtttaagttgttcatagttgagtctgactccatgtgcacattgaatgcccattctgatcaaacgtgactggaacatgtataggaagggaactggggccaacaattttaggcctagttagtcttgaatgattcaggttcgtccctccattttattggttctcttaaattaggttgtaaactgaacttggaacacgtcacattgtccgggtagtctttctgttggttattgagttgtgtgaaattgatcaggatttgccacaggcgctgaagtcgattccaattacgtgatttatattgcattgagctgctacttgatctactaatccgtaatccgttgttattaggagccacaaagaaaaggcatgatgatagcatctacgagcaacaacccaaaagaattcactggtgttatcagcatgttcaaggatgttaaatgagtatgtaccttcagcaatgcaaagtcaaatttcgaatagatctttttgcacggctgtccacaatcacctcatctacataggagatttttttttatttagatgacattttattgtggtttacgctagtttccaccaaatttggggtttccaccatatatagttctggggtaggttctgacatgtaactagcaggtggttccattaacattcgatctttgaaatttactttgactcctgagaatagcagtgcaatataggatttactatacaatcctgaaccgacagtcaggtagccctgaagaagcaccccactgcactgcacaatcagctggtgaactcaatatatgtagccccccacaataatcatctgatgcattctattattgatctgactctccttaagcagtctgaagcttggccttttctttcagttcataccatgggagattgtgtttcacatctctgagtttgtttctttgtcagatataagctttaccatttgttacattgtttggtcatgttgtcagttaagtttgacatccacttaacccccacaacacatggagaccttttaatcatctaccaacagtcattcgactttgacgata

SEQ ID NO: 13950 - DNA, 1501 bp, Oryza sativa
cgcagggagatgatggcggcgtggccatggactcgtagcggctaggagctatattggttggggaggagcgcccataatcagagccccggggatgtaggcttcggctgaacctcgttaacaaatatcgtgtgtttttgtgtcgtcatctggcatgtcttgggtgatcaatgattgaagcgatcgagaaggttagtcgtcgttccgctatatcgactaacttttataacaagtggtatcagagcataaggtttcagcattggatcaagaagacatgtggaggaggaaacacgaggtggggatcgcgcatcgacaggagatcgtcagccgtggcgatgagatcgatggcgacaacgaggatgttgcggaggcggcgacctcgctcgcgatcagaccggcgatggcggaacgtgaccggaagacggggccgggcgtggccgaaggcgaccggagagattggaggggtagcgccatggacggcgcacccgacgcacgcggtgaatgtggatccgcggcggcagggaggctactgacggaagggcgaagccagcgagcctggcacggcgcggcggacgtggagggccgatgacgatgaggtcgtggacggtgaacacgagggttgcgactgcggtgcgtacggtgtacggacagcgcgtatggtacgtgctatacacgcacaagacgcgcatctggtgaacaagaagtgcagcacacaaagagtccaatggagctacgggcagcatgcactaatttaattagtgtttgcatggtgtaattatatgtaaaatcatacgacagggcttgatgcatgtacgtgcatgcggggctgcagttaattgcatgcaatagcataacaaatatgcatgcaagccggtcatgcatgaggagagcatgtggcaggacatccatggatctcaacgtggagtcgtgtgcgtcagaaggccagagaaatcctattcgagcaagaagtggtgtgtgcaaatttggtggtggcacgtgacgctaaatgagatatattggagccgattcttattggagcttgacacgggcccgacttggactaggcagcattctatgggaaggattcatcgagtttgtccaggactcaggttcctgtccgactcggtgactaatgacgctctttaaaagaaggcgtcaggacaggattggctaagtaactcacaacagcgtaggcacacagaggtttgacacatcgtttggtggactatttggcaggcgacgacgcaaattgcacgagttcttgggaagaaggcgcacgggtgcgggtggaccaagccaggctgacacggttaggcagctagcaggcggctaaaccaagggcagaagatctggtctaatcggtgcagcaaacagtcggtttgctgttgaatgtctgagatcggatcacaagacgagattgtgaagacgaatacagacggtactgagaaaggcgagtattctggtggcgatagaccagtcaggtcgcgggttggcaagttggcgc

SEQ ID NO: 13951 - DNA, 1501 bp, Oryza sativa
ctcgggccgccggcgtgtcgtgccgcgggccgtgccgtgctggcccgctacagtagccgtgccgtgccgtgccggcccgcgggctcggccagcggcccaggcacggcacggctactcgggccgtgccggcacggcccgttactgtagcaggccgtgccgggccgtgcctgctacaggttcggccgtgccccgggcggcccgtttggcccggcccatttggccacctctacacaactctactaactactacaaatgaacacagccatagtttgccaaaaagaatcacatcatagctaaataaatgttttatgtaatatatatcgagagaaaaaggaaatagggagaactccaattgccccgagagtggtgatctcacttaataggaatagccctatgtcaatatggtataagtgaactcaggataattttaaaccaaaacaaatacttatagaacctacgtggataaaataaaactgaaacgactaaattgaacttttggtgaaacttaaggaattagatctattcaccctaaaaaatcagctaaagaaatattttacgaaataatatatcaaacaataataataataataataataataataataataataatgaagaaaaaataaatatagggaggagaagtccaatccccaagagagcggcgaagaaagaagaaagagaaacacgggtgcacgcgctttcgcacccttcctttttaaaacgccactcccggccaacccggcctctccccatcctctccgtctcctctcctcccttccaccacgacgcgaccgacgcggcggagaaacccgcgaagccgcagtccagccagcgaggggccgccagccgaagctgaagcgagagctagggtttgctccaccccttgaacccgcccgcgcccccgccgccacgaggccgatcgaggtgcgtgccaccgtaatctccgcgcgtgtttgtcgtggggttgggttgggttgggtggggtggggtttggtgtggatcagggaatgcgggatctggtggggtttcgtgcctcgctcgctcggggatttcatttggtggggtggtggtgatcccatcctcccccactggattttgatggatgcgacccccttccgctgaaatcggagggattttggttgccatgcgctgctccttctgtccgtacggttcggtgaatcgggagttgtagattggtggtgatgatgacccagtagttggttctgatgctcaatactcgctgcgatttcgctcccctttatccaagggaagggaagggagaggggcttcctttgcgttcaaatttagcaaagtaggaattgtgtgagattggtggtagcgctcacttttttcagctctagatcgttagttctgcataccatgaagattcttgtatcaggagaagattattatatttattctgtggagaacgatatcagagatgatttgtgggggtgatttttggctgatttctgctctgcagggttctgcttctgaggct

SEQ ID NO: 13952 - DNA, 1501 bp, Oryza sativa
agtgctcgcgcgagtctgtcgtggcggcatggtggttctggcgcggaggcggcgaggcggctgctcccaaatgagacagatcgtgagcgcattataacaaagaccaagcgtccatgctgcatcctactgtactgtatcactccctccattttgattgaatgggacctattatattaccaatctaaggaggtgtttattagggggtgtaaaattttagtgtgtcacatcaggtattatatagggtgttgtatggagtgtttatgcactaataaaaaaaataagtatccgacagtaaatatgagacgaatttattaagccaaattaatatgtcattagctcatgtttactgtagcaccacattgccaaatcatggagcaattagacttaaaagattcgtctcgcaaagtagtcacaatctgtgcaattagtatttttttaagcatatatttaatacttcatgcatgtgctcaaacgttccatgtgacatggtgtaacatttttaggtgggatctaaacaggccctaaacaaaaaaaaactaggatacattgtatttaaccaaaatctattatattttaaaacggaagatatagaggctagccaaaataaatcttactagcgtccaaattttgataaactgacaatattatcgtttatcaaaatttttataagatttcttatctatttacctcaatttgacgagaaactaaatacatacacatctttgataattttagtaaaaagtaatatggtttaaattttaaaataatatcaatctgaatagcccatagtattcactgttgagggtacgagctgaattgaatggctccatagtactagtactgaaacgactgatccagtagtcattgtagcaacagtactgtagaaggtaggactgacggactgtggtggaagtgtggatggatatacggccggccatcatccattcattcgtcgtttcctgtatccaaatattccataaaaacgaatctacgatcggatgtgacatattctaatacgataaatacgaatctacaatcgaatgtgacatattctaatacgataaatctgaatagatgtatatccagatttgtagtactatgatgtatcacatccggtactaggttgttttttatgggacggagggagtacacctttaccttttgtcctaaaataaatttatttttcacaaatcctacatatatcaataaaaagttttaaaaaatatttctacaatatcaaatcctaatgtaactatttctcattttatctactctcaatattatttttttcacttttataaactttaatgtaataattactttaaaaataaaataagaattcattttgagacaataaaaatggctaaaaataaatttattatggaacaaaggaagtcctttgacaatgcatatgcgctaaaaatctgggactattaggccatccccaataaaaaaactatcaaactatcaattagctttcatacatgttattcatgtagat

SEQ ID NO: 13953 - DNA, 1122 bp, Oryza sativa
tgtatacgtgtatacaaactttgtatacgtacatatacaaactttctctccgtatcttttttttatacgtgtatacaaactttgcctacatgtatacaaactttttacacatacatatgaaaaaaccgaaaaaactggaaaaaaaatatggatagaaaaaaacggtgcaaaaaaaaacgcggaaaaaacagaacaaacaaaaaaaaaaaaggaacgtgcgggaaaaaaggaaaccgaaaaagaaaagaaaccgttcgaaaaaaaacacggaaaaaaacagaacaaacaaaaaaaaaaggaatgtgcggaaaaaaaggaaaccgaaaaaaaaaaaaaaaccgtgccaccgcctgtgccactctccacgcgcgacacgtgtccagtcgcgcgagagaggacgcgcgcgactgatcgcgtattagcgttctcgatcccgacccgttcagtctgggtgaaacactgaaacctccaaacgccagtcaccggcggcactccgaaaaggcaagtcccaacccgttccagcccaacccagcctccgcagaagagcccaatagattcaccctcatgggtcgccccgccggcccactttgcacgcgagtattgcctgcgcagcccaacactcggaccgtacagcccacagaaaccttattgtcggccaaggcccaaaggcatctcaaaacactcgaattccggtccgcggttgcacaccacaagacagtcggcagaagagttttttgactcctcaatccattgaaccttcctgtccccttccttgatgcaggttggtaattacaccgaacagcgacgtctcatccaagtacgcttaaatatctcgttcatttcaacattaactgctcctgttcgtcgaatgcaaaatcggcagacagagaccggacgaccattctcgaggctaaaaacgtctaacgttgaacaaagcaaagcaagtaattgccatgtacagatgtactcgttggtgatgacagtgacggaatccccatgttgacctgctcgtctactaacccaaggttagcttatccggtgttgattaaaccggcggcgaggtagtagtagtagtagggctttgctctggtcttgcaagttaggttagtgattagtagcagc

SEQ ID NO: 13954 - DNA, 1501 bp, Oryza sativa
tctaatagtgacatgtgatgctgaaagaaaaccatctacattaattttgctagagagagaggggtcgatggttgcgtgtgtaaacaaattagcataagaaatgtcttaattaaaagggaaaattggaaccatgccattataattttgcaaaatttgagatatgccatcctgacccacatcattgactcatgtaggtcctacatgtcattgagatatcgatggcatatcttaaactttacaaaattataatggcatgattccaaattactaattaaaacgaccacatgcgaaaaatataacaatttacacaggaagacatcttaggttgcattctagagggcaggtttggaacgcttgcctcttacacggaaaacagagcgatccattagtacataattaattaagtattagctaatttttttttcaaaaaggaacaatatgttttttttaaaacaactttcgtatagaaaaattttgtaaaaaacacaccgaaatagtagtttgaaaaacgtgcacgcgaaaatcgagaaagagaggttgggaacctagacaaacgaactgagcctaaggcaacactaatatgaggtagtcttaaagacactcaatgctcttaattgcccacatatgatctgtcttttagttttcgtttagctcgcactactaaaaaggagacgcgaatgttagggaagcaacatgcgcaacaaagaattgtcatgcaacatgcacaacaatattatttgtgcttccaactaatttgcacatataattcgctatattttgcaaaaaaaaagggaggaaaatcacaacatgcagttttacgtggctacgttgtagactagtacgtggtagttcgatcaagcatcatgtctacgttgcaaaaacacgtttgctcatcgctttatatcacagtatcacgtgatagagacgctagagtttgaaacaatcggaagttgccaccacgattttgtgtggtaaaatgtcataatctagatatttacaacccatcatttcacttatgcttataagctaccatttaaatattaaaatttaattttaaagttaattttatgttttttcatcataatgaattttacaacagttgctctaaaatattttatttcaaatcactaactatcgtgtagataccgtgcagataagtataaacataatcgaaattctagcacggaactgcgacaaattcctcatccacaaacacactgtctccaacgtggacacaccaaatcagctatcgtgtttccatcaaaatttgtcaaacgaatcattctttcaaagaaaaaaaagaaaaaaaacattcataacttgaggcgtgtgatcctgatccgtccacgtcggctttcggttttcggccgacgcatagccactgacaggtgggtccaccagattcacatgaagccacgtgtcagtggtcccggtcagaagggacacgtgtcaccgaacccctcttaaatctaggagtagtagtagtagtcgccagcacctc

SEQ ID NO: 13955 - DNA, 407 bp, Oryza sativa
gtacccacttatagttttacatatttcacaaaattttttgaataagacgaacggtcaaatatatgctaaaaagttaacggtgtcaaacattttgaaacggagggagtatatacatcttcatctcatcaccaattaatcaaccactaccctttgttgttgcgcctttgtttgatcatctcctgtctccaaatgctttaatttaatgcatgaccaaagctaaataaagcttccatatgactgatggcctgcagtgcatgcaggcgatcgatatgcccaggctttttgattcatcaacacacacacagtacacgtacacgtacacgtacgttgaatatatatcaaaggcgatatggaatcaacaccacgatgattagcggtgatagatcctgatatgatcctatatgata

SEQ ID NO: 13956 - DNA, 890 bp, Oryza sativa
gtatcctgccaaacctaagaaactgcgaatttgagtgactgtcttgggttgcttccaatcagtgacggcggtcactgtttcggggtccacagcaactcctttagcagatatcacgtgccctaagaatttgacttcggacaaccagaactcacacttgctaagtttggcatacaattgatgttcccgcaacttccccaacaccagacggagatggtgctgatggtcttcctctgattgtgagtataccagaatgtcatcaatgaaaaccacaacaaacttatccaagtattccatgaacatttgttcattaagttcatgaagaaagcaggagcattggttaaaccgaatgacatcatggtgaattcatacagtccgtatcgcgtggtgaatgcagtcttcggaatatctttttcacggatgcgcaactggtgatatccggaacgaagatcaatcttggagaataccgtggcacctttaagctgatcgaacagatcatcgatccggggaagagggtacttgtttttgatggtgacttcattgagagctctgtagtcaacgcacatcctcttcgtcttgtctttcttctccacaaaaatcacaggagcaccccagggggaagtactcggacgtatataccccttttctttcaactcttccaactgtttcttaacttcggccagttcatttgctgccatatggtagggtcgcttgtacagaggagtggttcctggagcaagatctatccggaactcaatctctcgtttgggcggcataccgggtagttcttccggaaacacgtctccgaactctctgacgatggggatttctgacagtcctatctgatgaagttctgaactactgacagaggttgggggtgcaaagaaaacaac

SEQ ID NO: 13957 - DNA, 1501 bp, Oryza sativa
gtccgcgacggctcgtcttcctcttcgctcgcgcgctgcgtgccttcgtagacgcctgcgaaaagtttcgaccgagcagccggtctttccgccacctcggtacgtgttcaatatgttgcgcagtttgatctgttcatgttatactgtgtagtttacatgtgtagatctaatgatgcgttcatgctatttttcatctgtaatgtcatgatctatttatggaatagattaaatcattatatgcttataatctcaacaacagatgcttaaatagaagaggctgtatctccatttgtattgtaatattttacaacactatgattctaccaaattgaaacgataccgatcccatctaatatttaaattagtttacatagtattttcatacggttctatggaatcttagatattacattgatttctatgatctttataatcctacaaaatattattaaaaataatatgaataaatatgcttaagtttacataaaactgattaatttttttaaaatcaatactatatactataatttatacacaacacacacacacacacacatatatatatatatatatatatatatatatatatatatatatatatatatataatataaaaataagtactttctaaaatttgttagtattccaatcctacttagcatctcgatacggattacctttggatggagtggagccaattgtccctgtgtcacgaaaattgaattgacgaaaaataccctccgtgtgagtgtgacgcaccttacatcccagcacagagggaggtggagagcacgaatctcagcgcatggcctgcaccaaacatgatactactcggtgcagcagttagtgggcccgcattgccattggctgcagggaccagcggagtgggtagcaacgacggacggcgcaacgtgtgggcacgcgacaccgcacagcaaaaaaaaagggtaaaatgtcgggtgcaggcacaaccccaagtaaccaccactgaccaaagggccccacgtaccatcctaccccacctgtcagcgtgcgtaccgggtacagaacccggtgcaaaaaagaacaaaccagggccgtttcacgctttaccagcctggcgcgtcgcgtccgtccacatgcccccgcactacccctcccctccacatggcgcgccacacccacgagaccaccacgtgcttgaccacatgggcccacctgtcattcactccaagatctccggcccgggtcacgcgcgcgcggccgcattgattaataagggggaggggaaaaaaatctcccgtgggccgctgcaggtgggctccacgttagctccgggcccacgtgtcatcggctatgtaataataatataatataataataataattgcagtatataggggggatatagtcgcggtcgcggggagccctaggcgagcgagggagaaagagagaggcgttggtcggtggccgcccgtcgcttctcctcttccgacgccggcgcggccgagagaaatggcgg

SEQ ID NO: 13958 - DNA, 1501 bp, Oryza sativa
tgggaatatatttctaacatgcgaaaaacggaacggtccattagcgggtgattaattaagtattagattttcttttttcaaaaatggatcaaatatgattttttaagcaactttcgtaaaaaactttttgcaaaaaaaacgtaccgttttgtaatttgaaaagcgtgcacatggtacacgaaggaggtgagttgggaatgttcttttggaggggttgggaatccctcccacggagcgatagattaacacatgattaatgaagaattagctatagaaaacttaaaaaatggattaatatgatttttttatttaaagcgtgcacatgaaatgcgtacgtttactagcagattgaaaaacgtgcacgcgaaaaacgaagaatatgagttgagaactcatgggaaagaagtaaagaacacagcctaagagcaggtacaatagccgactattagccagctacaaacatattttaatgagataaaagatgaaagagaatagtagcgggttacagatatatagccagctgtagtacagactccaagacgtaatgtgtttatgacaggtggaatcatgtattaataatatagtaagcaactattttatgaattggctatagatgaatcggagctattagtaggttatactattaaacttgctctaatgatttcctcaagttgtttaatttttgagtaaatttcacaaaactacacgttttgtggtccaagttgcagaaaaaccacatacattttgacacttggcacttaagtatatatattttggttgtgtagtttcacaaaaccacactatcgatgaattgattcactcgcgagatgacgtggatgtttcacctaggacgaggacatggcatcctattactagccatcacacgaaattgataggatgccacgtccccatcctagatggaacaaccacgtcatctcatgggtcaatccattcatcaatagtgggttttgtgaaactaaactactaaaatatatatacttaagtgccaagtgttaaaatatgtgtagttttctgcaacttgaaccataaaacatgtagttttatgaaatttactcttaatttttttttacccaaaccagcatatataccatcaggaacgtgatcctctaacgtactgctccctaactttgagaggatgacatatgggccccacagctggtggacccacatatcagccacgtaagagggcagtacgtcggaggagcctcttccgtgcaaaatgcctagagagagcgagctgcgatccaacgggaagcgcgcggcctcaaaacgcgggcgaagcaacggccatgggaatgccatgccatccactgcttgcgcgcggtggcgcggagacggaaggcggccatgggaggagcgcgcgccacctgacctaaggcaggaggaggaggaggacgccaatccaaggacggcgaagccgagagcgggcaaagcgccccgtcgatcgctcgagttcccccgtcccccggcccgccggcca

SEQ ID NO: 13959 - DNA, 1501 bp, Oryza sativa
gatgtccacaatatattacaaatagatcgagaaattctcgctacgtgtgtgtaaaactcagacccaaatttttgaaactcatgttcacaccataaaaacttgttaaatttaattaaatttggtaactttgtacaaaccttggccatctatacatgtaaaaccatttttgggttgaaccctttagacctaggttttaggggtttgattcttttatctttatattttaaagcgattctgaagatttgttagagtatatctatgaataggattaatagataagtggatcgaacctaaccgttctcatcgatcatcatgaaacataatcacgctaccaatatatacttgtagcgaaatagtaccacacaatctcgataggaagatgatcaaactgcaaatataatcacgctatcatttgcagtaggaagcaggagatgaaaagaacagatctactataagttgaaaaatcattcatttttccaagttaaagtcgatcgtggccgtggtcgtcgctctcctcggcgacttgatctcggagttcgccgttggagctgctcttggttgagggcatcttaaagtaggagtgcaagctggtagaccaacggatccactaaccacttgcgaaaggtaagtaaattaactaggcctatctcttttcttaaacttgggcctactttcctttcctgtatgggcctcaaatccagctccgctggatttcggcggcccactcgtctacttcacgtcacgtcctcctctctctgtctcccaaccaagaactcgtccacgtcacgtgggccccaaaaaagtgaccggggatgtagctggaccatgggccccacgcgtccgacgtggcacgcttctcctctcgtcgccgcctcgtcttctcaacttccctcggctcgcggcggcgtcggccgtgaatcctccgccaccgccgccgccgccgccgccgccgacgagccctaccacgatcgcctcgccgcattcccggggagattccgccgccgtcggcttcttccccgtgctcccgcggcggcgttttgagctctctctcccctgcgggttttccgccctttttgggcacggatgagtgggatcacattgcgcgatctctagctcaagtctcggatttccggcggttggtaggctcgtactaagctgcctaaatctcggatatcctttttttttctttctaataatgctggattaaccctaaatttcggcgagttggtatccgattcctacgctgattgagtgattgggttggatcctgacacggaaggggaaagtggttgtacaagtcgggaggaggagttggccgtttcgggaactgattccttgctatttttggctacaagttcgccgccccgggcagctgcttggccgtcgcgacgcagccgcgtctgttcgatcagttcagctcgcgcggttttaggtggggaggaatcctgttcgatttcgccggttgcttgtggtttcgtgtcggaggcgggggcggcgatga

SEQ ID NO: 13960 - DNA, 1501 bp, Oryza sativa
ttacttctttcccatgagttctcaactcatattcttcgtttttcgcgtgcacgtttttcaatctgctagtaaacgtacgcatttcatgtgcacgctttaaataaaaaaatcatattaatccattttttaagttttctatagctaattcttcattaatcatgtgttaatctatcgctccgtgggagggattcccaacccctccaaaagaacattcccaactcacctccttcgtgtaccatgtgcacgcttttcaaattacaaaacggtacgttttttttgcaaaaagttttttacgaaagttgcttaaaaaatcatatttgatccatttttgaaaaaagaaaatctaatacttaattaatcacccgctaatggaccgttccgtttttcgcatgttagaaatatattcccaacactagtaaacgaacacaaccataagttgtggatgcatgattatgactccatatatgaggattcacattctgatgcccataaatattatgtactgtaataggtttagtgacatcggatgtatgctgctggtttctgtctctttgagcatatgctacgaggtgcatttgtaggggtgttagtgtggtgttacgtgcgtagtggtgtgtatatatatctgttgcgtaatcgtaaaaaaacaacttaaaaattaaatttgtctttttaatttgaagttagttataaatatttggcgattatttacgcttcaaaattcgtgcatatttcagaggctcacaggtctcctggtccggggcagttcagtttggccatacgtggcgtcatttcggcctttctgcgacggtcctcggcagggctccccgtccccgcgagccgcgaagccgtaaatccccggagaggcatttcctcgaacacctgccgcgcgcgccgtccgcccccaaaaaccctcgccccaaaccccgcgccggccgaagcggcggctccgtgcggatgccctcccgtcccgtcccggcgcgccccggccggcggtagtaggaagtggggggcgccgagcgtaagatgcggcgcttctccccggccgccgcggcgctgctcctccgacgctcgctcgccgccgccgccgccgccgcctcaccagcgctccgctcgggtccggtaatctcttgcctctttttaaagaaatatttgttcggtggattgaacctagctgagcccgactgcccgaggtttatgcatgggtgattccgaggcctcgttgtgaagggagattgcaatttggacgattggaatttgtagagaatggggttactgtgtgattaagttaggaatttgtctcccattagttatccccgagttaacctggagatcttggtgtcttggtggctcgtgagagcttgcatagtggatttgtgaagtttgagccatgtttaagcatttggggattgtcgtatgatttactttgtgttgttttaaggttcattcgcacagtgtaacatgccttgctttgtggcattcaaattgctcatttgaattc

SEQ ID NO: 13961 - DNA, 749 bp, Oryza sativa
cgctgatcatgctcgatctagtcaagaccaaacaagctggcagcaaccaatgatcgatctagtgaaatgtctcgatcgatccgccatcgacttccttgcagtttccaacagggtaattacttaacacagacgataattctgttaattagttaccatgtatgggtatgcgtatcaattagtttatgtagtaaatgtccacgatcagcttttccaaatactcttaactactataatttatctgaatttacttcttctaaaacactcctaaaaaagattggaagtacactagtcacgcataatcaatagaaatatttttattattaattttactaatgcgatttttatttgaaaaatcatatacttatttttcatatatttatatttaaagaattatctataagaaaattattattattgaaatcgagccagcccaactggtgttatattaagaagagaaaatatgtatacacaaggtgctgtcaactactccctccattttatattgtagtcgttttactctttttttcttgtcaaactttatcaaatttgaccaattttatagaaaaaattagcaacatataaaatatcaaattagtttcattaaatcgaacattaaatatattttaataatatgtttgttttatgttgaaaatactactatatttttctataaatttaatcaaacttgaaaaattttgactaagaaaaaagtcaaacgacttataatatgaaatggagggagtaattac

SEQ ID NO: 13962 - DNA, 820 bp, Oryza sativa
caccaccacccacagccaccgggctagctagcttccggccgcgggcgcggacgtacgggcggcgggcgcgcggcgtggggagtcgggccggtttgaccaccggggagacgtacgcctcgtgcctgatgggcctctcgtcgctcgctcgatcgatcgcagttgatcgggagctacggttgatttgcttggtgctcgatcggagatcgagaggcaggcgggcattattgtgcttgatcattgggtgcatgccctagataactactgtatccgtcctaaaagaaaactcaatctaataatagaatatggtacatcctaatacgataaatctaaatatactaaattgtttatattctaatattagattgtttcgtcccagggagtatagtgaagctgaaagttgttgtaccggctgactagtactgtacttgttcagagcgccaacgctgcaggacgtacggttttgattaagggattaattagctatatactacgtaactttcgacaggtgattaattaatctacacgcttgatgggatttgaggaaccaaataatactactactactactaatcatgcataaaatatggatatctcgtataaataaaaaagagaagttaaatatttgtatacacgcacgtacgcatgcattcaagtgatcaggaccttgatcacgggacacagccagccggggtccctaccaacaacactccccctaatcgatggttatcgcagtagtgggcacgccacacatgactaggtttcgcgctatttccacgacatgccatcgctgcccgactgccggccagccggccggccggca

SEQ ID NO: 13963 - DNA, 1501 bp, Oryza sativa
tgataggtgcatatgatatggtagtgtatcggtacgagattggtttattttgggatacaggagtagaagtttattttttatggcacaagtctcgttcacatttgttttcatatatttccaaaataaaaaatgtcttggaagctcgttatcgaacataacggagcgaataccaccaatagcaaaattctcacatatgagaatgaaaaaaaaacaatatttttggcgacttaaattgctgtgctatatacgcgatgagaaaaggtgacttggtcgcatgaatgaaacttataaaaagaaaaaaaaacataacgatgtgtttttcacacatatttataagcgcctgcgtttcactgtgtttttttaattaaaaagtaaaaataaaataaaaagcatatcgatttcaggactccccccccccccccccccaccaattccctccccttccccgtttcatctgctgcggccggactccctccacgaatcctcctccgccgccgtcgccgccgccgccgccgcaaggtacggtgtatgctgggtgccctctcctccgctctcctcctacggatctgctcgcttccgccttctctctgctcgttctgggaggacgtgtgatctgatggatgtttatggatggttgggagccgagggcgatctgttcttgccatgttagatctctgacgcgtggtgcgtagcgacgtgttatgttagatcccgagccttttttttttgttttttttggtctgagatttatgggggcggtgatcttccttccgcctcgttcatgaacggtttggatctctgatctgttcgttcttgttgttactacttgaattcctgatccgcgttactgcgtgcgtatcgtatccccgcgataattcagctcttcttctttgtctctgtgatctcttgcatatggtgctacaactacaagtgaagcatcgcataaggctcatttgtagatttgttcatgtctctgttgcctgttgatagtgtcatccaagtggtgttcgtttctaatgaagatgaagatgaagatgaagttgagttttaattatgacaaacttaaaagttggatttgtttgatattacaaagcaacttatatgtacgtacgaaacgtgttgtttagtagtttgaaagacgtgatgatggggattgaggtaaaatagaaacgaaaaccacctaagtctcacagtgtcgattcaattagaagatgcagtttagctagtctattagaaaactgtttattggtctcatgtcctttggggactgagtagattctacttcttatattcagccttttgccattgttatcctttcctatctgtcgtctgcaatttgtgcttccatcatatgatgggtgcctgtacttctgaatttcttgttgaacttattgatgcaacatgtttgattattgaactttgcattgtgtgtataccactagtgctgtcattctaatctttgaagcctgtattgcccttgcagagagctaaaacaagatgc

SEQ ID NO: 13964 - DNA, 1419 bp, Oryza sativa
gacgccgcgccacgcctacgccacgccacgcagccgctggcacgccacgccacctacttcgccgccgcgcgcgcaacgccaccgccgccacgccatgccgccatcttcgccgccgcgcaatgccgccgccgcatgcaacaccgcgctgccaccgccgttgccaagccgccaccgccgccgccgccgccgtcaccaccacgccgccatgccaagcgccggcccgatgccgtcacaccgccgttaacgaacacatgaacgagaacgaacacgtcaacgtacgttgccgcgagaacgtgaacgagaacgagaacgatcgaacgaacgagagcgacaacgagaacgatcgaacgaattaacgtgaacgagaatgacaacgaacgtgaacgagaacgaacgtgaatgagaacgagcgaacgaacgtgaatgtgaaatgcaatatatatatgttactttgcatttatcctaatacatattttttgtatcttgcagaaaagacgtgttgtcggagtcgtccctcaagctggagtggaagagctagccctagaaggaattcgtgcaggcaagtgacgtaataatataaatgattgttatatttgtaatgcaattaagaatattagacttgtaattatacttagcatataagattgtgtagtgttctaatattatttgagttttaatataagattattttattgcaaattagacttagtatgtaatttttgactacggaattggtgcgactcctagcaattgactattgtagtcttaattagacttagcatatacgcatgaaacacttagcatacatgactattttagtcttagcatgtaatattatttgagttttaatataagattattttatttgtaattagacttagtatataattattgactacggaattggtgcgactcctagcaatttacaattttagtcttaattagacttagcatatacgacagttacacttagtatacatgactctttcagtcttagcatgtaatattatttgagttttaatataagattactttatttgtaattagaattagtatgtaattattgagtacggaattggtgcgactcctagcaattgactattgtagtcttaattagacttagcatatacgcacggaacacttagcatacatgactattttagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttaaattgttaaaacataaatgtctcgtgacttaccagatgtttctagtatcaacaga

SEQ ID NO: 13965 - DNA, 1501 bp, Oryza sativa
ggccgctgagatgaagcagaaggaatggcgcccagaaggatgccagccagtgatcgctcgccacggagccgagggagaggtggccaagggcgtatatcgcggtggagtcagccagcaggtatgctagccagaggaggaacctaagcatggcgggggcgtcacggcggcgtgtccccgcgaggaggaggaggatgacctgcagcatgaggctccaggtgacaagaatttggataccccattttttccaaacatccatcagataatggaagaaatccattgccattttggtacgagctggtggctactgtgatttctgagcttagatgcttaaagccagccaagggcagagattgatgcctcatgtatatatgcatgttgttgcagctattagtagttccgaaccctcgaccatgctgcatctctgtgaagtcaaatatagcctcacccttagctagcctgttatttttccattctctctcccgagtgtagctcgactgattcgatttatgatggtgaaaccttttcaccagagtttaagtcctaaacttgaaatgggggtttgcatttacggctaattattgtttcagcgatatgccacatgtactggtcggtcgatagctagacgtccataataactttataaatcttaagataaatcagtccaatattcagaagcgatcatagggataggatgtgcttgtgtgcattcaaagggattagtgcacacgtgattatatgagttgacaatgttgtattgtgtttcaaaagaaaaatttttgtcaactggatcgtctgtgtttctctaggtcagatccatgggtatatttgcatgtggaagcgctcattgaataatgaagtccaaagatgaccaacgcaaattgttatatactatggatccgcacggaaacaagcatgttaaggagggaaataacaaaataatatttctataatataagcctatttgaaaacataactatattgcatacgtagtaagcccatatttatattttactaattgaagacatcgcggtttccatggtcttttatcccattatgagtgaccgtttactagaatctattccgtatataatattttttgcagatattaagttggttatcattttagtaggggagttggggtttgtcccatcaccctatctccttttatttcaggaatagaactcaatagctacgtgttagcggcagaagccagatatctaaactattttcattacggaaaaaacctgaaagatatctttgaacccaatgctaatcacacaacaatgtatatagtgaaatggtcccttgaggatcatagatatcgcctagagaggttaatacgtgtttcctataattaaaaaatttacattggatgttagataagagagttcaactggaccaattcgatcgaacacagagtaaataggaaccacctatacaagcaatccagtaccatacaaacaattaatatgatacccttcgatgagatagagcagattgt

SEQ ID NO: 13966 - DNA, 1501 bp, Oryza sativa
aagcttgatgattactacctttattttttaatatactagttaattataagccattatttttattaaatttcgtggaaggatttggatagggtgagctgttcggtttattataccatggtctttttttaagaaatcggtttttcaggatagatatttttatgggaagagagaagtttttaggataaagtgttggagggaggaagaagggcgactccctctttaagtattagatgacataattactaaagagtaaagtgtacggacaatccttaaacttgtagcagtgtgtcatctatatctccaaactctcaaaatgcatatgtaggacctagaacttatcaaagcgtatcatctaggtcccaaatcgacacatcccctcttgaatcctatgtggcgctgatgtaacctgccacatggacatgacgtgtccttttttttttcttcttttccttttcttttccgttttcttctcattcttcttttttttttcctttcttctgctcgggtcacagagaaaggagaagaaaggaaaatacaagagaagaaaaaaaggaaaaagaaaatttttaaaacggtcccatttgtcagtcaaaattatgccacgtcatatccgtgggacatgccatatcagcgccacataggatcctgaaggggctgtggtgatttcggacctagatgacacactatgacaagttctgggacttggatatgcattttgagagtttaaggatctagatgatacaccgctataagtttaaggaccgcccgtgcaccttaatcattactaaaagtgcgtagctagggttcaggaagagaaggtgatgggtaatttaaaccttgaagaagagacctggtatttttagagaggtgttggagttaagaagagaatctataattgaggtttgatgattcatatataatggttggcccaattggcatggaattgaggaaatggaataagatcatatggatgttgtgttctcggctaacattagagccggaataataaaactctaaactcaattcaggtgtcttatatatcgtagccatatcacctacacaattcttcttaaaaaaaacttatttcaatattccatccacattgtgtgtgtgatgaggaactaggtcccgatcttccgataggtactgataactctcgatttggtggaatcttgacacacacgatccgacttccgatcaacacgatttgaaccttgcaatcgcagcaccacatctcctttggttatcaaccatgcgctgcccaattgaccttgccgagaaggctaatccctatgtatgcaaatcgaagaacacaagcaagaacaaggtagattgcaactcaatttcatataaatgattcagtactcgaatttggagtttcacaaaccgaactagcggcgaaactgcaataatggtagaaataatctaagcaaaagccgactcgaaattatgacagatactgaataaatttgataagggatatcctatggttgccctagaa

SEQ ID NO: 13967 - DNA, 1501 bp, Oryza sativa
ccaaaatttaatggacgtttacaaaacagtcgcattgctggtaaatcaactcaataattatcactacaccacatctgttcaacttaataattaataatgattgaaactttgtggtgtgtaaggagtctgagtgtcctgtcattttcaaatttcaacccaacgttagtattaaatgaatagcctaaatttattgacttaatattgttttagagccatgattaaaatttattgacttaatattgttttagagccatgattaacttcttaacttattgacaatttagagaagcaattattagttcagaaaagaaggtcaaccatatacaataatttcaaaattaagcaaataaattaaaagaggatgataatttattagacatgtttaaggttaattttttataatctagcgaaagcactagtggtgcagtggagtcatggatacatgacttcacccaggtcataagaacacaattatgtacttttaataggaacttagtgatgtgttaagagggtgcactcatgggtgtgtgctcatcagctcatgtaagcatatgttcatcttctgtgtaagtgcgtaagaattactcctaccagatattgaagtcagtttgagatttcaattagaactgtgctcaatctataactaactagttttttcatattaggatgaaaaattagattgtgagcagagtttgaagacaagagaaaaaaagttgaacttttccgttaccagattccttatgacgagaaatttggcaaaaatttcgtccaaaacaatttcttttaaaactataacgccccctccaagtctgggttcatgcatcctaattagtcacatccccataaatctcaaatgccataccgatcaggtcatgcaccaacccgtatttctttcaaaatttctagattggcatcagtaggttctattttttgacgcaacagtaggttctatttcatcgtaaccattgtgtccacagaaatatacgtacgccgtatataccttttgcttacatccatggcaaaacacagagccagctgaccttcgctttactggcactgaatcattgaaagcaatttgcctccattttctccacgaatttccctatcagctttgtcggctactgctaccatgaacaacccaaattaaagccatatatcaatcaaactataataaccgagagagcctggtccaagatgaacagttaaatacaagctactagaccgtttcgaacatctccatcatgttaattctgtcactcgttaagtcacacgtcctcatcacgctatgaatgcaaggctcaatttttctcttctttttttttcaaaccaaatatgagtagggagattgactaggcaaattcaaaagacttcggaattcaacgtacgcgttgatatgaaccacaattgagctgaaacagtataaacagtatagtagatcatttgcattgatcaaacagtaacaaaagtacgtacgtgtcgccgcgccgcgccgcagacatga

SEQ ID NO: 13968 - DNA, 1501 bp, Oryza sativa
atccaatccacaataggcagatgggaaaggcattcaaccagaatctgtgtgtgtccctctcgctttttttccttttgtcacgtcgagtcgtcgatgctgctgctgctgctgcggaaagagggataagcatggggagatcacgttgcgatcgtcgtcaaatcgatcgatcagccgcgacattctcgtgacatttttctgttcgatcgcaacgtgcgtgttcggtcttgagtcttgacctaaaaactagatgccgttttacttcctttttttttttctttttcactttggcgacaataacaggaaagcaaatggcaaattcgtttgtggtacccatctaatacattaataacaagagagagaatggataatgcaattatttatttttatgggaggctatattttttatcggattttagtaaataacggggcaattcggtacttaggtaaagctacgtatgactatcgctaccgctacggtacttgaattggaattcttcgatagcatctgttgtgttgttgcagttagggtacttgaatagccccagccgtgaaaacgaggggttttcgcaggttttataggattgccaagttagactagggcaattcatgttcacggtattgtgtagtatatgaaaaaggagatctcccaaacaatttataattttgtacaagggagaaatcgaacttgaggtgtctaattcaccaaccgagctactccctccgtttaatatacgtatatacatatacacgtatatacacatatacgtatatacacgtatatgtatatatacgtatatacacacacacacacatatatatatatatatatatatatatatatatatatgtatatatatatatatatatatatgtatatgcgtgtatatatatatatgtatgtatatgcgtgtgtggacaatgctaaaaagttttataatatgaaacggatgaagtccctatagttttctagcattgtgtagtatacgaatgcacaattatatccataaaattgatattagatattcgtcgcgacaaaaataaagacataatatacggtataccatttatccacgatatatctaaattccacttgatcccttttatggataaattctggataacaattactaccagcagtatatcctactatcagcgcactgcacaccaaactaccctcacccagtagttacaaacgcatattttgccgttagttaattattatccggtaaagaagattagtagtaatccaaaattttcccaaccccaacctcggaacaaaaaccgcgtagtatttgtcgtaaccaggagcatccgagtcattaatttacacccaaacacaaaaaattagcagcacgcagccgccttcccaatcctctcctcttctccaagcggcaattcgcgcgaggttttctccgatcaaaccctcgaatccccccctcgcgaatccatcggagggtagccccgcgatccgcgtcggcgagagcggattccgattccgcga

SEQ ID NO: 13969 - DNA, 1501 bp, Oryza sativa
gtcaccaaagctcaaaaactccaaaagcaaatgttactggtgtcaggtcaagcaaacggtacaagccagcatagtacatacactggctgcttgccaactccgatggcatcttggatttcttggtctcttgcaggtttttgccttgtcattgtcctgtcctgctgctccctactaggattatgtcccacacaactcaagacaaagttcaaatctttctccctaagagcaagtttaatagaatagccaaccactagctccaattcatctatatatagtcaatctaatagctcattcatacaatagttacatactacactatcaatacttggtcccacatgtcatacacacactgcgtcttgaagtccgtgctacagctggctacaaatctgtagcccgctgcccttctctctccttatttatctccttaaaatatgtttgcagctggcttatagcctgctattgtacctgttcttaatgctcactctcacagttaagtactatactgttccctaatgctcacagttaagtatcctgtttgctccagggtgctagcacctactccatccgtccttaaaaaaaaagcaaactctaggtttccgtgtccaactttgactgtccgtcttatatgaaatttttttataattcgtattttcattgttgttagatgataaaacatgattaatattttatgcgtaacttgtctttttaattttttatataattttttaaataagacggacggtcaaacgttgtacacggaaatcagggtttgttttttttggtacggagggggttgggcatgcataatagtactacactaagattatgcaagaaagaacgtgtcttgctgatgatgagttcttctgaagcaacatgccgacatgcttcgaggttaatttgattgcaagattcttttattcagatgcatccatgtatacatgcttaaagtaacagaaaaataataatcttgatgtgctaccagtagtattactttcagtaaaaaccaagtgaatatatgtataatccatcatggtaatggtaagatcgaaacgtgcatgtgatgatcaaaaagctttttggggcgaaacaaactgccagataaattacccttcttccagctcggatgatccaagcgccgaggctggtggtaaaaacagaacgatcgcagcatccaagagtggagtagatctcaccctgactacgggccccacctgtcacaccccttgagagacagagagaggagaggaggagctcctcttcacaagaaccaatggagatatactggtaaagataagtttttttttttactcctggttaagttagggcactgttagagttagccagtgaggtgtctgatgcgagcagaggaggacgaagaagagccaagtcgccagccactagcgtctgtgctctgtgctgctgcctgtacaaacaggaacagagagacagagagagagcacccagagccaagagggataaagggggagaagaagcaaagaag

SEQ ID NO: 13970 - DNA, 1501 bp, Oryza sativa
attgggccgacccacagttgtaagctgttgcctactggactggactagaatagagagactttcagtttcgtgcaaataagcccatatgtatattttagcccaatatagtctataagcacccaatgagcccatagtaacttctagcccaataaacccataagtattttctgtctcttcctcgtttttccgttaacgtacataatgctctgttctcgaaagaaaaaaggaaaaaaaaaacgtacaaaaggtgtcggttcgagacgaaaacatgacgaactttacgtacgccggccgtgtacagacaaagcaggcttcagataactgaaacgacgtgtacaaaacgaacacggtcagctatctacagtatcagctacgtgcttgtcagcggagctctctctgtaactctgcatgccgacgtgccaccacgcagccacacacggacggacactagtagttgcgaattcggcaagaccgttgggggtttggtcgtctctcacatcgagctagccagcgacacgatcatggggagattggcccggacgccatggacgagctggcagattgatccagaaataaagggggagacagcgacgcctgaaattaaattagtgtttcgacttggctaattatgatcggttgataagctgaattagtttcattggttaattaggatgagaatggtcagcctgttaccgtctttttcagcttgtcttatctggccgatgttgcattattgattttctttttttttttgtttatccatcccatttggccacgattaggcatgcaaaacgattctgtatgactgtttttatgtgcaaggtgtgtggagcacgtggctgacacgtcggctacacagtttcaaagaaatgttaacatttgttagtaaatgcttaattaatcacatcgataggattatcagcatttcagtatgaaataatcgccaaaacataaaaaagaaaaccaagtctacatcaaaacttaattaatcgtagggccacgtgctctttgctcatatgctcatagggagtgacaactggcattctggcaggaagcgaagaaaaggggaatataccggtattaatactgcattactatccagtttatacaaacaaaaggcaattaattaatgtgctaaaaatggattagtatttgttagtgctaaacaagatctaaattatctaatcatagccaagtcaaaaacagtgaggagtagaataatgcatgcatgcagaaatactgtaggacctggagccctccacgtgtcccacgacgtcccccccgggaaccgtccagatcgagcgagcgccacctagttccccacctgtacacatactcatccacacaaccaaacccaatttagtcaaattttacccaatcgccagcgagagcttgctttgatttgatccgcgcgcggagaagacgaagcgagagagagagggagaggtggaggaggctagctagggttgcgagcgatctgcagcgtgggagatggggaagg

SEQ ID NO: 13971 - DNA, 1501 bp, Oryza sativa
agcctgcatcgattgcagagtgttataaaccacatatccagagtgttataaaccacatagaaaacccgcatgtatggagtttattaaaaatttcagcaaagcctccattgtcattttgaaatatcttgtttgtagatcatagggaggctttgttaattaaaattgttaataacctttttttggcttaattagtagtttttcatgtggttttgtggcaccttatgtatatatgtggatacctacaatattaaaaaaaagcttaaagtgatggatatttatgacacaaaatagctcgagctcgaagtttcagaacaaaattccctcccgcgaaccacttacataccctccatagagaatatcctccttgctaaattttgccaatatctgcaagtccaaaatttctgaaagaattcgacattgtattgcggaattttgccggcactgagttttgcactatttttccgataggtttgaaaccctagacacagaacaaaatatagatggatccactgttcgattgagtcaagtgtaatacactcaagaatgaaatgaaaagaagaggtagggtgcaccagaaatcaagcaacgggccggcaatatacgtgcccacacaatccactcatgactatatctatctatctatatgtatatgtagctccattattccatatgatcaatagggccgaaagggaacagcaccgaatgtgcaagagatgctcccccattaccctaatcatcattcattcatgtatagctcatcctactaatcatttcacactagttttctttctttctcctacatgcctgatcactatgtctctgtatcaacaattttccgggttaccggatctatctatgacggggtgtggtatttcgactaattcgcttgatcgaacacaaaaattccacattactaatttattaaagccaattccatgggacataataatttaaataaaatactccacacccttataatcaagccggataaagttaattttttaaaaaaagaaaaagaaaacagtgtaaatagccgataaccagttaacattggcatgtggccacgcggcggggggaatagaatatgaacccggaaaagcgcgtaacgcgagatcctactacagcctagcatagggcttgggccgtggtgggtgggccccacactaagaaaaaacgcatgggctgccaccggatccgacggccccggtgcggcgtggcccggcgaccgggggatccgcgtcgccgccgcccgggccccacctgtctccgccccacccggcatcctgcccaccccgacctccatccatggcgttctctctctctctcccccctagctataaaacttgcactcctccaaaccctaccccctcatctcatcacagccaacgcatcgtcttccttcttcgtcgtcgatagatcggctctcgagctcacaaccacatcgatcgtctccggcaagccgacgtacgtacgactagctagctagagaggaagcgagaaa

SEQ ID NO: 13972 - DNA, 1501 bp, Oryza sativa
cctattactccggaatctctttgtccatttgcttccggacgtgcaccttagtgaagattcgattcaaccctggtgagcagtgagtgatccataataatatgcaagaacaggggtggtcataatcacagatgaacatttgcagaggttttggtatcccaagtctgaaagcaagcacacattgaatgggatgacacctaatgcaaatgcagtactgtagactgtagaggatgtgtcgagcacaaaatatacattgctataagctaacagtatcagattactcgataaatcatgggtggacttgtcaacattacgtttagagttgcgctggttttttcagtacactttaactccttggaatggagaaattttacatgaactgtacaagattcgaactactaattcttacgtctcaaagaagcccttatttcctttcttttctagattggggaatcaatcacaaagcatttcgtccatgaagtaacaatacaagggaataatttgtactgctaacattagcaaagattctttctaacctcacaatctcgggaagctgagaaaagctgaaaatcctagcttctaatttttgcaagccagctttttcagattgtacaagaaactggtccgtttggattagatggagaagctaggaagtaatagagggagcttgtctcagctgcagcttttcccaaaagctgcttctgctagaagctacctcaaacaatccacagcttctaagaatctgtagttatagattctgaaaaatgaactaagaagccagaagctggagaaactgtgtttcagagcttttccagattctcagaagctggctaccaaacagctgcttctcagaatctaaagctcccccaaacaggaccatagaagccccccaaaattccaaagcacttcacaaatagcgcaaatactagctaggccacacctgtccaacaacaaggatttttttcttttttaatttttttaaatatttacagaaaaattatatcgacgaaaatatttaaaaaatagaccctaccgcctaagtggaggacggaaaggtgacgtggcacacggcgccgtgcccttgacgccctctgcacgggcagcaagtgggtgaaatgcaattttcgccgcatgcacctgctcagcggcctccagcgccggctcacacacgtcaccctgccgtcttggggagggctgcagggtctatttctgtaaatattaaaaaaaataaaaatgaaaaaaaaaatccaacaacaagagcccatttaggcctaaatctgtatgggccgggacccatatgcgtcgtcctcgcagctaacggcaacagcccatctggaccaaacggggcagcccgcgtcgcgtcgccgagcgtgagagacgacagtgacacgtggcataaaacgacgctaagcctatcccgtcgaaaatatccgcccgcggccgctgcttcgccgcaatccccttctccgcctccgcagctaagctaagctcgccgccaccgcca

SEQ ID NO: 13973 - DNA, 1501 bp, Oryza sativa
ggctcggtcccccccatcttgcggagccgtttcttcttccgctccccctcgggctgcggcgtcggcacggcaccctccgggcgcctgctgctggcacgcaccgccccgccccctcggggaggagatggggaaggggtaccctcctgcttcctcttcccccgggcgtcggcagggcggctgccccccgggcccccgtcgtggggcccagaagcacgaccccctcctggggtagattgttcccccctgcggctcccgcccgcgccatcgtggccttggagggcccgctcccccgacgccccgaccgcctgcatgatggtcaggatgttggcgcgctctggatcgcagcagagggggaggactccttgggggatgagggatgcctccacggagctgagattcagcacccgttggaccaccatcttgaagtcttcagggacccagtcccatttgcgcccctggtgggtcctcatgtagtcctcggatccggtgtactcccaggcgccccgggcgcgccgctggagcggcgcgatccggcgatgaaggtagtcgccgaacaccatggcccccgtgagcccctgggatcgcagacccgccaggcggtcaagaacggcgtcgtagccatctcccagatctaccgtcgcccgccagctggaggcctgcgccgggggctggctcggaagtcggaggcgcgcttcgtcggcgaggggggtgtagaaccagtcgctcttccagtcgtcccacttcttgcggaggacgcagggaatgtagcggttcagcaccggtccccgcggctggaagtagcagccaccgactaccgacggcggcgacaccggctgtacggtgaagaaccaccggaacagccggagagatgggcgcaccccgatgaacatctcgcacaggtgcgcgaagatggccaacgtcattaccgcgttgggggtgaggtgcgccatctggagatcataaaactccagaatatccatgaaaaaagaagagaatggcgggaccagccctgccattgcgaaggagaggaagaagacggaccgccccgggtagtgtggcgccgggcgtccctcgcccagcgcgaccacctcccggccggtggtagattccggcatgaatcggcgcggcagcccggctgcctctcgctcacgatgcgggaaggcggcagcacgctaccgtcgagcggtgcggagccccgtgccatgacgccggcggaggaggagcttgagaacgagcgagtgcggcaagggtagggcgcaggaaacgaagagttagagcacaagtggcgaaggcaaggggaagtgtggcgagaggaaggaaacgaatcccttcctcggcgtctttatacccttgccaacgctatgcccggctcctcgcttcccgcgcccactatctcgccccctcgtttctcacgcccgcgcctccactgaccccactcgcccgtttgcggcacgcgcggcagatgtgcggccgtggcggttgagatgggacagatcgagcg

SEQ ID NO: 13974 - DNA, 1501 bp, Oryza sativa
tttgcaaaacttttgggatatttttggtccaatgggatggatgaattgatgtgggttgtgatggttgaagtattatggctgtttttattgaaatatttttcgtctcgtaatggcagaacattcacaatgcatatgcgacaaacatttggtttttgtaaatattctttgtaatacaattatattctttagagtaaaatcctaggtagctcgtctctgtatatacttacatttctagttacatataaaattgttccaatttataacatatttttgcaggttttgatacatgtcggcggtttggagagaaaaatggatgtgaatgacatatatgtgaatgggttgtggatgtgaatgtatatgtatttgattttgtgaattggttgtgctgtgatggaatatgaatgtgaattggctgatgtgatgctgggaatgggtctatatgaaatggctgtgatggaatatgtgaattgatgctgggaatggggttgctgggaatgggactatgtatatatatgcttctgtcatttttgcagcgggcatggctagcaaaggcctgaggctagccaaaaagacaaattttttttttctaaactcatccctgacgggcatttagctaatgcccgaaagagataactcatccgtgacgggctatagagtcctgcccgttagagattagtcatccgtgacgggcttttagaatacacccgatagagataagtcgtctgaactgggactagtctgactcaatacgtggggtcaaacctatcggtgacgggctctggctaaatgcccgatggagatgactactcatccctgacgggcttagtggtgttcccgattgagattagtcatccgtgacgggctccttattacgctggtttgactggtcatactcatctgtgacgggctttgttttcggcccgattgagataacatccatccatgacgggattttgcctgattgagatttttcctcacatcagtgacctttgcccagtgacggtggccttacccgatagtgatgatgctttcagcccgtcacagataagcgatcccgttctagtgagagcagcaagcagtggacggcgcagccggagcacagcatccggtccacgcccgcagccgctgctgcagtcgccgtcgtggtgaactcgagcgccgccgtcttccgttgcgcgacccacgtctcgccgtcggagttgaagatgtcgtcgccgagcaggtcacggaagacggcatgccagaaggggggccgccgccgccgttcgccgtgctcgcctccccgcgttcgctgcctctgccgccgcctcacctcgcatcgccgccgccgcgctcgtctccccgcgctcgccgcctccgccgccgtctcgcctcgcctccccgcgctcgctgcctccgccgtcgccgggaggagagagagagtgtgtgtgagagatagaatagagagagaatgacatgtgggtcccacattttttaataaatagaatgctgactggactgc

SEQ ID NO: 13975 - DNA, 1501 bp, Oryza sativa
tgattaagctggtgttttctggcgcttccatatacttcatatggaaaaatacaaagccaatgcacaagaaaatctttattttagcagaacagaggggaacatgtgagcactcttaatttgtgctccattatgtacaatcatgtttatgatttaagatactgtatactagatgggtatgaaaaagaaccgatatgcggtctttgtggaattgtgagacctgtatacaggggcgaagctagcatcaaaacaaggggggtgcactaccattgagaatctagaaaatttcagtacaacattgtatattctagtctttttaagtgagaaattaggaatttcgggggttcatgtgcaccccccaaacactatatagcttcgccactgcctgtatatagcaagttacaaaacggaattttgttgtaggtaaacatctgaagtatagtatttcacttgaaactaagtgatgatttggtatgttttggggagagatgattttagtgcttcattatcaaaactaacccagaatgttgtgagaactccaagatacctgtgatcgtagttagggttttgggcaactaacaaggtgtgttgtaagatcgtttaatgtccatgcggtctttagtttttgagtgatacatttggtagttaatattgatgctaaattggtaacatctgattagatctcactcctcacagttcttccgttcccaaagaaactgtatctcatagccttagccaaattgaaaagtagaccttgtttttatcatttttgtagtgagcactgtaccatattggggttccattgcggacacaatttttaatcataaatgtgtcaggctcactatgtgatagttcttgcaactgtgaacaaagtgagagatgatatcatgaattagtgtctttaatttttgcactgttttataacatatttgcatcattttctctcgcaacatcatggctattatgttatttaactcaggtcataaaaatgttcgactgtgtgtcaaccgtcaactgtgaaaatgccatgataatcagttgcattcatcattccctagcccaatgttctcttcatgatttattggaagaatgcgttgctattttaatgttttcttaactgacatgtttttatggtactttagataacttgctatgcagcacatgtttaaaagtgtagtagttgatctagttaggtatggaatgtggcttcggatggattatgagatatgcgtatacgaaatggaccttgtctagtagcatttgtgagtatctgatgctagatgggattgcatttactgatttacatgtgtaatgtttttgagattttactaaagctcttcaaatatagctaaggtgttgtggaggtgactacattatttttcatcagaagcaagggcattatgcttgttttctggtttggttttgtgcatatatgctttggttttttaaaatcgtatttccccatcattattctgatttagtcaacattttgctatatcacagg

SEQ ID NO: 13976 - DNA, 1501 bp, Oryza sativa
gagcaatgtacccaagttagtgttttaatccttaaaacctgcttaacaattaaaatgtggaatggttggcctgggttggcttgggacgagctgggacccagggtcgggttgccagtttggtctgaatcatcgtaggccttgggttaaggcaggttcgtgtgggttcacggccttgattaataatcttgtatagctctaggatcatatttacaatatagctttgagcaactaagtgtcttttagtgctgtttactacaaaccctaaccccttatatgataacccccttgtactcccttacatttattctgcacttgtgggtgtgtcttgttgagtacggtggttgtactcagtcttgctcaatttttcccaaacccagaagaggagtttctggaagatgaaggctttggtgtctagctcgtgcctgccgtcaagcgcctgtggtcgtcgccctagtctttcgctgtttcccgtttgtctttgtgtgctgggccttcgccgcccatgtaataaattaattatttacgcttccgcttgttaaactctgaattgtatcaacttttagtgtaccttgcctcctgggaaaaggaataatgcacccacgtaaggaacgcccgttgggttatttccggtcgtgacaggcggtgacgaagcgagccggccgcgtggcggccgtgcggcagacggtggcgatggccatgcggcagcggcggagcgaggccgccgcgcggtcaggcagcggcggcggagcgaggccgcctgtcgggcggcggacgggcggcggcggccggtggggccgcacccgatggcggctggcaggtggccggcggccggcggcaacggcatcccatttgcacatttgtgtggataattttgtgattcattgcacgtttgtatggatctgtgatgtatttgatatgtttgtaatttttgtaggatttgtgatatatttgaattgtatgtataagtaactttaagatttgggatgttactttgatttggggatttgggtttgatttgggatatatcccactcaattcgggagaaaataaaaaagaaaaaaaaagaaaaggggaccatcttactgccgcttccctcaccaaccgggactaaagttccctttctttagtcccggttgataacaccaaccggacgtgaacgaaaaagaaagagattagatagatagattacgcggttgaaccaggactaaagatagcgatttttagtcccggattggtagttccggttttaaaaccgggactaaggggggttacaaaccgggactaaaaagcacttctccaccagtgtactacacatgttgtgaaccatgataatctcaggtctaaggattcaacagcaacactaaatgagatcactgatgacacaatacatatggctcttgcagtgtctcatgttgggtctatccaacaacatgttcaccaacatgtgtccatattattaatttggtatctctataccatgatccatgagacatgatcatca

SEQ ID NO: 13977 - DNA, 343 bp, Oryza sativa
ctttgtattgtctgtctatgcccgtacgtgttatggttgttggtactgaaagtgaatttcatctttgttaaagtcttttgatctcatataaaactatgttttcacctttagtgagtttcggatccttcataagagtcttgctcccttgttcatagaactatggcattctaaatcaaattaagaatatagtaataaaaatatgttctatggtttaaattgttataagccattttgttctaattaaattgaggcatcaacacgtaccttgtactggggtaatcattctctatttaagttgttccatggctatttctttttcttagaacaatgactaatcctgcca

SEQ ID NO: 13978 - DNA, 996 bp, Oryza sativa
ctggcctgggcttatgggccgggcttgccctgggctatctaaggaagggcccagcattatgtgggggaaaaagtataccgaggtcctctacttgtcatcgagttacaaaatcgtcccctaaacgcaacatgagacagctgagtcagtgtgagacccacgtgtcagaatgccacttcatccccctccgtctctttcccctcctctcccttcctcctctctctctccctctcctctcgggcaagctagccggcgggtggggatgaggtcgccgacaacgggcgcgaggacgagggggtcggcggcgacaggggtgaccgggtcgacggcgttggattcggtgacggcggtggcggtgatgttgaggacgttggagatggagatggcggaggcgtagagcggtggggagcagcggaacacgaggtaggcgtcgcaaggccccgtggcggtggcggaggtgacgtcgtactcctgctgcgcccgaggcggcagccgatggccctcgcccgcgccgtgccgcgacggcgaggagaacgaggaggaggacgagcgcgagcatggcgccgccgcctcggatttgccgtagcctcttcgccatcggcgaggtctgcggccgctgccaccaccaccaccactagggctcgggctccgccgccgccaccactcagccgcggcgaggaggacgaggaggaggacgagcgcgagcactgcgccgccgccggccaccgtcgatggctgagaggctacggcgaatccggatctagccgcctccaccatgggcgccgggtgccccagccgacgccgtttcgggcggcggcgagacggaggggaggaggaaggtgtggcggtgaccggcgcgcgggggaggaggaaggtgtggcggtgacctggcggcggccggcgcgcgcgttggatgcggacgcgcgtcgctgtaccggaaccgcctcggcccgctctccacgaagaactcctcgtcggcaagctcgtcgtacaccatct

SEQ ID NO: 13979 - DNA, 1501 bp, Oryza sativa
ggacacaccaaagcaccactacctaatctgcattttcttttccttttatttaagagaaaattccttgtgtgcccttcaaaactcacccaattccttctgtaccctgaaatttactcaatcctttctatgtcctccaattttttttatcccttatgtacccctaccattaggtttccttcaatggactggttagtttgtttgcaaatgttcattgtgccgttgagaatggaggagttgctggaagctgagtgcctggttggcagagaatttgataaagtttgaaatattcatgagtgaatcataggtgtgttttatgagactaaaataatcagtgcgttgaaaatttaaaataattttcttcaaacaaatttaatgcattgaacttttgctatatcatgtactagggcaatggatcctaaaagggtactatgaaaattttaaaaatgactggacattatgatcccatccatagaaaacactgttaatgcataattaacgaattacttcataccatgcgtacaacacattaccatttccatacacaaaagcgcaattaacaaactaaataaacaagataggaactgtttatatcatgagcatcattgccacaacagtagtcaccccaatagcaagcaatcctgggcattacggtgctatggtagcaaaaatcctgagcgggcttttctacgctgaattgttttcttgaagttcccaaattatctcctttattttctacatgcacattttttcaactaccaaacagtgcgtattgtgtaaaaaaaatatacaaaagttactttgattatttttcagaaaaaaaataatacttaattaataatatactaataaatcgttctagctgcgcgtagttcccaacagcaagtatcgaactcagcctctgtggtggtctccattgctctgcctgcacgtgccaattgcagcataccaagttaaagcgaaagccgaaacaagcttggatatgaaacaaatttaggcaccatgcttttaatctggaagctgaaacaaaactttttttatgttgttgacctctttgctctcaggacacataaatttcagtgcttgtcaacttttgtttatatttggaataagttcatctaaggtcccttaacttgtcaacgaatccgattttcgtccctcaaccggaaaaccagatacaacgggtccctcaactatcaaaaccggtgcaaattaggtctctcggcggttttgatggcggttttggctgacgtgacgcctacgtggctaatttgacttggtcttcatctgatgtggcattgatgtggcgcttacgtggcaatttgatccggaaaaataataaacttcgcgggacccacatattagtttcacacataaattaataaagaaatggtggggcccacgtgggcccccctccttcgtcctctttccccacctcccctctcttcatctctcccctctcctcggacatgcgggaggcagcggcggagaccggcaatgccga

SEQ ID NO: 13980 - DNA, 1501 bp, Oryza sativa
aagtttctcaaatggtactctcagatcacttaatgtgtataattcctcacgaatgcattatgttgcctcgttttcatcctacgtataaaaggatcatatgtcgagctcaaggtggaaaaaaacatgaggcaatacctgtatcacacatatattgcaaaatcaaaaagaggatccatggagaacacaaataccatgtgatcaagatgtgcaactgtgtggctatatggtggaaagtgtttggtggtaatccttgtcatagactctcttttattcctaatcggagacatgactattcttcttctattttttgtcccatgctgctcaagaacaatcgtgcgcatacactcctttttcttttttttttctttctcataatgcttgagaacattttctattttctatctcctcttttttttcctcttctatcacagtcatctcttttgcaaactaccatgtgagacattttttactgacataaatggagcatttatttggtagatggaatgttgctaatccccagtgtagaggcaaaacaactatggtgggtgtatgacattttttgctaacctccaatgtagaggtcaagcatatatggtgggtgcgcatgtgtgaccttgattaataaagtacgaaaacaatctcacaagggtcacaacaatttcaaaaaactcaatgcaataacatgtagcatatttgtaaaggttttttcattgtactcatcatatggttttggtaggaatttttcatcattgaggaacttacaaatttttcattcttttgaaaataaggactccggagttcaagtatcgcttggagaaatatcatagagtctctatttcaccatctcatatcccgtaacaatttagacatagatcatgcgtgtgcaacccacaagtttcaagttcaagacaaagattgttatccaacaaactcaaaaacttaagcaaagactaagttataaactaagcactggaggaaacaaaatagagaaactattcattatttcaactattagaactagagcattcttaggctgagttctttctcccgctttcccaactcacatctctcgtttttcgcgcgtatgcttttcaaattgataaacggtgcattttttgcaaacattctttatacgaatgttgctttaaaaaatcaaattaattcagttttgaaaaaaaattgctaatacttaattaatcacgcactaatgcaccgtttcgttttttgtgtggtagagatggttcccaacccgaaggagcaaacacagccttactgaatatggaaagcacatatttttggtatttttaacttttgcaaatttttataggtttttctttttaaatgcaatgcattgaaatatatatccaaattaccttagtgtggggatcctcctccaagctagggattgaatccctttgactggaaaggccaacatgttagcctgacttttctgtacggtggcgctgatgttcaccgactggccatcggtatgctgctgcca

SEQ ID NO: 13981 - DNA, 796 bp, Oryza sativa
tgtgcttggtggtgacgagcagctgcgagaacatgaagcggcctgaagatggcggctgctgcttcccggcgaggtcgtcggagaagatgatggcgcagctggtgacggcgaaggaaccaaggttggaggggcccttcagatgcgggagaacgtggtgctcgctggtgatagggttgaagaggccgaggaggtggctggtcgcctctgaccagtcgttggagggggaaagccgcatcaggaggatgccgcggcgcgccgtcaggggctcgccgtcgtagctggaggggatgggggcgaagcggcggcgccggcaggaagccgaatgtcgaggccgagttgcgttgccggtggaagaagaagccgaggaggtcgccggcgcgctggccgccccagaggtcgcggaggaaggcgcgatcggtgaagcggcggcatgttgcggccagcatgaagaggctcttgacgttgcccacgcgggagaggacctggaggaggacgtcctccggcaatgccgccatgatgtcgttgtccgccatgggtgtgtgcacgtacgtacgtgcaaaggcctccgcgattgcatctagtagatgtattgcattgtataggagggtgaaatctggtgattaaaaatcaaaattctcatcttaatctcaccatcaattctctcgtgtaaactcccaatcctcttccctcgagttgcaaaacaagctgtgaaggtcgccgctgcaggccgaaacgcggctggatgttgggcctgtacagctgtactggatatcaactcttggtgatatctatactt

SEQ ID NO: 13982 - DNA, 483 bp, Oryza sativa
ccacatgcgcggccctgaactcctccacgagaggggagggagagggagagggagagggagggaggaggaagaagagaagggtgagaatgatatgtggggctcacgtgggccccactattttttattaatttgtgtgtcaaactgacatgtgggtgccacggggtttaatatttttctggatcgaattgccacgtcagcgccatgtcaatatcacgtcagatgaagatcaagtcaaattagccacatagacgccacgtcggccaaaactgccctccatactgccgagggacctcgtttgtccggttttcgtaagttgggggatgggttgtacccggttttacagttcagggacgaaaatcggactgagcgacgaatagagagacctaaagtgcacttattccaatccgtaaagatcccgaactcccgaaggccagcccattccgcggctaccatacacactagcgtggttacttttcataatat

SEQ ID NO: 13983 - DNA, 950 bp, Oryza sativa
tcccttcgtctgtcaccaccgccaccgccgccactccccaccgccgctccggccggggtgaagagaaacgctgggggagagagggaaggagggaggaggaagaagggaagccgggaaggagctagagggaggatgacatgtgggtctcacatatcaatggatcccacaatataattttttgtgtgagtgacatgtaggtcctaccttttttttatttttattctaatgccacataagcgccacgtagaacaaagacttggtcaataccgccacgtaggcgccacgtcagctaaaatcaccgagggatataatttgcaccggttttgatagttggaggagtcaatttacctggttttgtggttaaaggatatgaatcatactcggagctatagttgagggagtcaaagtatatttttccatcccaattgtcccacccacctgatactaccatcacgcgacgcgacgccccacggccggcggcggcgcgaatcgcctaccgcccgctgcacaggggcactagacacacatgggctgatgggcacatgacttagcccagcattctcgcttacatatcttatgttgttttttttattaagacgtggattttaccaaggattttattagtatgttttctaaaccgctaaacaatatgtttttcaaaaaattatataaaaataattttaaaatatcaaataaatttatttttaagtttgtaacaattaaaacttaattaatcatgtgactttttcattttacgtatgctaacttaatctatatccaactctattttaattatatgttaatggcttttttattttaggtagactatcttaatcttcgtccaactctattttttaatttttaagtttgtaataatactgcccaacacggccaggatgaagcgtcgatctgaatttctttttcaattttgagggcactctccttctaga

SEQ ID NO: 13984 - DNA, 1501 bp, Oryza sativa
cgttcaaacgggcggatttgcccccgcaaatctcgccggcgccattgatggagcccgagagcgccgcgccggtttccttctcctccggccgccctctctcgctcccaaccctatataaaccatccccgtgcctccctcctccgtttccgccactcgccgctctctctccccgtcggaatcgagctcgcgccgtcgccctctctctccgccgtcgccgccgagctccggtccgccgccgtcgtcgccccggacctcctcccgcttcggcatcgcctccttcagcttcgccgcgtcctcgccgacctcgtccactcctccgcttcgcccgccgaccgccggaacgccgccgtcctcgtcaacccgagccgcgccgccgctttcctccgctccggtcgccgttcccgtcgtcgccgtcgacccggggtgagccgtggaccgccgtttcatttcccccttccctcgcctctctcgggcgccgctccgccgcgccggtggtcgccggcggcgaccatcggggcgcgggtgcgccgcctcccgtcggctgtgccggcgaggccgcctttgggcgcgccccgcggctgccatgtggggcccggccgtcagccgcccgcgccctcgggtgcggctgacgcataggacccacggcgccggccggtgtgagccgggtgcacctggtccaccgtggaccgtgaggctgccgcgtgggccccactcccgtggacccggtccgcgcgcccctcccctcggctgacgcaataaatccgattttaaattaaaatttaaatgaagaaattcgcaaatatccatttaaagagcatataaacttcaaatggccatatcttggccatttgaactcggaattggaccgttcaagtctctaatttttccttaagaagtcaagaacccatttttgtgctttgttcctgcttgttatatggagtttattagagtaaaagccttttcttttccgttggtcgtgtagacgctgcagcttcggaagatccgctcttcgtggaagttgaagccgacgtttgggaaagcgagcaaggcaagtcacatcatctttgagcatattgaatcccagtttataaaattatgttgattcaaattattgcattatcgctttatttaaattcccgcgttatcactgttttatttagccatgcctatttacctttgttatgaccttattattattgttattgttattattaccttgttcaccctagaataaacaaaacctcaactagtggacactctactcatggcaccactagtttagttttaggtagatgcttcgcaatttaattaggtaacattaggtggtttttcaactatagaccttgggaaatattcatatcatctggatactatggaatggtttggttattgtggaattggcttcacaccgctccttctattcaaaatccccaaaatggttttaggctgggctcggggtgcatggttttgatagtagcacctcggccatataaggaccggt

SEQ ID NO: 13985 - DNA, 1484 bp, Oryza sativa
aataagttcaccggatatctctcaacttaacagcgagattttttgaggttccttacctgtaaaaccagaaatgtttacccctaaacttattcaaatcgttcaaaggaggtcccatggcagtatcgactcaatttttgcccggttttactgacgtggcatcctagttaacaaaaaaataaaaataaataaatatgtgggacccacacgtaagtgaaaaaaatatggggtcgacaatcctaatcagcaatctcctttttctccctttttctcttctgtttcgttttttgggggagcggcagcgggtatactgcctcgggaccttttttaaaggggcaattttgtttctaaccctatttgatgtctaatattgattttacccctactttttaggattttcatttttaccctcacttttttgaactgaatgcttgttttgcccctactttggatggtgaagttaatagtgttaagtaattgacaaaatggcatttataccctctcatgtatgttcattaataatgtttttgtccccattttatacatgtagctttagaactttatttttgggagtatatttaaaattacatgacccgcattgactaatataacaatttggacaaattctgaatttgatggaattttgacaaaatttcagcattttgatataacttaatcaacattttaacaacattttataaaatgtaattatctgttcctttagatactagtcaatgtgcttcatttaattttaaatatactcacaaaaataaagttataaagctacatgcataaaatggggacaaaaacataattaatgaacatacatgagagggtataaatgtcattttgtcaattacttaacaccgttaacttcacctctaaagtaggggcaaaacaagcgttcagttcaaaaaagtaaaacgaaaaaagtaggggtaaaatcaatattagacatcaaaataggggcagaaacgaaattgtcccttttttaaatggttttacatagtttagggatacacatttctagttctatggttaagggacctcaaagaatgttggtgttaagttgaggtatctccgttgaacttattccctctaagaaaaaccgaacccatttccagacggaatgagctcatctcaggtcccttaacttgtcaacgaatccaattttcgtccttcaactaaaaaaaccatacaacgggtccctcaactgtcaaaaccagtgcagatgaggtccctcggcggttttgagagcggttttggctgacgtggcgtatacgtggcaaatttgacttggtcttcatatgatgtggcattgacgtggcaattatgtggcaaatcaatcccaaaaacaaaaaaaaacttcgtgggacccacatgtctgtctcacacacaaattaacaaaaaaaggtggggcccacgtgggccccacaagtccctcttctcacttcctctctcccctgtttctccctctccctgctagc

SEQ ID NO: 13986 - DNA, 1501 bp, Oryza sativa
gttaagttcatgttcgcgttcttgttaacttcacttttcgttcacgcacgttcgttcgtttacgtacgttcacatacaacgttaagttcacgttcacgttaggttcacgttcgttcacgttcacgttctcgttcacgtacgtttcgttcgttcatgttcgttcacgttcgtttgttcattcacattcacgtacgtttcgttcgttcacgatcattcttcgttcgttcacgtggcggcagcggagcggcggcatggcggcgcggctgcggcttggcgcggcttcgtcggcactgccagcgcgacgtcgtggctagtggcggccgcatcgaggtcagagtcggcatcgtcggcgcggcggagtcgtgttcggccgcgacgacgtcggcggcggcgtcggcaacgaggcggccggcggcggtttggggagagagagagatcgaggtcggagagagagagagagggaggcggcggcggctctcaccccagagatgcggcggcggcggaggcagcgatgacgacgcgcgcgaagcaacggcgagatacgacggcggcgtcggtgcggggatgccctatggagtggcggcgaaggagaagccgagagagatcaatcggggaaaaaacttctaagtgttggtggagaagacgagggtgcgcatctggaatatatatacacccctagatctttagtccctgttgttctcaactaccgggagtaaagatatctttactctcggttgttctcatcaacggggactaaagatattttcccgctatttccaaattctttttaaacccggttagggttaagaaacgggactactgataagcgcaatgaatattaatttccattacatatgtgtttctaaaatagaaaataatgcattaaaattatttaaagtcgaaaaattaatgacaattacttcgaaacattattgttgtctatagtaaattaagtggataaaacgtaataagcaaatatatgatttaaaattaataaaaattctaataaccatatatacttagcatatgaatgatattaaattgttaaaaattgtaattaacatatgtatatacatacgacatgcatgatttaaaattaataaaaattctaataatcatatataattagcatatgaatgatattaaattaattgttaaaaactctaattaacatatgtaaatgccacatgcatgatttaaaacttttaaaaattctaattatcgcatataactagcatatgcatgatttaaaattgttaaaaactctaagtatcatatgtaaatgccacatgcatgatttaaaacttttaaaaattctaattatcgcatataactagcatatgcatgatttaaaattgttaaaaactctaagtaacatatgtaaatgccacatgcatgatttaaaacttttaaaaattctaattatcgcatataactagcaattacatgatttaaaattgttaaaacctctaataatcgtacgtaattaacatatgccata

SEQ ID NO: 13987 - DNA, 1501 bp, Oryza sativa
cccagcattgcactcaccaagctcaagctcagaggcggatccaagaacaaaaaaaaatttaggggactcagttacgcagtttatttaatctgcagccatttacagagctttaatttattattcatagtgaaaaaatcgaagaaggtgctcctaaggtatccatggattatgtgaatgtaggggggactcaagtccccctgcactcacgttgcatccgctcctgaccaagctaaaggcgttggatgattcatcacaggattcaatggcaacgagcagagtaaaaaaaaaattggtgcaaaaaaacctgatgaatcaggagcgggagtttgacgacgatctcgagctctccacgtggcaatgcgtgccacctggaggcggctgcggcggggacagcagccagccgagcatgcagctagctggagtagctaggtagccgtggggcccaccgctcgtcagatcgctgtggggcccgactaggattcaagtaagcgggccccagcggccgtacgtacgctctacgcgtcgagatcctcctcccctcctcttcgctaggctagctagctgtgcgcgcagcgccagcgactctactgtctactccgcgtcgggatctcaagagagagttctggatgactgtatcccatcaaccgcgccatgcatcctggagcgagagctgagtaaccgttcgtttcctactaaaagattggatgaagttctggttttcgtgatacgctttttaaactgctaaagagtgtgtttcatgcgaaaactttctatataaaattattctaaaatatcatattaatctattttttaaatttataataattaaaacttaattaatcacacgttattatcacctcgttttgcgtgaaatacttaatctgcatttcatcttcatctttctcttcaatctcctatcagcttattcagctatgcgtattccgcaacgaagaactgggccttgggccttacggcccttcagagaagagatagaccgcaagtggcctgcacattttgcaaaggaataagtttactgttggtcccctcatctggatgtagagtttgaatcaaatccctaaaccgtaaaatcggatacaacacatccctcatattttaaaacccgtgcaaatatagtcctaatacaatattgaaggtggtttggagtgacgtggcacaagatgcaaaaattaaaaacaaacacgtgagacccacatataagtgaaatagcaatcttctttcttatccccatctcactctgtcaggtgccggcaaccatgcggtcatgttccgagcaagaagcagcacagagcgcagggcagggcaggggtgacggtctcaatctgggtggcgagtggatgcgcagaccggtggcctcaccgtagcatcgccatcactagaggaggggacgggtccaccacggtctctaccaggccaacatcgaccgtgccgagactcctccacattcagatccacttttgggcggcactgtcatctccacgtc

SEQ ID NO: 13988 - DNA, 1075 bp, Oryza sativa
cacagtcatctcttttgcaaactaccatgtgagacattttttactgacataaatggagcatttatttggtagatggaatgttgctaatccccagtgtagaggcaaaacaactatggtgggtgtatgacattttttgctaacctccaatgtagaggtcaagcatatatggtgggtgcgcatgtgtgaccttgattaataaagtacgaaaacaatctcacaagggtcacaacaatttcaaaaaactcaatgcaataacatgtagcatatttgtaaaggttttttcattgtactcatcatatggttttggtaggaatttttcatcattgaggaacttacaaatttttcattcttttgaaaataaggactccggagttcaagtatcgcttggagaaatatcatagagtctctatttcaccatctcatatcccgtaacaatttagacatagatcatgcgtgtgcaacccacaagtttcaagttcaagacaaagattgttatccaacaaactcaaaaacttaagcaaagactaagttataaactaagcactggaggaaacaaaatagagaaactattcattatttcaactattagaactagagcattcttaggctgagttctttctcccgctttcccaactcacatctctcgtttttcgcgcgtatgcttttcaaattgataaacggtgcattttttgcaaacattctttatacgaatgttgctttaaaaaatcaaattaattcagttttgaaaaaaaattgctaatacttaattaatcacgcactaatgcaccgtttcgttttttgtgtggtagagatggttcccaacccgaaggagcaaacacagccttactgaatatggaaagcacatatttttggtatttttaacttttgcaaatttttataggtttttctttttaaatgcaatgcattgaaatatatatccaaattaccttagtgtggggatcctcctccaagctagggattgaatccctttgactggaaaggccaacatgttagcctgacttttctgtacggtggcgctgatgttcaccgactggccatcggtatgctgctgcca

SEQ ID NO: 13989 - DNA, 1501 bp, Oryza sativa
caccatgaccgtctccacgcacctcgcgagcttgcccgtctcgagcaccctgtcggcgccggtgacggcacacacgctgacgccccaccatgcgttcctttcggatggggaactataaaggcgttactatatatttgtattcctttcggatgcagaccctctttagtgctcatgatatagtagcagtagttcaggtgtacgtcttatggtctcagtgtctgttattatactaatggtactgtagataattctcattgattcctttatagtgcccacaacattcatatcactttttaagtgcccacagcattcatctcactgataaactaaataccttcatatcatccagagatctatcaacctccattacgtactcggagccagaaagctaacaagggttcaactgcagccaagttcctgaggcattagctgcgtacttgcatagatagatgtcactgtaggttcccaattatgtgtgagcgtggctatcatggattaatgacatgtctacgccctgaaatgagcaccccaagtctacaagagcaagtttaatactcctacgagggaattaatgggatcccacaccataacaagaaatccatgtccttgtgcatgcaactgcaaattaaaccaatactacaatgaacaacggtgttgctgctaacaaacaacactcaatgccaaattgccaatagtgatgtgatcatgtgaaatacaaaacttgtccatgcaattgcaaaccaatactacattaatgaacaacactgttgcctgtatagcaagcaacactcaatgccaaattgccaatggtgatgtgatcatgtgaaagacaaagtgacaaacccgggatcccattgattccctcataggagtattaaacttgctctttgagacttggagtgttcacttcagagtgtagacctgtcactaaggatatggattttttttttcacctaggtgcaatcccacctaatcatttacatgtgacttgaatagatatggaaaaatatgaaagaaaaaaatgatagtattgttcacaatggcacaagtctatacacaatcgagcaagcctaaaatcaatatataatcagaaaaacaaaaataataaaattagactgtaaacagtacctatctagcacaaatagaacttgttattttctcgatgtgcatgtttgcatagtggtttatatcatctttatctaccttgtcaaattttatgaaatatttatttaattacataggtgacatagatacactatgttggattgcatctacatgtaaaaaaaatacttttcccgcatgcacaacgacaaccctcctgtgtgcacgttacgcggaggttgtaaattatttccattttcacgtcaaaggattaattttttaggttaatttgatcgatgccattgtgacttaatcaatttaaaaaaatattattattattcacgatattaataggatatgctactaacattttacaaaattaaaaccatatatcgtcgtc

SEQ ID NO: 13990 - DNA, 1501 bp, Oryza sativa
catactataagccaactataagtatattttaaagatataaaggaagggagggaagagcagcggactacagatctgtagccagctgcagtacggacttcaagacgtaacgtgtgtatgacaggtgggaccaggtattaatagtatagtaagtaactattgtatgaattgactattacattggctatagataatttaaaactattaaacttgctcttagagcttaattaacaatgatgtcatatcaatgacatggccccgagggccaagctcagccagatatttttctcttcctgggaacctacaaaacccatgacgactcgagtcttcctggccacgaatttgatccgatcctcccgtacctcacctcctcctattcctgcatgcagcagagcaggtttggcttaggccgtcatctccatcctttcatgtgccaacgagaagtttctagaagaaggcgactggttatacgtgccagtttctttcatttactacgaatcctaattggtgtggcaaatttgtttgataaaagttttggtagcaaaagattagttattgaagttttgctagattgtatttagatgcatgggttaccatttttaatagtaaaagacagaaagagcacggttcccaacatactttttcgtaaaatttgctactttagaaccccaaataacaagtagtatggggacatcatgtaatagactggagtaatagtttctgtataataaaagatgggtaataattgcgtgaatggttgcttgcaaaatcaacgtatataagaaatgcagacaggccagccgggttagagtttttgtttttgttttgatcaacttgaacattgttaataattgtctagtgcagtaatgaagcggatacgggtgcgaggatggatgcgttttggtgcaggtgggcggtaggcggtagaagatcgatggccaacgacgagacgacgatacggctagcttagctgaggctggccgcccggccggggaggtaaagcagcagatgcatgtgaagctggctggctgaggctggctcgctcgctagccgacaacgtcatgtgatcccttggctcagctgcgcgctcgcttatacccaaccacaaactgctcgattcgatagcttcctcagatcagttgtaatcacaggacacttctgcccctcaatcagacaacactaatactgtagtttagggtgcaaaacagggaaagccatagcatgataggagtacggagtagtaccagccaaccataaaccaagcaggcaccccccccgtccttgtgaaagagaaaaggttttaaccgaccaaccaatatttggcacgcacgcacgcacgtagctcacacgggcacacacagtagtcgctcgctcatcactagcagctcacactcatcatccatcacacggaacaacgatgcacaacaacaatactctcctcctccactgtgttgtttagctgcagctgcctgcaggatcgaggagcaacaaagaatggggggca

SEQ ID NO: 13991 - DNA, 1501 bp, Oryza sativa
ggcaaggtccgggtgtggcgcgccgacgcgggggaccccgccgtgcaccgccgcgtcggctcgctcccgaggctcgccgactacgtccggagctccgtcaacccgtccagctacgtcgagacgccgcggcgccgccgcgggcggcgccgggaggtgtggctccggcactccgacgccgtgtcgtgcctcagcctcgacgagggcgccgggctgctctactccgcctcctgggacgggtccttcaaggtgtggcgcgtatcggactcgaggtgcctcgagtcggtgtgcgcccacgacgacgccatcaacaccgtcgccgccgccgggttcgacggcgtcgtgttcaccggctccgccgacggcaccgtcaaggtgtggcggcgggaggaggagccggcggcgagtggcggcgaggcgaagacgaggcacgtcctggagacggtgctgcgggaggacgagagcgcagtcaccgccatcgccgtctcggccgagggccgcgtcgtgtacgtcggttcgtcggacggggacgtgacctactggcactggatcgacggcgaggcgaggtacggcggcgcgctcagggcgcacgggacggcggtgatgtgcctcgccgtcgccgggaacgtcgtcgtgagcggctcggccgaccggacgctctgcgcgtggcggcgcggcggcggcgagcactcccggctcgccgtgctcgccggccacaccggccccgtcaagtgcgtggccgtggacgaggaggagacatcatcgtgcagctccgacggcgagcggcggttcgtggtgtacagcggcagcctcgacgggtcagtcaaggtgtggcgaatctccgacatcgaacctaccaatcctccgccgcggctgccgtcgccgcatgtatggaagagagaggatcagccggcggcggcgacggcggcggcggcgagggcgtggtcgccgtaccagacgtcggagatgaacagcgtggcagcggcgtgacggcgaggctagagctgatcactaacttgacacaaacgtgcgtgcatgcaagaacagtgtggggctcacacgtgtactgtagcagaagagtgtaaatatacgtagaatatacggtgcctgtacgtagattacgtatttgtcaaatgtatggatgcgaatgggtggcttggtcggagataccattttggtaggaggaatgggcggttagttgacagcgagaggtctaccagccacgtcaaaaaccaataatggaagggaaaaaaataaaagggagaaggttttgggaatggctttgttttgttgattttggtagtgatttaattaacgctctgtgtaagatgtacagatgtatataataatataaaagccaccatattaattttgatgtatgaatatattattaacagttcggttttggtggcaatcctcacctttaatctgttactacttctcttcagtcatctgtagtagcatcaaaggacagcagcatgcatgtattcttccctaaattaat

SEQ ID NO: 13992 - DNA, 285 bp, Oryza sativa
cccaagtttaatagtagagctaactgctggccataaatcatctataacttaatagccaattctacaatagttacatataaacatatactacacaatcaatatctggtcccacctattactacacaatcaatatctggtcccacctattatatacacatgcgtcttagagtctgtactgcagctgactacaaatctgtagcccgctgtcttttctctccttttttatcttcttaaaatatgtttatagctggcttatagtctgctattatacctgctcttagcagc

SEQ ID NO: 13993 - DNA, 1501 bp, Oryza sativa
atccatctatctatctatttatctatgaccattaaactttctataaacgctctcaagtcaccacgtggcattcctgcaaacgcttctaagccaccacatggcacggtctaatctcacagttgattttcacttaaattggtggattcatcattttacaccatcaaattgaatctattattaaaaaataataacttcctgtatacggtacaaaacgatctaccgttgtacgtaattcgtgtcgttaatttgggtgttaatgaatcaagttgcatatatacaacgttttgtacggtaaccaaatcaagcatattactcaaacttttttcttgcgaacaaaaaaatgagttcactggtacatgttttttctcgaagtgcaccggtacatgtttgggctgaattacagagttttctatcttctatctaatttatttatttattgtatactaaaagtccattaaactttctagaatcgctcttaaaccggcatgtggcgttcctacaaatactactagaccgccacatggcactgtttaatctcaccatcgattttcacttaaattagtggtcccaatactttttatctttagattagatgaattattttaaaaaagtaataattttcttatgtatattgtgggccggaaaaaataaaccaaacataagtacttcgtgtacgtacttacgtaactggaaaagaatcaacgaaacatacctactgtcacggaagaaaagaaaacctgcatacgtacttgcaataaaaccaataaaaccgataaagtaaaaaaacatacataacatatgtacgtagtgccatttaaaaaaaatcgatgatgattttctactatttaaaaataaaataaaatactctaaaaacttacgcaaatatacatagttaataaactaaatcttctacaataaaaaaataagttgtcctatctttgatatattttaaaattatatatctaatttgtgatccagtcacatgaggtcaacatataataaataatattatgataatattttaaagaaaaaaaatgatgaattataccttgaactattatgctcgattgaattatctccataaacccaaaagtcaaacatctttcatcttcaactattattaatattagacaaattacccgctgactcaacccaagttggttttggtcctacgtgacagtccagttaacattttcttcgaaaacaaattggtgagacccacctatcatatatgtccctcacccctcaccccactctctttcttctccctccacgtctgtcaatcggcaaggctaggggcggtgatcggcggggcaaaggagctcgagtggcaagtggcagaggtggctcctcctcggcatctaccggcgcgtgcctccttgatggccgtgtggcttcccctctacctccatcggcgcgtgaaaaggacaatagcggtggggcgaaggagctcgagaggcagaggtggctgagggcgttgagtggcgaaggcttctcctcc

SEQ ID NO: 13994 - DNA, 1279 bp, Oryza sativa
gggaaaggggatcggatcagtggatcgcggcctaagaacggtgcgggcacatatcagtttttccggtcgtgggccccacaacccgcgtttttaggcgcctgcctcggctgcaagcggattcagattgggtgagataggatagacatgtcataaggtgacatagcgtagatctcagctctccaaaataaatccaacggctgagattcgttcacatcatcatgagttaaaatttaactcgtatgagtaaaaattttactggtagttaaaatttcaggagttaaaattttattggagttaaattttaacttgtaatgacgtggacgaatctcagccgctggatttatttagaaggactgagatctacactatgtcaccttgtgacatacctaccccatgtcatccaatctaaatgcgctgcaagcgggcgctatgcccccaaaaaatgcgttatagcttggcgacaatttagtcgccagctcttctctttcccctcaatcattacccttccacgtagaaataatgtgacgtggcaattattggagctgatgggtcagccctattgtacctgctctaaatgatcaggtgggtttccttgtgcaagaattgttcgtagctagattggttaggcagccgcgccttaaggcctgtgggcatatggttcaaatcccttcgctagcgggcgagtttggctcatttgcatggcattcggttttggcgcgttgctgctcgtttttttttttgccttggttttcactggcgcgctcacggcacgctgtctggaccgacgcttgggtctcccatctcctgcttgatctatttaagacacgccacttcttaacgccacctcttcctcacttgttcatgtactgagccatccgcacatggccgatttatttcctgggttcgatctcaacgaacctgcggcagagcacggcaacggtaatgcatcatttcattgtttcattgtttccgttggagtatgaggaaattagttttgttttttgatattcacagcagtctcatgcaaattagtttccattatcagtgtgttctttcattttcgacaggatttgatttgaacttaccactaagatgaatatggtgcatttgattttgatttcgtacaaaacatcgctggtaagccgtggttattatttcctttctcagtttgtactttccatgtatgattgttttttaggtaagccgtggatattattttgaatgtgcttgttttttttcctcttactagaaccaaaccatcgaaagaaagaaatgacag

SEQ ID NO: 13995 - DNA, 1501 bp, Oryza sativa
ggggcatatcaaactatgcatctttttattctttatttgaagaaaagtaattaaaaaattgttgatcttatcttttctaaaagatactccagctgattaatattttatgtgctatgtgataattcatagatagtgagatattatataccgcaccaagtgttgagttccgttatgtttactgaatgtgctaacagtgttcttttatggtgacaggcgacagaggtgaagatgatttgggtagacaggttgggttttgacttgcatgttcattccggggaaagtacctttgctgcccggatccctttcacgagagaggtctctgatgagaagggagtgaaatcatcattcaacatgatgtctcatcatgcgtgggaagtagagaagagttatgcggccccagagtttgagaaggtagagctcttgaagaaagtcagataggtactgtgatttctatggtgccgccttaccctgcatccgttgtcagtattttgtcattcatacgagtatagcgcaacttttgtcgcattaaatgtattgtgtgtacctccattttttgccatatgtgctataggttagtcgttcttttgtggagagctatgaatctagactgtaaggttggaactttagctgtggcttcttcatgagatgagattgagataattaaatcatgtttatacgatcttcagttgtaacatgcaacgttctacgtagtcagaattgcagtggagtactggctttatgccccaagtatagagcacttttgatgtaactaggaagatagcccgcgcacatgcgcgggcatcttatctgatgttgttttaaattgtgttaagaatgttttatgtgggtgacttttcttaaaattattctttgacactattgtaaacgtgttttttcactaatttgttttggattgctttgaattttggttatgattttcttatatttacccttggaagtttaaattctaaattaaaattaattggaactacgctgttttgaaactatgagaaaatatgttgtcataataatggagtttgttcttataaaactatcgtttgtactatgtgtatttactttttaatatttagcatatcttatctttttttagagttttttttatgtttctatgctttaagtaacaaaattgcttttataccatatatatttatgaatgttaggatatattaagtgaatatattttctattaaacaatatggctaataggaatgtttcatctaattaaaaaaacttctattaatttacttctactctcttctctttttttttcatatgttttcttattttctttgaaaaataaaattgatttgaaagaatagcacaatcatataaatttaattagtatgtgtaaagcgtttataaaggtttaagtgccatgggctaaattgcagttttgttcgatcaattctttttatcaagtatgttttactgcatgcactctcataaataagtttagtatgatttccctaataaaccaatc

SEQ ID NO: 13996 - DNA, 1501 bp, Oryza sativa
cggagagagtactaactatcattgttgtgcggccagcaaaagccacggtacccaatggcaatgtcagcatgtgacgagtcgtttctcgagaaggaaaccgatgctacggagtagagtagtatctttttgaactgttgatgaaagcatgtacctcgagtcgaggtaaaataattcatcgctcgccgaatgtctttgccttcaaatggaatgtccgaaggatgtctgtctactagtcttcggtcaaaaggtgagttccattttccatttcccccctagtgttcgtgtgttgtccagcttgaagacggttgctactctcatctcatggcagttggcactgcagagatggaggtcggccggcgtgtgtcgactagagatctggctgtgtctttaacgggttacggcactgcggtttaagtccacattttctcgttgggccggaacggaacgggattgccacgcatgtacggcctgctatacttgggacggaacgggattaccgtctacgtgaggccctttctacttgggcaggccggaacaggattatgatgcaagggcgtcctgtattgtatacttcctccgtctcataaaaaaccaacctaatatcggatgtgatacatcctaatactacgaatctgaacatacattattccagattcatcgtactagaatattcatatctggtcatatattcattttttatgggacggagggagtagctggctagacgagataggtcccaactcgcgccctgtttttttttcccaagaatacgcaaaagagttgtgcatcattgtattaagactttgagagaagcaaattaatacaagattatagcactaggaggctatactcacgataaaagagaaaacacaccacgccacgtgcccacacaccaccacaccctgaggaatacacagccacctctaaaacgacgccttcaataagatcacaacattaaaaatgctgtcatcgctcatcccaaaaggataagattttcacctagaggatccctttgaagagggaagggaggcacctcgacaacgctctcaagaggtacctcgaccactcgcggcctgttttggttggcctggaacttaacgccacgtgtttcggaatgctaggagacgagatcctatctcaagcatccgcattgtatgttgggatcctttataaggtaggcaataagaaatgggtagggcaatctgcatctgttccccgatttcatcccctaactctagcactagcttctttgggagagaagcctccctcactcttggtcccagcgggttctctaccgcttaatttgaccttacacaagagccaataagttgtagtgtttgacggtattttgtgatcttataaatccaaggagtatttgtattatcaagacaagcaaacaaaggagctgctatgatcgtcgcattcgttaatatgtgagactgtatatagcttgctcaattgcatgggatgcatgagccatgcacgtactacatatatatgt

SEQ ID NO: 13997 - DNA, 1501 bp, Oryza sativa
tgtccagctgggcgagcaataaaatagcccgatcaatcaaacacgagccggcaggcgtggcagcgacaatgtcactccggcggcggagggggcccggggacggcactgatcgataaggctggtgatgctggtggacgagtcggcgcccgcgacgtggccggcaggcgggcgcgcagcggccacccgacgctagctggccggtggaatactagtatttgagatcgtcgtgctggtcaggaaatactagtatttgagatcgccgtacgtgtcttccaacagcgagcgcatgcttgaatgaatacgtcggtactactcggcattcggcaaggaaacgattgaggaactatgtgtctgtttgaagagatttgttctggtccagcaaaattattttaaggtaccggtacctcacggtaccaaatcgtttccgatcgttggattagctagacaggataagcatggttagattcaacaattgaaaataatttttttggtaccatgaggtatgatacttcgagataccttttattggaccggagcaaatctactggttaaaatgagacgatgcatacttatgggtataagatctaaagatctaatatctgttgacactaaaccgatatttgtcagtaactctcacaatatttgacgtgttgagtagttgttgatatcgacaatatttttttaacgaacaacaatagtgtgttgttttatattgatatagcataccaataatactttcatgtcacccggtgtgccgaaatccttatttccactaagttagaggaaaactcattgtccgaagcatgattttctcatgcatcttgcaaactaaaaaagtttaaaagatagagaggcagcaagggccacaattatgacatttactctaatcaaaagactaaagatttcaatcccacaaagctatcacatccaaaacttaggtttagttctggagacagtttgacttgaattttagtggcacgtaaaatcaaatactccatccgtcccattttaagtgcagttatgattttccacgtttaaattagatcgtccatcttatttaattttttttaaaaaaaaattaaaaacataagtcacgaataaagtattattcatgttttatcatctcataactacaaaaatattaattataaaaaaattcaaataaaacggactatcaaagttggacacggaaactcatgattgcacttaaaatgagacggagggagtaagtgattagcaaataatgaattgaatactaattattataggtgtcaaaatagatttacttgattcttttaaataaaattatacataaacttatgcacgaaatttagtagtttggtaaacgttcatgacagggatttttttttcagcccaacctccctcgagagcccagcatagtgtaagtagcattgttctaagtaactttaaacggcgacccatttgttgcacttgtgacaagaggccggttagttcctgcagtacattgtactcttatttg

SEQ ID NO: 13998 - DNA, 1501 bp, Oryza sativa
ccttttgattcctccgccaccggcggcgacatatccgtcaccgcgggaatcccctcccggagcaggagcccgtcctggatcccgcccccacctcccgccgcggtcgcccgcagtcgctcttgccagcttcgcctgccgcggccacactcgccctccgccgccgccgccgctctcgccggccgttgccccacccgtctcggtcgtcgaagaagacgatagaagagaagaaaggggaaaatagaagggatgtggggcccgcaccgttttctctcacttacatgtgggccccacgtactttatttatttatttttctgactagggtgccacgtacgcgaaaccacctatactgccaagggagctcctgtgaatgagtttagggcgaggttaagggacctcgagggacctccggtgaacttattcccgagagatatcatgatgggcccaactgcttacatacagtcgattaggccggcctaaaacttttccgtgtgttccaccggctgttgatggaataagtccattgtgcgtccctcatctcttgtgcttgtgtaaataacatcccccaaccggaaaaccgggtataacgtctccttcatctctcaaaccagagcaaatcacctccctcagtggttttgctggcggtttcgtccgacgtggcgttgttgacccggttgacaagctgactcagcgtagtgggacccacatgtcattctcacacagaaaataataaaaaaatggtgggacccacgttttcccttcttctcgttttcttctcctctcgattcttctctctgctcttcctgtcgatgctgagacagagccggcgctgggcggcgatgggcgtggcgacggcggcagtcggcgcggcgacggcgatggcggccggcgcggcgaccgagaagggcggcaaggcagaggcggtttcggcggaggcggaggcggcgcccgtgcgggccgactggccgcgcgcggggtggcgctcgggccgatggtggggactggggaggcgatggtggcggcgaggcagaggcggttggcgcccgaaggcggccacgacgcgataacgacggcctgatgaagacggctagtcaaaggagcgcgcgaggaggcggcgccccggaggaagaagaaaccggcggcgacggcggtttcggcggaggcggaggcagcgcctgtgcgggcctaatagccgcgcgcggggcggcgctcgggccgatggtggggactgggaggcgatggtggcggcggtgaatggtaagtgaaatggggaggatgatgtgtttggggattttttgtgggggattttattgcagtggcttcgaagagaaggaaggatgggtgcacagtggtgatggcagaggcgacgcagcggcatgggcgtggctcacgagggcacgaggtggtgcaccgggtgtagtggcgttggcaaggtggacagctgcggtggcgtcgtggagtccagatccagttggcaaagagaggaggaggaggaggaggaga

SEQ ID NO: 13999 - DNA, 1501 bp, Oryza sativa
aaatgtcggggcgttacaaaaaccagtcaaaatttcacttggaatctacttccgtcccatgccaaaaacctcaaaatttcacagatttcagtctgcttaattttgtcgaaaacataaacccacatggtgggagggttataaaattatgatcgatataaccacaattagcttactttatcttcgttatttctatcggctatataatcaacaccgatcctataaggcaccatggcaaatccagggttgggattagtcaggatgggaatgggtatggtcgatccatttattcactaaacctatccgtaaatttgtcataacggatttttagggtcgctccaaaattataaatggatcaaatggcttaaaccattagaacctagatttaaggggttcgacctaaaatgacttcacatgtataaatgtttcaagaatttgtacaaagttacttctctatataataaatcattcctacaaaattcaactaaatttaacaagtttttatagtgtgaacgcgagtttaaaaattttgggtccgaattttacacacatgtaactataatttttgaatcttagtaatgcggcatatataggggggcatgtctaaatggcttaaaatttgtacaaagttgcttctccatataataaatcatctctacaaaattcaactaaatttgataagtttttaaaatgtgaacgcaagtttaaaagtttttaggcccaagttttgcatacatgtaataagaatttgttttgtctactagtaacatagatgatcaatttggatatccatgtatatcctattgatataatagacttatgatgaattgactctattaaaccatggataaatgaacttacttaaaatggttaaaccaacgaggctggcccgaggcggtcgccggctcgacagcctcccccacccgcggctcctcgacgtgcctctttccgccacaaccacagtcgacgacgtactcccctcgcgacgatgacatggtggtccggacggaggtggcaggggtccaggcgacggcctccaacgatgccacccgtgcaaaagagggtggcaagacggtggtcagcgcctaagcggcggacacggcgggcgttcggtgtagatggaaaattcgggacccccggtgtttagtgtttccgaagccgaatcggatcacaagttaagcgccgattccgaagcagaaacgggacgagacaacgggctatataaccacggggcaacgagtgcacgcactcagatcagtactacgtacgcacgctcgcgacgcgatcaacccaacccgatcctgcgacatggaggctctgccgcagatacggcaaaccctcagcgagatcgaccgccgcatccccgacgccctccgcgtcgcgatgggcctccgcttgcggcccaccgccggcgccgcgctggaggaagtcacgaggatcgccgcgtcctgcctgcctcggccttgcccggagggcggcgacgaccccatggagtgcgacaagg

SEQ ID NO: 14000 - DNA, 1501 bp, Oryza sativa
ccgcgtgcaatcaataggggggaattattccccgtgattccctctatctttccccccaattttccctccctctctcccttggtttcgtttggaaaccctcccctaatcccgccggcgccattgatggagcccgagagcgccgcgccggtttccttcccctccggccgccctctcccccttccaaccctatataaaccctccccgcgcctccctcgcccgtttccggccggccttctccgctcgccgggaccgtctcccgccccggcgtcgcctcctccggcttcgccgcaccaccgtcgactccgtccaccccctcgccgagcccgcggaccgccggaactccgtcgaccccgtcgacccgagccgcgccgccgccttccttcgctccggccgcctttttcgtcgtcgccgtcgacctagggtgagccgtggaccaccgcgtcttttcccccttcccttcccctctctcggcagccgctccgccgtgcctatggccgccgccggcgaccatagggccgcgggcgccgcctcccgccggccgcgccgagtggctgccttcgggcgcgccaagtggacgccgcgtggggctcggccgtcagccgcccgcgccctcgggtgcggctgacgcgtggggcaaacggcgctggctggtgcgagccctggtacgcccggtccaccgtggaccgtgaggctgccacgtgggccccactcccatggacccggtccgtgcgccccctcccctcggctgacgcaataaaccttttttttaaattaaaatttaattgaagaaattcgcaaatattcatttaaagagcatataaacttcaaatggccataacttggccatttgaactcggaattggactgttcaagtctctaatttttccttaagaagtcaagaacccatttttgtgctttgttcctgctgttatatggagtttattagagtaaaagcccttttattttccgttggtcgtgtagacgttgcagcttcggaagatccgctcttcgtggaggttgaagccgacatttgggaaagtgaccaaggcaagtcacatcatccttgaacatattgaatcctggtttattaaattattttgatttaaattattgcattatcgctttatttaaattcccgcgttatcactgttttatctagccatgcctatgtacctttgttatgaccttattattgttattgttattattaccttgttcaccctagaataaacaaaacaccaactagtggacactctactcatggtaccactagtatgattttaggtagatgcttcactggttaattaggcaacattaggtggttttacaactctagactttggaaatactcttatcacctggacactatggaatggttggattattgtggaattggattcacacctccccctctattcaaacccctcaaaatggttttaggctgggttcggggtgcatggttttgacagtagcactaccgtacttccatataaggaccggt

SEQ ID NO: 14001 - DNA, 1230 bp, Oryza sativa
gtcgcctcctccgggttcgccgcaccaccgtcgactccgtccaccccctcgccgagcccgcggaccgccggaactccgtcgaccccgtcgacccgagccgggccgccgccttcctccgctccggccgcctttttcgtcgtcgtcgtcgacctagggtgagccgtggaccaccgcctcttttcccccttcccttcccctctctcggcagccgctccgccgtgcctatggccgccgccggcgaccataggggcgcgggcgccgcctcccgccggccgcgccgagtcgccgccttcgggcgtgccgagtggccgccgcgtggggcccgaccgtcagccgcccgcgccctcgggtgcggctgacgcgtggggcccacggcgctggccggtgcgaacccgggtgcgcccggtccaccgtggaccgtgaggcttccgcgtgggccccactcccgtggacccggtccgcgcgccccctcccctcggctgacgcaataaaccttttttttaaattaaaatttaaatgaagaaattcgcaaatattcatttaaagagcatataaacttcaaatggccataacttggccatttgaactcggaattggaccgttcaagtctctaatttttccttaagaagtcaagaacccatttttatgctttgttcatgctgttatatggagtttattatagtaaaagcccttttattttccgttggtcgtgtagacgttgcagctttggaagatccgctcttcgtggaggttgaagccgacgtttgggaaagtgagcaaggcaagtcacatcgtccttgaacatattgaatcctagtttataaaattattttgatttaaattatttcattatcgctttatttaaattcccgcgttatcactgttttatctagccatgcctatgtacctttgttatgaccttattattgttattgttattattaccttgttcaccctagaataaacaaaacaccaactagtggacactctactcatggtaccactagtatgattttaggtagatgcttcgcttgttaattaggcaacattaggtggttttacaactctagactttggaaatactcttatcacctggacactatggaatagttggattattgtggaattggattcacacctccccctctattcaaaaccctcaaaatggttttaggctgggctcggggtgcatggttttgacagtagcacctcggccatataaggaccggt

SEQ ID NO: 14002 - DNA, 1501 bp, Oryza sativa
actgtcaaaaccatgcaccccgaacccagcctaaaaccattttgaggggtttgaatagagggggaggtgtgaatccaattccacaataatccaaccattccatagtgtccaggtgataagagtatttccaaagtctagagttgtaaaaccacctaatgttgcctaattaaccagtgaagcatctacctaaaatcatactagtggtaccatgagtagagtgtccactagttggtgttttgtttattctagggtgaacaaggtaataataacaataacaataataaggtcataacaaaggtacataggcatggctagataaaacagtgataacgcgggaatttaaataaagcgataatgcaataatttaaatcaaaataatttaataaaccaggattcaatatgttcaaggatgatgtgacttgccttggtcactttcccaaatgtcggcttcaacctccacgaagagcggatcttccgaagctgcaacgtctacacgaccaacggaaaataaaagggcttttactctaataaactccatataacagcaggaacaaagcacaaaaatgggttcttgacttcttaaggaaaaattagagacttgaacagtccaattccgagttcaaatggccaagttatggccatttgaagtttatatgctctttaaatgaatatttgcgaatttcttcaattaaattttaatttaaaaaaaaggtttattgcgtcagccgaggggagggggcgcacggaccgggtccatgggagtggggcccacgtggcagcctcacggtccacggtggaccgggcgtaccagggctcgcaccagccagcgccgtttgccccacgcgtcagccgcacccgagggcgcgggcggctgacggccgagccccacgcggcgtccacttggcgcgcccgaaggcagccactcggcgcggccggcgggaggcggcgcccgcggccctatggtcgccggcggcggccataggcacggcggagcggctgccgagagaggggaagggaagggggaaaagacgcggtggtccacggctcaccctaggtcgacggcgacgacgaaaaaggcggccggagcgaaggaaggcggcggcgcggctcgggtcgacggggtcgacggagttccggcggtccgcgggctcggcgagggggtggacggagtcgacggtggtgcggcgaagccggaggaggcgacgccggggcgggagacggtcccggcgagcggagaaggccggccggaaacgggcgagggaggcgcggggagggtttatatagggttggaagggggagagggcggccggaggggaaggaaaccggcgcggcgctctcgggctccatcaatggcgccggcgggattaggggagggtttccaaacgaaaccaagggagagagggagggaaaattggggggaaagatagagggaatcacggggaataattcccccctattgattgcacgcggggaggacgggatgcggcggattcggcggcgg

SEQ ID NO: 14003 - DNA, 1501 bp, Oryza sativa
atgaatagtgaaagtaggtggaaaaagtgaatggtggagggttatgaatggttaagaagagaatgttgttggagaagttgttatatttcgagacaaatcctgagagctaaaagttgttatattttgggacaggagaatattaatttttcgacaattaaggtatgtgctgataagtgaatcaaaagaggtagtaacatattacgtgccatgtaagtattctttcactctgacggttcatatatgacggctaaagagacctatcacaaattattatacccatacaattgtttaaataaaccgttaaagatctatatatatagggaccatcacgtaccatcgataatgactacgtatctataattaatggtctaaaaaaaggagcagttatatagatgtggtgttggtcatatacaaccactcttaatatgcagtttttacatatgtcaaattatttgctatggttacttatttaaaacctgttaaagaaaacataagtaatctataatgggttattttttctgcaacaattatagatagtagtatccatctagtacgatccttatctctctacgtctagaccgggcaccagacaccaaatcgggccggccatccagatctcctccttgactatcttctctaccttctcctaacctgcaccgctgctgtttggaccgtcttgtcatggttatagataccacatacctaatagtagttgactaaatctcggcaggatgcaccacataccatgtcttatacggaaactgacctcgagggagttccggataaggaaagacaaccagagttctacatggaaacgacaaggattactcggattgtatctatattggtttccctagttctacttggacaaggggacacctatgggtataaatacaagcccccctaggaggacagggggacacacacccaccatgacacaagacaatcgacagaagatcgacacgatcaacacccgacatgatcaacacccaacacaatcaacacccaacacaatcaacatagaagcctacatacgccaagacacgccgccggatatcgacttcagggataagcatggctattctcctacggtgtctctggataccgtcatgagatacgaaagcgctatctctgatctcgccgggcacggattcgaggaggaagactaccctgttgtcgactacaagtcagaccttcagaccgtcatgtcgacaacagttagataggctaccctacatattgtactggtgtgattatggtgaataaaaagcaacatcggctccggccaacaggatatagggctattacctgaccactcaggggcctgaacctgtataaaaatcttcgtccccatctcttttacctcagtctcgcgtatatcctagcaccaacgatccccatactgtccaaataccgtagttgcgacatccaacgtcgacagtggcgcaccaggtagggggattttggtgctctaggatttcgacgagatgggtttaagaga

SEQ ID NO: 14004 - DNA, 1501 bp, Oryza sativa
ccatggtcaccggcaagctcctctccgtggtcgcggtgccggtgaggttgagctcctccctatggtcgccgaatgccaagtaaatgaattcctttctctcttgtccccaaagctcgcgagctaaacgagctggctcgagcttgcagacgagccgagccgagccgagccaggtttctagcttgttaggataacgagtcgagccgagctggctcgttatcttaacgagtcagaccgagccgagccgagccgacatccacctctaatggaaactaaacagatacagatatagaatctatcgactctagagacgaagtcatggagagtaaaaggccaatcaagcactatatgatactttccggaaatgtggttatatattctggtacatttttactgtatatgatacgcccaacaaattaagtgggattccgtaacgggataaatcgtcaataattaattcagctgggggagacaaacgtatcgatctccccaaatgtacataagcgaaataacttcagtaccgtatagtgcatgctttatgagttattctcacgtacgtactccctctatttcaaattgatctacatattttacaggtacaccaagaccaagaaaagctaataactttctcatactatatttactctagcaacaaactcaatgcatgcaccatccccactatttcctaaccaatagcaaatcaagattttgcatgtgagttataaatacttgtgatgcatgcatcaatgttcatttactccaatgcacaaataacgaataaagacttaataaatgaacacaaatatttagatcatttaagaataaccaaaaaaaactatatgtagatcaatttaaaatggagggagtattacgtagtatatatatcctatcgatgatcggcatgcacgcttgccgcaacatgctcgctcgccaatgtacgtacgcgatcgtgtttgagatcttctacaagtacggtgttatatatgtgcggtgtcatatcctggtacttctcgtacccctactactaccactaccggatcattcaatatatatatacacacacacatacacacatatacacacatatacatacatatatacatatatacatatacatatatacatatatatatatatatacatatatatatatacatatacatacatatacatatacatatacgtacatgtatatatatatatatatacatattgggcgtggaagaagaataaacgaagatttcagaagactactcaagaaggaatccagaaggacaccctataaagcataaaggaacaatatagggtgcggtgaatgacagcggtgaatgacatatccctgtgaagaataaaactttcggcaggaaaggcctcaactttagcctgctctcgtgaatccacagtagcgaagagataagtaggaggcacaggcgacgccacccctgacctctataaaaggaggggcctgcccagctgaggagaacacaacaacaaaaaaagacac

SEQ ID NO: 14005 - DNA, 1501 bp, Oryza sativa
aaaaattagagacttgaacggtccaattccgagttcaaatggccaagatatggccatttgaagtttatatgctctttaaatggatatttgcgaatttcttcatttaattttcaattaaaaaaaacccatttattgcgtcgccgaaggaagggggcgcgcggaccgggtccacgggcaagtggggccacgcgtcagccgctcggtccacggtggaccgggcgcacacggctgtcggcggtcggcaccgtgggtcccgcgcgtcagccgcacccgcgggcgcgggcggctgacggccgggcccacttggcagccgcgagggcgcgcccgagggcggcctcgccggcgcggccgacgggagcggcgcgcccgcgccccgatggtcaccgccggcgaccaccggcgcggcggagcggcgcccgagagagcggagagaagggggaaagcgaacggcggtcttcggctcaccccgggacaacgacgacgacgagaacggcggccggagtggaggaaagcggcggcgcggctcgggatgacgatggcgacggcgctccgacggtcggcggacggagcggagcggcggacggggtcggcggcaacacggcgaagcggacggaggtgtcgccgagtaaggaggaagtccggagcggcggcggcggcggaacggagctcggcggcgatggcggagagagcggagcacggcgcgagcacgaatccgacggcgagagcgagcggcgagcggcggaaacggaagagcggagctcgggcaacggttttatagcgtcgggagggagagaaggcggccggggaggaaggaaaccgaccgcggagatttcggccgccatagatgcgccggcgatgaatgcgggaaggaaatcggacgaatccgagggagagagagaggggaaaacgggggaaacgggagagggaatcacggggagtgattcccctctctttaatgcgcgcggggacggcgggatgcggcgcaatccgcggcggcggcggcgctagggcacgggcgcggcggcgggcgcggcgggaggaaggcgatgacaggtgggccccacccgtcagcgagagtggcgggcgggcccgcctgtcagcggcgcgcgcgcgcggggaggccgatgggccgcgggggaggagagagagagagagagggagaagtgggccgagccggcccaagagggaagggggggaaaaagaacttcttttaggattttctttttataaacctttttaactttgttcatttcttttcaattattatttgtgctctgaaaattccactaaaatttgtttaagcattttaggcttttaggaaatatacaaaaatcctccaagcctcatttgacttttatctttgcacattttaattgttggaggctttcacattgaattttaattattctttgcacaatttcgaggatagatttttgtcacgcccagaaattcccgaatagaattccaagcagaatgtgtattaaaacccccgtccaggacc

SEQ ID NO: 14006 - DNA, 1501 bp, Oryza sativa
gattcgtccgatttccttcccgcattcatcgccggcgcatctatggcggccgaaatctccgcggtcggtttccttcctccccggccgccttctctccctcccgacgctataaaaccgttgcccgagctccgctcttccgtttccgccgctcgccgctcgctctcgccgtcggattcgtgctcgcgccgtgctccgctctctccgccatcgccgccgagctccgttccgccgccgccgccgctccggacttcctccttactcggcgacacctccgtccgcttcgccgtgttgccgccgaccccgtccgccgctccgctccgtccgccgaccgtcggagcgccgtcgccatcgtcatcccgagccgcgccgccgctttcctccactccggccgccgttctcgtcgtcgtcgttgtcccggggtgagccgaagaccgccgttcgctttcccccttctctccgctctctcgggcgccgctccgccgcgccggtggtcgccggcggtgaccatcggggcgcgggcgcgccgctcccgtcggccgcgccggcgaggccgccctcgggcgcgccctcgcggctgccaagtgggcccggccgtcagccgcccgcgcccgcgggtgcggctgacgcgcgggacccacggtgccgaccgccgacagccgtgtgcgcccggtccaccgtggaccgagcggctgacgcgtggccccacttgcccgtggacccggtccgcgcgcccccttccttcggcgacgcaataaatgggttttttttaattgaaaattaaatgaagaaattcgcaaatatccatttaaagagcatataaacttcaaatggccatatcttggccatttgaactcggaattggaccgttcaagtctctaatttttccttaagatgtaaagaacccatttttgtgctttgtttctgctgttatgtggagttatttagtgttaaagcctttttcttttccgttggtcgtgtagacgctgcagcttcggaagatccgctcttcgtggaagtcgaagccgtcgattgggaaaacgagcaaggcaagacacatcatcttgatcatattgaatcccagtttataaaattatgttgatttaaattatggcattatcgctttatttaaattcccgcgttatcactgttttatttagccatgcctatttacctttgttatgaccatattattattgttattgttattattactaccttgttcaccctagacaaacaaaacctcaactagtggacactctactcatggtatccctagtataattttaggtagatgcttcgcaatttaattaggtaaccttaggtggttttacaactttagacttgggaattatttcatatcacctggatactctggaattgttggattattgtggaattggcttcacaccgccccctctattcaaaatcccctaaaatggttttaggctgggctcggggtgcatggttttgatagtagcacctcggccgtttaaggaccggt

SEQ ID NO: 14007 - DNA, 1249 bp, Oryza sativa
actactatgcataaagctagtatatgtaaagtttatacagataaagttacatgtatgaaatagaattgtttatgttggattttagtctaaatgagaaaggaaaaggctgggatatgctagtgggcccatgaaaattttgcatatacgtggactatgttgtgggctggagtagagttttgtgagcaggttcagatacgcacggaagaaataggtagcgtccacgcgtttgctcgacacgagcagtcgcgtactagactcaccccaatctgggccaggagcctcataactcggatatatatgatggggctgttcactctaacgaaaaaaaaccttactaaattttagcaggattttttatatagttaccaaaatttgacaacaaactaaatgtagctaatttttttttttataactttaccaaaacttggtaaagttgaaaatgacatcaaagtaaacgggcccgatgtctctagctggcctacatgactcggcgggctattaggattaggctaacaacgtgctatgcggcgacctatcacgccaaagtcccaagcacgagcgtggcctatgtacggcctgaaatcgggctgtgcctgaccaccgccttggaccaggctaggaaagcatggcccaattcctagcatccggcaaacagccaaacaggaaactttgggcttcttcctcctagtcagcaaccattattctagatgctttgacatggtcacatggggaaattttttatatttatctgtatctctgtctttatgctaatggccactaactgaaatcaaaacctaaagctcaaacctcacgcttctatatcatcattagttgtaagacgatggatcagtgcattatatcacttctgagctgataaggaataagttcacttgtggtcccttaacttgtcaacgaatccgattttcgtccttcaaccggaaaaccagatacaatgggtccctcaactatcaaaccggtgcaaagcaggtccctcagcggttttgatggtggttttggctaatgtggcgcctacgtggccggtttgacttggtcctcgtcctacgtggcgctgaccgggcactggaaggaaaatataaaactaaaaaataaaaacaaaatgtggggcccacatgtcagtcagacaaaaagaaaaaagtgaacccaccgttagtgggtcccaccatcctctctatccacggacgattggactacgggagactgggagagggagcgaccaacgcctcttctc

SEQ ID NO: 14008 - DNA, 983 bp, Oryza sativa
atcgaacgaacgagagcgagaacgagaacgatcgaacgaagacaagcgagaacgagggaacgaacgtgaatgagaacaagcgaacgaacgtgaacgagaacgagcgaacgaacgaggacgaacgttaacgtgaaatgcaatatatatatatatatatatatatgtatatatatatatgttacttcgcatttatcctaatacatctttttgtatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctagcaattgactatttagtcttaattagacttagcatatacgcacgaaacacttagcatacatgactattttagtcttagcatgtaatattatttgagttttaatataagattactttatttgtaattagacttagtatgtaattattgactacggaattggtgcgacaagtagcaattgactattgtagtcttaattagacttagcatatacgcacgaaacacttagcatatacatgactattttagtcttagcatgtcatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacaga

SEQ ID NO: 14009 - DNA, 1501 bp, Oryza sativa
ctctgtaggaaatcaaaatacccaaaattatctcataggaactacatatattgtttcgacataatactttctcataaattgagaagtgtactctctcgagtaattttagtttagaatttatgtgcatgtaattggtaataatatcatgtaaatatgaaaaattataactagcaagttctttttttttgtttagatatagtaaaagaatattttaagacaaagtcatccacacatggatattcgtataaaattttacgtacattaaataagatgcacgcgcatatgcgcgggctaccttcctagttatcttaacaggtgtaaacccatttactagactttccatatgtgtgtttaaagttcagaatggaaatcttgcatgtccatgtaattggtaataatatcatgtaaatatgaaaactcacgtacgcgtttgaataaatggttatatatctctaacatcatggaaaatgtcgcattttggaatatggaaaataattatttggaaaaatataaacaaattttagaaacgaagtattttggaatattgaaactcagtatttggcgacatagaaactaagtatttggaaatatgttatttgtgtatatatattttgcagctgaatatatggtaatgtagatgtagctaattttatcgtttataatgtcattagttttggtattactgtagtacggctcactttcaatcttacagacaaaaagtacaccacacccgtgatttttggggcacacattttggcgcatttatacatgcgtggtttttttttttggaattaggtggaaacggaaaaaaagcatgtaaaactgggtatgtacccaatttacgtgtaagtttagaaccgtacatatacccaaatattgggtatattcttaaatattcagtatatacccaatttacgtgtaaatttagaactgtacatataaccaaatattgggtatatactcaaatattgggtatatagtcaagtattttgtatatacccaattttgcgcgtgaatatgtgcatatatccaaatattgggcatgaacccaaaagtaattctgatgcatggaaaatacttttggaagtgaattagatcttaacgaacctaacaaaatttgaatcgaactttggaacagtatgtatacccaaattttgggtttgaaaaaacaatcccaagccatgaacaaaaccaacaatgtattgggccgactaacgagcttgaggacgagaaggtcgcgacaaccagtggctgcggcaaattaagctcatagatgaccagtggtggcaacgaagaaactcttggatgtctggtggcgtaacagcttgactacgaagattgtggtggcctgactgtggcaatgaagctcgtggacgaacaatgtcatccacagatctcgcagacgaccagcagcccgcgacgaagaagctcgggcacgtccggtgggacaatggcatcgggacgaatattgtgaaggactagttgcgatgaaggtcacgga

SEQ ID NO: 14010 - DNA, 1501 bp, Oryza sativa
aaggagggctatcaggatggtaaaataaataaatttacgagcaataaaactttgagacctcttaaggaaaaagtaatcaatgaaaattcaattaaaaatgaaaaatactttacttgaatttcaactggaactatttccaaaataaaataatatgcatgcccacgtgaatacgcgggctaccttcctagttacataaatgatagctaattcatgagataatttttttaagcctaattaatccataattagcatatgtttactgtagcatcgcacgggctaatcatgtattaattaggttcaaaagattcgtctcgcaaattagtccagagttatagaatgagatttacaattagtctacgtttaatacttctaattagtatccaaacatggatttcccttatccaaacagggtctaggaatagttcagagaaactcttgtgatgctttaagccaacgatgaggggagaaaatgagaaattggaggccagctgggcctcctttcctggtgctcattcgtcttcccccttgtcaggcacctccgccggcggatctccacgcatgcatctgcctcctccactcaaggaacccatccagcgccgtcgcagcctgcgcgcctcccgccttcctcctcacccctgtctccccaaaccctagcagcaagtgctcgcaaacatggaggggaaaagagacagagcgagagtgagagagggagaggactctggaaaaactctctccagctttcccaagcccacatggttaacgtgctagggaaaattcagcacattaccaaagatactaggaaaaaaaaaagtacaaattaccccctaaactatcacggtcatccgaattatcctctgaatcacaaaatcggacattcttcatctccaactatgcaaaccggacgaattacccccctcaattcaatccttgtggttttcgtttacgtgacgtacgtgtggcagtgcagtcagcattctatttataaaaaaatatgggacccacctatcatatcctcttccactgttgccctctctctcccttcctctcttctctctcttctctctcactcttcccctctctctctcacgcgcacggcgccaggcgggggacacgaagtggcggcggcggtgcacacgcacgcggaatggggccggaggcggcggcgaggacggcgacgtggccgagacgcgcaccgcgacgaggacggcggcacgcacggcgtggcagcacgcacacatgttgtggagattatgggtatcccatacccacacggcatggttatccgactagttataggggataacttatatttatgtaatatgtaacagatcatgacttgggtgttacgtttccttgtatattacggaacggcctaaagtcctggtttgataatattgtaaagtagatttaggaaaccgataccgtattggttaaggtttctatcttgtaatcctgccccccatcctatataaggtgggcaggaggccctctagggggcaga

SEQ ID NO: 14011 - DNA, 1501 bp, Oryza sativa
aaggggtcgggtaaattttaggggtatgaaagggattgagtgagttttcaggggtacacagggaatttactcatttatttaaggtgggtaggtttgtaacaccctgaaaattcgaccaacgaaatcaaaccctaaaattatgggccttcaaaaactttttaaataaattgcatcatgccgatattattcgcctatttcattggattttgatttcggagttcttagatcgcgaataaagaataattaattaggaataaaccctaaaattaaattggcaaaataaacaattagaatataatttaaaataatgatttggtgaggatagaaataaatgaaatattattgcaaccatatttgcatcaactaaatttaagtgcgacggaataagaattagccctaatataaaaattcaaataaattataaaatatgggtaatattaatctagggtgaatccattggttagaataacacaaatattaagtaaacttcatttatgcaaaaattaggatttatagaataaaatttatataggaaataggctgaaatagggataaataggaaaaaacattattcattcaggcataggtgttcgatgaggttccctagtcctgtcccctcctctgccgcacgcgcctggccaccccgagccccgcgccaccgtcgccgtcgcgtcgcctgtcgccgcgccgccatcccgtcgccgcgtcgcgtgcctaccgcctcgcgccccgtgccctgccgcgcactcgctgctgccgcgccgcgccgctgtcccatcgccgtcgctgtcactgtcgccgtcgccatcccgtcaccgcgcgcctgtcccctagtcgcctcgagccccgctctaccgtcgccacgcgtcgccgtcgcctcgagccccgctccgccgtcgctgtcgcgtcgcccgttgccgtcgcgtcgcccgtcccgtcgccgcgcacccatcccctcgccgcctcgcgccccgcgccgtcgtcccgagccccgtgcgccgccatcgcgtcgccattatgccatgccttgattattgtttacccttaaatccttgtaaccatgatttacgtataagtccctagtcaactatgacaaatacttagaaatgttactctagatttacgcatacacatatttatcaaatactatatgcttgggcaattacctttgggaaggtaattgagatgcggcatgtggagacatgagcgccacattgccatgatattgatgacatgatttgtgaaaggaaaataaaactaaacaaatgttttcgactggggcggatggaggatttgagtggtatccgaaaagggctagtgccgtccctggtcaattaaggaccgagccatgaagttaagcatgaaacgacccccgtacaaccgtacttctcgaatgggtatagacctagcggattagatagccgagcggaggcactatccatgcatagtggtttctcattgagtgaggcaggtgctctacagtgggacagctgttgaggta

SEQ ID NO: 14012 - DNA, 254 bp, Oryza sativa
tgccacgtggcatatctagaaacgctcttacaccgccatgttgcactctaataaattatagaaattctaagaaaaaaaagtaaagcatctaaccatcgatttcatttaatctggtgaacccattattttcaaccattagatttatgtaaaaatttcccattaagtacgtggataggtattaaaaaaaaccaaacgtacgtacgtactcccggttgcacatctatttttttttctttttctctttcctatttaga

SEQ ID NO: 14013 - DNA, 1501 bp, Oryza sativa
ctgcacaatctgcagggggagagatccacaaatcggccatggctagcgccccgaaatggcaagcgaaatgtgcaaagaaaccaggagctagcggccggcgcggggatctcacactccaaccgatcgaccgagctagcaagcaaacaactgaaaccggcatgcatgcaatgcgacgcaatgtgatgcgatgcgacgcaatcatgaaccatgcaccgccagtcgtgacttgcggcaatggcaccgaattgaatgagtaaaacaaattgttcccaaaaacgccgcgagatttgcaatcaagtcaatcgtccaaacggatgggggcaagggcaagccgagcgagctagcctaagcctagctagctactggtcacctgcccacgccgggggccgggccaagcgtatactactattgacaaggaacagcacgcactcctccgctcgctcgatcgatcgcgcgatatatgaacaatcgcgggaccagccagtaattcgatctctcccttcgatcggccgccgcgcccgcacgctgtgccagcttcgaactaacgattcgcgttggaatttgcgtcctgtactggaacactgttggatcgatcgggttcgcgcgcctgaccactctttggtgcagcgagctgtagcgcgcgagattccccctcccctgcggcagcaacagcgctggtcagggcagcgccatgaaagcgcatggcatgcatgcactgcactgcacgcacgcacgcagatggatggatggatggattgggcgatagaggggggaagacgacacaggcgccgtacgccgtccacgccactcgcggtagcgcgaggaaaggaccatgtaggcatgtgtagtgtagcgtccacatataccaaggggatccagaggcagagacgagccccgcgccgagttaaatgcacgccctctgatcgggtggatggatgaagtgggatcgcgattggcagcgatggttcgttcgttcctcccgcggcgacggggtggggcacacgtacaccgtggggggtgaaatcacggtcctgcccctactcctctcgcggggtggagttacgtacactgacagtgagaggccactttgccggcaggagatcgcggcgcccgaagaagatatcgagtcgttcgcgcgagccgagtcgagtcgtgcgtgccgagccagccacaccgtaccccctctcctctcctctatttatgcctctacgcagcgcaatgtgcctcactctttcgcttttggcctctctctctctctctctctctctcacacacacacacactctcactgactctgctgctgcattagtcactcgcagagagccacagctccctgcaaagaagatctctcgtagtgaattgcctcgatcacgtactactacacatagacctactacttgagcccgagagaagaggagaggaggaagaaccagagggcgtcgaagatcatcggggaggagttttcctagagctcgctgctgctgttgcttttctccggcga

SEQ ID NO: 14014 - DNA, 1501 bp, Oryza sativa
ccccgccggaagcggagcaggacgcctcggaatcttcgccagcccgtgctccggtcggtcatcccatctgctggattgtcgtggagcggagcgtgagtggagtggagatccgtcccgaccgctcttccgtgtcggtaagccacacctccgcgacctgcttggattcgttgcgtgcgcctctgatctagcttgtgcgtagtgagctctgctgtgagcaatctgaatccaattccgtggggggtgctccgttttgaattagcgcaaatgcgtccattctgtcgctgatttgtttgctggttcggtgacttcggcccttgtgcttcacaccgcgcaaaagatctctcggcgtccttgtctcgtggcaccgtgggataggatgcgaggcgcgtgacgcgtccatcctgattctgctcgtttttgggggcagaaacagccgctgcagcgagggtgccgggctatagttagttacacaattgcgtcgtaatttacggaattattgaccgtacttcgttactgtgtgccaaggagctgagctactgtagttgttttatgcgttctacttttatttttgactggtggttttactaaggtgctcaattcatggataaggccctgttaatgatcccttggaataattgactgcaagttttggccgacagcaggcacaatggccacatttactgggataacagtgggtgggtggaattgttggccatgcttgctaacaacttgatgtttttgcaacatatttgcatgttatcctggaacattgcgataaggttgaagcggaatcacaatttttcatgttgatacgtttgggactcttattgccttaaggatgcacatcagctgataaagcgcgtatgtgatccacttctgtttagtttctaatgcatcattgtagaccatcaagttgacaactgagccaatgacaaaagttgccctttctcctgggagaaacaaagacctcatgcagttcacatgctcccacttttttcagttagatgttactatcaaatgctcagttgattttgagaaaattaaaaagttgtttttttctttctgaactttgcttgttttactgtattggtaaacggcctaccaggagttaattcatttttattattaagaaaacaatgttctctgttgcttcattaatttaataggcgacaaaatttactgctggaacttgattaaggaagcagagttataaatacattgaaactgtttttttttgttttggagccgctgattagtttggtggtactttaacgaggatgaaatagacaagagaactctttagatggactcactaggagaagtttattctagtggttcataattttctgatattttatattaacatctgttttgtttgacagatacagactagtttgatcagtggtggtgttaaatacgaagtttttatcatataacatttggaaacatgcataaggggactctcacgtcttggaaatgagtaattccattatctgaaaaa

SEQ ID NO: 14015 - DNA, 1501 bp, Oryza sativa
ctacgactacagattgattctcagaatctgggtaaaaagctgaactgttggagggagcttctggctactggagattctaggagaagctgcagctgctagaagctcccccaaacagatccatagaatgaattaattattataaagttgaaattatattttaaacagatttttaataaattcatatgtatataaagtttttattaaaattatatcgtttagtagtttgagaagcgtgcctatctatgtattctttcatatgtactttctataaagttatatcccactaagtctaaagctcaacatgcaaccatatcacattatcacccactagtaataattacatattcttatcaagcatacaacatcatctacaatttatttaattttataaatcaacatgtaagtatatctaatcatcacccctcacatcatttgcacaatattttaacaaatctatcatttttacaatatttaagatatacttatcaatatgtttcacattaatacggggtatcatttgtttgtttcatgataagcattgataaaccctgatgttttattattttttttctcttgaaaaacaaattgagcattgtttactaattcccgcatcacctagtttctttaaaagggacagcccaaaagtgattaatttactgtatttgaaatatggcataaagaaatgttttttgggagcattggctgcaacttgcgaggagtacaaacagtcgtacagtgttacgtacaatcctcacctaccatttccggtccctactgatcaccagccagcaacccccgaaaagcagtacattcccagatgcaatttgggagtagattcattgaacatcgcagattggcagtgtagagaacatggtgtttcggaaatcctgcaatcagtatagacagctagtactagctagccttctgtggcctgataaacccgcccaaaaaaggaccgtcctgcccgaatcaaaatcaatcattcaatcaattgaccgcgcaagacagaaaatctcccttgttatccctctctccagagaagcagcaaccgggttagtacagtacgcagcaacggcttctggcgtagcaggtgccgggacaacgtccacatgcgccacataccgccctgcgcacccgtgccggtaggcccggtacacggtccctaccccgccacgctcccagaggccgcgaaaccggagtagagaaatcagccatatccgcggcgcgcgatcggcgccaggcagtagcgtggtaggaccgtacattccacctcgcgcgcgacccactagctaccagccttctactactaacacccacccggccgtgccgctgccgccgtgtgcccgagcgagcccacgcccacatgcacccgcgtgtctcccacccttcccccttaaataccacgctattccgcaggtggcaggtcgatgtctcgctgctcgacgtaccactactactgctgcacgcactaaccgtccggacgtccggtggacatcgaccg

SEQ ID NO: 14016 - DNA, 1501 bp, Oryza sativa
cttcaccaatcaccagcgcccctctcacagtagcaaatcccgcctccgccctcctgcacatgggtgaggcacatgcgtcaaaactcgccaagaaaactaatgcaagaaacaaagaaagaaaggcataaagcaagaattgaagactggcgcctctcctcttctttttcatccgtgtcaaaccgtcctggcccaccatgatcgcctgccgtgctccctatgctcacgcgtgcagcagtgcggcgtcctcatcgagcagcctctcgatggacggagctcgcgagatgtaggaagcaggcgcgctgctgggaggggatctgcgccctgacctgctgccggagaaggaggaggaggaggactcgtcggagctctctctcgccggtgcttcttgcgcttcgatccacgtcgccggtggctgctccggatgctgcgctgcacgcccccaccaggcccgagaggcgccggcggcagcggatccacagctcccgcgtccggcagcggtggagacggatgccggcacggcaagcggcgaagggggaggaagccggcgcggtgagcggcgcccggcggcggcggagacggaggccggcggtctcatctgcagtagcgcctcgcgtgtggtggcggcttatctgatttggattggctattttactaaaatacccatggtgcatccgaagttaccactaaaatatctggacaaaatggtcatttcacattgaaattttgatcaacatcctgccacactgaaagtttggcgccagctgctccttcgggccgccggcccagcgtctgtttttcctccctcctctcaattaatttcaaaatattaaaactgcaaatcgaattttatcatattaaataaacttatgtgaaaaaattgttaaaaacaaagttatataacttaatgagatctacaacttttgtttgggtcgttttgctatatgactttgtttcaaaattttgaatttgaattttaaattataacaacttcaaacaatattttcaaataataaattatttcaaatgaaaaggtcatcaacaacaaagttgtacaactcatcaatatttacaacttttgttttggtcatttttctatatgacttggtttgaacaatatgaatttgaatttcaaattatgacaacttcaaacaatattttcaaatactacatgatttcaactaaaaaagtcatcaataacaaagtggtataactcatcaagatatataacagttaacggggtcgattgctctgctatcgaagtcctgctgccctgagatcactcaatgtacatatggctaattcagcatacgagctatgataaagaaatataaatttggtttataatatatctgtaacttcgtcggatgaatcaatgaccaaaatataagttatagatattgatgatttatacaacgttgttattcatgactttatcagttgcaatcatttaggatttgaagctattgttcgaagttgtcataatttgaaattcaaattcaaa

SEQ ID NO: 14017 - DNA, 496 bp, Oryza sativa
ggcgaattcgagctcggtacccggggctgagcacaaaagtgttggctacgtggcatgccacgttggcggtcaaacgtggtcaaatgacaattggactaggtgtggtacattaaaccaagttcacggacctaaacatgtaattttcaagttcacggacctaagtgacaccaccccacaagtttaaggaccggccatgtatttcactctatgcctattcattcttctatcaatctcattgttcttattatgtgcaagtgcaacctaggcgccacctattatggcatgtcaatctcattgcttttttagaacttttcttcaatgggaatggtgcaaaatgtgtgaatcttgtttattctacaaaagttctatattttgaggcaactatcatgaattcgtgatggatcagagagtagttgttttgtgatggcatactgcagttgtgtgtaatagacatgtcaatactagtaacactttaaacttgctttcataggattca

SEQ ID NO: 14018 - DNA, 1501 bp, Oryza sativa
cgccttatgccctcagagtcttgatcatcagtaggttcttcatcagcttcaggttctccttccttctcctcctcttcagctggaacagccatgtcaggtaggcacctgacaatttcgtagagacgcgctgcatcgatgcacgcattgcacacacatatacctggcggtacatgacacgtaggttgtgatcaacctgttggttgtcggtgaaccgtggctccctcccattgtagtccagatcgatcagcttcggcggcacgtgccgcccgttccgccggggatcgaacaacggtgaggactggtcggtgtacatcgccggcattctcatcccgtccggtgcatcccagttccagaacggtatggcgaaggtgggatcaccgatcaagctccccaggatccgctcgaagaagtagagatagcacctatggaacggcatgaacagccaggagttgtgcacctggagatccagccccgggaacccgtcggggctgtacgacccgtcgcagtaggcgcagtggacgctcgcctgcgccgcgaagctccgggggtcgtccgccggcagcgccttcatggccgcgatcgcgcggttgaacttggcgacgtagtccgcgccggcggagtgcgcggcggggcgcgtgcggagcggcgaggacgacgcgtcggcgggcggggcgaagtccaccggcgaggcgctggagggcggcgggcagcacgtcagcacgttggcggacggagggagctggtcgggcgggccgcaggaggagatgtcgggcgtcgcgacagggtcggcgccggcgcggcgcgggaacgacaggaggatgcccgccgccgtggcgcttgcaccggccgcgccgagaccgaggaggacgtcccggcggtcgagcctagaggcgtcgggctccgcgggagacgatgtgcacgagacccgtccgacggcgccgcggcgaggcttaaggcaaaagctcgctcctggagaggaggggctcggtgatgatagagagcaggtgattagctgggagagtgatgccatggccgcgcgcttgggtcaaccgagcgcgatggtgatcggtatagctctcttgcaaatcacgatttgccatggtacggtatatataaggcgagcgcacgtctgtgccaccgtgccacgcgagcgcacgtgagcgaatgcatgcgcgacagcgcgttgtagggagatgcgacgcgcacgtgagagcgaacgagaaattgaagacggggatcacagcgtagcccgtagcagggagcgcacgcatatatccctcggaaaatgctccgcatgggggagtagctgggattcgtcggtgtgcacgttgaagatttgttatcagctgtcactaattttatgcatatcatataataatagattaagagcttatatgtaagagtgaggataatagtaagtcaactataaatttatatggaagagagataaataaaaatgaaaaatattggttctcatgcaaatattacaagacattttcac

SEQ ID NO: 14019 - DNA, 1501 bp, Oryza sativa
aaagctcagtagctccttcgaggcggaaccgcggaaggggccctcctcctcggctcctctcctctcccctctcggtgccgcctgcgccggcctccttgcagtctcacgctgcgtgacgaaagggacaaacgcgcgctcgacttggccgtgtcgtatcgtacgtgtcgcggccccgtgtgcggaaggaaggatgggctgatgggcattcgctgaacccggcgtgacgcgagcagcgcgagcgcgacgccgcaccggtgacctggccgttcgttttgtactatcccccctagctttctccaccaggaccaaccaccacgtgccccttctggttgcggcggctgctggccaggtgggctggttgagcaccatcatttatcacgtccctccgcagtgatcgcctctgctacaggactacaggagttcactcctgtacatgcgtgacaggtgcggtcgccctatccgattcacgcgatgaccaagctagctgccgtgttcgtgtgggtacagtatcttggaagacaagggagaaaggttataatcatgctcctgttgtctgtctggagcaagcacggccttgagcatcattggcgcggtacgtatgtctctttcgatgttgaggcgataatggagcacatcttttcgtattttcatggatgtcgcatctacgatcgttccgcgttttcgagcgagttccttaggcgcgacgtgtcttaagacgttaggccgcctctggttaattctgtaacggctggcactagctagttaacgacgatgcatgattcaactttaacagacgttaatcatgcatccaccaatggctacggatcaccttttgcaaaatcctcccatcctcgaatgatgatgatcttctgcctcctttgtgttcccgtcaagacttttggctacgatcatgcatacagccgatgcaaccaccgtgacgccgccgcgcgcccactggaacacgttgcgttgcagctggccgatcggtctcggagtcggagcgcaccactgacccccgtgtggccgtgtcccggtgccttttccacgcccaccgttgctagctaccgagccccccacgtacccctgggccgcgcggcaaaaagacgtgctccgcgccgtcgcctccgcgcccctgccagctgctcgaacggcagaccgccacaccgcacgcgaaggctttgaaagcccccgccgcgtttggccattacccggcgccctacagcgacggacggacggacggcgtcacggcggccgaaatgacgtgaacgcccctgtggaaaaggaatgaagcgagcgcacagcgcactgcccatttatttctggagaaaatctgtggcgtgactcgactcgaggacgttgtctgcatagaccgttccactacttgaagtcttgcagggacctagttattagctagctagcggctgccgcctgccgcccagcaaaatcgagcacacagggaaagcgccgagaagaatagtggacatgggacgggagccggaga

SEQ ID NO: 14020 - DNA, 344 bp, Oryza sativa
aagacaaaagggaggaggctgccccccaatgccacgtggccctcccccgacgggggtcggacccgaggtagggcggcggatgccccctttgtaactcccccgaccccctccgtgggtcgccacgtacgatgggctgggtggctgtctccaaaacgcccacctacccgcatttatggcggcttgagcaggcacgccacgccgcatttaatgctgcgtggagcgcgcctgaccggtgtatgacgggccagtgaccggttgaatgaccgatgggaccaggggtgtcaggtgcactagcgcgtgtgataggcggcgtgcggcccgccctgtcccctcatcatcatagc

SEQ ID NO: 14021 - DNA, 1501 bp, Oryza sativa
ctggtagtcacaaaaaagcttcaagaacattatgtaaacactaagcaagaacacataaataaggtgttacgctcccaagtagtccaagcctatcaatatcacttgtccattgcttgtacatacgattcacatccaagctcgaacaccgcaccctagccgaatctcaaaggggggtatcttaccatcccgctagagaagctcgtgctccgacagctagtgcgccaggtagaggtgcacctgtttgagcttgttttcccgcatcctccattatcgccaaagggaggccatggctggagggcatcgtcatgtcgattccaaggggaaggctggtgctgaggaggtgactggcaagtctttcagtgccattctatcttgcctgccgcgttctccgttgaggcacgttgtgcgccctcgacgagctaaccatcatcatcactaggccgcgcgagcggcggcgaccctctcgcttgccaagggcactgggaagtgcccaggtggctcgatggttgttcccaccatttggagggagcaggcacaacgcgttccagtgtagtgctgcctcaacttcaattttgccacaccgggggtgcgctctttgtagtggaggcactccttcgtcatcactcacttcgggccggcggtggcactcctaggggttgatggatcaaggatgtggccgatctggtgaggtgttgctcaccgccaggttgccgttgggaaccctgctccggctccatgttgacatcccatgtggtgcccgagctccgcacagtcatctattctatctaaattaatttataagaaaatataaattcaaatcaaggaatatcatacttaataaaaatccaatggatagagtataaaatacacaagatcgccgatttggatagcgacgtcatttctatctgaatccaatccacaagatatcaaaacatcaatgaatacaaatccaaatgccagaattaatgtaggagaacacatacaaatttgaataaattcagaaacagatcaattattcattactaggattgcttgacgtctatgcctctatataaacaccagcaaagaaccatatattccagtgagcaagaggaaggagaaaaggtaaagagaaattcaggaatactcgatcaatttgcagcttcttatcatggcacccttcaagatcaacaagactatcgctgctactttcttcatggttcttattatgtcctgcgccctcacatccacatctgcttgccgtatgttgctactcttgctctttgttttttttgggagccgttttggattaaatctcaaaatatatcctatcaattctaacgcatgtactcaatttggcacaattataaatccttctttatcataatataaatttagcttccaattatcatcaatccggacacactcatctataatgctaccctatcaaaacattgataagtcctagtactatgagtgtctttaggtattaaaccaaacaaaccattaattattttctcaa

SEQ ID NO: 14022 - DNA, 1501 bp, Oryza sativa
tcccatctcggcaccaacatatcactgctgaggtagggtccatatgtaagatgtgttttatgggtctatttgtatattattttttaaaatgactacattattaaaaatctagctagttataacatgtgtttgttgtgcttttcagttagaaaatgagtctttctatatattttattgaaaaaaatttaattacaaaaatttgacagaagcaaatataatacaattatagtgtaattatattataacttgcatgtaactacgatacaacttatatgtaatgttcctaaatctcgcagtaacatgctatttccacgaagcggacctctcgaagcggacctctcggaatagaatctcctcacatgtaagcatgttgtgattttttcttccttgctaatatgaattttaaaacaaatttaacagttcaaaattatattaaagtacactataataatattatatttatatttgataaatttttaagagaaatttgttgagatgtatataacaaaatcgttagaaagttttggtagtgtgacttctttattgccttttatttaaggactagctaaaggctcgtgtgttgcaacagaaattattagagataaaagcaaaagcaaaaaagaattataagtttataacatagttagttgattaggcatataatgctatgttcaaagcaaaaagcacgtgtagggaccttattgacaatgaagtgcatcgatctgtccggtgcgaactcggcgagttctggcaccacccggtcgcaacctccgagtcatggcatcgtggtcgcgcctgtattttctattatctggttttgatgcttcttaatccaaaaatacatattttatttattagtattttataataaactacgcatattttaaatgttatgtaaagggattatcgttgtatgatgctaaattaaattattgatcaaaacctgagccaacatgttaatactcattggttagatgcattcgtatagttccctagtgtttgctacatgcggatgaattaatttcttccttcgtgacaaaaggaagtacgaagtatgtcttagacgcagagatttcgcttggcatggctcctgtggtccggaccattgtggaccatacacctcgcatggcccattgtccatctgtagaggcccgaaaccgaaacgggacactaggacatagatgggccgaattcgtagacgaaagagctgggctaaaaattcttggaaaaagtacacgcaaggtccctcaatttgttacccacatacaaaatcgtcccccaaccacaaaaccggatatccggcgtcccccaacttataaaaccgatcacaatagttccttcagcgattttgaccatggttttatcccacatggcggctgactcagcgtgggacccacgtaggccccacatgtcatggagaccatgtcagcaccctctctctttctctgtttctctccttcctttcgctctctgctctcgcacaggcggcggcgcgcgcggc

SEQ ID NO: 14023 - DNA, 1501 bp, Oryza sativa
gactggggtaggagttaactgtggaaaagaagaacaggaaaagattaaaagatacactaggggatcaggttaacactaacgtgacgtgtcttacttgaggaggagacagttggacacaacattttccctgcagtttcatctcaacaagcaagcactgccaagagctcaagaccaatggtgtcacgtccaaatcagccaatttttagcaagaaaaaggccggaatgactgtggaagcttacaagaaagtgctattgcacacgtcgcaggataagataaccatcactggaaaataggcaccaaaactgatcaaagttcagaggattattcatctgttccatgctgtctggttcctcataggaaaacaagatatgtctgatttgtttgtgtggtgggtaaagataccctggaatttaacctcaaccaagatctgaatggcctgagaattcagttgaaaaattgaccaaagcatgtgaagaatgaacattgtttggcaatcaatttagagtagaaacaatgtgcatgatttcatttgtcccttattttaaaatgtcacagaaatgtttaagcaaacaagtaaatagagattaatagggttgtttcagtaggctgatgcagaaattcacggtttggtattcacacttataaataaccgtttcatacaaaataaaattgttaaggataatacacatctagttgcaatactgacataaattcagtagaaataattcatattatagaaatctaaagaatttgagtacactacaaaatctatatccctattaaaaaaagtagtggtggtgacagttaatctgctaccccgcctactctcattgtaaattttataagttatccctaaacttcttaaaaaaaactagattgatatgtaaaaggatgggtaatgcattaatatattttttattagtagcaaatcacggacatttagctactaattaaagaagcctaatgttgagaaacaactggaatttttttttattcctgaaaatacccagagctccatggattccgcccctgggttgtttattgtgtgattcttttttctgtttgtcaaaacaaactccaattacacatggcaaaagagtgttaattctaaatcggtcactaaaacatcttacactgcattctttacttacatttaatcaacttctacggcatattttgcaatacgagttacattcaaaaatcatatcaatttatatattttaagttttttaactaatacaatcatacaataattcgtcgctccattatttgtgccatgaaaggggtttccaatcccccaaacaaacaccttagattgtaaattctcaacctcgccatttacttagcacagagtatatatcacgtagtaaacttaccgtaagattgtgtgactaggcacaggaaaaaaaagcaataaacgataatccatatcagttacatatcaccatcactaacaataaacttaaaaatcaaaactaatataaatcagaaagccattac

SEQ ID NO: 14024 - DNA, 1122 bp, Oryza sativa
catggcggcgccggcggagggtggcgaggtttcggtggattttttttttttttgaatcggaggaagggagcagattaggcgaaggagagagatcgattagttgagatttatggccgccgcggcgccgcctccggatgcgatggcgtggcaagcacgtacggctcgcatgcacgactttcgagccatctcgtccgtccaatcactatgtcggttcaaatcaacggagtaagatctggatttacgccgccctaattgccatagccgagcctacaattaaggaaggcatttttttctatgggccttgcattgagcccggcccaaatatctagcctttagccttacacgcattgtagactttgtgcatcatatcttgcgcacaacgtgttttgtacagttatacggttgtgtccttgtttttatctgctctttttttttcttctgcaaaaaaaatgtgtgtatgaatgtatgaattatatagggctatttttttggttgcataccaaaacttgtcttgccaaatatttggtaactttgaataatacatgctactatgcatttacattgttaccaatttttaccaagctattacaattgatactacattaccagaacattggtagtgctaaaacttatctaaggtttaacactaccaataatttagttctccttgttttattgcaaaattaatgtacacgttgcatatatatagtgtaagaaagagttaatcgcacattaatgtaacatttattgcaaaattaagtttaatcttaaactaccccaagttttcctatgtggatattattatggccgcctcgcccgcctgcagatgcgcgatgcgtgcgtggcgagcacgactcgcatgaaacccagactagatgcataatcaggtcggttcaattcaaatcactaatgtcggttcaaatccatctcatccgtccaaccactatgtcggtacgaatcaacggcacaggataaggaaggaaatcttcatgggcctcccgttgcggcccaaataagaaggccatggcctatatagatcggaaatccagagcgatcccttctcgcagtctcgcctagctcctgaagttttaacgatcgcctccatggattccgccgccaccg

SEQ ID NO: 14025 - DNA, 1501 bp, Oryza sativa
gtgaaggagatcgatgcggcggaccacctcgtgatgctctcgaggcccgacgagctggcgcggtgcctcgccgacatcgccgaaagctacgcttgagctcgatgtcaacctgctgttaatgaagtcaatctgctgttagtgttactgccgttttagctgtcgcgttttgctgctgtagtctcttttgcgtgcctgcgctgcggtgttcgtcgcaacatactgttgggagcttggaataattcggtcttcttttcccaccaaatttgtttcgggacttctcttatattcagagaattgcaataatggtaaatggtatattatttattgggtgtaattaggtttccttcatggtaaaattagagtatggggacgtgcacaaagatcagaagactccttaacccagtacagtaggccaatccaaacgattgcgataggtccctgggtatcggacacgtgactgggccgcttctttgaagaggtgtggagccaacttatattcgagaatcctaattaccgcagacgcgccaggaggttaagtggcgtgcgtttttttaacctctacaacacgaaaaaaaattacaaatatacttatatttttaataatttatgtttatatacctggatgagatagatttacaaaaaaatatatccgttccgtgggacggaaacgcaggggcacaacggtcccgcaacgttcgcgtgggaccgcgacggtcgcacggtttcaaaacgccggagcgaggcagccaacgatttatttactgcatcagcaccgtttgatattgtttcgtgactgtttgctactgttcaacactgtttagacactgttcatggaccgcgttgagcctacgggaccgtcgcgtgaacagtgtcaaaacagtaagaacagtttaaaaacagtgctacacaacgttaaaaatcgctggttgcctttgcattttgaacctgcgggaccgtcgcggtcctgcatatcctttccgcggtaccgtcggtcccgtgttttggagttatgggatcgtcgcgctccacgggacaggggacgagtatatttttgtaattccgtttgatatatgtatatatacataaattattaaaaaaataagtatattagcaaattttgttcctctacaacatatgcatttttcttatatttagggacggaggagtattttctataacatcaaactcaaatttaaagaaacttttagcacacaattcaaaattttcatctcaaatggaaaaatttcatacatcaaaattcaaatatttcaattcaaatttaaactttttactcaatttttgaaatccttttactacatatttttaaataaactagaaaaaatgcccgtgcgttgcaacgggtgaaggctattttaattttattattgctatacagtttagttgagatgaaattcactttaagaattcgcttggatatatatttgtcagggttacggataaggtataccctctacccttggatgtatgctatacggcaata

SEQ ID NO: 14026 - DNA, 1501 bp, Oryza sativa
aatttcagttaaattgtatttttatatggtctctaacctctacttttagttttgttatttttctaattccgaattccagctaaattgtattactatatggactctaacctctactttttagttttcttatttttctagttccgagtttccattagttctatggtatgccagtatggactctagtcttttcttcctatattccttatttttaattccgaatttcagctatattccataattatgtcaattataataatcgtatcgatcattgttgctaagtcatattataagaaaaattgaaacatctttaatataatgatccaatcttgactatgacaaacttaacaatgcatgttttacccaaacaaattggattatttacgtggttgtacacatataatctaaaataatctttcaatctcattcttgcaataatagtaggatcaatcaaatcctgcattgtctcgtattgtcaagtctaaacaaatagagcctcagtgcactcttctcttaataacaattaaaaatatgtttatttattatttttatttttatatgataagctatcaagaatattagctatacttaccagtagtctgataattgcatacagagacatgtagagtctcaaatacaggagaatataattgtggaacacaaaccatgtagatgatggaaaaatcgagaatcctatccgacccaaagcctcgatcaatttgatcttgttccaagaaaaccaagcctaagcaagacttgttttagatccgcacgtccgaacattcgacaacgctatggaaaaaccaaaacgacatggtagacgatggacaatacaaacaatacaaatcttatttcatgaaatcggattttttctgaaattagacagtttttttcgcattgcgcagtactgaatcagaatttttttataaacgcgggatttttctcacgttgggtcagttttttcggggtagtattttttatatatggcggttttttctcgtgtgaattcggatggttttttctatctttttttagcaatgttttttctgatggtttatttcggacaaatagagcctcagtgcactcttcttaataaaaattaaaaatatgtttatttattatttttatttttatatgataagctatcaagaatattagctatacttaccagtagtatgtatgcaattaattgcatacagagacatgtagagtctccaatacaggagaatataatcgtggaacacaaaccatgtagatgatggaaaaatcgagaatcctatccgacccaaagcctcgatcaatttgatcttgttccgagaaaaccaagcctaagcaagacttgttttagatccgcacgtccgaacattcgacgacgctatggaaaaaccaaaacgacatggtagacgatggacaatacaaacaatacgaatcttatttcatgaaatcggattttttttttctgaaattagacagtttttttcgcattgcacagtactgaatcgga

SEQ ID NO: 14027 - DNA, 443 bp, Oryza sativa
gtaattttcttgtccggttccgcgcgcgcgacacccacacacgtagccgccacgtgtacgtgtcacgctcacacctcccgtgccgcctcgcccgcccgattttggtgagcggcagcggtccccccctccccatcctccatcgtccggccgtttcgtttcgtctccccgccgcgttcttaaatcccaagcccaagccgccctcgcacttcctcttcccccacctcgccgagctccacgccgccgccgcggcgccccgtctcccacgccgcttcgccccgtcgtctgcgggggagccgcttggagtcaagagcagcgaccggttcaagtctcgggggacgactcgactcctccacgcgggtcgcggactcagcggtgccgtactctgccacccgtgtgtgcctgatatatgtgagttcgtgccttttcccttgggtggcggcagc

SEQ ID NO: 14028 - DNA, 543 bp, Oryza sativa
attatggagctaggcatggggcttaagccctagctgccccatgtctgattccgcctctgtacttacacgcatgtaaatatttttccctctgcttaattaatatataacaccagctaagtctagctcgtttttttctaaaaaaaaagtagctagctgttcaagaataccacacgcaaaagtacctctttgtgttgtaccacgaactgcattagtcataagtaaaacactcactttaagcaagctactccctctgtcccaaaaaaaaaagacaaaccctgaatttccgtgtccaacgtttgaccgtccgtcttatttgaaaaaattataaaaaaaattaaaaaaacaagtcacgcataaagtattaatcatgttttatcatctaacaacaatgaaaatactaattataaaaaaattgcatataagacggacagtcaaacgttggacacggaaacccatggtttatctttttttaggatggagggagtagctagcagctttcgatctgagatgaaatgtggacaatttaggccaaatccatagaaa

SEQ ID NO: 14029 - DNA, 1501 bp, Oryza sativa
taataatccgatataaacaatacaaagagatgagatgaaagataatttcaaatcaaggtagagatcttataatgaacaaaatatagaataagctccctctcaagatgtgcatacatatggatatgaaggaatgcatatgcacataatcaatcaagatcaatgagggagctcacactatattttggatccacaagagagaccaagttagaatatatgaagtttaatacatacctcccatcatttttactttcatatccaaataagactagtcaaagaaagactcataaaaacgttagtctcatataattagatttgtcattaatcaccgaaaccaaattaagacacttgaacttacaacactagcattagatggaatgtgttctacttcctctgtttcaactatctatatacttaatgtccactaatttttaaagctcaaatgtaagtgtgctatatcatcacccactagcaattattatttaaagtattttaaatcatacgtaagtgtgcaacatgatcacctactagcaattattatctagagtatttttaaatatcatgcaaacatgacatattatttacaattttattgtagttttaaaacacaatatgcaagcaatgtcaaatcattatctccaaaatattttcacattatttaaacatatatatctatctacatccattcatccacatatcctaaagcaaagcgcgtgtatcaactgatataagcaattatagccaggttgaggagaacagattttgggtaccctcgataaatgaggactggttaagattgggagaggtaagataggtagaaatttaagtgggaagcgattgatatgataagtaaatagtgctaaaaattattttattgtcgaacaatgtttaaatcatagaagtatttaaatcttggaatgttgtgagtagttttcgcaactctgcttttcacagcttgtcctggtccaggttccgtgtgccatcgctcggcccaatggcctatttcagttccctcccgcaaaacagcccacgagcacacgtacgcggccctgcaacactctgcaagggcaaagcccatgccacgtttcctcgagcctaaacgggcgcgacactccaaacccgtatggaataagttcatctgaggtcccttaacttgtcaacgaatccgattttcgtccttcaaccgaaaaccaggtccctcaactatcaaaaccagtgcagatgaggtccctcgacggtttggatggcggttttggctgacgtggcgcttacgtggctaatttgactcggtcttcatctgacgtagcattgacgtggcgcttacgtggcaattcgatccgaaaaataataaatctcatgggacccacatgtcagtttgaatgaattaaaaaatggtgggtagcattctcacacctcctctttccccatctctcccctctcctctctccagcgccacggggtcacggggaggtctggcggcggcggccgacgacgcgggggaagg

SEQ ID NO: 14030 - DNA, 1501 bp, Oryza sativa
aaggttcaagcttggggggttttgttgacggtcattatcgatcagtttcgaccgtcaatattactaaaatagaggagaactagtgatgcttgcaatgcatatacctgttagaataataatattccactagtattaggtataataaccgtttgcagagaatgataataaagtggaggagaatcgacatcaactcagacgataaaccaatcgaacggtgtcaagaaccagacttatgtatgaatgggccaagaactcagaaataacatgacacattgggccaaaattcacaagtctacggaggaggacaacaaaagaggccgctagctgaagatgggttgggttaggccagcccatgggtttggccgaacctctcgtggcgccgataatgcagggtttggatggacggccggggttgatccccaatgacggttggagggtattaccgaccattccaaccgtcacaaccgtcattacctgcctataaaaggagctcctcttctcacttcactcacacacctcaagcaatagctctctcatttctctcaagtttaatttagtagtatctagctagtggaataggaatagagtagaaatcaggagtccggaagccttcagaagagtacgggtattcctccgcaccggtatataatcctaagttaattccctggggagggtattcctatgcttttagccccagttgtatggtcatgacaagctgttgtaatgaactcggcagttaggggtggcttctcgaagtaccaggagggcatcggaaagaggatattagctagtatatcggttaactagaatgtatacatactatgtatattagaagtataggaatagattatctctctcttttcttttcacttagcttagataatttattatgagaatgagtagttaatgcatgtgtgtcactctacccttggattattttaacccatgcttagaatatgattatcaaaagtaatatataaattattagtcaagttctctctacatgatcttcccacgagataaaataaatacgatacccttggaatactctcgggtgaaatactactatggtctatccgtgcgctcgggtgaaatgctactatggtatatccgtgcgcttgcggataaactttgtaactgaaattttacaaaatttgagacatgccacccgtatctcaatgacatgtaggacccacatgagtcaatgacatgtgggtcagggtggcatatcataaattttacaaaatttgtgtggcatggttcaaattttccctttctagaaataccaacaacctgaactggccgactcaagcttgctgggccacttgatggcattattctgtatgggccatgtaggagctaaggcccaacttgacatttatatgataaaaatagtgcaggcagtgggattcgacccctcactgctaggattgaggcaaactcttcaaaccactaggccaaactaactgttgtgactaaggggaaatactaaatgtacata

SEQ ID NO: 14031 - DNA, 1501 bp, Oryza sativa
cgcattgctactgtcctaattctccatatgctgcccctaagagtaccacattggattgagtgatgaggtggaggagagaagtaaggagagagatgatgatccactcctccacacaaactttaaaaaagatgtgagagtattagatgtattggtatttgtgtactagaggtgacatattgtaagggttgcctcttagtttataagtgaatgatatgaataagggcaagttttatagtagggctattgtcatatctaattttatctatgtaagataagaggtgatacatacaatacaccatatctacactacctctaacatagtaacccaaatgatattttatattatttgtttgtccaatcccctctttctttcatcccctttttcttggggtttgtgtggaggttaccccttgcattaggggtggctcatcttctctttcctcacttgtttcttccacctcatcatccaatcctatgtggtattttaggggcagtagattttccctattacacttgcacttagagcatcctcaatgtatttggcatactagtctatagaagtgggacccaagctcgaagtctatagttttagaaaccaccacaatgtgagttattaaggtgggtcccacagtggtaaaaaaatcatattgagttacaggagttaatggaaaatatgtgtttcaaatggatgtttgttgctttcaaaccatgtgtagatgacttttcaatggttgtagatgcataggtgtagaagcatctagtttaattggtaaatacactcgtcaactggtctcagacacatctattgatggacacaactggcaagaggcagacacaatgcataatgctctcccttttcatagcatgcaaccatttcctcaacacatcggttaaggaaatcctcttgtatccataaggagcaagaggggtgatgcaaatgtaacacagctcaactcaactcaaccaaaaccaagatgaataaggtatctcttgtggtataggatgtgagcaccgccgcgagtttacggcaagcaaatcttaacttcggaatagaagttgggtgttgggagccatgaaggctagagccactcaaagctggtgtatggttcgagcttacacagtcgtgctatttgccaccttgggttagggatgtagaggaaagtggatgcgtcgggctgggtctgtcccctccttcaaccgaaggccgttgaggggggggggaggggtagaattctagtatacacaaaaatatgaagatgcacttaaacccccaagtgggttttggtgattaatgacaaggtggttaaaggggactaacgtgtttatcaagtttattcacaggagtttagtcccaaagcgagttgtgatggctaagaatgcaaggagaccccccaattcaaatgttcctaagtgcaaaaatcatcgaaggtgattagactaggtttttcctttcgaaattgagtttaggaaaagccgtactattaagaggggtttcaagtgt

SEQ ID NO: 14032 - DNA, 360 bp, Oryza sativa
caccatgcgccatcgcactctctacgccgcagccaccgcctcctcagctgcaatcacaaccacatgtgatctgtcctccctcactgaagaggccagatccgaaataggggagcaccggattaggcgagggggaagccatatctagcggcgcttcccgtaactgagcccgctgcctcgtccctgcctccaacgccacctcctccatcatcaccgctacctcctctaccccgccacctaccagtctcctcgccgaccggtgaaggagggtctgatgctagcgccacatcctcgctagcctccgaggtccaacgacgccatgttgccctaggccgcgatctgccgccttgctctctgcccagt

SEQ ID NO: 14033 - DNA, 948 bp, Oryza sativa
gagggagtatattttatacacagaaattttatatgtatgacaactttatgcatacaatgtatgtataaactttgtacatatatggaaaattcatacatgagtagtatacgcatatatacgtacatttttttacgtacaaatttaaaacataaaggcacttagaaaaaaaaattaattactgtaacattatatccgaactttgcacgtataaataaactttatacttatggatcttaaaaaattcaaaatttattttgaaaaaaaaaacgcgcaggtgggctaacctcccttgaattcggtatgatctgtaaacactaaaaactgccaaaatccatatagaaaataaaaaaaaaagcttgatcgttaaacacgcaaaaactaaatgtggcccaaatagcgcgggcgaaaaaaaaagaataagttcatctgaggtcccttaacttgtcaacgaatccgattttcatccttcaactgaaaaaccagtgcagatgaggtccctcggcggtttggatggtggttttagctgacgtggcgcttacgtagctaatttgactcggtcttcatctgacgtagggctgacgtggcgcttacgtggcaattcgatctgaaaaataataaatctcatgggacccacatgtcagtttcacccaaaaaaataaattaaaaaatggtggggcccacgtggccccacatatcattctcacccctcctcttcttcctcctctctcaccatctctcccctctcctccctccaggcgccacggggccacgggaaggtccggcggcggcggccggcgacgcgggagaagggcagtgggcagggcgtcggcggcgggagcgctgggtcttcgctcacggcgtcggcgcggactccgcgcgggggctcgtggaggagatcggggccgcggcgccgcccgtctccgatgaactgagctcgtgcgagcgcgg

SEQ ID NO: 14034 - DNA, 1501 bp, Oryza sativa
tgttgctcaatcaattctctctcttcactgctctcgcgccacgatcatctcggaggccttctctgctagtctcctctgatattgccaaagattcatggtggtctcctacctcgcccgtgcggtattgacaacatcattgcgcgtgtttgtcctcccgggtctggcaaacccggcggaacgtctcgtcctccacggttcggcaacatcgactcttcggtgtcatcttccttaacgaccaccgcattctcgtcaccgtcatcatctttagttcgtcctcgctcacgactactctatggtgccccatgcacgccgtgcggctcggctacctcgacatcagctttccgatttcggctacatcgatcatggctactctacgcacggcttcatcgaccacggctccctcacaaccttcgttttggctacgtcgactatggcacaaagggctatgatatgtattgagtactctcgtcggttttttctctagtctaagcgttcacactgctcacgctcggaccgtggggagatattagagtatatatggtagttctagaaataataggatataattgatttgattagagtctttccttatctctagtacctttctaatctttacccgtgtaatctctatataccagcctacgaggctcaatacaaatattcatgttacgcagtattcctctctttctatactattcaacagcatgatccatctctttcatcctgtacatcagcttcactagattaattggcacatcatctgacttcttgaattgattgcgcaattgagttatgtaaccaaagtgtatactttgaaaattttgacacggttaaggtacgtagccggtgacgttaggttggatagatttttctagagctacctctgaccggtctctgcagatgtagggcccacacacaaataaataaactttgaattgaaagaaatgtgtcaataacggacaaaacttctacgagataaataggtaaaggacgatgcaatatatatgtaaaaacatatcgtaagtatgaggctttttctactatggccctttttttttgtgtgtgcggtgctttatatacagttcaaattgttgaagcaacatttactgtcatggattatgtcaacagagatgtcagtacataatataagctttaatgaaatactctctccggtcacaaataataagtgtcactttagaatcagtgtagtcaacaagagttaactttgactatctttgttttgaatacatcacttgtgtattggcatagccaaacttttaaaaacaataactttcataatataatattagtttacacacaattcgttttggatttatacaaatgaattaagtgatcaaattaagttatctcctgatgactttgcaaagtttaaaacaacacttatttatgattgattggagggatcaattaattactcattctccattcttaccgatcgagcgtcatgagtgacagaggtttggtcattcaaactgtaaac

SEQ ID NO: 14035 - DNA, 1501 bp, Oryza sativa
atagtagtcgtggcaaggtttaatttaatttgcaagcatgccgacacatataatcagacttagatctaagttttcattataaaataaataacaataacaataatgtactgtctatccatgtcaggagaaatcctgatgtcacatgtgtggtaatgtggttgagatttctatctaaaatatttgggtctcgatctgccctgtgaagtgcacacacacaatcatatttgtatgtaattacatagctgagatgagatgacaggatgaaagataccatgcaccatgggtatgactgcgtggagcgtggattccatgattagttctcaatcttattattagtattctggggaggtattcatgttttcttgttattcgttagtacaagccttgctaaacttaaagtagagttcagatcgaaaaggcatagacgtatgatagggcgcccacatgtgtatgagcgtaagtttagtgtgtgtgcattgttcggaaactataggcaaacaaacgataaaaaataataaataatagatcaatcacaaaaagacacgagatttaacgtggaaaactctctcaaagcaggagagaaaaaaccacaggcgctagccagcaaaatatcttcactatatcagggtaaggttacaacgccgcacgatggtttacaagatgtatatatatggtggaactctaaaagggatgatgattcatacccaatcctaccggcgacgggcctccgctccactatggcagaagctagtctttattaagtgtaaatgaatttggatccataactcaacatgcatcgcatttgtactcgaaaaaaaatgagagatcgaaaaagtttagaccaagcatcagggaattctaagaccctctttgtttagtcttataagctaacttataagtcaaaatgtctaaacctaaacaaacaagcggctttttcatttggctttttttaagccataagccactctaacactattaaaccaaaaactaggttggagaagcttttttggcttatgtgaaatagatgcatgactctaccattaaacttagaacattaaatctaccagcttataaatcatataagccaataagctaacttaaaaatctaaaccaataaacctaagcccaaacaaagagggtctaaataacctcttcctaattatcgtggaaatcaaatttattgtttttgtttatttcttgatcgacaaagctcctacctttctctttaaaaagattgattcttatgaatctcctactttccaacataacttaggtggtgtttgaatccagggacttaactttagtctccatatttatacactaatttagagtatcaaatatagactacttacaaaactaattacataaatgaaaactaatttgcgagacaaattttttaagcctaattaatctataattagagaatgtttactgtaggatcacataggctaatcattgattaattaggctcaatagattcgtctcgcgaattagtccaaga

SEQ ID NO: 14036 - DNA, 1230 bp, Oryza sativa
aatcggtaagacccacagcgaaatcggaaccacagccaaaatcgaaccaaacaacggtagcgcgcaccgtggcgttgcggctgggatagggcccggatccacacgcagggacctccggctccgcagcgtggcatcgtcgccccctccgccgccgcaccctacggccgtagggaggacgaggaggaggcggatgcagcggcgacgacggacgagcagcgcgcggtggcgacttcgcgggaggcgagaaagctcggcggggggtcggtggagtcgggaaggagaggcggagcgctgtcgtgtggggacgacctgggcccaccggacagcgagagggggagggagagaggctttgccgcgagagcgagtgacgcgcgtgctttgtagcccgtgggctgcttttgcggtgcagctccggcccatttggacgatctcatggtgaagtgcccaagagttttaccagtttttctttcaagtcaaaaatactagctatgatagtccgcgttgctggcaaatacggattcaaaatttgccttgtaaatttaccagttgatcggtggctacaactgtcttgtatttttttttaaccttgccttccaagttgagatcggtggtaatactgccttgtaatgcagtcaacaatgagcacaaacgtacgtgttcctttcctttacgcatacatatgagtacacgcgcggtctgtaaattaatcacaactttgtcacaaaacttattccggaccagtttaatttaggtcgtatcaatgctggacatgtagaagagatatccataaaactgttccgcgttgaaaatataaggacatgaacaaaaccggacaaacaaagggcagataagacattggaacttggaagttcgtctatccccaaaggcatcagctaagatgaacagaaacaccacgaattttacgaccgtccatcgctccatagacataccacaaattctgttaccaatccccttgtaatatcttatctcttttgtaacagaattaaaattcctcctaaactaaaccaccctgcctaaactcaataacgatgatttttttcacgtacatcgatgctgttgcggttgcgtcccagtagatctcatctataaaatgtgcgacgtacgggacccggagcagagtccacagcaggcgccgcgcgcgctatcgatctccgccgcctgaccgccgtaccaccgtctcccggcagctagcgtcgaccggcgtcatgt

SEQ ID NO: 14037 - DNA, 1501 bp, Oryza sativa
tctctcttttcttagcacttctaaaaggcctttgaccaactcttatatgtaatatgtagtttttttttctatttttatcttagcacctctaaaaggcctttcactaactattgtatattatatatactacagctgaatgtcagctgatgctgtccagcctatttggaaactgaaaacactattgtgtcatttctctgtttatatgtatatctagaagaaattccatcacccctctatttaatcttattctacaatctgctttgatggcaggtacataattctatatgggttgctggttttacttaccttggtacaatacctatatacagccacttcttctccagggtaattgatccttgcggatgttgaagttttccctagatgatgacacttatacgttgcgtttacttgactcttgtgctgttagatatttacctgatatgttgacagctggctcaaggatgcatgcaacctttattaatacaacaactctctcaaagtaatgtcttactttatgttgttttgccttatgatatatatgtattttaagtgctgagcctgagtatcgtacaccacttatttatgctaaattaaatgcctttgtgattaagaaaaggcaggccaattccaaaagtggaagcttaaactctgccatgagtcgcagcaaaatagatcagcaaaatccacaatccactacagctttgttactacagcagacgatggatctatatcctcctgggacatccaccaggtacacctgtttatgtttggaatttatgctgctgaagtgtaatattcaatatcttttgtcatgtaatttctgtcctgtgatacagttgtatgcctccattttattttagggatttcacatgctcttactgccggctcatccaggtatctttggttttccaaatttggcatccagagatagtattaactgaatacagtgctccaaaaatatacaaaaacaaagataatttgacttgacataatgtaggtctttcaaggatgtaacaaactaacaatctgcattttgtaggaggtatgcttattatggtgattagtcttgtgttatgccaatgtactgaatgacaggaccagtgtatcttagattatggcatgtgccaatcgccctattttttttgtatctactaagttgaatgttggtctgccaatgtatgacatgaccagttatgactactagcatcctttctcatcagtgtgtccagtcttaagaccccttatgctttccaaagtccaaacgataatgagagtttctctggcttgatttttgagaagtcataaccatcaccagtcacaatctatctaattagaaaaaggtagacactatctgaaaaagagagaaggacacactgaacttcttttccttcatgaacacaccgtgctatgctcgttgttcttctcaattaactttgtaactgctcacatttgtatgcattatccatattttttagttactacaaatttcattcatactagc

SEQ ID NO: 14038 - DNA, 1501 bp, Oryza sativa
gacaaattgattaacccaaacagattggctggacacaaactccaataacaaggctgcaagatgttagttaaaagatcgggtgttatcttaaaataaaaagttaaaagattgggtatattagaagcaagttgttactagtctgaagaaatttggtgttctctgctctagttttcaagtcctgtcttaagaatcaaaactttgtaatctcagcctagttttgtatccccaaatcattattagataatcatgcatcactctaagtgtgctctacttgatataaaagtattactgtcgttaggtgagcttggcgtggtaggtaaaaaaaatttctatcctcctgaggtgtcattgataagcatcagatagctcatagcattgactctattgcaaagtggccatgtgataaagtcaactgccaataagaaaataaatcactagttcagtctcatgtttgcattataattttcaaacatggcgtgtcattgaattgaaaagtcctgccactgatctgtcacttgtctattagtgttgtgattgtatgaagattttttttaagataatctaacttgcctccacagtccatggtggagctttgaaaatcatgccccttgattagtgagttttttattctgacaaaatatatttgcatctctcaatggataaatccgacaaaataaaagaaagaatcaatacacataagtatccattctaaacctagtcattttgctctccttaaaaatatatatgtgcagagtctcaacctataaatcattgaaaaaaaaaaagaaagcatcaatacagataattatctattctaaacttagatattttgttcttcttaaaaataaaaaaatatatttgcaaagtctcaactgataaatcatactccataatttatcaaatgatatatatgtttgttctacaaatatttatacaaaacacctatcctataggaattctactataggataagtaaagcatcaacacataattatccattctaaacttagccatttttgttctccttgaaaacaaatatataaatttgcaaagtctcgcttgataaatcagacagaaaaagaaagcatgaacgcgcataattatccgttctaaacttagccaggcattcaagaattaaaggtttacagaattggcgacgacgttatagcacattgaaaagtattaaaagcattactcgaatgattcgaaatctcgattttcaaaaaacgtaagaatagaaactttgaaatggcgaattattggcccaacaaagatattccgtttatgggacaacttgctacttttccatgttgctaaaaaccgaaagtgaaaaatgcgaaacaatttgggaaaaatttcccgattcggcgtacatattgatgtataaagaagagccgaattcttcagaacaagaagaagaacaaacctttcttgcatagagtgtagtctgtactagtactgttgagatcaaccatctgtagcaaagtagcaagcttgaatt

SEQ ID NO: 14039 - DNA, 1501 bp, Oryza sativa
caataattcgccatttcaaagtttctattcttacgttttttgaaaatcgagatttcgaatcattcgagtaatgcttttaatacttttcaatgtgctataacgtcgtcgccaattctgtaaacctttaattcttgaatgcctggctaagtttagaacggataattatgcgcgttcatgctttctttttctgtctgatttatcaagcgagactttgcaaatttatatatttgttttcaaggagaacaaaaatggctaagtttagaatggataattatgtgttgatgctttacttatcctatagtagaattcctataggataggtgttttgtataaatatttgtagaacaaacatatatatcatttgataaattatggagtatgatttatcagttgagactttgcaaatatatttttttatttttaagaagaacaaaatatctaagtttagaatagataattatctgtattgatgctttctttttttttttcaatgatttataggttgagactctgcacatatatatttttaaggagagcaaaatgactaggtttagaatggatacttatgtgtattgattctttcttttattttgtcggatttatccattgagagatgcaaatatattttgtcagaataaaaaactcactaatcaaggggcatgattttcaaagctccaccatggactgtggaggcaagttagattatcttaaaaaaaatcttcatacaatcacaacactaatagacaagtgacagatcagtggcaggacttttcaattcaatgacacgccatgtttgaaaattataatgcaaacatgagactgaactagtgatttattttcttattggcagttgactttatcacatggccactttgcaatagagtcaatgctatgagctatctgatgcttatcaatgacacctcaggaggatagaaattttttttacctaccacgccaagctcacctaacgacagtaatacttttatatcaagtagagcacacttagagtgatgcatgattatctaataatgatttggggatacaaaactaggctgagattacaaagttttgattcttaagacaggacttgaaaactagagcagagaacaccaaatttcttcagactagtaacaacttgcttctaatatacccaatcttttaactttttattttaagataacacccgatcttttaactaacatcttgcagccttgttattggagtttgtgtccagccaatctgtttgggttaatcaatttgtcgtgctcaccatatgggtaattatactaatccagcttgacccctcgttaactgtaatttttatgttatcagaagtttgccagaaactgatgactattccaatgtactccatagaataaaatagtcttccaaaataatgctttcctatacctttttgggctatggaaattcctaaaaatgtctctctccatcatctggagttaatcctaaaaatattatatatatatatatatatatatat

SEQ ID NO: 14040 - DNA, 1501 bp, Oryza sativa
ggagccgtggcgaggccattggcgagcatgctcctccggtgctcctcccccacgtgcaccacccttccgcactcgccgccggcgatcatcgccgccgcggcgcacgccaccggaagcagcaccgccgccgccgccgccatcgcctcggtgatcaagaacggcacagctcgccggcggctggctgctgctgatcagctcgagttaagaagagaacgagagtgaattaatggcgctctcagccagtgacgcggcgccacgtgtgcgatcccccgccactgacgcggcgccacgtgtgcacctccatcgaagccactggaagctagagtacgcgtgataggggacacgtgtgcgcgaaagggtaacgtggggcccgccagtgggacccacttgtcggcgaccggaagcttccgaccgcgtaggcgtaggcgtcgatcggtctgatgatctgatcgttatcctgatgaccgagtaggtggtaggtcgacgtacggatagaacggaatttatttctaccgttttcctggaccgcgatgacgctgtccgtaggaagcccgcagagctacgctgctgctgctatcggataaggaaaactgatgaaaaacctctaaatataagcagttcaaaataatttatgaataaactcttatacagtaatgtaaaaatcaatgataggtgtgtttggaaaaccagttgtggctgcagcagcatatttgctgcttgatgcactattgacttgtaaacataaaaggtctgttcgttgcaacttttgtgcagctgcgcagttgtagctgctacagtgactatattgcttctatgttgtagctgctgctgcagcaagctgcaccgaacaggatcaaaagtagacgacgagggcatttagaaggagaggaattgtatttgttcctggtatttaatttttaaatttgtggtcggaagtttcggaagaaaaaatgtgctcatgagtgattattggctctgaacaccaacctctcttttcgttgattccttctgaggtgttgggtgttgggacacgatgctgccgccgacacgacaccgggttccacaatacactaatctactcgcgacaccttcattgaactgcatataattatttagaaagtccattaacacatcttataaaaccttgttgaatcatataatcattctacaaagtctatttgaacatcttataaaaaaataagatctgacctagtcgttacactctcttacattttccattagcctaactaattccgtgcaggaaacgcccaaaaataatagtaccaatagtccactaatcccgtgccagaggccgccaatgattagtgattaacccaaaaaacataatcatcatcacacgccgctaatgaccagctctcgcttagctaatcccacaggcggcccccacacgccactcctgccatgtgggcccacctttcacaccccccaccaaccagaaaaaaaactcccccaaaaaaaaaacttttaatgcttatctcgc

SEQ ID NO: 14041 - DNA, 1501 bp, Oryza sativa
gggaccgacaaatgactattattattggatgaaactatacggcaaaggccgtggtaccgatcacttaatccactgtgattaaaaaaacccagcaaactatatacccgtggcttgtttctattaggcggccctgtttgtgaacactgtgtgcactgtgcagtgggaaggtaaagtgcacctttttctcgcatgttgtttctcgcatgttgtttacgggtgaaaacgggatgaggattttcctaccgcctatctaacccaaagcttacgggaaaagcatgagaggaaaaatgggatacccgatattatccgagtttaaacttgaatctataaaataatatgggttaagatacgagaagaattgtatccgctcgtataaaatctattataaattcacctataaacataataaaagattaattaatcactatttttgtgtgctcacacgtaatattatataatttatttttttaagtaatgttttattttattatctaaaacaaaatatctataagttagatatataaataaataaccgtttccgaatctgattcgaagaaaataatatggaataggatacgggatgagtaataagttatccggcactacatctactcggttctgaatttaacaggagatatatgagaatgatgtgatccgaccgacccgatccattttcgcctctattttcggcttgctttcttttttttttttctgtgagatgctaaccaacaggtgtctgcgtaactgcgttcacatgaatgttttgtaacgtagtacattctcgaatttgggctgtttttagataagaggtgtaaagttttaacgtgtcacgttagatatacggacacacatttgaagtattaaacgtagtctaataacaaaaacaaattacagaatccacctgtaaactgtgagacgaatttattaaacctaattaatccatcattagcaaatatttaccgtaacaccacattgttaaatcatggcgcaattaggcttaaaagattcgtctcgtaatttacacgtaatatgtgtaattagttatttttttgtctatatttaataatccatgtatgtgtcaaatattcgatgtgatagggtgtaaaattttacaatatctaaacagtgccatgatcgttttaaatcagtctgcagcccgtctaaaaatgtagaaatacatgggcttgcgattcattactcacttaatttttttagagtaaattgtatattggtccatgttttttaactatggtttcacattggaccaccattaactgaatgctttcactttacaccagattttattaccaaaatgtatcactttggaccagtggcccacttgccagtgtggctgagggaaaaaaaaggaaacttctcggttgggaaggaaccagcgagtccgctggctcatctcctaccacaccgtcgatctctttccaacttcacccaaccatctcatggcggtgtgggcagagatcacgctaaagccttgggggcaaca

SEQ ID NO: 14042 - DNA, 1444 bp, Oryza sativa
cagtaagctttctgttaaagatggtgatacgattaccatatcacatagtctgtgttagatgtattgtatagctagctgtgtatttactcccttcttgagggtgctttcttcatatttgtattgagctttgtgtatatctgtttggcccagttggcccatttaatctgtggtccaatatttgcaacatggtatcagagcatatggtttagggttccacatccgccgccgtcgtcgtgaagctctctctctcctctcacgtgactggatccctcttctctctcgcgcgagcgtcgccacctctgccctatgacctcgcctgtggtcgccgccgcgccggcagtgtcgccgccgcgcctctgcctcttggggtcgccgccacgccaactggagtcaccgcccctcttgcgggcgccaccttcctctgctcgcgggcgttgcctgcccctgctcgcgggcgccgccgttcctgctcgcgggcgggcggccacgggcgggcgctgcctctgctgccgctgcctgcttctccctcatcttccaccgtctaaagctactgcctctactgtgatggcgccgccctcgggaaaaccgggtgccatttctcttctgaagcctccggtcatcttcaacggactcaacttccgggagtatgcattgcatatgcagatacacatgtgcagccagtggttgtggggctacctcatcggcgatcggccttgcccgccttgtccaaccttgcctgctgagcctgccatctcggcagatgctgatgagaacactaagcgtggtctccttgatgatcttgctgctgctatggaggcgtatcaaacagatctctctctatatgagacttggttagagcaggaggcctatgccaaggctattttggttgggagcatggaggttgacatatcactcgacattgcgggccttgctagctctgagttgatgtggacccgtcttcgctagcagtacgagcctcgcaacgatgccatgtttcttgccgttgtgaatgaggcacaatctcttcgtcagcttgatgccactgtggatgagttctttcgcaagatgtctgcggtgtggcgtcaaatggacctacagggcgctgatgtttgtcgcacttgtacctgttgtcagcgccagagggtccagactgagaccactcgcctctatgagttcttgtctcgtttgaggcctgagtttgagcctgttcgagctcagctgttggcacgacgccctcgaccttcattgttggagaccttgcctgagctacgggctgaagagactcgttgtcgtgaggctggtataggcattgcacagcagtccacctctgtcttggttgcacagggcttgccttctcaggtccatgtctctgcccagcctgttgtggtgccatcacctttacctgttgcggctggtgctcctagtactccttcaggcattgttt

SEQ ID NO: 14043 - DNA, 1182 bp, Oryza sativa
ctataaagcagctgataatattttttaaaaaattatcgacggatgtattatctagatagtctcgaccgattaccatgcatacactggatcatttataccatgatacacaacaacattatatctaagtagagtatgtattacttcagtggtcagtatccactaccaatccattagtagctagtacaatctacgggaaatgatttagtcgattgatgtaatatatatctcaaaagtgcatattaattagataggtgagattgatgttgctagctatctcagtaagctgtccacatttaatattttttcttttgcaacttatagatactcactttccactaaatatatatgataaatacccgtcgtggcctacacttgattagttattgttccaaactggatattttgtccagcctgggtattaatgttagctaattgctaatatatataagctctgtttttatatactttgaccaacagtttattcaattacttaattaattaagagaactaccaaatatgtcatcaaaagtattttaagcatgcctgatctctctatttacacaaatattttttttctagaaaaaggaatagtcaaatgattgttatttttttttaaaaaaaatagcactcgctagctccagtgtcctatgcatggagtatttttacattactattattacctagcaggagtcatcagcacgtacgtgtatctcacaccgtagcatgcatatcccgatcaacatgtgcacgtacgcacgaattattatttgcttttctagcttggttgtgcatgtcccaccacaatcgattacacactacaattatttatgtaggcttgaccactagaaaaatcacataagatttgcaacccctccgacaattgtagagactggaagttattaattacagtatttcttttcattatttagatagtattccgattacataaaacgaccttacataacaatcatatggattatgagatatatatatatatatataggaaaatggttctatactcctagggagtacgtactccctctcccatccaccgttcatctgatcgatcagatatgtactccctccctcatcataacgggtttggctcggtggatccgattagtttttctaattaaaagaccggactgcttatcccgtaatttggggtttgctcccaacagg

SEQ ID NO: 14044 - DNA, 1501 bp, Oryza sativa
caactgatctaatttagggaaaaaaaaacagaaacgggacattatcatgagatgcgttgcaatttgcaatttcatcagctgcaagattcactttactaacttttgcaagaaaattaagcaatgcaattgaactgcaactccagatgagatccacctggtctgtcagtatctctcactagtctcaccccactggtcgtcggcgatggcgactcttccattgctgaagagtcatccgtgtccagcttattactatagcttgattagatatttggatttggattagcaaattgggcagccccattcttttctcattactatactactccctccatcacagtttaaatgcagcgttggttttcagcgtccaacttttttaaccgtctgtccgtcttatttaaaatctttttaaaaaaacttaaaacataagtcacaagtaaagtactatttatattttatcatctcataacaataaaaatactaattattaaaaaaattttaaataagaggaggatcaaagttggacaaggaaactcatggtcccatttaaaatgggacggaaggagtaaaatccttatatttaggaagggtggagtactgtttattgtttattacgttccatgcgaaaactttctatacagaaattactttcaaaaatcaaatatatatattcgtcaagtttgtaataattaaaacttaattactcatacactaataaatctctcattttagtgcgcctactcaaccttcagtttcaacttaatttgatactccctccgtctcataatataaaaaattttggatagatatgacacatcttattacgataaatctgaacatatattcgcctaaaatcaattatataatgggacgaagagagtactacagtagtactaagcaggatgaaatgctccccagatttgatacggagaatagagaagaaaatctgtgttccgtggaataccggatttgggtaggaagacggcggttttgctttccgccttccacaaatggcgggcgcgccaaaaccaccgccacgtttctctctctctctcgcgccaaaaaaaaaaaagaagaaataaataaaatccggtttctctctcccgtcgcggagggtttgcatccccaacccaacccaacccagcggcggtattcacgtcgctgtccatggatttgatgctgcccctagtttctcccctccctgtttctagcgccagtatatctctccctccctcgctgcttcttgcacctctcctcctccacgcattgcttcttgattcttgattcttgctgcttcttgcttcttgttgctgttgttcttggttggatctttgatgaaggtggggaggggatcgagggggggaggtggccgcgatggcggcggcgtggtggaggaggagaggagtggcggggtggaggcggcgccgccggtgaagaggaggcgggtggcggtggcgccgtcggctggggccggggggagcaggcgggtgcaggcggaggcgtc

SEQ ID NO: 14045 - DNA, 1501 bp, Oryza sativa
tgttcgactgttcgtcacagcttacttaactagcactatttataaactactaaacgacaagcaatgtattttgtgcaaaagttttatacgtataaatttattaagaatcaaataaatatatatttttatttataatatttaatatttagttaatcctacctgcaccttttttaaattttttttgcaccaataatctcagccaaacagttgaatcgaacgcaacgaggaaccatggtatgcccagtgtttggtaaccaacaaaacacgtctagcttaagaaaacttaaacaataggataatataatttttgaaataacctttatatagaaaattttggcgaaaaatataacgtttagcaactcgtgaagcatgcgcatgagtaatgagaaagaaaattgaaaaggtgcagaaaaaaacatgccttcttttacacaagaatatacccttagagcattatttggagtgaagattttggagaaacatctatactacggtaaatattggcaatgatgatagtagtcaatctgccaccataaccccttatcacttacgtgtgggcctctcaacgttggtaaaaaaattatacttcctatttcaaatgctccttatccctaatccctgaattgtgctttcattcgatagtaacatgtgaaaatatgttgcgtaaactaaatacagtgaaaacctaaaaactataatgtaaaaatggatgtacgagattagttcacgtcatctaaaatactaaaagctttactcatagattcaatcatgactaaaatttttactcttggcggcgtgaaaaatctcagacatcctttttttaaatcaacgggactccagtttttatattttcagtatacgtaacttccagcgacatatttttaattgcaacgcacgactagggtgcaagcgggccaacccgcaaacccgcttataggcaaaatgagtggataacccgcggtttgactcgcgggttaccaactaatttgatatataaatgagttttggggttgatccacttgcttctctatgacacggcaagccgagccatgacgcgaaaacccgtggattaccttctatttacatccctagtcctataaaaaaaaaaatctccgcagccgactttccattcagcccaccctgaggtctcggcgacattgcctgggccgtggcgctctcgggctgggctttttctccccacggagaacacgctcgcggccatcacgttagcagcccactcgctcgctcgctcgcggccgcgtctcccgtcgtagctcggaggaaggttctagacgaggaggagaagacgccgccgccatcttcgcggccgccggagagcagccagcagcggggtgcgggcgggcgcgggcgcgacgcgcgtggcgcgggtggagctcggaagcaggcgcagcctccacgggcgcaggcggggttgccgggacgcgcctgggcgggcgggcgggctcgaggttgtggtggggcgtgtggcaggatcctcctc

SEQ ID NO: 14046 - DNA, 1501 bp, Oryza sativa
aaaaactaattgcacggttgggggtaatcgcgagacgaatcttttgagtctaattatccatgattagccataagtgctacagtaatccacatatgctaatgacggattaattattttctttaaagattcgtctcgcggtttttaggcgagttataaaattattttcttttatccgtgtctgaaaaacccttctaatatatggtcaaacattcgatatgacatctaaaaaatttatttttactacctcggtacccaatcccgagttctgtgtgcaccacctgacggcaacggcaacggcaacctgtacagcgcaccgctagatgcttcctgcacgctgtagcttccggcaccaccagtccaccacatggcattaccatttcaggaagcgtgcgcgtcgttgtgcctgtccggacaccagcgacactttcaggttcctttcccaacttgccaatcgaccaaagcaacgtgtagggtgtttttgcaagaccaagttcccaacaccccctctcgttttctgcgtacacacttttcaaactgctaaatggtacgtttttttaaaaaagtttctatacaaaaattgtttaaaaaaatcatattgatctatttttaaaaaaactttagctaatacttaattaatcacgtgttaatgaaccgctccgttttctgtgtatgagagatgggttcccaacactcacctccaaacacagccaaatttgtcttcttcgggagagtaaaaccacgagcaaatgattacccctccccagctctcggccttcaccaaaaacgaagggattatgacacgaaattaacaaaaaagaaagtttcagattatcagctggaacaagcacgggctagaggttgctgttacctccgtcttaaaataaaattttcccatatatatccaataaaaaaactaaaatacaactattttatcaaacctcaatacaattttttttattttatctattctaatacaattacttatgacttttacaaaactctaattcaataattactttaaaaacaaacttattttttaaataaagaagaagctaaaagtaaatttattatgggacagaggaatgctaaccatgacgtttgaccaaagttttcttcaatttttcagaaatggttatgtcaaaatatcgaagaaattatttttcttaaaataagcattgaaactctttttttttcttgaaacacgcccatcaaagtgacggctgctccaaagcgcaggatgtgattagctgaaaagaaaagcaaaacgcacaataagctaatgctaacaaccgcaccacgtgttcggcccggatctccccatgtcccgtcaccacggcccatcaggggcccccaaatctctctccaccctttcagcgcgccacgtgtcccacaaaccaaacacttgccccgccacgttcccccgagatatttccaccggggtgggccccaccgcttctcgccggagtccacgtgtcggcctcgccggcaccggaccaccacc

SEQ ID NO: 14047 - DNA, 1501 bp, Oryza sativa
tggccagaatagggttctagccataggaggggaggagttccacggagaggaggttactcgaccagcaaacgagaagatggaccgccgtcgccgccagccgcttccccgctcgcaccaccaatccttgagaagtcgctacctccttgcaccgccacctcacgtcgttggccaccccgtagtagaccatcgccatctccatttgcaccacacacggtaaaggacatcgaccggagagaggacgacccctcccgccatccatggccaacgacgatagggctgccgactcccacgtcgccgatttggctgctctccctgtctgccacccgagccaagccaagggaaccctagatctaggagtgtttgggaatggcaacgaagctcggggtgggagctcctccgccacgcaccctgacgcacttggtgccaagctcagggcggccgctcctcccctcgccgccatgtagccttcgcgccatcgccgccgcacggcctcgtcgtcactggccgccccttcctagcaagccacacggtttccgacggctagcactggcggcggcgaggtaaggaagaggggaggagggtggcggcactagggtttagcgcgtcgccctcgggccaccggtctgaacccgcggtccacctgggcgcccaacgcgcgcgcgccgtcctcttcgcacgtcaccacatccgccgccccttccacgctcctcgttggtgttggtggctgttaaatgccaattctataccgccaacatctacataaggatcagataataaaacatccaacatagtaataggtgtttaatctcacatattccacaagtgttggtgaatatctatatgcagatgataaatcccagtgctgggaggaaaatcagactaaagtggggagaattatatatccatgcaaggaggggttgtgaacttcatcgaaacatcggtgaatcagcccaaaactccgagaattggacagaggaggaccagaggagaaggcaggccgaaggccaggccggggggcccagcccaagttcggccgaaccccctggtgagcaccgttggatccaggttttggcgtggacggtcctgatcatctcctgatgacggttgcgggcatttccgacaattcgcatagtacaaccgtcatacctacctctatataaagacctcacttcactcacttcaacacacacttccaagcttgagctgaattataagaggctctatttcactatattgtatactagaataggaagagagtagagtagaagaagtcggaagaattccgaagctgtcggtaatcttctcctatttcttttattctgtttattactctgaattcaatataatattcttcctgagtaatttagatttatcttgtgagaattatctcttggttagttcctaaatagcatatgagattattgttcactataatcaactaaaatatagtgattgctttggtgagttagaaacactaaagtagatattaattacttagacg

SEQ ID NO: 14048 - DNA, 1501 bp, Oryza sativa
ggatatgcatttcattccatgacattgctcttcctaccgtctagagcttgagtgcatatttttttttcgccaggcagcttgagtgtgtattcactaataatgaagcatatgactgttgagtaatacggtttcccctaaatgtgtaataaagatatataattttactgttaagcaaactcttaatataagatttcccaccttgtgagctgtccatctcacaaattctggagatatgcgactggtattaccaacctttgcagagaacagttacagtagcagcttcactggaatctttaatcctccggattaaaaacagtaatatactccagtgtttattcttaagcatattgagatctcaatcacccttaccccatagatacatattaagcatgtctttacaccaagagtttgttaaatcatcatcagccccctatgtactggtgcacttttataacattgaacattgtctttagcttcccaagaaggtaaacttatgagatggttgtgttttagattggccaatggccagaaggcctggcaagcatcattaagtcctatttcccctcaaaagtctagcaactgtaacttgtgatctccaaatacaagcaggtatgccaagtattagcacacctaaccatgtcaggtatgtgtgttcattccagaagaatcggaaaaaaaaagtccactgttggtagattaacataagcgggatgcttttgtcataccctggtgaaaatgttgtgctgtcaccaatttcctggggacattgattgacattttcattttctataaaaaaaatggaaaggagaactgatcaatattgtcactggcttcacaattcactatggggcattgattttaccatattgctatgatgctatctgatgggttgaatagcgaatttcatgatgtgtatggtcctttctgatctattatctctttcatgtatttaatgaggtttatgtctatcttactctgtaactgtcaaaactcaaaactgctagtttctatttattgggctccagtttggttaggctctcaggtgtactaccctatgcagaaattgcattttttttctgttgcacaataaaacatcatctccgtgcatttttgtttgacacaattgcacagcaactaatatagttgtctactcagtgctctaatgccaattgagtatatttcatagtagttaatcactgctacccaccagtaactgtcttttctttcagagaatcactgataagtgataacactgttagtgataaacttttctatgcaaggctcaatttacctacgaaggttacattccactgcactatgtacctaagcaaggcagcgcaccttgcatgcatcatgtggagagctagtactccatgtcgtcgcactgttcttctttatctggtttaagtaaccatttggctttacaatcccaaatttgaacctctcttcctatgtttgtccatgcaggatatctggcgtcatatacattccctaatgccaa

SEQ ID NO: 14049 - DNA, 1501 bp, Oryza sativa
agagggcgcggcggagggggaggacgacgggaggagggctgcggcgaccgagggacggggagaggcgcacggcttcgatccctcttctcccactggtggccatcgaggagaagggcgacggacggctcggcgagcgtgcgcaagagagatatggccgccgccaccccaggcgcctcacgcgccgtcgcccaccatcgcccgccgccggccatgcgctgtccgtcgtcgcgagggaggaggcgagctcgtcggggcggccggcgggagatgaggcagcgcacgccggctgacgggagggagggagaggagcagtggtgcgcgagcgttggcagccggtgggagggcgggagaggagcggcggcgcacggggaccagtgggagggagcggcgtgcggcgacccgcaggtgggagggagaggagcggccgtcgttgcctggagagagagagagatgaagagagtggagatggggagggagcaggaagaagagagggatgagttggactgacatatggggcccacgtgggtcccaccttattattattattttctgtgtgactgacatgtgggggccacgggttttattatttttctggatcggattgccacgtaagcgccacgtcagtgccacatcagatgaatatcgagtcaaaatggccacgtaggcgccacgtcagccaaaaccaccctcaaaaccgctaagggacctcgtttgtccggttttcgtaagttgggggacgggtcatacccggttttgcggttcagggaccaacaaatagagggacctaaagtgaacttattcctaatttaatttgagaccaacgaatttggtacaattttaaatctggcccatccatttcctgtcgaggaattcagcccataatttaatttgagaccaacaaattcggtacaattctaaatctggcccatccatttcctgccgaggaattcagcccataatttaatttggcctacttaattctcgtctacaaattgagcccacgaacaaattggggctacatttgtaccgtttgtaaattcagcccttaattgaatttggcccagctagttcccgggcccttgagtgaatattttgatatcttctaatacgccccttagttttgggatttcttacgagacagtctttggatcgaagcgtcatctaggccgctagattcgtcgatcggacggccaggattgcccgttagcgtaggagaagagcaaccaacacgcgcaccaccacctcgtcgagcgctcggcgtcttgacggcggcgcgcgcgaggtgttcggagaaatgctcgcgtgagcccaacgcctctcatgcttgccgcgcgcgggctcctgagaccggaggcggcggcgcgcggcctcgcgctccagcgctgcttcgtcgcgccgctccgcgccgcatcggggatggcgcttccgggggccagcgcgaggttccacgagtacgaagccgccatcacggcgtgcatcgagaggagggcgctctgggagg

SEQ ID NO: 14050 - DNA, 1501 bp, Oryza sativa
gatagataacttagatgtaagttgtgagactattgtcgccatatattaaaacttctagatcgcttgaagaaacaagaatgcatgttcactcaagggtctttgtcaaatctaaggctataaaatctattttgtataatatagttaaagagagaaaggcataaacctcgatcacaactttgctgccccgtaaagtggttttttgacaggctatctctattataatttgttcaaacacgacaaagctgcttaagttgtaaccttgaaagcaacttcaagttaagaagtgaccgtccaacgactgatgaattatgttggagcaatttttcatttttaaaaggatattcatacttctttagtgtcggtaaaaaaaagtacccaaaagataccaattaatgtcataatgtgggaggtatatatcacatccctaccatattctatgtagtactatatagtttagtgcctaccttcaagcatacatgcatgataaaaaggtatagtgggatccaaatccaatttgtgatttctttgggatcattatatgaagacagaagatggttggtgccaaatagtacaagaagctagctaatttaaaagtcattttgatgctctttctattctttgtcctggacaatgacactcactgatccacatcctgttctatggatggattctagatatgatatgacctctcaaacgaatactactggtatttgactctcactcacagtccacagttccacacaaaaccaaaactgatgatgcatagcatatccctgcagcgaccggcctcagcgtctagctttctacagtgtataacaagtactacgcaaaaggaaatccaaagacaagcaatacacatcagtttatatcgagttcacggccgctgagaacaatgaaactgtcatgcacggtcatactaattattaattagggcagcatattctactaatagtggtagttgggtgtagtagaaattaaatataactatgaattttcatgagtataaaaatgttttattcaaaactgcactaaaatatctttactaatttatctaaacatgctatatgtcatacaaatttatcatggcgctatatattttaattttaattttggaaaaagtacgaatttttccacttgagtattgcggtagtacgatttaccccctaaaactacaataccggacatttaacagcccaaactcttaaaaccggataaattaccaccatagctcgattataagcggttttcagcctacgtggcacacacgtggcgatacagtcagaaaaacaaataaaagctggtggggtccacctgcgcttttcttctctctccttgccctctctctctcttggtgaacataggagccgactggcaggtgcggaggcagccgcggctccaaggccggcggcgggcaagcgcggaggcggcgggccaggagccgaggccggcgactagcgggcgtggaggcggcgggtgaggaaccgacgaaggtagtcggtga

SEQ ID NO: 14051 - DNA, 1501 bp, Oryza sativa; identical to SEQ ID NO: 13782

SEQ ID NO: 14052 - DNA, 1164 bp, Oryza sativa
tgcacccccttagctgaaatataaatatatcatttgattgatatttaggataatgaacaactagcagattatgccgtgcaaatttacacggactagacagcatctccagcagagcccctaaactaattaacccctaaatagtttttggggtgaaaggagaaaaattgagatccacaggacggcaggaccgctattaaagcccctaaaatagaaaggcaccgaaatctctgtccatagccctcaatcctagaggctctacacccaaccccatctctttttctttttggtgcgtgtgaaaattccctagcgcgcgcttctcccgttgttctcgcgctctcactgtgttgctaccctcttttcttttgtcgtgccgccggctattatctgatcaccatcttgctaggatagtccaacgttgccctgtccgatgtcgttcgtcaacctacgtgatctccacactgacacgtcgcaggtcgttgacctcatgcgtagcaactctagcaatgtctcgcgctagtagtcggttgtccggattgaaccattcatgtttgtagtatatgttattttaaaaaaatcatataattcttgtgaacttgcatacgtgtgtgattgtgaaaattgaattttattatgcattttgcaatgttgaaaattttgaatttaaatttgaattatggtattcaaaattataaatttgaatacggttgaattctacgtgtttgaattattctggtgttaaactagacataaatataatgtgcgtactaaaacacacacacacagagatggagcctaagaaatggggtttgtagctgaagatgggggcaacccccattagacctttagaggctttacaatagggggctaggggctgttgctggaaatgctaattggacttattgtacaacactatttaacttttgattccataaatataattatatttaatctatcttgtcaactcttaacttttaattctataaatttaattgcaatttatatacagtcgaaacgtggctacgaaccacggtgtcgggggttcgaatccctcatcgcccacagccttccaaagggttcacattctttggctctacctatctattatagagtaaatagctcttttcacaataagagttatccatacagtgacagcgtttaattatg

SEQ ID NO: 14053 - DNA, 1501 bp, Oryza sativa
gtggcgcgctacctcgtggagtccagcggagaactgctcatggtcgtgaggtgctctcctcgtcctggagagttcacgtcagcgttcaaggtgttccgaatggcacaacccgaggaagacgacgacgcaccctcactggatggccggacgatgctgttcgtcgggcgtccctgctccagatctgacggcgatgtggttcggtacatctggagggagctgccctcgctggaaggccggatgctgttcgtcgggcgcggctgctccagatcctacgacgcggatcagtaccctggcttcgagggcggcatctacttcttcgatcatcggatcgccgggcagctcggcgacgcgccggcgcagtacccctgcagcgactgcgggaaatggacgggaaaacctgcactccaggtggaccgcttcttcccggagcaagacccatcgaactacacctctcaagtttggttgctcaacgggtaagctagtttttgatctgtctaacaggtgcttcgtctgcattgtctttgtttctttttgctgagtttggaagtttggatggtattgtagtgctgagattgtagtttctgatcagtctccaactgttagaagaagcagaacacctttttctagtagaaatctctttgctattgcagctatgatcaatacaccgtttgataatttctgcttcccacttaattgcatgattcaatcattagtatattcctgttgcaactgattttcagtgcggacatgtgcgtatggttgtgcttatattttctttgtgaagtgcacatcgttttgactgatagatggtgttgtacctttgccttgcacgaattggatttctatggattctgatatttggttatgtagctctgtcagggcttttcttgaaaagccactgaatgaagtatgaatatcgaggttataaactgaatgaagaacccagaatggttggatcttgatttattttgtattctttaccatgatggatttatcaaatttcagtcaagctttgttatgcctctctggtgcctgcagattctgctggcttagtcaaatttcctattgacaaatcaattctgcagaattgcaggctatatttttcctctttggaacctgctgattctttatggttagcaggttacctgatatgtaatacacaagacacctctcaaaaagttgtcatacacagacgcaatgcttgctaattaagttggcatggtatcttaccctcatctgttttagggctcatgtttaacctgttcattttgttggtatcgtattttagtccgaggtaagtagtagctaaacattctcatgaaccatgatgccggaataatttctcatctgaactgtgcgtgcaacatgcatcaggtcacagtccatttttgttgttcagattgaaatagcgagcaattttgtttgaggcccttatggcattctgaatagaccttgtaactgaatattgttgaaattataagcacataatgatttaatttat

SEQ ID NO: 14054 - DNA, 1424 bp, Oryza sativa
cttgagtgtgtattcactaataatgaagcatatgactgttgagtaatacggtttcccctaaatgtgtaataaagatatataattttactgttaagcaaactcttaatataagatttcccaccttgtgagctgtccatctcacaaattctggagatatgcgactggtattaccaacctttgcagagaacagttacagtagcagcttcactggaatctttaatcctccggattaaaaacagtaatatactccagtgtttattcttaagcatattgagatctcaatcacccttaccccatagatacatattaagcatgtctttacaccaagagtttgttaaatcatcatcagccccctatgtactggtgcacttttataacattgaacattgtctttagcttcccaagaaggtaaacttatgagatggttgtgttttagattggccaatggccagaaggcctggcaagcatcattaagtcctatttcccctcaaaagtctagcaactgtaacttgtgatctccaaatacaagcaggtatgccaagtattagcacacctaaccatgtcaggtatgtgtgttcattccagaagaatcggaaaaaaaaagtccactgttggtagattaacataagcgggatgcttttgtcataccctggtgaaaatgttgtgctgtcaccaatttcctggggacattgattgacattttcattttctataaaaaaaatggaaaggagaactgatcaatattgtcactggcttcacaattcactatggggcattgattttaccatattgctatgatgctatctgatgggttgaatagcgaatttcatgatgtgtatggtcctttctgatctattatctctttcatgtatttaatgaggtttatgtctatcttactctgtaactgtcaaaactcaaaactgctagtttctatttattgggctccagtttggttaggctctcaggtgtactaccctatgcagaaattgcattttttttctgttgcacaataaaacatcatctccgtgcatttttgtttgacacaattgcacagcaactaatatagttgtctactcagtgctctaatgccaattgagtatatttcatagtagttaatcactgctacccaccagtaactgtcttttctttcagagaatcactgataagtgataacactgttagtgataaacttttctatgcaaggctcaatttacctacgaaggttacattccactgcactatgtacctaagcaaggcagcgcaccttgcatgcatcatgtggagagctagtactccatgtcgtcgcactgttcttctttatctggtttaagtaaccatttggctttacaatcccaaatttgaacctctcttcctatgtttgtccatgcaggatatctggcgtcatatacattccctaatgccaa

SEQ ID NO: 14055 - DNA, 947 bp, Oryza sativa
ctgcacgggtcgagtcgcacaacacctagtatccatcgtttacggctaggactactggggtcctgtccaagccaaagaacttacccccgaaaagtcctgacaaatgatgattgagacgagattccgcgtttttgaaccacgaaaggccaactttcataattaaacgctgtcactgtatggataactcttattgtgaaaagagctatttactctataatagataggtagagccaaagaatgtgaaccctttggaaggctgtgggcgatgagggattcgaacccccgacaccgtggttcgtagccacgtttcgactgtatataaattgcaattaaatttatagaattaaaagttaagagttgacaagatagattaaatataattatatttatggaatcaaaagttaaatagtgttgtacaataagtccaattagcatttccagcaacagcccctagccccctattgtaaagcctctaaaggtctaatgggggttgcccccatcttcagctacaaaccccatttcttaggctccatctctgtgtgtgtgtgttttagtacgcacattatatttatgtctagtttaacaccagaataattcaaacacgtagaattcaaccgtattcaaatttataattttgaataccataattcaaatttaaattcaaaattttcaacattgcaaaatgcataataaaattcaattttcacaatcacacacgtatgcaagttcacaagaattatatgatttttttaaaataacatatactacaaacatgaatggttcaatccggacaaccgactactagcgcgagacattgctagagttgctacgcatgaggtcaacgacctgcgacgtgtcagtgtggagatcacgtaggttgacgaacgacatcggacagggcaacgttggactatcctagcaagatggtgatcagataatagccggcg

SEQ ID NO: 14056 - DNA, 1014 bp, Oryza sativa
aacaggagggaaccaagcctgagctctttgcttggctcctaaatcccattcaaatattcttaaaaaaatcacatatttcttttttttaaaaaaaatattatgatgattacgccgaatatgtcacttgagccttaagcgtggagaatttaatttggctctgtcaccaccatcaggaattgaagcagggaaatgagagctataaccgttgaataacctctcaaaaaatccctgaattttagctgcttgagcaccttaaatgtgggatcaatattcattaagatcaagttactaacttgaaaaatatacagcatgtgtgtgttgttttgaactctaaaaatacctagacggagttatgcattattgaaaacataacatatgaatgcaaacttatactagaaaaacccatgaattctaaccttagtggtttttcaccaatatttctaataaggggtcaacctttggaagatgagaactctaccatttgaacacatgaatagtgaaaaatcaaactattaaagcttgacgggctagggccataactgagcattgccacgtcagattattgtacaattatactactctagcagtacatacactcttggctgtgtactgttgtacgaaacggagagtccaaagtagtagactgtccatatagttcagtttgatggatttcacccggagatacaccgtacgatttaattgtaataatacatagaaccatttgttttttttttgaactgaagaaccatttgtttttcatttacttttactttaaaacatggacaatgaatttgtttttgaacagggcttgaaactcttaactccgagcaaatgaaaattcaaacagcagtggattcaatattcaactcgaaacccctcctttttttcaactaaaaagtccgcaaaacttcccaataattaaaccgtgaaatttcagcgagacctgtatttaaaaatatgggccaaattcaaaatccaaagcaataaacaactgggctacacacaacatgcgac

SEQ ID NO: 14057 - DNA, 1501 bp, Oryza sativa
gatttatcaatctgtttttacctgaacatctccataagaagttatctgtgggattttgagactagtttctctgttttgttaatgtgctgtcgtgagaacatagagtatgtggtttggaccagcctctaaattatgtatgcacttccatgttctctgtgatgtcctgtattttgatgctgtgatcttgtatcgctgtatcatattgttctagggctcatggcttactcggtcaccatggcgctgattccattcacagtgttcagcctacttaaacatatttgcaattttggttagatgagtttgttgtgaaatctggtcagtgggcatgcctagcaagcctaaatcaagttgagcgagcctcaatcttatcttgcttttggtgaggaaaatgttgtctgttttgtggttgtgttagttgaggaaaatatggtcgtgccattgctttaatcctggaatcactgtgatgactgactgaaacgagtttgctagttaaccaaactctgttaccgtcaatgattgaggaagaagtcttggctcgtgctgttgcagaattgcacgggattgaatcagtggcaacttgagttctggatgaattttcttccaaacaaaacctcgacagttcgactgtgctggcaaccactgttccttggtttgcattctgttttgcgggaccgcttagcgttacgacaaatttagggcctgttcactttgatgacattttcaaccttaccaaattttggtaaagttgccaaaaaagtggctacatttagtttgctaccaaattttggtaactaatgaaatcttgccaaaattttggcatagttgtcaaaatttcagcaataccaaaatttagtaaggattttttttaagtatcaaagtgaacatgcccttagcaaaacactgaaactttgtccgaaatttgatccaaaacgaacggtttgaggaagcttcggacggaattcgaactaacgccgtgtttagttccaaataattcttcaaactttcaacttttccatcacatgaaaactttcctacacacataaacttccaacttttcatcacatcgttctaattttaaccaaacttctaattttagtgtgaactaaacacaactaagactgtttagttcaacgcaaagtttagattttggttgaaattagagatgatgtgattaaaaagttgtgtgtgtatgacaggttgatgtgatgaaaaaggactgaagtttggatccaaaccttgcatctaaacagtaaacacagcccaaattcgtaaaccgtcgggttcattcacttcaccccgcgtcaaacacgcaacggaccggagcgcgccgcgaagccagctcactcggtcagtcgcgcacgtggccccactccaccggccacgtcaccctccacgtcatcaaaagcatcctctccctcctactctcccctcgtctactactacttcacctcgcaatctccgcccaaatccaacgcctcgtctgaacacaaaaccccgtaaa

SEQ ID NO: 14058 - DNA, 526 bp, Oryza sativa
tgtctcgtctgtgagccgccggccgttgttgctctgcgacgttggcaagcgctgctgtagcctttgtgtcatgttcgacgccatggcttgcctccggagatctatgcccgacgagtcgctggcaccggcaacaggtgcggcaaagccggttggtgttgctggcaggctgatggacataaccttcttcagctcggaggagtccggtgagtcaagtggcgggaatatcacctcggtttgtcgtggtacacagcgatggagtggtggcaactgtaaagaagacaaacgacaatgactcgggtggtgtttgcatccagggactttaactttagtttctgtatttagatactaatttagagtattaaatatagactagttacaaaactaattacataaatgaaagctgattcgcgagacaaattttttaagcctaagtaatccataattagagaatgtttactgtaacatcacataggctaatcatggattaattaggctcaatagattcgtctcgcaaattagtccaaga

SEQ ID NO: 14059 - DNA, 1501 bp, Oryza sativa
gcgtcgggatggcctacacgcgttcggatatcgaattcaccggttaatcgcgctgtccttcttgtcgggaaatatatacacagcagtttaaatctaagcctttaatctatggcgatggtgtgcgtgctgaccttgccgtgggtgacaaacttgaggaggaggcaggcgatggaggcgcctagcagctgggcgatccagtagaagagtccggtgaggatggtgatgtggccgccgacggcgaggccgaacgtcacggccgggttaaggtggccgccggagatgttggcggcgacggaaacgcccacgaacagggcgagtgcatgggcgatcgcgatcgccacaaggccggccgggtcgagggcgccaccattggtcaattgccctacacaaaccaagccgtcggtaggtcagaaatgaaacatactactgtacatatcaaaccggaaaatgcgttgagctcaccataggcaatggcggatccgacgccagcgaagacgaagaggagggtggcgatgaactccgccacgtaggccttcacggacgtggcgctgaaggagtcacccaagcttccgaatgcgagcttcaccatttttaatctatatttttttccttattactctgataagtgtggagaggtctctacgcttgaaagagagcttggcgattactgatgtggcgaagctcgttcagcttaggccccttttatacacatggcgtcgtgctggcaacttaattcgtcagcttcaattgtggtttagaatagaacgggcggtgcggatgatcaccaaaaacattttaattagacgctagcttgttctatgattgatactagcctctgcccaaccgcactttgctttgtccaaatgttttgttgctattatgaaatttaagtaggagtaggactaatgtgtggctatgagaatactaagactctggatgttagctagcagtaataatatggatcatatgttgtgcatttgaatggcaggaaatgtttgatgtgctgcggtgctgcctttgtttcttatgattctgacgaaacgaagtgaagttcttttttcttgccagtgtacactcaaaaagtctgcccggtgcttttgttccttttacaaaatataacgtcatgcctagaaaattttgaattttattaggttccaccgtgaaaagccactgttgacaagttgcgtaaaactcttcctctcaattcaaaggaaaaggtagcttgtgcaggaaaatggttcacaatttgtttttcgtctgactgttgaaactagttcaactccctccgtttctaaatatttgacaccattgactttttagcacatatttgatcgttcgtcttattcaagaacttttgtggaatatgtaatatatatgtatatacatgtatatatatatatatgtatatatatatatatgtatatgtgtatatatatatatgtatatatatatatatatatatgtatatgtatatatatatgtatgtgtgtgtctatatata

SEQ ID NO: 14060 - DNA, 392 bp, Oryza sativa
gataatatccaaattaattgcgtgtgatgtgcagcagtaggaggtaaagtatgcttcccatggtagaattggcgccaatttttacttccctctcagacttttccctccaaaacacatctgctcgagtcagagagtagttgaatagctgggggaaattaagcaacgaatctagaccatcccttgtatgctggatggttagatgatggatactgctaaagttacatgatccgaatccatctacccctggcttctcatttcacacggcaaatgaaaacagtatatattattgtcctgtgcgtgcagcgtgcgtacgtgtctcactcttgttggtgtttatttaccggcgtccgtcgccctggtcccgacgtagtacgtggtgttatgttaacagg

SEQ ID NO: 14061 - DNA, 1501 bp, Oryza sativa
aggcattgaattttaatctagtgggtagaaaatcgtattattagtttggggaatttcttagacatgctgtatatggtagtccggttcaaacaaaaatataatttgttacaagcaattgtggttggaagagtactaatagtagatatgctttgttgtggtcttgttgtaatgtcgtggataaaagggacatcatgatcgtcttgcacggtataacatcggttctactaccgtacgtgctcgatcgaggtcctaaaccttcagcgaaaatgagcagacggccggcaaaactgacaataacgataaggagagtcgaaacgcacgatgaacttaagaagtggggggaaatcaattagacgcgtcgtcatttcgttcgtctgtactaatccagtacgaggcaaacttacacaactttgctatgaacctagctacagctcacgggtgctactccctccgtttatttttatttatccactgaattaagccgtgattaacatcaagaaaatgccatctgcgtcagacgtactgtcaccgtgcaagtacgtagacaaccgctcgcttttaattcggtgcgctctgaagctttctctagcttatctacctatatctcctcctgtttaattttgccacgtacttttcctggtcgtgggtcaccatatgacccgatcccagcggacaaactcacatgattacccccactaactatttactgcccgtttgtgtatggttcgcctcgccgtgcggcactggtgcgacgacggctgggccaggggcattagtacgttccgattggagcatttgcttctgccgatccgctgcgtcacctgcaaaaacggccaaagacgacatgcggctgcatctgcatgcacgtacaggaggcagccgtttcagttgcgctactgcgaggtgcgaccgatgagtagcatgttgatgcatgccggtcttattggactcccgaaggagtaaacttgaagagatttcggattacttattaggttttgattggtctgagttacgggttgataagtccttaaaaaattaacaaactaacaaaaataattcacaatttaaaagccagtatgaacaaagaaacttataaataactctaaaattaagttttaaaatttaaattttggattcggcaaataagagaagcatacaatgagaggcttaatttttctctactttttcataccatgccaacttttgtgattcatctattgatggaaaaaaaaaagaacaatctgttttatttctagtcaatgtcttccatcattttccctgcaaattgcccctactatatatactacctcagtgtagaaattggacgggaaaactgcataagggcattcacgatggaagctacttctaagaatggccttagggagaaagaatgtggaatgtagattgaagttatatcttataatacccttctcacaatgtatggtggctttgactagggcctgaaataattcagttcataaacttagctaatatatgtttt

SEQ ID NO: 14062 - DNA, 529 bp, Oryza sativa
attgaaatcatttagtatttacaaatgctgtttagatttgtcatattgacaaaatcaatttcaagctgttggaaacaaagttatatagacaaatgaccaaataaaagttgtagatcctgatgagaggatcaactttgttgtttaccatatttccatttgaaatcatttactatccgaaaatatattatgactaataaaatgaattattatacagcagttatatattttgtactcacaaatataaagacttatctggaaaaatggaaaaatagtcatcggtgatgggccttagttcaagcccgatagagattaatctatctctatcgggcattatctttgggcccgtcacagatgagtcatccgtgacgggcctgaatgtcatctcaattgagcattagtatggagcccgtcaccgatgagtcatctgtgacgggccctacggcaaagcccgattgagatgactcatcactctactatatctagatcgaaaatttttctaagtcccgctacagtttcccgcctccttaga

SEQ ID NO: 14063 - DNA, 1434 bp, Oryza sativa
tacaagcacgacctcgtctactttttcttgtttagtgtatgcacatattaatatgttgaagacatgatgatcaagttgcatgccattttgtaccatcaaagctaagagatcatgcatctcaacaagagctcctttggaagcatacccatgaagcagggtaccataggtagtaatatcaggcttgagacccctcttgaccatagaatcaaaaatctttctggcttctgtgcattttccgttcttgcagagatagtccatcaacgagttataagtaacaacatctggttcaataccatcactgcacatctttctgaaaataccaatagccttttccgactgtcctgaagaacaatatccatgcataatactattatatgtgaagcaattgggcataaccatcactgtaagtacctccatggccctgtccatagcttgagccttgcttaaggcagcaatgatagagttgtaagtcacagcatctggagaaaccctccggtccagcatttcatggtatgtgatgtaagctttgtccacatcaccctctttgaagagaccatcaatgatggtattatacgacaccacatcaggtgggcagcgaccatcatcagccatcgtgtggagtagctcgagagcttattggcttctctcctcatcacacagtcccttgagaagaatgctgtaggagaagacatttggtatgcaaccgagctcagccattctgcggagcactatgtccaatgcatcgttcgtcctcttctcggcgcataggccctttaacagagtattgatggtgatggcgttcaccctaaatcccttcttaacgacattgccgaacgccgcgaaaccaacacgtccaatcggcccgcgcggcagcagcaggagatgaggatgttatgggtgcacaagtcgggagccactaccttcttggcgccggaccgggccatgcggttgtagcaggccacggcggccgcggggctgtcgcgcgcgacggcggtgagcgcgcggttcaagccgtagatcgaggcgcccctgcctcgacggagcaattcgtcaaacacgtggcgtgcgtcctcggcgccactgccacccgcgcggcctcctcgcccttcggtcgcgtactccgagcggggacgcggcgtgacatgcccagcctcaaggacgcggcggcggcgagatgcccggactccggcgacctagcaaaaggagcagtggagcggaagactgatactgtgtttggcgttgggccgttgcccaaccccgcggtgaacggaacaagattctctgacgtacacgtacgttacctagctctgtgtcactgacatgtggatccatagtgatatggacccacatgcaagtgacacaaaattacccagttgaaacttgtttcttttttttaaaaaaaaagtacagaatgtccgttgtttctaatgacat

SEQ ID NO: 14064 - DNA, 1501 bp, Oryza sativa
gtcggaatctttggaggagttacacttccctctccctcaatcatcggctcaaggaatcgagttttctatatgggtcctttccgagtcatgctaaaatattccaagcacaggttttgaaaatcttgcgtcgcttgatctactttgttttctgtttatctgtcaacctgtctactgtcactcaaataatatcatcgttattaacttctttagacaggttgacagagtaaattcgtcccactgtgtgtgccaaaagtgtgttgatgcaaaattcgtcgcacacatgaaggcatgaaagatttgctttacactaatgcatgtcctatcaaatcgggttcagggcgtgctagttagtttgatcctgtaactaataatatacgaatgaaaaatttaaatcgtagtgcgaatcagtcacaaggccgatgtagtatagtatgcccatccgatgtcgatggaatttcagttcgatcggctataaccgatggatataaatataaccttgcgagtacatacttatacccataggctaaactaaatcaatacaaggatttctgactcattacacttccgactcaaatacgactgaaagtgtaatgagtagtttcctatttgtaaggagtatcattacacttctgacttatatacgactccaatcaactcataaatagaaaactatctgagaaaaattctaacatgattccattggctcaagccactatctacagaaacataaactaagatacaccttccttattatggaagcttgatttaaacccggataaacttgctaactgaatcttctacaagtatgacgtgaattccatctgattggatcttgactaatggaaattgccaatttttttgttaacacaaacatgatatcccataggtatcatgctgatgttagcatggtaccgtacatatctctggtactagacatgatacctgtaagtaccagattcggtacctatggtaccatgcaattgatccgtacccacggtatcatgctgaggtaccagattgatgtaacgtcctgtatgaaccagatctggtacataaatatcatgttgaaatcatcatgatgtcagctattccgttggaacgttggaccgttatgtactattttttgaaaaaaagataacacgaccgcgcagggaaggcaggcggctagattactcatggaataagttcatctgaggtcccttaacttgtcaatgaatccaatttttgtccttcaaccgaaaatccagatatgatgggtccctcaactgttaaaaccagtgcaaaaataagtcccaaggcagtttggacggcggtttaagctgacatggcgcctacgtggctaatttgactcagtcttcatctgacatggtgcctacgtggcaatttgatttggaaaatcataaaaacggtagccccacgtgtcaattgcaccaaaaggattaattaaaaatggaggggcccacgtgtcattcttacccctcttcttctctccccatccagg

SEQ ID NO: 14065 - DNA, 1501 bp, Oryza sativa
tcacttgattttcttttctatctacaactaggttatttgattcataatagagtaggagctcacggaaatgagactctaggtctccttaatcatcaataaaacatacacaactcacagcacttgcaatcttaacatcgatccttcataaacttgtcaaactcattcattatctcatgtttctctcttattacatggttgacagggaacaactataaaacaaaagtacttcaacaccgatacaagagtattatgattgcttctgactagcactaggcttgacaggttctgcatttgctccagtgaccctaatattgtggtcatgtcttcttcgtgcataatgtccggaatgatggcgtgggttacgctttggttgtggacaatttctggagtaatgtccttcttcactgcagttgtaacaaacaataactttcttacactcaggttcttcatcttgtacctgatttcttggctgctgtgctggaacatctaaaggtacaacgcagatactggcctctgtcttgtcaactggttgctggggctgaaattgagcattgacaccttgtggtagtgcactcattggagttcaagctgttgcaacgcgggctataggactgcttcgggatgcatggatgacaattcgctggggagcaagcttctgattccagggatttgcgtggattgacgtgttggcagctatgtttctcggtttcgggcacttgtcggtgaagtgacccaattcatgacaattgaagcaacagatatctttccggactcggcattttcttttcctattttgattcctctgtcctctggcgggttggtttgccatcttctttgtcagcagaaaactaaattgacattcttttggtacatgatcagttccttcacaccagaaacaagtgatcctgctcgttggacacccgtcgggtggatggtcttcctcataatgaacgcaggtagtggcacaagtcttgtcgaggatttgtgttgccttgatgcttctctccgtcggaactggcgggttggtttgccatcttcttcgttagcagaaaactaaattgacattcttttggtacatgatcagttccttcacaccagaaacaagtgatcctgctcgttggacacccgtcggatggatggtcttcctcataatgaacgcaggtagtggcacacgagctagcaacatgaccaatttctccacaacgagagcatgccttatgttccattttattctgcttgaaacattggagatacttctcatcttcatcatctgaggagacttgatctgaatcttcactatcagacactctacctccattagctaaaagatgttctgtcaactgttgtgcacctcgaaagaaatttcctatctgacgttttgtcattcctggtggaggccattctatgccggtaatggtcatcttacggacttcatcttcggttcgcattgatgcttttcttttctgctaaggacagttccttgcatagtgcgcttgttcat

SEQ ID NO: 14066 - DNA, 1501 bp, Oryza sativa
gagaaggcagcagcggtggcggcggtgtgccggctacccagcggggatggagcaggagctcacctcgtcggggccgtacaaggacctcaaatccatgggaagctcaaacaactcgttcaagttgtgatccatggaccagacagcagcttgtgtggcttgtgaattctcgtccgccgccagcctccctcactgaagaagagaatagagatgagaagtacgagagaagagaaaaaaaaagtgcaactgacatgtaggtctcacgcacttttttttcctgactaggatgccatgtaagtgaaaccacctatatattatatcataggacgttgagtgcacggtttgtgtgagtttagggtacatatttctaaatttgtggttaaggaatctaaaaaaaaaaggaataagtccactttgactcccttaaaagtgacacgaatctaatccatgaccctaaaccgtaaaactgggtatgtcgacccccaaattattgaaaccggtgcaatttgactcccttggtggttttagagggcggttttggtgacgtggcgctgacgtggcggtgttgacatagtctatagggttgacgtggcacttagatggcatttgaattaaaaacacatatgtaggacccgtttggcattcacacacataaaaaaaatgtggggtccacatgtcatcatctctctctttattcttcctcccctcttcctccgttctctctttctttctctttctctccccttcggccagccgcggggactggagcacggctagagcggcgggggctagagtggtggtggtcggcggaagctgaagcagcggcggcgggctagagctgacggcgggttccagagcggcaacgggcagctcgatgaccggcaaggaggcgggaaaggacggcagcgccgacgccgatgccgacgacatcgagcgggggggcggcggtcgacggcacggcacctaagcgccctaaccccagtcctcacctccaccgtcatggcgccctcaccggggaacgagctccctgctccctccgccgcctctcgccgtccgtgataacaatatccggcgctctggcctctccgccgattgcaacaacaagatccgggcatccggcgtatgcgacaagctgacgacacggccgacatcgaacctgtcaagctagttaggggcgagggccgccatcgagctacgccattcagcattgcaacgacgacgtcgtcaagtcattgctcgagctcgctgcgtggccgtcaactcccgcgccagccccatcatcgccaccaactcatcccccgttacgtctccttcaactagtgctgctaaggccacaagcatcacaaaaatctagaaataaaattgattcatttagcaactaaccagagataaaattgaccgttagcaggtcgttcaccatccactgaagaataggatgagtaggcaggggggagcaattaattttgtctcgcttgaacacacccaagatggccaccctcccagg

SEQ ID NO: 14067 - DNA, 1501 bp, Oryza sativa
tgggtgtgaaccattggaaacagaggagatcagtgggacggatttagcgtggagagagcagtcggcggccttcacctgagacggtgcaccacagatgagtaggtagctagcagtacaggtgcgaggtcgagagggaggcgcaacgttgttgggtgggttagaagtagggatgggggattattttgatatgcgatctaattatgtcgtgtattaaattaaatatttgaaacaacaattcacattattctacttttgaaataaatatacttcaagcacgagagagatatgtttggaaccgtgttttacatctttggtttgtatgttccatacctgcagaaaatgttataatgttccaattaatgaatttatttttaaagatgttttaactatgtattctagctttgtggtgtgataatttctcatatatcttgtttcagatgtctcaatgactaaacacctttttataacttaatccgtcaaattgatgccagaatttttttttcggggatgatggcagaatttgttacaggacactaaaaaattgtggtttttgttgtaagacaccaaagaacacatatcttcttgtagacatcgcaaaaatgtgaaaattagttgcccgacactcgctaaattattttattatttttggtggaaacggagagagagaaagaacgataaatgtaccgaattgaccggcgatagccgaaacgctggtcacagggtcggttgatccccgccagagacgcgcagggtcagagctcgccgctcaccgtcgacgaccagtgccaaatttcgccgtcagccggcgacgcgcgacggaggagctagggcagatccgaggcattcgtcacggctgccgtggtcagatggcctcctgcccaagctactcggcgtcatcttcaagcaactgaactgcctcgtcgaccgcattggcttcacggccgtctaccgcccatggcgcactgccgcggccttcgtcaacgccctgcactgcgggctcccgtggctgctcctcccgtcccacgacacatcgtcctacttcagcctctactccgactctccggcttcacccgccacctcagcctcctggaaggcgtctgggacacgtgcttgtgcggcgctcatgacggcggctgggtcaccgtcgccgtcgacccgtgcgccgtggcgaggattcgcggccggccgtcaacgtcttcaccggcgtgagggttatacacaatgaccccacgggcaaactcgtcgtcttttatgaaagtttctctctccgtttccacccaaaataataaaataatgcggtgagtatctagctaattataatatttttatgctgttcacaagaagatacgcgttgtttcggtgactttaagtgttatatagcaaattttatcaattttgatagtctgaattttaggccgagcacccaatccctaggcttgcatatgggctacctctaccacgattccaacgtgggcttcatgggctgcttctgatccttacc

SEQ ID NO: 14068 - DNA, 1501 bp, Oryza sativa
cactctccactctccactactccccccttctaattttaagctatcaaactaaaacacaaactattaataataattgcaaagatcgtattcttaagctataaatctaatttttaatttaattgttgctcttttaaataatcaaaccaaaaatacatgatccataatgtctgtatttttaacctaaaatgtctgtattcataagtagaaaaatgtcaatagggattgaattaaatcaattggacaaaatataaaaaatttgtaaaacaaatagttattacttttcaaaaactggataaccattgtacaatgttcgattgccataaccatctttaagtgcttagatgttaatggccttccatccatcctacaccatggcattacgagtttctcaatgtattattgcatatacaagacacattaaggtagcagtgcgtagaagtacgtagttgtggttaaaaagttatgcattgctactattaactttaaatttaggactcatattggctagatattttttttagaaaacgctatagatcacatatataatagggaagcgaggtatacaatatgtatatctcctatgtatttattgacacgttctttccagaaaatgaagaattattgacaattgcttgtagtaatgaattaaatattatatagttcaaatcttacaaaaatattgtaaaaattatctaagcaatgtagatggagaaaatttatgaagaaattaaacttttcaagcgtgacaggtgtcatccggtagatattccaccttacaagttagtcaagcgtatcctattttacgtgcccgcgcgaatgcgcgggctaccttcctagttaatttaatagccaattcatacaattgcctattatctggtcccacatgtcatgcacacatgtatattggagtccgtgctgaagctagctacaaatctatagtccgcagctcttctcttcctctttttatctccttaaaatatgtttgtagctgatttataccctgtacttgcttttagagcaagtttaatagtattccaattcatttatagccaatctaatagccaattcataccatagttgcttactatactactaatatatggtctcacctgtcatacacacattgcgttttggagtccgcgctgcagctggctacagatctgtagcccgctgtttttctctctcattttttatctcataaaaatatgattatagctagctaatagtgcgtcccacgcaaaagcacacgcacaaacaaaaaaaaaaagaaagcacacgcataaacaaactacacacacaaaaaaaaaaaaaaaagcacacgccgttatattctccaccaactaaacgccgtggtcgtcgtcgcttcgtattccatttttccgctttcctctctcccccgaatccccaattcgccctaaaccctgctagaacagcggcgagcagtgtcctgccatggccaccgccgcctgcggcgagagcccttcgcggttgggctccgcct

SEQ ID NO: 14069 - DNA, 753 bp, Oryza sativa
gcctccccctgtactcctccctcttctctcccttcctcctccccttcttctctttttactacagtacacacaatttttttaaaaaaacaaaagttagaaaaatttatgtatagaaatactatatataaaaaatatttgaattcaaattcaaatttgaatcgggtatgtaaacttttgacttataaactttgggtctataaactttaggtgtataaattttagatgtatagaaatactatatatagaaaatatttgaattcaaattcaaatttgaatcggatataattcagattcaaatttgaatcgggtatgtaaacttttgatttataaactttggatctataaactttagatgtatagaaatactatatatagaaaatatttgaattcaaattcaaatttaaaacagtatataaacttttgacttataaactttagatctataaactttagttctataaactttaggtgtataaactttagatgtatagaaatactatatataaaaaaatatttgaattcaaattcaaatttgaatcggatatataaacttttgacttataaacttttggtctctaaactttatatgtgtaaacttgaggtgtataaactttaggtgtataaatttactaaaataggaaagtaatgcggtgtcaaaaaatgaaaccaggtggaggagtggagggagggaggggggaggggatcgatcgctgatccatccccagggcgatcgatcgctgatccatccccagg

SEQ ID NO: 14070 - DNA, 1501 bp, Oryza sativa
cgtaaaggaagtcgtttaggacagcgacacggtattcaaaacacaactttaacttcttgtttctataaaaatatttattgaaaagtgatatatgtatacttttatgaaagtatttttcaagacaaatatattcatataatttttatatttttaaactcaacaacttgagagttattcatgatttatattcccaaggtttgacttaaacattgtcctaaccgactttctttatgagtatagagggagtatgtgtttattttatcaaatataattaaaatataacaaaattttggatagcatcccaaaaaaaatataatatcttctccacggtgtcatcatcgttgttgccgactcagtggcagcgcgcgcggaggaagacggaggccagcacgtgcggggagggagggagcggtaccctatgctcttcgccacggcgtcgtcgttgtcgctgcctacccagtgacggcgcgcgtggaggaagactgaggccaacacgcgcggggagtgagggagcggcgctggagctcgcgggcgtgtggagggcgggcgacggcatcacgcgcgcgaaggaaggaggaggccggcgcgtagtggacgagaagtgacggcgcagtgccggagctcaccaacatgcgggagagaggcgcagaggatggcggcgagcggcggccagtgtcggagagcttgccggcgcggggaaggagtcgtgcgtcgttgatgacccgcaatccctgagaccaccgcagcgccgctgtcgctgacccgccgccacgggatccgtcacccgcatgtgtcggatctgtgactcatatgcccagccgtcgtcagatccatggctcacacacccagctaaagccggatccatcgcctgcacaccgtcatagctgagctccgccgccgttgctcctcgtcgtcgtcatcgagccaccatcaccgctagtccttctgctcgccgtagccgtcgctgctccattctctgcatgcaccgcctccgcgcacgcaccgccgtgggtccattccctctgcgcccctccgtcgccactacctccactagctgacgtggctgcttgtcccctccgcgtgccgccgctgcaatggatatacgagaaagacgggattgaatagatagggttagatgtggataggatttcttgagggtagtttggtcattacaaataataattatatttctttaaaaaaaatgaaactttagtggtgcagtggaaaagggtcagatggggtgtttgttttgaaaagtaaggtcacataaacaaactagaaaaagtaggatcagtttaaacggagccaaataagcaattgtctttttttttaaaaaaaatattttttttattttgcttccaataccacgtaggagttaggacgtggattaagtcaaaccatccatgtagacgtggactatttgcagagttaagtgacgcgtaatgtttgttattgcgggttaaggacggatgtctgacccagcaacaaatgggggacctaa

SEQ ID NO: 14071 - DNA, 1501 bp, Oryza sativa
aaaatcaatcaattacttgaacacatggtcctataatagtcggccatggcaaagacttgcaggaagcttcgtacggacattaacggtggacgtgctattagatcatattccggccagacgtacgcagtctggacacacatcttagaatcagcccttcaacaaaacagcaacatgttacacacgttgaaatccacataaatctcagtcgcctgtgctcttttttttttcctctccacacaagtcacccaagagtgcggccgtgtttgacatttaggatgctgaccgcctaacataggtaagcacaaggttacaacttaatttatgcaaaagtccaaagaggagacggaagaggacatggcttgcctttataattaagccataatactggtgcaggaacaaaaggaagaagagaaggagctgaaggcagacaagaacttgagaagaagaggagaggtagctgtgctgctcaaagcagctagcttctcagtacatgaaagaggagatgatcaagggagactcaaagcagctagcttctatgtacatgaaagaggagatgatcaagggagagaggcagcttggaacccatgaagatcggttaaaagacgaggtatggatctcttttctatctgaactatatatgtatttcttatctttctagaaaaggttacgcttcctttatctaaaaataaacttctaacctttcttccaaaagttggatcatttatttgggtaagtacaactaggactagtagagttttctcttcagggttcttgttcttagttcgtggaatagggattttttttttcagagatgcagttctttggtccaaattaatcaggtttcatcgatttttccttttttgaaatgcggtgttcatcaatttcttaaaaaaattgagaaccactggttcttatgcgtacatagatagcactgataaatcatggataatatatatatgaactggaaggaaagttaatttatagattctctgtagctagcctgaatatatttgtgtattgtcttgatctctactgatatatagtatcttcaattctatgatatattgcaggttataaaagatggcgataaaatttcagatggcaattttttcaagtccttgcaaaacatatcaagcacaaaggaggaggtacctctactctgacccacccatcaattcattaatcaatttctaccattttctctgcctctttttacttcataattaagaagcagcagtgtaaactttaacgtctaattttcttgtcctaaaattactcattggaattgtcataaaaccaactagtttctttaagttcatacacacactttaccttttcttctagactattcttaccatcagtttatttttctaggtgtgttcaccaggcccaatagaaagatcatgtatggactcatcattgctaaacatgaaagctcaaaataaggtcaggatgcatagcatgcatcatagttataccaatgtctttttctatcaaccta

SEQ ID NO: 14072 - DNA, 1488 bp, Oryza sativa
catttggttaatttcttaatccaccaatgggattgccgcacattctacaagacaccttggatactgagtactatttcgatgcaaggaataactaaataaatgtaactagccaattacgatgatgatgccggcgacacgtgagtgtgataccagccgccagtcatattgctttttcctggaaaaccattgccccaagctgtcaagttcactgctctagattctccccggtgtggtcaaatggataagggaggggtaaatgtgcttaagccacatctagggttttcagtgaattccagctgatatctatcgattcggtgacgcagctcgccggatttgtagagttcctgagagagattatgagaccagagactgatcgtttgtggaagtggtgatggatttccgtcctttctcaaccgcacaacgagcaaattaaatccgggcgaacaagcaccgagtgatggaaggagggaaccacgaagctaattagagtcccattggttggtttaattagtcaaagcaaaagctaacactcaaacttaaatttaattttaaagttgattttaagatatttttaatataatttctttttaatattgatttttaagtcgctgcgaataaatataaaaaagttttacttataaattaatttttatttcctattaaaccaaaataacttatgagaaaaatgagcaaccgatgaggctcttgcaagaaaaggagctgcacagataacttcgtgtcttttatagtagtatattgctagatggcaagagtgaggcatgtttaatctgaaagcctcgaaactaccgtattatactaactaaggtgtgtttagattcagggagtaaagttttggcgtgtcacatcggatattatataggatatcgtatggggtgttggggcattaataaaaaaaactaattatataatccgtcagtaaaccgtgaggcaaatttattaagcatatttaatccgtcattagcaaatgtttactgtagcatcacattgtcaaattatggagcaattaggtttaaaatatccgtctcgcaaattagtcgcaatctgtataattagttattttttagcctatatttaatactttatacatgtgttcaaacattaaatgtgacgaggtgtaaaattttgggtaggatttaaacaccccctaacgatgatattatttaatgggaaagcggtgccgaaataaaggcaaacccaacacaacaccaaagccaaagaaatgcgccgtcgatatgataaggtcctttcatcatgcacaaggcgctcacgctccatctttgcttcagaagtcccaactgatgtttatattggtagagtacgcagcccggctcatcaatcgtgggctatccaggttatattgggtctgctccaccacagatctaaccagagcaacaactttatcccgagcctacacaaccaaaaaaaactagtctgatgggtgaggaccgcccacattttaagtcgtgc

SEQ ID NO: 14073 - DNA, 1501 bp, Oryza sativa
tctcttcgcgatctgctgcgacatagcatggtgttttcgaaggtgattaaagaggtagaatgtgtgtgtacgtttatacatattgttttttagtcttcatagaaatagaatgtatgcacatgtttataagagtgagtttgtacgcgttgtaagtgtctgcattgtagtgtgtttcttaataaaataaattatatatctacactcagcaaaatagtagggagtttattcgattaatttgtgtgctgcccacaaccgacggaggtggctcacggggcaaaggggtgctcacaagttacaaatatagacgatcacaacaagtaaacactcacccttttgaatgtatacatgcacatcttatattcatgatcagcagctccgaaaaaatgagtcggatatcaaccaacacattcatccgagtctccataccttatttgtcagcatgttcgagagaatcaacactgcactaaggatgcgtgggaatatgtagttaatttttacacgtggaatttaagctacgttctcttgaatcatactttgtaaataattaatgagcatgtttgtttgaggtgtgaaagtcataaccaaatttgaaaatcagaacttagtctaggtttttttttctttttccatcactttaattttttcagttttgacttttgtactgtcaagagtagaattatagaagttctattctaaaattatttgtattacttggtttttccattataagctgcagttgtaaaaacaccttctaagcagaataataaacaagtagtacaattaagttttaatttctggttgcttcacttgtttatctttgtaataattgatttggcgtggagataaattttagatacgaatatataattatttcagtttgttttacggatcaaattatggttgaataaaatattgttatccatctgtatgcctcttcgaaatgtttcacattttttagcgcaattttattgttcgcaacataagtattcccccaaacgttgaaacgtgaagaattaccccaaggtagtagccccatcattttgcataatggaggaaaaaacaaaagcacatatttgcaaataaaaggtaatttataaataaaacttttatatacatgttttaaactatctaaaagtagggataaaagaaaaactgcgacaaaaaatctcaaaatcaaattaaatttgaaaatttattaaattgtgctgataagtcaatcgcaatatacagccaagtccatttcttcttttctgctcgcggaaaaaaaaaatctaaactccccgaattttaccgtccatctcaaatccaacgcaccagatcaacccacaccaccccgcagcgtggctgtcgtattaaacacacctctccccttcctttccctcgccgcgataaacctcgccgacggcgcggagagaaatctgactctccaacctcccgtccttggtccttacacgcaattataggggcgtgggtcccacgtctcagtgagagagagagaagc

SEQ ID NO: 14074 - DNA, 1501 bp, Oryza sativa
ttaataagacgaacggtcaaacatgtgctaaaaagtcaatggtgttaaacattttagaacggagggagtatatggtgatattgactatctgaagatggcagcatgcatggtggacacgtaaatggcatgcacgtatgcagtcaggacgtgcggttaattacctggattccggcccagcccttggccacgtcgtcggcggcggtgtcggactcgttggcccatccccagaggatgcggcggcgcttcgccgggtcgtagaacgtcttggaggcgtagaagttgccgtagtcgtagcggatgtggtgctcgtcgccggcggggtcgtccggcacgtaccgctcggccttccggtcgtacgttccgacggtgtagtagtcgtaccggcgcaggtcgaggctgttcttgagcacgtacttgacgcgcgccgaggcggcggcgtcgacgacggcggacgaggtgtcgacgccctcgcggcggccgtccgcggtgaccgggtagaagtccgggcactcccacatccccgtgggcgccgagtgcagcggctgcgccgcgcgcgtccaccgccggaagtccctgctccggtacacgtacgccacgccgcgggactgccccgcgaggctgccgacgagcagccgccagtggccgtcggccccgcgccacgcggtggtcgggtcgcggaactgcgtcgcgttgatgccgccctcgggcacgatcaccgggttgtggccgggcttcacccactcgcgcagcagcgggtccgacccgttcctcggcagcgccacgttctgcacctggtagttgacgtcggggcggttgacgccggtgtacatgatcaccggcgtcccgtcggccatcatcgtcgccgaccccgaccagcagccgtacttgtcggccctgatgctgggctcgatggccggcttgagcgccacccagttgatgaggtcacgtgacactgagtgcgcccacacgatgttcccccacacggcgcccttggggttgtactggtagaacagatggtaccaccccttgtagtacatcggcgctgcatgcacccgttcagtttcaccaaatcaagaaatgatcttcagtcttagtagtacattgaaatcaattaccatttcagtttaatcgcgcgtgtacattgcatttttctctacactgctcacgattaattatagaactatagatgcttcatttcgtacgagaaaaaggtgaacttttggctaattccctttctgagaggaagttaagattttctgaactttgtggtcatcagccgtggtaggggctaggtaccccacggtcgacaagcaagcctgcatgtggagtcccagtgcgcctaccattttcgtgctaaaatgtgctttgaacctttaatcctaccatgaaaggcgtcactaactacagtcctctcccgtacaacgaaattgcaagttgcaaggcataaaagttctagtactactactactactactagtagacagagattcgtgacaggata

SEQ ID NO: 14075 - DNA, 1501 bp, Oryza sativa
tttttttttcaggttacgatcctccggtattgtaatcttttaaatcctctggtattgtaatcttgtaattttttttctagttacgatcctctaggattgtaatttttttctgctctattaataaaacttcgttaaaaaaaattcgctttgttctgtttcttccttgtgattccgcgcgttatcttgcagaaaccaaaactgaacagttctccgcgcagccgtgtctggaattctcatgcaatggaatactagatcggaacaagcatgcaggcacgagacgcatttgaacagatcggagattaagctgcaagccaatgcatgtattgattaacggcaagatcatgcacattatcgcaggaaggagaggaagaatttacggtgctctaaagaccaaagaaaaggaaaattctgtctgatctactgatcaagactcgagggcgccgtgtccttcccttcctgatcctacgcgtggccccgcgccggcgccgccactacggcggccggcctccgggtggatgagcagcttgaacctgccgtcctccttgcacggctgcagcaactcctgcgacggcagccgcatctcccgcagcacgagccggccggcctcccggtgcgcccggaggctcagccacggccgcccgcccttgccgatcaccgatatcggcggcgggaacgccctcccgctcctcgtcctcctcagcaccatcacggcgtgctggttgtcgtcgtcgtcgtggcctacgccttcgctgctgctgctgaggaggacgtggtgcggcctcttgcacggcggggccagaaagtcgaccgcggcgacggcggcgccgacgtcctccatggcgggggaggcggcggtggcgtcgtcgtcgtcgtccggatcgaagctctcggccccaagtgcctccgtgaggaggtcgaggccgccggagtacgggaggaggtgcggcgggggccttgattgtgtggcggggcgcggcccgagccgctgctcctcgggggctttgtagcagtgcagcggtggtggcggtggtggtggcgccatggacaaacggacggacgggcgtcgcgcgcgcggcggttcacgtggcggctagcagagcgcccgcacgcgggtgggcgcgagctatatatatctgcgatggcgagagacgagacggcgagatcgcgcggcgccgatcgatcgagagcgagtcagcgggggcggataggggagaacgaagcgtgcgcgatctgatcgaccgatctctctcgcgcgcgcgcgtgccgctcttgcactagagataagactacgtggcacgccaaaactgtcctgaattcgtggcaaacggaaaacggaaagaacgtcgcgcgcggacgcagccgccgcgccgagatgagaagaagctaggcaagctagaagcccctataaaatagtaccattcacctcactatatcattgatcatccgagtcctaactgggtctcactaagcgaggtaagtagtgtgttagtggaaatggcga

SEQ ID NO: 14076 - DNA, 1501 bp, Oryza sativa
gggatgcagccacctgcagatcccaaatcggctccgagctgccgctgcggcggattcgcaccgcgcgagccaagttgcgcagcggcaacaccagttcaattgccaacacgcactagctagtggtcgatctgccgcacccctagccagatacggatcgtgcgcttgcatgcgtgcaggaacggcttgtcccttactgctgaccagctgccttgctactaacctccccgtaagggcacccgcaatggttatctataggctctctacaagagatccatgtcaacatattttcctacttggaacagattaaatgaagaaagagagtaaagctatctactaatctggagatagtctatagagaaaaacgaggcaatagatgagagagctatagatacctatgtagacatactattgaggtggtttactattaatctagtctattgctgagatgtatatattttatagagagcaacttactttaccattgtgggtgatctaatagtaatgacgttctatgtatcgggcgcagcttagatcgacaggtggtcttgtgtagcgtatatcctgaaaacaataaaattgacaatgtataagcagagcattagggcattgccgctttaattggtgatcctaaacggccaaaccgctccttttcaactctgtagagggagtgcttgcgatggtccagatgatcaagttcttggaagccagaagtatatgcatattctagctagcactaaacaactgcagcgccgttgcaccacacgttcgtcgcaaagttggattccaatacgccatgctatgccaagattctcttattacactatgggtaacgtagttccataaaaattgctagctaaaatattttatgtggtttaacgctagtcaataataaatggaagttggggatttgtcccatcaccttatttctcattttgatttatttttaccttacatttttattactattaaacttatggctgtatgtcttatgacagaagccggatatgtaatctatttccattatctaccaaaatacgccatgctatgccaatgaagcagtagtagtccgcgcgaggttactggttgtagccgaaatgattaggcgggcgtctaaagtgcgctgccagaagcactgccaatgagcgtgatggaactttcagcgtcaacttggcatggcttttacgtctgcacgccctcatttcgcacaagtcttgctccgcctttattcgatcctggctcgatgatggatcgacctcccaataatgcgcacgttctcaccacattctctctcgagagcagattgtggacaattaagtccactttgactcccttaaaagtgatccgaatttaatccatgaccctaaatcgtaaaaccgggtatgtcgactcccgaactattgaaaccggtgtaatttgactcccttggtggttttggagggcagttttggtgacgtggtggtgttgacctggtctatagggttgacgtggcgtttaggtggca

SEQ ID NO: 14077 - DNA, 1501 bp, Oryza sativa
gaaggcggcgtcggggacgtaccggtcggtggcgtggtcgtaccagccgacggtgtagtactcgtaccgcgtcaggtcgaggctcaccttgagcacgtacttgacctcctccgccacggcggcgtcgtgcagctcggcggtgtcgacgccgcggcggtagtggcggctcccgcccgccacagcgacggggaagaagtccgggcactcccacatcccggtgtgcgccgagtgcagcgggtggtgcgccttgacccacttcttgaagtcccggctccggtacagcacggcgagccccttcatgttcaccttgctgccgacgaggagccgccagtggccgtcgggcccgtaccaggcggtggtcgggtcgcggaacgcgctggcgttgatgccgccgtccgggttgatgatggggttgtagtcgggcttgtaccactcgcggaggtacgggtcggagaggttcaccgggtaggcgacgttctggacctgccgctcgtcggggtcgatgccggtgtacatgatcaccggcacgccgctggggagcacggtggcggagcccgaccagcagcccttctcgtcgaacgtcttggacgggtagatccccggctccagcgccgtccagtcgatcaggtccgtcgaaaccgagtgcgcccactcgatgttcccccacacggcgcccttggggttgtactggtagaacagatggtacaagcccttatagtacatcggacctgcaccgtgacacgtataccatgtcatccaatgcacattagtgtacgtaggagtacttcgtgccatacgcgaacaaattttcagctagtttttacggccgtgtgattagccgtttacgtaccgttcggatctggtcatcgtgtacggaggaggaaacagataggagagaataacacgaagttagtattatatcgatcaaagaggacaacgcaaatcgatcatcgtacgtaccgttgatccagtgcttgggtggttggaagtggtacccggtccggagcttcccgtcgacgtgcttcgcctccagcgactggagctccgggtagacgacgtgcgacgcgcgcaccaccaccactgccgccatctgcagcagagccacaaacaccagcgcggccctcgccctcgccgtcgccatttccactaacacactacttacctcgcttagtgagacccagttaggactcggatgatcaatgatatagtgaggtgaatggtactattttataggggcttctagcttgcctagcttcttctcatctcggcgcggcggctgcgtccgcgcgcgacgttctttccgttttccgtttgccacgaattcaggacagttttggcgtgccacgtagtcttatctctagtgcaagagcggcacgcgcgcgcgcgagagagatcggtcgatcagatcgcgcacgcttcgttctcccctatccgcccccgctgactcgctctcgatcgatcggcgccgcgcgatctcgccgtctcgtctctcgccatcgca

SEQ ID NO: 14078 - DNA, 1501 bp, Oryza sativa
ttagactcaaaagattcgtctcgcgaattagtccaagcttatggaataggttttgtaattagtgtatgtttaatactccaaattagtgtccaaatatccgatgtgacagagacttggaataagtccctggaaaccaaacagcccctaagccatccaagacgctaggagtgaaaagtcacacgggttttcgttttgccgagttaggcttgtcaagcccgagtcttatctcacaaactagattttacaaacacttcaattatatagttttaactacttcatctgtttttaaaaaacaacatgtaagaatgaatttggataaatacatatccggatttttcaaaaattggttttttctgtgacagatgaagtaatttataatgtgtttttgtgtgtgtccaatgttcccaacaaaaaattgacactagggggtgtttagatggggctaaaactttttagcccatgtcacatcggatgtttggacgctaatttggagtattaaacatagactaataaaaaattaatttcataaatgagagctaatccgcgagacgaattttttaagcctaattaatctataattataaaaagtttattgtagcatcacattgtcaaaatcatgacataattagactcaaaagattcgtctcgtgaattagtccaaggatatggaatgtgttttgtagttagtgtatgtttaatactccaaattagtatccaaacatccgatgtgacatggacttggaataagttcctggaaaccaaacagcacctaagtcatcaacaaacaacacgcttggacaaccttgtaaatagacaaaaatacagaaatactcccagtagcaaaatgatatcagcaacaacagtgtgctaatccttgcaacttgtaccacatcgccgccgtacgattaacattggatgctcctgatcgttttgctgcagcagcagagcagcccgacacgacacgagcgagtcacacggaccatcagggcattagcactgcgttgtgtttttctgaggagcctaaacagccacgtacgaagaaacagcgtgaagctcctctctccacaatgcggcgtgggcgcgtgtctttaggtggaccccaccaaactgtttctcatgtgggccccaccacaaaaatttacttttttgggtcagcttctcccccttctctctctgtgtcctgctttctcatgtgcaaatgcgattaaaaaagcgccaaatgaggacgcgcggagctggtgaatatatgggccccacattcttttcttctccacgtatacaatctgcttagctggacagttgaggccaaatgccatgtagatgcattgtgaatggcctcacggtacacaccgtaaactgttactccacgctgcgctgcacggcttcctcttcctccctcctcttcttctcctcagatccctctcgcggtcgcggccaacaaccacagatccacatcccaaagctgcagcgcggggggccgcagcagccgcagcagcagcaa

SEQ ID NO: 14079 - DNA, 1501 bp, Oryza sativa
taaaccaagccgccccatctccctctcgttcattccctcgccaccaccgtgcccttgccgccttgctaccgctgtcctcgcctccctcctccatcgcgcgtgctggtgaagccggcgtgcgcgcgaggagctgacgcgggactccaggcgccgtctccttcccctttcccggcccgaggccggagagctcgcttccgcgtcgtcggccgctcgtcacagcgtccgtctcggctcggtagtgcatctcccgttctccctcctcgctccctctcctctccttagctctgggcagtagtgcgagtagccttccagtagcaagctggcgccgccccgaccgccgccgctgctcgtcgtaggctcgccaccgtcgctgcccaaactcggtagtagccgctcgtcgctggccttcctcggtgtagctccacccaatccgactctagaaatgaactcaggaggtcgcgtagatgctcaagtccctaggaatcgagctctcatcgcgtcgtcgtcgtttccctcttttgccgccgccggcaagcgccgtcgcgattcgtcgtcgccggcctccctccggcgaatccgatccggtggctcactccctctcgtccgtcccatcgttcaggtgtactccctctctctcgaatcgtcgcgacgagctccggtgaactcggccgccgtccgccgtccatctcggccgccccttcttcctcctcccgccggcccgcgtggctgccacgtaggcgccatctcggcgccacctcggccttgaccgggccaagccagtcagccgccccctccctccgtcttccctcccgtgcgcgcggtccacggcaagccgtgcggctgcacgtgggcctgccgccatccgtccacccggcgcgccgcgcccgaaccgcgcgcacccgaaaccctagcgcccgcccccgcgtgcgccctccccaccgtgaacccaaccaccgccatgtgggtcccgcgcggtggaccgcgtccacccgcgtcggcctctctctccccgcgcccgcgccggcccaatggcctgaccgcgctgcgcatgaccccttgggccgagcctaagccgcccgagtaagtctaaatgacatccctccttccttttcttttccaagggatttgataaatccttttcctttagacagaaaatccaaataatcttaggaaatccatatctccccaaccgctcgtccgattgactccgttccacttccaataattccgtaaattgagatctatttaatggcactactaattagtctaaataggatctttcttttggtcttttgtttaggttttcgattgtttgcgtatagttgcggttatcggattttcgtcgagggttttctcgaagattcgtgaagcttcgtgaagaccttgagcaaggcaagtcaccctttgatcaattgcccctataattgaaaagtcattattattttgtttgcaacttgcattattagaatcacacacttaacttgcttggcctcggtttgcg

SEQ ID NO: 14080 - DNA, 1501 bp, Oryza sativa
ctaagaagcacaaaacaagcattgagatcatgatcggcacagctaacaagcaactgaagtctgaagattaaacacaaaaactaacggtattttgcaaagcatattttcacgcgtcccttcattataaaaatgtattatttaccccccaacccccaccatacccctttcaaatataaccataaggagaaacagaaaactaacaatcactttgcaaagcagtacatagcccttaaacccatttttcatgcaaagtatcttgtatacattgtggactgtgtagcacaaaatgccctcacacaagatgcataagtgcagtaggacttatgcaggtctccgaatttcataaaaaacatcatagaaacctacgaaaaaataaagagagaactctaggtatcaagaggatttggcttgttgtcacagtcactttagctctttctacagagtgttgacccatttgtttgacacataaactagccaaaaaatttcagtcagtgggaactgatttggtcaccagaagaagcatgataaccaactgaatatgcacacattattacataaggtactcattaaaagtacaggtatacacaaaatgggggaacattggaacacaatctaagaaaatcaactaaaactaatcactatattataagctacaaacatataaccaagataaccaagggttgttcaataatatgcccacaatagccacattgcatgatacaatttccaacattcatgatcaaattttcaacaaaatcagttccatacttctagtgcgtgcacccaaccagaagtatgaactacaaaggcgttatccctcgtttatatactatgcaacaaccaattctctagataacctcactttatctcaaacaattgaccacattgtcccctcaacccgaggcgagtatgctacatggatccatgcataaaccatgcctatccatacaatgcatgaaaagaattattcttacccatatcatcctacaggtataatcaattagtacaagattacaggttcttccaaaatttctaggttgcacaattgtatcccttgcatcaccaattatccaacggcctagaacaaaatatcaaattctgaaaaggtatctattacaagtacacgagagcatctaaaaattggaaggagaaaaataaaatcccctttcatccattctccgttaccctggtcgcttttcattgaccacctaatatatgatcgaaggcaccgaaattttcgtaaaacgatcgtccacaattcgaaaattaaaaagaaaattgacgaaacaagcgtttaatttgggcggtttcaacaacgcacctttctccttgaggagctcctcgcggcggcgcttgcggtggcgcgcccaatccgagagcgagccggccccgccgtcccggctggagccgggcgcgtggtcgtcgtcgtcgtcgtcgtcccccgcgacgacctcgatccggagcacccggtcggagaagttgaccgagttgaaggcgaact

SEQ ID NO: 14081 - DNA, 1501 bp, Oryza sativa
ggcacaagatcactgttggatgcaaaaagaaaacatgttatcttataaaggaattaacatgatgagcttggtggtgaaactttagtatttaggagattgacgccacaaatgatcgagaaaggtgccatggccgagttttcatgtacaaaatgttatgttgttgaattgtttacatctaacagatggtaaagaatctagagttcactgccctgtttataaacatatgtacaatagaaaactgaaattcatgattgcctgttgttattataaattattctaaataacttgccttctatattttggacagactattaaccatggcacgtatgactctatttacctgtctagccaatcattgagcctaaaacatcctaccatattcattttatggtgttaaaatgcagctctggaagaaaaaagatcaattcaacttgtctctataccaagttgctgcttattatagaaaagtttattagtgtgttctgggaataagctgatctggtattgcaaagtgcaaacgttgttggttatagccaaaaaagaaaggcaccgagtcgatattgcgaattgtaatggcatttttctaatatgacatatttgtaatggcatgactcaaattaacccaaaaaaggaatgtatcacacaacctcaaatgtgcttctaccttaaatatgctccttcaccatacctgtgagtggtttctccaatctgtctgagtcatcacacaagcaacaattaatcatcaattcagtaagagaacaaatcaaattcaatagaacacgtaagcacacaacatggagctacacaggcaagaatacttcggctgaggaccggtacaggtaatgagctgatggaataaattcgaaatgacttctgtacaatctaattgatacacaagtgctaggcctggaccacaatattatcgctagaaatcaagtaatgaatgccagcaataagattttcagtctaaatgtggaactatgtactggcatggcatgtatttttagaatcttgatgaaatccttgatgactcacaaccttaaaagggtataaatgaataaattgtttttgttttatatgcctgagcagtacttggaccatatttcagaactttttatcagaatcaactcaagagaagaagtagaaaatgtatttaaatatgtgtattcagattttttaatggactacttcatgatgtagataattagacagtaaattaagatatatcaataatgttttttaacttgagtagagttgcttaaatactgcctgcatgcataccgttgaattctgtatctcgagagatcctttgctcatggcagtctgaagactatatataaattgaatcgtacatgacatttcaaggttaaaacaaaatagggggtgcgtttgatcaggaccttcagttaccttgtttcctaactccatgagatccaagaggcaggacttttccttaaagtatctcttaatgatttctgtgggcatgacacttgagctgata

SEQ ID NO: 14082 - DNA, 601 bp, Oryza sativa
acatataggctgaaattcctgaaaagcatataggcggcccaattggcccaactatgatgaacttttggtattacccaagatccaatacaccaggtgtagcaaaaaaaaaaaaaaatctgccatgaaggaagcaaacaggggcggatccaggaaaaaaaaaattgggggggggctcaattacacagtttcttcaatatccagctatttagggacctttagtttatcatttatggggaaaaaatcgaaggggtgctccggggtatccatgagtcccccctacattcacgttggatccgcccctggaagcaaagaagcatatgtccttgccccaaggaaggaggtcacccatggcgtcaagctcactccatctccatccatggctaccttaattagcttagctaacctaacccaggttgcattgcatatgctcctgccatctccatcaaccaatccaagctatctatctaattccattctcacaacacatttgcatgcatctatataaagtgtaatataatgtttattacaacacgtcgctgtcacaaaagcaagcttagttgacgtgtacacatcgaactccggcgagcggcggcggcggcga

SEQ ID NO: 14083 - DNA, 1501 bp, Oryza sativa
ttgcaaagcgcatatcgagatccctagggttggtttcttctatcagcccggtccagagccgtgtttgaccgtgatctagcatacgtggcataccacgtggacgatcaaatagattttattttattttttctcccttcttccttctcttttctcttttatgaaaagacgatgacgtgtatgaggcattttcatcttttcgacaaggaagaaagagaaaaaaaagaagaaagaagagagaaaaaataatttaaaaaatctatgtcatcgtccacgtggcatgccatgtaggcaagaccatggtcaaacgcggctttggattgagataatacaataaaccaagtttagggaccttaatgtgcgcttcgtaagttcgtggacctaagtgaaatctcctgacaaatttaaggaccgctggtgcattttactcctacaaaaaagtcagtctagtgatcacaaatccacttatactactacccaccatgcattgtgttcatcatttctgacagacaggcactggctcactagaattctcactcctgttaataaatcagaaacttaagttgcaaatggtggttccttcttgagatgatcatcttgatcttccagaagaacttgactggagaagagaagagacaaggtgttgatgatcctactgtaactcatggatcaggagaagatatatagtcacctgtgatagcttatctgaattacttactgcgtggttccaatctaacagtagcatctcctgatgttgagacctcgattagatggatggatgttgaggctaatagttgttcatccgtgtggtgccaatctgacagtagcatctcctggatgctcttgttcatggaatggcgtgtcgtccatgcattggtcaggcaatttgacaatttgttcatcgtctagcagagaggatatatggtcaggaaagagttgatgagataaaattgcagttcgagtacggttatactgccgtcttacctgatccaataattggatggagaatgttgtgccggtaagtaaacagtaacaagttgtgaattttcattatctgctagctagagtgtcagctctgaagaatatatcagcatatgtagaaacatgatgaacattagtttcagctgatttgttttcttgttactgtcatacatctctggtaataatagaaatgggataggttttccactctgtctgaaaaaaataattcagctgatattccaatctcactcacctcacctgctgaattcccatagccaaataaattgattccataccacctattataggggatagaaaggggagaggttttcctctctgtctggccaaaaaatatttcagctgatattccaatctaactcacctgctgaattcctatagccaaagaaattgatttattagacatactccctccgtttcgaaatgtttgacaccattgactttttatcacatgtttgaccgtttgtcttattcaaaaaatttaagtaattattaattcttttcc

SEQ ID NO: 14084 - DNA, 1501 bp, Oryza sativa
ccccaaatggtcagtgggttccacaataaattttcatgtaaatgatatgtgggtctcacatattttttttgtttttttttcattgtaatgccacgtaagcaccacgtcagattaagaccaagtcaaccgtgccacattggcaccacgtcagtgagcactgatttaattattggaggagtcgttttacccggttctgtggttaaggggtatggtttagattcgacctatagttgaaggtgtcaaagtatacttttttctaaaaaaaaaactagagcagtctgcgcggcccatgcatatgcaagagccacagcctgtttccccacgaagagtacagtttggaaatctcgcctaaagcccatttcagtttcagcccaacatatatatatggaccagcctgtatgcttgcttatcttcttaacacaccgacccgtctctgctctaccaaatatctaggggcttgatgggcatgaaaagaccaaaccgaaaagacccggatcgagaaatttgatcattagttcagtgtcatgtattagacgaccgagttttattcggtcaagtcggtagtactttcagttaaccgaatacactgaacaaaccgaattttgcttcaataggtacattcgaacaatccaattaaattgaattttgatccaattttggcctccaacatgctttgatttgtgacccatgatagtgaaaagagttgatttgtgatttttttatgtgtataatttttttatctagagcttattagataaactgcatgtaaaattattggcaacaatttcctctagtgtgacttcacaagtatttaacggaataacagtccgatatactccctccgttacaggttataagacattttgactttggtcaaagtcaaattattttaagtttgaataagtttatagacaaatatagtaatatttataatactaaattagtttcattaaatcaataattgaatttattttcataataaatttttgctgggttgaaaatgttactacttttttctacaaacttaggcaaaaataaagcagtttgactttaaccaaagtcaaaacgtcttataacctaaaacggagggagtattacattaattgaaacataaaaactacgtaacactatagtgttagacggtacaatctgtattaatatatgcataatgtcggagcccagaactaacaacttggatccgactaagataatgtatcagtccctggatcagtaaatattgatacatacaatataactggttcttcattgcatatgttaaagttttacaatactaagggttttacaataataggtactcacctaactaattaatacacagcggaagtttctatacattctgactaggaaggtataatatttaaggattctctaagttatcggggtcatcgtagtaatagtcataagggtcctcctcttgacccaaatctgaaaaaggggttataagagcaagggtgagtattcacaatactcaacaagttat

SEQ ID NO: 14085 - DNA, 1501 bp, Oryza sativa
tcttaaccattgatttatgagttattctaccattatcaacagttgaggggtagtataaacaaaaatatgacctattagattattatagaaaagaatcaaagatgaacgatatatatatagactgattaaaatattaagagaaactattgcaaaacatctgttaaaattaatagggtggttgttgatcatgttcaggcaagtgtgggtcccatcagcagctgaaggagagcaataagctgagagatgacctggagtacgtgccgacgtacgaggacaaggacggcgactggatgctcgtcggcgacgtcccgtgggagtaagcctcgccgtcgcgataagcataatcccagttctaataattaatccccatcagctaagctagcagatcggatggatcgatcgagtaactgatcaacggatgaaataatactccctccgtttcaaaatatttgacaccgttaattttttagtacgtgtttaaccattcgtcttattcaaaaaatttaagtaattatttattcttttcatatcatttgatttattgttaaatatactttcaggtacacatatagttttacatattttatattttttttaaataagacgaatggtcaaatatgtgctaaaaagtcaacggtgtcaaatattttgaaacggagggagtaataataattctcttgatctttaatcctcatctcgtcgttaattgtttgttgcaaactgacatacgtgcaggatgttcgtcgagtcgtgcaaacgcctccgaatcatgaaagggtctgaagccattggccttggtcagtactattgtctcaacagaaattcagttcagagtttcagatcaaaatgtgttttacttttacatgcttcatactaatttggcactaactaaatagtatgtttgtttgattccagcaccaagggcagtggagaaatgcaagagctgaagctgatcaaggagaattaattagcgccgcatccagatttattaattttcacggatattatattatattatattatattatattatattatattgcatgcatgctttgctcctccctgtattatactagtatcaagtaattagtttactgtaattcagtgtcagttaagcctgtgtcatctcagtttttctaagggattttgatgtatttacatgtgggttagctccatcttgttatgctcatggagtatatatatacgtaacaacaatgtcatccttacgtcacccttttcctctctgttttttttttctgttccttttttttttttgcgggaaatgcggttggtgattacctgttcttctgcagggatcctgcagcttgtctaacactagtacagcagtgctcaattatcgtggccatccaacagattataattaattgcctagctgcattgtttaattaattatgtcgaggtgctaattaaaaaacctgtttctggattcaatgatgagaatgagaggcatccttttgtgatgtagtgtacacaagaaaca

SEQ ID NO: 14086 - DNA, 1501 bp, Oryza sativa
acaaatatcaactatacacgcatacaaaatgacaatgtcatgtacaattaaatcgacataattgtctcttaacatctcatctcaagataacatatttatttaggtcgtcacacaacttacaccatacacatgctaaattataagacaatctcctaagagcaggtacaatagcagactataatccagctataaacatattttaaagagataaaagagaagagagaagagcagcgggctatagatatatagccagttatagcacgaactccaagacgtaatacgtgtataacacgtaggagcagttattaaaagtataggaagcaactattgtatgaattggctattacattggttatagatgatttggagctagtagttggctatactattaaacttactctaaattacatgctttcataattctccatccagcacggtgtatatataaaagatgcacacatgccttgaatatacaaatcatcataaggtttcgggaatgtactacccagattttgaactttcgagctattaaaatgataatgataggcaagtcctgtttccctattttggttcagaaaaataacttctttataaggatggaatcccaaaattgaaagatatccgtggcatcctccttcatttggatttgcagtgtcaagaatgtcatcgttgtcggagtcccactcaaatttatttactcgtactaccacatctttcttgatatcttagtgatttttgtaccagacactctcatattattcatagtgatatttcctaacgatgtgtttcttctaagcttcataatagttgtccatgtcattttgactgggatatccaaagtagttgtggtagtgcaaagtccacggaccatcattttgtatacagctttcctgacaccttagaaggaaactaagatcattgtcatgcttcagttcccatgtcatctgaccatataactcattgaggaaccaaacccgtagtcggtgctcaatatcgattaatgcatagtgcacacccctcattgatcttccgacaaaatggtttatatattgacatactttagtattcatcggtaactcaagtacttggtgcttgttattcgacaaggatattctgcattagaaaaaaaacaatatatgggtcataaataaaaccattgaaaaaaatataaagaaagaagagaaaacaatataagcacgataaaagtatgatgaacttgtacatcataataaaatctccctggcaatgtacataaagtgtcccatgccaatagactgcattatgatgatcatatggaaaagccaatgccatatcagtaactgtgcaggcagccgcaccgtctcgtacaaacaatcgctctccccattgcctagtccttgatgagaacacttgcaacacacatagtaacacacatagtgatggtggccgttgcaagctcttaagcataggatctagcacacgaaatcctatactcggaactcgtgggattttgaagatctca

SEQ ID NO: 14087 - DNA, 1278 bp, Oryza sativa
ccttcgcctgtccccttgtggccccggagctcatggtggacagttgcacggttacctgtttctgtggagggccgcgtaccggcggtgacgtcacaaggctagtgtgtgcggggaggacctgtggggtggtgaactgggccagctggtggctgaggagatgacgtggtggtgcggcaacggttattgtgtgggggtggtggtggtaatggatgaaaatcgctggcgaaagccttgcttagcccttggctagcgtgacgacaacggcgtctttggcgtcgttcccttcttggaggcgtcgtgatggcgtttttcttcgtcgctaccaattctccaggtgaaaactgtgttccggttcccgtacaggcggtggcagcgtttcacgtcatatcctttatgggggcatcgtcttggagaaacttacccttgcattgattgctgttggtggactcccgcgtcagctcgaagcactagatgcctaggttttggcgaggccttctcctaggttcctttcttgtattggtggcatccagcttcttcgtttgtctctgtcagatggagtcggagctactatgtcgttagggtgcgacaatgcttggcaacgataacatttgcagtttctctcaaggaatgttggtgttgccagtgtaggttttggcgccccaggggctttggctgatgtccaaagtgtgagcttggtgttgttttgctcgttttggcggtacctccaatgatgttgtgatcgccgtgaagtcggaactgcttggtcgctgggcggcaagcttggcaatgatgacatgtgccttgtgatgtcaaagccgtgtgccgtttcttcagcatcctgacgttgatgctcgcctttggattccgccgtggtagtttggctagagttgtgtggtgctccgtgtgctatgtggtttgtaccggccgcggttgagggacttagcgttctactcatcgagtggttgtttttttctttttctgtaaccctatctaggtttttactcctgcttaattgaaatataataggtagttctcttgttggtttagtttttagaaaaaacatatggaggcagttgcaatggtggacgtgtactggcactggtggagaaatcgtttgtagtcccggttcgtaacccccctttagtcccggttgtccaaccgggactacgaatccgggactaaagttagcgatctttagtcccgggtgaaataaccgggactaaagatctatgtaccatttttttatttgcatggccctgtttgctacatggttgatta

SEQ ID NO: 14088 - DNA, 1501 bp, Oryza sativa
tgccctaagaacttgacttcggacaaccagaactcacacttgctgagcttgcaaacagttggtgttcccgcaactttcccaacaccagacggagatgctgctgatggtcttcctctgattgtgagtacaccagaatgtcgtcaatgaaaaccacaacaaacttatccaagtattccatgaacactttgttcattaagttcatgaagaaggcaggagcattggtcagaccgaacgacatcattgtgaattcatacagtccgtatcgcgtggtgaatgcggtctttgggatatcttcttcacgaatacgcaattggtgatatccggagcgaagatcgattttagaaaagatagtggctcctttaagctgatcgaacagatcatcgatccggggaagagggtacttgtttttgatagtaacttcattgagagctctgtagtgaacacacatcctctttgtcttgtccttcttttccacaaaaatcacgggagcaccctagggggaagtgctcggccgtatataccccttttctttcaactcttccaactgtttcttgacttcggccagttcatttgctgccatacggtagggtcgcttgtacagaggagtggttcctggagcaagatctatccggaactcaatctctcgcttgggcggcataccgggtagttcttccggaaacacatctctgaactctctgacgatgggggtttccgacagtccaatctgatgaagttcggaactgccgacagaggttgggggtgcaaagaaaacaaccggttgttccagccctcggtacagagtgacagtgcgtcttgcgcaatccactactccttggaattgagccaaccaattcatcccaaggatcacatccaagttcttggtgtccagaagaatcaaatccgagggaaaagggattccctggatttctataggaacggcagggctataatactgtaatgtcccgccttccccaggacaggcccgcttacatctgatagctttcataggtcatagactgccctcacaaaccaacacatgtcttttttgcacactttgtcctcactcgtgtgcacccgggaagaatttcccggtcggtcactgtcacgtcccaaaacgactctaaaatacatcctctaaattatgcctagaataattaaaatccgtgtgaaagcctccaacaattaaaatgtgcaaagttaaaagtcaaagaaggcttggaggatttttgtatatttcctaaaagcctaaaatgtgtaaataaattttagtggaattttcagagcacaaataataattaagaagaaataaacaaagttaaaaaggttttataaaaagaaaaaccttaaaattccctccctccccctcttgggccggctcggcccatctccctcccctctctctcctctccccgcggcccactcggcacctccccgcgcgcgcgccgctgaagggcgggcccgccagccaccctcgctgacgggtggggcccacccgtcatcc

SEQ ID NO: 14089 - DNA, 1501 bp, Oryza sativa
tgagtgaagatgtatttcaaactcttatgatcagtatatatttcacagcgattcccaatgagatagtgtcgccagatctttagagcatgaaccacagcggccaactccaaatcatgggtagggtagttgccttcatggggccgtagctggcgtgaggcataggctaccacatgaccttcctgcattaatacgcaccccaatccttggcgcgaagcgtcacagtacaccaggtagtccttgcgagtatccggtaagatcaacactggcgaggagaccagcttttcatgaagagtttggaacgccttctcgcattgcgggctccacacaaatttttcttctttcttcaacaactgtgtcatgggtcgagcgattttggagaagttctcgatgaacctccggtagtatcctgccaaacccaaaaagctgcgaacctgagtaactatcttgggttgcttccaatcagtgacagcggttactgtttcggggtccacagcaactcctttagtggatatcacgtgccctaagaacttgacttcggacaaccagaactcacacttgctgagcttgcaaacagttggtgttcccgcaactttcccaacaccagacggagatgctgctgatggtcttcctctgattgtgagtacaccagaatgtcgtcaatgaaaaccacaacaaacttatccaagtattccatgaacactttgttcattaagttcatgaagaaggcaggagcattggtcagaccgaacgacatcattgtgaattcatacagtccgtatcgcgtggtgaatgcggtctttgggatatcttcttcacgaatacgcaattggtgatatccggagcgaagatcgattttagaaaagatagtggctcctttaagctgatcgaacagatcatcgatccggggaagagggtacttgtttttgatagtaacttcattgagagctctgtagtgaacacacatcctctttgtcttgtccttcttttccacaaaaatcacgggagcaccctagggggaagtgctcggccgtatataccccttttctttcaactcttccaactgtttcttgacttcggccagttcatttgctgccatacggtagggtcgcttgtacagaggagtggttcctggagcaagatctatccggaactcaatctctcgcttgggcggcataccgggtagttcttccggaaacacatctctgaactctctgacgatgggggtttccgacagtccaatctgatgaagttcggaactgccgacagaggttgggggtgcaaagaaaacaaccggttgttccagccctcggtacagagtgacagtgcgtcttgcgcaatccactactccttggaattgagccaaccaattcatcccaaggatcacatccaagttcttggtgtccagaagaatcaaatccgagggaaaagggattccctggatttctataggaacggcagggctataatactgtaatgtcccgccttccccaggacaggcccg

SEQ ID NO: 14090 - DNA, 1501 bp, Oryza sativa
tgggaagaaaatgttggtggagaagttgttatattttgggacaaatcttgagggctaaaagttattatattttgggacggagtgagtaggtatcaaacgaaatctctgagatatcatcctatccgaatgtaatactgtttggtagcatttgggttggaatcgccatccaaatttaggcttttttcttacataaactcatttaaaacatactactccctccattttaggttataatatgttttaactttgatcaaagtcaaactgctttaagtttgatcaagtttatataaaaataagtaatactttcgacccacaataaatttattataaaaataaatttaataaaactaatttggtaatgtaaatattactatatcaaatatataaacttaatcaagcttgaaacaatttaactttgaccaaagttaaaatatcttgtaacctgaaacggaactgagggagtaacaaaatttgccacgtaaaagtcagggatgatcacacgttctcacggtctcatcttttcgtttatacttatgtttatcagccaaaatttaaattttcaatcttaaatttaaagttgattttgaggtttttttcgtcgaggtttatcttttagatcgctaagaacacgtatataaaagttttattcacaaattattttgagtaaagtgcattggtggtccttaaacttgtaaggttgtgtcatataggttcttaaactctcaaaatgcatatccaagcctcataacttatcaaagtgtatcatctaggtcccaaattgacacatcctctctaggatcctacgtggcgctgatgtgacatcctctctaggatcctacgtggcgctgatgtgacatgctacctggacgtgacatgtcatttttttttctttttcgttttcgttttcttctcattattctttttttccattcttctgctcgggttacggagaaaggagaacaaagggaaaaaaaggaagaaaaaaagaaaaaggaaaaaaatttaaattggtctcatttgtcagtcaaaatgatgccatgtcatgtccgtgtggtataccacatcaacgccacgtaggatccggaagggattgtgatgatttgggacctaaatgacacactatgacaaattctgggacttgaatatatatttcgagagtttagggacctaaatgatatatccctacaagtttaagaaccgtcggtccactttactcttatttttatttttagtttgcaaatatgtactgtagtttaaacgatgaaacgctcagtgccacagcttactgctggtccggtcctcgcctgctgagtgctggctgctgcagctccaaggcaacaatggtgagtgggaggtccatcacctccggcgccgccgcgccgtgccacctgcgaccgacggaccggcacaccatggccgcgtgccgctcgcggcagcgaccacctctgccccccaaaacaagggcaaagggcccggcgcgccgctccggtaagctccatcg

SEQ ID NO: 14091 - DNA, 1501 bp, Oryza sativa
gattgcaacactcaagtaatcccctatctgtgaaagaacatagcaaataatcaattgatttttgcctcagaagaatacattgtaataacataatacagctctgacaaatacctggaatcctagctctgcaagagttttagcatcatctccccttccatggccataagagaaggttgaacccaccttcaatcaatatccaattatataagttatcacaaattgaacagttactggtttggaatataaaggaacatgggttgtacaagggaatttactgacatatttagtggtttaatggcacagatagaacttgtaacaagctacgttttagtacagagacaattatcacgatgtgactgaagtggctactggtaagtggtaactacatggggcctagtggtgtaccaatgacatgtgttaggtatgcatacctgagtttgcagaaaagagattttgatgtcattggaagcatgtcatgaatataagcacacaaaatagtaaccataactaaaactaatagcccatgtatagtgaccaaactaatagccaacgtatagtgacagtcaaagcaaaatccaactcattcacgataataacactcattccctattcagattaagaccaacgtgctctgcattttttccatgtttgtgtatcagaggaagaaaaacaggatgagcagaagaatagtcacaatggtcaatggggataaactctcacctctttgacaacgaaacgaccatgcttatcagggtacacgaaagcaaaagaaagccttgcatttctttttcttgctgcaagagcaacctctttcacctgaaacataaccaaaactgtgctgatcagatctccatctaaaaacaacatttagtcaaacgtagtgccaaaccccacttatcatcatcagactagtcaaattttgttgatttctagtttgttaagtagtataaaactaggtaaaatttcattttccccaaagaggacaagaaagcacaatattagaaaaattacaagatcagtgagctctcggagtgtggcatccttccacgtgtatatctgcacttcatctttcggctcctttcctctcacggcaaactcttcattttggtgatggccaccaacctgaaaataaatgaccagtaccacaatcagctttctgtgtcgctgagtgtttactcaagaatctgaagtctgtcctaaatgaatggcttgggatttaattttcaacaacactaccatgagttacttgatcgagttatactgcatagaagtgtgactcaactacaagtgcgatatgaacattacaattccatcaaggcaccagaacctatgattcggtaagattgcacaatgcaaataactagcgcaataaagtttctgactatttatttaacttgtattcaaatgaacatatgctctcctcagtcaaccacactaaacagaagtgtaaatcacataatgtgaacttatcatacatacaggaatacaaatgaacgaagtt

SEQ ID NO: 14092 - DNA, 1501 bp, Oryza sativa
ttgctgtgatttatgtattgattatgtttctattttccctgtgtgctatgcaatgttctatttctcatttcatttttttccattgcttatgatatgtgcatccttataataactccttgtgcttttttttttgtctctctccctttgttttaattattagatgggtcatcaaaagaactgttgtacagattcagaaactttgcatcatgatgatgtgtgtgatttagttgtgtgttgtattactattgctacataagtactatatccacgttgtattttgttttctagttctttgtgtgtactcaaatgtaagctagaaatatgaagcctgagatattgatctgaagtgtagatcaatataggttttaacttatatagatcattcgattcctatatagacagccccttaatttaatttctgttaagttagggcaggcatgcaggttaattgattttgttacgctagtttattgagaactttatgatctatgcaaatttgttagccttgtgggatttggatgtctttttgtagctgttcataatgtttgtagtagactggattacactctagtgcaaaccccatttttgttattggactcgtgtttatgtacttaggtctaacatgtcttcccctttggggatttagacgccatttgtgtcggttctactgctaatgtttgtagtagactggattcattggattgcgtgcctctgcatagaccaactgtggaatggtcatgttccctagtgtgaatcaggtgtacagggcttaagtttgtgagattgtttgactttttatcatagtgtggacctctttgcatatatttgtgaggacatggagatatactataacatttgacttcaagttgaaagtactaaccaacgtatatatattgtactgggagttattttgttcgtttgccatgtttaagtaatgttcatttttttcttgaatacagtggtcaatttctgaggaattatatatctttttttaatgcataccttcacttattttataatttatagtctgccaaactttattgatttttaattgctatttttaatagatggttcaccaaaagcgttcaaaattggataattgtagccagcccataagtgaatctgatgatattaattcagagttttcgcgtgaaaaagatgatgattacaattgtgattttgatgataactcagccagtcatgtaagtttattttacatttcaatttcattgatttgaaatatagttgtttttttcatttccatttgtaaattcatgaagagtttgcaattatacattctcattgcttggtagccaatgtaatagtatgaccaatattttcttgttttatttgttcttgaattgtcatgttgttccaaggtcagaatagtatccattattctttcattattttttttcattagtatgcagttgtagctctgttgtagccatgtttcatagcacatttgcaatgttttaattgtttaatatgtttttttagg

SEQ ID NO: 14093 - DNA, 1501 bp, Oryza sativa
gtcagcttatcactcattgcttcagtcaatcagctaggttgtgaaagtacctaactatctatatgaaatattagtcttatcagcatggatgtaagatgggtatgtacccccacaaagatttccaatctattagtcaaaaacagcaacgttttttttatagaacattggtgtacaggtgtcacctttttatgaaggatcattagcatgagctcagcaaaatcttgaacctgtcactactaaattcagtttatgctaataaaaagaataattaaagtagctggtagttaactagtcactatatctagcagtgcacaagtagtagtttaacttgtataccagcttggctacatgcctattatagcataaggtcacatgaatcttgttggaacattgcgtgcttctttctcccagcttttctttttgtttgacctgttgaagaggggagagatcgcgtacctgttcttctttcagttgaactgaaaattgtttatgcgttctgcgtggaggatagcaaaccagagatcttgtgcccgtcatattcagatgatatactacattatctgaagtctggatgccggtgccgagctgtacgtgttgtgatgcacaccgtcggccgccattgtttatgcgctcataacgcaccaagaaactctgattgagatcgatcactgttggttcccttgttgctgtaataatactgtgcataatggaatcttctgggacactgccagcaacctgcagaatactgcacacatctgctgctcggcggactgcacacaagccgaaatcatcttggttcttggaaggggttgggaatggaccatgatgcagtgagcacaatacagtttggagtttatgataagatgaatcatgttctacacaatggaattatttatggacatagttaagcttacacgttcgtaactgtactaacatacctgtaccaagcaagccatttacagatacacttacacgcagtggagtcctcaggggaatttcgccgaacacatggcgtgcgcgccccacctcctccacccatccacctttggtctcatctccaattctgttcagattacagacgaacacacacaagctgatccgcattgatcggattattgggaaccatggatgattatttctagctactagttttgcttcttggagttgatgtagtcctggagggcttccatctgctccttggtcggcggctgctcgttgttcttgatcgaccggtgcacgtcgtacgtcgtcgccccgaggaacacgaccctacaaaaatcacacaccgcgtcatgccgccgccgccgccgacgaggagaatcgaggccggaggatgcaaggcggcgccacctaccctgcggcgagcagcgccacctgcctcgggaagacgtgcttgcccaacaccctcatcctcctgcctccgcctgcgtggccgcgtcttctcttctcgctttcccctctctcgatctctccatatgcgcgagcaggtgaaagcccatgg

SEQ ID NO: 14094 - DNA, 1501 bp, Oryza sativa
gcgagagaggaggctgctctccttgaacctgaggtacacctcccggatcagctcgtcgtgtccttgctccgcagccacgtgaaacacggtgttactctccgcgctcacctctgatatgttgcactggccatgccgctgtagaacacctgagtaatttttttacacggatattggattaagcttttagggtaaactggtcactaacggtaattaattcagagttcggccgaaaaatgactcaaactgtgttcggcccctccttgccgtcacacaaaacgaagcacttattattgcatgattaattaagtattaactgtttttaaaaaaatatagattaatatagtttttaagaaagggggaaatttcagcaaatactccatatatccaaatcgatcatccgcgttcttccttgtcggctaattaagtagtatacgtactaaattcttacttcatgatatgaatgcattatgcatataaatattttataacttttccatctatctaaataaagaggtttgttacggtccagcagatagtacctcgaggtactagtaccaccaggtaccaaatgaaatccaaccgttgaattagcagggcacgataggaaacgaattgaaaaggggcggagaaggcccgtgacacacatgcgcgtgcagatgccgccgcaatctcctcgtcctcacgcgccaacgggaaaaaaaatttggtggagaccgggtgtaaaccggctcccgtgcagccccgaccccgatgattgccgcgtggcaatcacagaatcggacgtctcgctatgcatggctccaggcgcagcgcaaacaggatggaggagccgactcgctcgatggctcccgggcccgtcggctcaccggctcaccggctcatatcacatcgatatctcttctcagcagcagccattgccaccgacacaacctctctcatccgtcgtccgcatggcggtgatagcgagtggccgatggcgaccgccctgactgaggacgaagacgacacagcgccgcctgggacgaggttgccctgtttgccggcggctagtgcagagatgtactccatcttcctgtgggcagtagctgctatctcttcccgatcacgggcttttttcttaccatggtgcaggattgatttgattagttattagtttgatttgggcctctgcattcaaactttaatatagttgttaactgctacatttcaatggatgcagtctgaatgtttgcagattctaattagatttgacaaagtacaatattgattttagtcctctaccatttcgatttgatacatactgaagattttggagacatgagcatttcatttcttcatggtcacttggtcagtgcatatatttccagggccggtcctaatattttaggggcctagggcgacacaaaaattagggccctatattgagttcgttttttttaattgtattaggtgccagaattgaagaaaacttcattttagagtagcataagaaaaacagatt

SEQ ID NO: 14095 - DNA, 1501 bp, Oryza sativa
cagcaagtcgacaaaccgacgatgagtaaatctcattccccacgtcatacctcaaacccttagggcaacaccaatgtatttagcaaactagtccatagatgtgggacccacacctgggagtccatagttttagaaaccaccacaatgtgtgcaattaaggtgggtcccactaaaggcaaaaaaaaatcagccggagctgaagctgcaggctgcagcatgcatgcacctggcataactatgattttttattgtctatggactacccatagtgctatggacaacttttgttatttctttgctatagactagttgcataatgtgttaagatagctgaatggaattttttatttcctatggactggttttcatgtacattgtggatgcccttatgaataaatttctaccaacccgttgaattatggtttacgctagtatactttccatagatcttatcacttcttccgtatacgccaacattatcacgtcattatatcataaacaaccatcggtaaattaagacgaccttatcgataatattcgtaagtgacaccccccctcaagtattacaaacacattaaagacaaaaaaagggtaaaatatgccaataaagaaaatgaacaattctacttaaaaaaggcagataaactaaaaaaagaaactttttagtggttcattagagtaatggttagccttgtgctaagttgctttgagaaaggtctattgcgatatgaatctcccaatgctgatgtaactgcggagcattgtaggttattgagtatcatattcacaattatattggcaacctcttctctggctcctatagttaccttgtgcgagtggttcaccttttatgtattattgaacactactatactctccttattattagaggtccatcctaaccattcaggccataaaccatgaatagccaaaattatctcatagtatactatactatcttcatctttcttatcgttgtcttaccaaaccagcaagtcgacaaaccgacaatgagtaaacctctcgctcaccacgtcatacctcaaacccacacgattaaacttctaacaacccatcgagaattatggtttacggtattaaactttctgtagagcttatcacttattccgtatacgccaacaataccacgtcattacatcagaaacgacaaccccgtaaatcaagacgaccttatcaacaacatccgtaagcgaaatcccctgcaagtattaaaaacatattaaaagccaaaaaaaagtaaaatatataccaataaagaaaatgaccaattctacttcaaaaaacaaaaagccagagaaactaaaaaaaaaagaaaaaaaacactttagatgcacaaacggttaatcccctccttgtctttctttgcagagggtcactcctataaaaccaacacccccacttctccaaaggcaccacctttttcgcgcccacgcacgccgccaccgctcgccgccgacgacgagagcgactgctccgatga

SEQ ID NO: 14096 - DNA, 1501 bp, Oryza sativa
tgccaagctccggtttcgagtgtcaccatggcccattgttctgctgcctgctccctgctgctgcagcactgttcaggccttcaaggtccaggctagcacattgaatcctcaaccattgtggctgtctcgacactcataaacccagcagcctcctacatcagtagcagcagcagcagcaccatggtgtaccagcatgcagtacagatcaaagtttcaaaggcacacattactcatcactattcaatacgccattgttacacactcatcataagcacaatcatgtgaaagaagctagtcaagtcaggaaggagaaggttcaggccactgctcccctctgtccgcaaatataaggtatttggggtttctccatccatccacaaaaatacctttgaatttatcacttattggtagttgaatcggtaggcatgatctttcccgataagtaaagtatcaggggcatcagaggaatttcaccttaaccttaaacagtgctaaacaatttagaaccccttaagtcccatcatttcgcctacagctgactatcagcttaaaaaataacttgtgagcaaaacttttatacttatcttcttagtgactttaaagccaccactgaaaaataaactacaataaaaaaatcaaaatcaactataaaattaaaattttaaattttagccgtgactgataagctaaagaacaaacgatgaacaaactttatgtttgtggaccaagggagtaattaattggtattggatcatgagccctcatgaaaaactttgctcagatggtgtttgttaccactggttaaagtagctagcagtagctgtagcacttgtagaccatggtcattgtagcagtaccacattgtgctgagttgtgccatgtgtttgcttctggaagatgagggagtactgcatgatgcatgaatgaatccacagtgctcacattcatagccaggttaattccagtaaaaaaaagcaaaagaaagattgtactgaattactcaccacatgtagcctctgaaaaccccccttaaatccccacaattacaccataattaacattgtccatctcatatgagggacacatttttctttgttgtcccattttttgcagtgaaaggctgtgtttagatccaaagtttgaatccaaacttcagtcattttccatcacatcaatctgtcatacacacataacttttcagtcacatcatctccaatttcaaccaaaatccaaactttgcgctgaactaaacacagccaaagttgaggagttagtaattggtatgcttaaattgtgttgggtacagagtttgcagtcctgcagatatatttaactgaatgcatgtgcaagaagaagaagaagaagagcagtatgtagattggcagattgcagaggcataggtggaagatgtgtaaggttctagaagcatctagaagccgaagctgaggtcactaggccatcacttctgctgcagaagcttcttctccttcttgtgcagaga

SEQ ID NO: 14097 - DNA, 1501 bp, Oryza sativa
tttaggatggacggagtatgcatttagaaatgccatgtgacaaatgcattcaatcgatcatgtgctcaatttaatactctgttcttatccttgggattcagagcatgcaggtctagctctcagaatattagttagtgagcaaggacaaatcatttgccattagttggaaaaagaaaatctgagtgcttgtggagaagatcatcttgtattgcttatttgctttaaatatgggtttgtcttgctttgcaatgtatactgatatcagaagagatctttctttagacgatgattagtggtgatctttagccaaatgtaaagattaaagccaagacgatgcttttgccctagcatctttattgttgcacatttagagattaatcaaagaatgaggatatgccaccttttattttacaatttaatggaagtcttcttcttttccaaaagcttttgcttgaaacattgttaattcttcctcaatgaaagaaatcaacataaagtactagttgctctgaagcaaccaaactggtatatatgttccaatgagagtttatctgaaaaatggttgccaatgagaggaagttgcacaaaactacatacgaggtagcaacaaatccttaataaatttttgcaagaaaacagaaatatgctataattaatactagaaaacgaccaacctgacactgactgcaaatctttgggacgctattttgctattccaacaaatcccttaaagttgtgctgtctgaaactctgaaccacaattcacatgcatccaagaattagaaagaaaaactgaatattcatttctaggaacaatttaacctgcgatctactatcagagaatgttgtatcactgtccaagtgagacatatactgataggaaataggatagctaaatggagagaagtgattgattagttgctcattaagtctaatactagatcagagttcaacttgcgcgttcgagaaaaaagatcagagttcaacaatgatatgtgtcagttgttttcacactcttacctctactgttctcagctttcttcttcagttttcccttttccttcaacagtgatatttggtcattactcaggaaccttcatatatgaaataatcaagctgattgaatcagattgagccaaacatagcagatacaaacatatgcagtttgatctatggaactgaaaacttacgtgcccaaagaattgaccacaaaatagggaccttgcactactgatttttttttctatttaattcctgcagaatgatcactgtattccaaacaattccttagattataataaagtgggttggtggccacttagaggaaattaaacctggtgatattttttcctgttgtcttgaggttcaggcaaaggcatcttggtgacagattccatctgccaacatacatatatattggcccatggagggccattgtcaacactatggtagcagctgcagctcaagcatggcccaccagcttgcaaatatcaatggccaa

SEQ ID NO: 14098 - DNA, 1501 bp, Oryza sativa
gacactctgctagattatgtttatttcttcagtgtctcaagaaaaagattgtgtactacgtatgtgtatgtttcaaacttacaagtaggaagttttgaattggttggggttgggcaaagttgttgtcttagctctgtgtttgtagatattagctaattgctctcatgtcactgaaaaatcgcaagttggattttttgttaaaaaaatagtaaccgtggcagcggtggaatgaaaggaaataaaagcaattaactatttcttttccttcatggcaggtcgctagttgccctcaaacatcgatgaaaataacttagtggattttagcattagtggtttccaaaaggaaaaaaagattatatatgagtagtacaaaatcacatttgctaaaatataatacccttttttaataatgggtagatcagcctttgcttccgcaaaagttacaaccaattattacagcgattatagcaactaagaaccgacaatatcaaatcagaaacaacaacatataaaaaagaaattcatggatgaaatataataccatttgtgctaaaataaccgtctttcttggttataaactgtgaacttgagcaatggtttgagagtaaatcatccgtaattctattggtcagagaagtagaccacagtcgatttaatttggaacagttcagtcaaacatctaccaaaaaatcttttaactagacaaaagcgttaagcgtatcacacaatattagttaaataaacttcctttattaaaaccatcctaatccctggcatttgacacagccaaacagtagtttgatactgatacgattcacacatcaattttccaattttgcgctgctctttcctcacatattgatcacatttgccactttttgaaaaatggaattaatcaacgtaaaattccaattaattaactaagcttcctttaataattaattccctcctaaaccctagcattaatttgacacagccaaacagttcatactaattcgattcacacaccaatttttcaaaaaaaaaaatcttagctctttccacacatcatatttatttgtctcttttttgaaaatggaactgatcaacctaaattgtaattaattaactgattaattaaactgcatgaattttgcacttttgacctagctagctagcagcctagctaggaaatcaaatcaaaccaacaaataaaactagttgatggcgatggaatcatgcaaggagatattgaatttgaaccccctgatgaaaaagtcaatgccatcagcttcttcctcttcttcaattcctccactcgttttcagatcattttccatggcgccatggcgcctatataagcacccacccccctctctccccctaaccctaaaaacatacaccatccatttttccaagcttcattccaagccactacactagcacacactacatacaatcttcttcttcttcttcttcttgagttcttggaggtcgaggggtgggtcatcaatggcggagg

SEQ ID NO: 14099 - DNA, 1501 bp, Oryza sativa
tttctctatttttcatatttttggattttatttgaattccttttaaatttgaattttatatatgtctaaccctaggtcttgaggattcttctgactcaatagataatatcaatcaatctcaggacatcgagcaaggcaagttaccatatacctgttgatcatttaagcttatattttacaaattatttatttatagccttctattcaatactctattttatatgcacaattcaaccaacaattcaaccatagaaacccagataatttagtattgcttactttgcttacaatctggttaaaatatcttatacttagattgggacagtacgtaagatttggttgattttcgggtggctagtactgtctcgatcgatataagttttaccaggtacttatgtcgaatgaacgggtacgaccacagtttctagaatggggacagacctagttattatattaattagcaatatggcacctctgtatagtggttcttatttttaagtcctcacgtaggaggcaactatagccgcgaagggcaactttaaccattaccatgtacaggtaaatggtttgtgatactcgagtatgaactatatggtatatttctaaaccttgatcgagatgacgtgttgtcatacgatcagttccccttaaatatctcgggaacgccagaactcctcttgctgctgttaacaatacgttcagagcatatgaggatataagttcatggaacaggtgccataattgttaatgacttaatgctgggccatgactaaagcgtacatctgctgcagtagaatatctttgaaactattcgaatagccgtactcatggagttgagtaccgggactcatatgctaccctggttagaaatctaaagtttataagttttacaaattcttgctataactcttccaaattgtttattactactttttgcaaagaaccctactatatgtcaatgcataacatatttccatgataacttgctgagtattgtaaatactcacccttgctcttataaccccttcttcagatctgggtcaagaggaggacccttatgactattactacgatgactccgataacttagagaatccctaaaggttatacctcactagtcagaatgtatagaaacttccgctgtgtattaaatagttaggtgagtacctattattgtaaaacccttagtattgtaaaactttaaggtatgcaatgaagaaccagttatattgtatgtatcaatatctactgatccagggattgatacattaattctagtcggatccaagttattagttttgggactcgacaggactggtatcagagcatatgttttgactataggacaaaccctaaggattactaactaagttaagtttgaacttatttcaagcttatctttttaaggggggtagatttaatccacaagcatgcattataatgacatttgtatatttcaagacaatggcagaagagcatgagcaagaacttgtagaaactg

SEQ ID NO: 14100 - DNA, 244 bp, Oryza sativa
gttgccttaattgtttgttatgtgttggtttcaagtttgagtgctgcttttgtttgcatcatatcatttttcattgagtatcagtttgaatgatatctttaagatgaaactctgatcatttatttgaaaatcctggcagtttttcatgtacggtaatcataacttcatatattgattatttttcaggctcagtcttgcgactttcttgctgtataatgagatcatatctttgagtgctcaatga

SEQ ID NO: 14101 - DNA, 1501 bp, Oryza sativa
atgtaactttattcgtataaagtttacatatactaactttatttacatagtaattttcagtaacattttatatgtaaactttacacaggtaaacttttcacatgtaaagtttatatatgatttaaaattccttctctaaataatagagaaaaatattcaaagataaattttgctgttgtgttatgattcaaaaatgaatacatattttgtgatcacaaaataataacaaactagaataaaaaataatttcacaaaagaaataataaaagtaaaaacaaaaatgaatgcatacgatgtggaggcattattgcgagtgaatttgttactttcgaatgagcatatgtggaaggctatgagtaaatgaaaaactccacgaagtaaatttgttacttttgaaacgtgcggagatactagaaaaacggaaaactcagaaagaaaagctagacggtaaatattttactaaaatgcgaaaacagaaaaactatatagaaggaatgaataacagaaaaatcaggatggttaatattttgccgggccattgatgaatcacggatgagatggaaaagagaaaaaagaaacacagaaggtgaggtggtaaaaaaaaatgaaaaaaaacgaaccgggtaggatgcggaagaaaggtggggtggcaaaaaaagggaaaaccggaaggagagggcgttgtgtggcgctcgaactattattccgcgctgtagcgcgcggaatgtaaaataaaaggtgtttttgattattattctgtgatgaacaattagcattggagattattggtgttgatatttggaatttatttgtaaagtggttttggagatgattgaaatttacaggtgattgacagggactgctgtctgttgggtccggtcagaccggcgcagcccacggtctcaccggccgactctgtgtcggtttcggtttcgggttgtttgtttggatatccgtgattgtttcatgattgtggcttctagatggatactatacgtatgtaatactgttgtttgttaacaatgagtcaagttggggatagcttgatctcggaatatggtttctttgttctttctatgtgtaggtcactcgagatgccgggagagtatttgcggcgatggaccgggagtcggcttggggataagacgaagtccgtggtggtcagagatcatgcgggatactaaggctagagttcaatgcacgtggttggtgaagtttccatatggcatacgatggatgtattctgtgcgtatggaatgcggagttgaatttggaaggagtccaaatttggtatgattggttatgtaaagtttatttcttgtacgagaaggtttcctatgaggattaggacttctagtatgagtttggttcgtggctttaggctgcctacctcatgtataaatagacagggagcgtgaggctttccggtatcgcttttgagagcaattgagttgatagttgagttagggtttcgagtttagtcaagatttttgtaaggagt

SEQ ID NO: 14102 - DNA, 1501 bp, Oryza sativa
gaaaccgatccaatctactaccaaaaaccgatctaatctaatctcctccttccttcttcctcacgcacaacatcacatgcgcaccataacggatacaaccacggcacagccatcgaacagaaaccttagatgcaactcaagaactcaaaaactaaccgacagaaacttctgaaaactacaaaaatagaaccatggcagcgagccgattccgttttcgtaggtcccgacgacaacagagacacggaggcaacaacaactgtggtacaaaacgtgaccagaactcgaaattctaaacgaactagacgctaagaccagcaacacgacgtgacaatgcaacaaaaattcaacaaagcaaaaactgcatagaacaatgcaatggcacaaatgtggctaggtaatgtatgaaaatttttttttggctattttctggttataggtaaatgaaaactcaccgagcaacgaaagctctgataccacctgacgaaccctgagctcctttcgacactcaaggcagttgtttggcccgatctttcgaagagttgatgataactacgatttgagagaaacgttgacaacccgactacaatcgtacaagacgttgtgttgcgcctttgcgattgatacacctctctgtgggttgttgatcttaccggtgggttgttaatcttaccggtgcagatcaaccttattcctgcaagcaaatcgaagaaacaagcaagaacaagataaaatcaatctgaattgcaaataagaatgaatacacacaataagttggggtttcgaatacaagcagacggacggtctagccgacacacgcgctgcaaggaagtagcaatggctaaactttcatctaaacaaaacccaagaaactctataggggtacctagttaattataattgtgagaggacgaccaaagggaatctagggtcatgatccacctggttggggcgcaccccacatgggccccacttgggccggggtcccagacgaagttacatgcccataggcccatgacaggtgacgcagctccttgtttctttgattgcggccaactgagatggagtttggtgatgaggctggatccgttggaaggactccgaaacctttccatcaagtactcacgggcccaaaacggagctcggatgcaaatttggcggccgtttgaagtcaacagtgtagcaggtggccgaatcgaattccagcacttggaggacttgatcttgatataatcttgttcatccatgatgtgagcaatggttgtatctatagtagccatggtcatattagattgtttcatgattatggcttctagatggataccatacgtatgtaatactgttgtttgctaacaatgagtcaagttggggatagcttggtctatgtgtaggtgactcgagatgccgggagagtatttgcggtgatggaccgggagttggcttggggataagacgacgttcatggtggtcagagatcatgcgggatactaaggttagagttcaa

SEQ ID NO: 14103 - DNA, 1501 bp, Oryza sativa
tggaacgtcttgttcctgacgcgcacgaacttgtccggcaactgcatcccctgcatctccaagaagacggcgtcgccaccgtcgccgccgcagggcagctcctccgttcgccggcatccccgcgagaaacggccgttgctccactcctccttgctcctcggctcaaacccatcgaggcactcgcatgtcggagccacctccgaatagtagcagtaaccgtatggcccgcagtagccgtagtgttcgcactcgtatttcggcagctcgccgagcttgctccactccgacgcgccgtcgccgccgtcccatgagaggacttggagcttgccggagtttgttagcacgtaccgcgtgcgcggcgcccggtcggagatgccgaaggagaggtagatctcgtcgtcggcgtcgacgacggacaggtagatcacggtggtgccgttgaccatcagctggctggggatcgggttgcctgtccaaaccggggagcgccagtacgggcgtgactggttccagatgaagagctggaggaacgtgtccgggtcgccgccgaacgagaagctccccggcgatggatcgccggggccgtcgttccaggagaggaggcgctcgccgactcgcgtcctgtagttgatccctatcttcatgccggggaggtacgtgtccgtcgggtggtcgaagctctgccacagcgtggcgccgttcggcgaccggacgacgaggttgccggtgttcatcagcactgcaaccgccggagaattcgccgcaataatggtgatgtccgtagtccaaagaacgcggccgtcgccgtcggccaagacgaggccagaggagtttgacagggtgagcgacggtgcagaggaagagctgccatggccgccgtccttcaccggagttcctcggttggcaacccagaccaaggtgagcggcgagatgtcgttgtaccaaatgccaaggtagagattggacgaggtggagttggtcggggagaagaatcctaaggcgaaggcgccgccgttcgaaacgacggtggagccaatggacagaggtttgccggggacaagctggtcatcagctacgcacgccggaaggaggaggaggaagatggctgtggtgaggtagttgaaagctatccagttcatctctggtcttctgatacgccgtggacgccgagttcttctcaggagtcataacaatgtgtgttggtttaacattaacgagaaacttcttgctacttgctactattgtatgtatattaggtgtaatacgatgttgttaagagtaaaatatactcttagaagttagatctatgccaacctaaagaaagattggatataaactacgatggtagctacgaccaatccaataatgacctttttttatttataattttttttattaaaagttttacaaaaataattttccattttgaaaattgacggaagtagtcgcctaccgccctccgccctctcagagggcggcaaaaatgacgtggcagacggcc

SEQ ID NO: 14104 - DNA, 1501 bp, Oryza sativa
tctgattctcgtatgcgtttaaagcataagcaaacgcacatagatttaatttgttcttgagtaaaatacattagtagtctctaaacttgtaagggtgtgttatctagatctctaaactttaaaaattgcatctttgggtttatgaactaatcttagacgttatttctaacccgctatatgggctgacgtggcatgccatggtgtcagtggaacccacatgttagtcatatataaaaaaaactaaaacatattttttccctcttaggtagagaggaaaaaatataaaattaaaaaaaataattctaaagtagagagaagaaaacatatttttctaattttatttttttctatgtgatataaaacgtgggcccgactaacatgtaggcgtcaccgtggcatgccacgtcagcgcatagagtgggtttgagttcgtttggacctatatgatatcgatcacgacaagtttgaaaaaaaaacattttaagagttcaggtacctacatgacacactcgcactagtttagggatacttcactctttttagtaacactactggagaactgatctttattgggtcggacgaaaagcacaatagtcccggttccataaagaaccgggactaaagaggtttttttagtcctggtttataactcaaacgggactaagtgatctttagtctcggttcgccccttgacagggcatgtcaaacccctatcagggggctggggaactgatgcgaacccgctagggtttgtggcccgatctttcgatgagaggtaagggataactcgattagatgaagtcgacattcacggcccgactacaactgtctaaagacgctgcaccttagcaaccgatacaccgtctccaatggtagccgcgaacttgtggtgcgcgtcaacctagccacgagggcactcgtcctgcaagcaatcgaagaacaagcaagaacaagtaggacaagcactgagattgctagataaagatgaaagtttcactatcaaacacaatatggtggggttccaattacaggcagacgggcggtttagccaacacgcgcgctgcgagccggtagcaagaagctatctctatcatcaaaacccgcctgttcttggcggcgactagaggtataaaaagaggggaagaacgaccatagggtcgtgctccaaccctaggacgcgcccctaatgggcccaacatggatacacagcccattgggccaaaagaggtgacgcagcaccatggacaaaaaatagtcgggagtaaaatgacaattgcggccgctccagaacagatatggacatgtggctggatccatttgaaagtagacttgataagctttccatgaagtacttgcacgcccaaatcggagttcgcatgaagtcgtggcggccgttagaagttggcgctgccctgcagtccgaatccaccccgcgcgaatcctcttccctttggatcctctccatcgttcctgagtaaaacacgagtgcacgcgtctccga

SEQ ID NO: 14105 - DNA, 1501 bp, Oryza sativa
ctcggattcggttggaaaccgctcccctaatctcgccggcgccattgatggcggccgacctcccgcgccggtttcctcccttccccggccagcctctctcgccccggctctatttaaaccctccccgcacctcctccgtccggttccgcctctcgccgcccttcctcctcgccggatttgagctcgcgacgtcgctctctctctccgccgtcgccgccgagctccggtccgccgccgtcgtcaccccggaccgcctcccgcctcggcgtcgcctccttcggcttcgccgcgtcctcgccgacctcgtccacccctccgtttcacccgccgaccgccggaacgccgccgtccccgtcgacccgagccgcgccgccgccttcctccgctccggtagccgttcccgtcgtcgccgtcgacccggggtgagccgtggaccgccgtttcgcttcccccttccctcccctctctcgggcgccgctccgccgcgccggtggtcgccggcggcgaccatcggggcgcgggcgcgccgcctcccgtcggctgtgccggcgaggccgccttcgggcgcgccccgcggctgccatgtggggcccggctgtcagccgcccgtgccctcgggtgcggctgacgcgtgggacccacggcgccggccggcgtaagccgcgtgcacccggtccaccgtggaccgtgaggctgccgcgtgggccccactcccatggacccggtccgcgcgcccctctcctcggctgacgcaataaatccgattttaaattaaaatttaaatgaagaaattcgcaaatattcatttaaagagcatataaccttcaaatggccataacttggccatttgaactcggaattggaccgttcaagtctctaatttttccttaagaagtcaagaacccatttttgtgctttgtttctgcttgttatatggagtttattagagtaaaagccgtttcttttccgttggtcgtgtagacgctgcagcttcggaagatccgctcttcgtggaggttgaagccgacgtttgggaaagcgagcaaggcaagtcacatcatccttgagcatattgaatcccagtttataaaattatgttgatttaaattaatgcattaccgctttatttaaattcccgcgttatcactgttttatttagccatgcctatttatcgttgttaagacattattattgctattgttattattaccttgttcaccctaggaaaataaaaccccaactagtgggtactctatttatggttccactagtatgaacttaggtagatgcttcgctggttaattaggcaacattaggtggttttataactttagactttgggaaatctcatatcatttggacattatggaattgttggattatggtggaattggacatacccctctcttcctctttcaaagcccctaaaacctgtttttcggtggggtttgggtgcatgccagttgtgggaagtagcaccccggccactataaggattaa

SEQ ID NO: 14106 - DNA, 1501 bp, Oryza sativa
  unsure (1)..(1501): unsure at all n locations
ctttcgtgttcaaacgggcggatttgcccccgcaaatctcgccggcgccattgatggcggccggacctcccgcgcctattcctcccccgccggccgccctctcccccttccaaccctatataaacgctccccgcgcctcctccgtccgtttccgcctctcgccgcccttctcctncgacggattcaagctcgcgccgtcgctctctctctccgccgtcgccgtcgagctccggtctgccgtcgtcgtcaccccggaccatctcccaccccggcgtcgcctccttcggcttcgccacatcctcggcgacctcgtccacccctccgtttcgctcgccgaccgccggaaagccgccgtccccgtcgacccgagccgcgccgccgccttcctccgctccggctacctttccgtcgtcgccgtcgaccaagggtgagccgtggaccgccgcttcttttcccccttcccttcccctctctcggccgccgctccgccgtgcctatggccaccgccggcgaccataggggcgcgggcgcgccgcctcccgccggctgtgccggcgtggccgccttcgggcgcaccgtgcggctgccgcgtggggcgcggctgtcagccgcccgcgcccttgggtgcggctgacgcgtgggacccacggcgccggccggtgtgagcccgggtgcgcccggtccatcgtggaccgtgaggctgccgcgtgggccccactcccgtggacccggtccgcgcgcccctctcctcggctgacgcaataaacctttttttaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgtttcagcttgttatatggagtttattagaataaaagccttttcttttccgttggttgtgtagacgctgcagcttcggaagatccgctcttcgtggaagttgaagccgacgtttgggaaagcgagtaaggcaagtcacatcatccttgaacatattgaatcccagtttataaaattattttgatttaaattattgcattatcgctttacttaaattcccgcgttatcactgttttatctagccatgcctatttacctttgttatgaccttattattgttattgttattatttccttgttcaccctagaataaacaaaaccccaactagtggacactctactcatggtaccactagtatgattttaggtagatgcttcgctggttaattaggcaacattaggtggttttacaactctagactttgggatattcatatcacctggacactatggaatggtttgattattgtggaattggattcacacctccccctctattcaaaaccctcaaaatggttttaggctgggctcggagtgcatggttttgatagtagcacctcagccatataaggaccggt

SEQ ID NO: 14107 - DNA, 1501 bp, Oryza sativa
tatcttcatcacccaagccagtggtgatggaggcctcaagagccaccatgttgacaagccagcacgccttgaggtcatcgatgaccagtggcgctaggaaaattcccccgaacaggcgaggggctccttcgtagatgcccatgtccttgagctgtgacgtgtcgttggccacaagctggatgccgatctctgcaagctcgatggcactgctagactgtggcagtgacgtgacgccttcagggaggtggaggtccgtccttccgatagggatgctcccacattggtagtaacggaggagaccgaggagatgcgctggtgtgtagctgccgttgaggacgagaggccttttaactaggtctaaccgggcctcgaatcccaaacctgctcgagcgataaaatcctccacgtccagcgctggcttgaaggacatgagggtctgaagcaccagccatgggatctggttctccatcagaaagatgtcccgcaggatgctggctagtttggagttgaaccaaccttgcaatgacggagcaactagcccacctggactgctacggatgaaaatcataaactgcagcaagaaacagccatcccggaacatcatagctgcaaagtcggcctcacagctcatacctgccgccgtgtcaccaacatagcagcttcgcacgttgcctgcaacggagaggattttctcgtaggccgcctcagccgactgcggcggatcagccccctgagccgagtccccccagtccctccagaagtagtaggcagccgctcgcttcacctcctccgcctcctgcaggtgcggtaaatcgtggtggtaagggccgatggctactgcgctcggtaccaaatatcggccttctttggtaacgccgcgcaggtttgctgggaacctgtggatcttggtcttgttctcggtgaagttagcctcaaccttttcggctgctctcttcaactcctcttcgaccggaattactactgcttctgcagtgcccatggccatgcccgtcatcgtcgtttgattggcggccaccagctgactctgctgcccgcacctaggaaatgagcgatagagggatcgccgtctatggtcgtggagctggccctgcttagagcaagtttaatagtatagtcaactcactactggaaaactgatctttgctcggtcgccccaaaaccacaatagttatggttaaaaaagaaccgggactaagtcccggtttaaaatccacagccattctacgatctttagtcccgggaataaagtgatctttagtcccggtttatatcctgtcagtcccttgtcagaggggcgggaatctttagtcccggttgatgtcacaaaccgggactaaagatcaccactttagttccggttggtaccaatcgggactaaagatctcctagatctttactcccacgcgtagtatattatccctattccctatcatcacccctacaaccggcctcaatctccttaacaaccggcctctcctct

SEQ ID NO: 14108 - DNA, 1501 bp, Oryza sativa
atatacattgtgcatgcatcctttaattttgttaggagggaagaaccctactagggcacgcccactctactagtgtagtgtgcaccccaagttagaacacaataataatgcggtagaaattagatatattatgtcgcaattataacacatattaatggattttcaactaattctgctgctaaattatgaataatggatcgacaggcagaatacatgcattgatgcatatagaacatggatctactggttgttaaaatatcatatcatcatatagggagtatttcgaagcgcttggacaatagaacatgtagccacaagaaaaatcatcagggtgagattgatattgtgttttttattaataggaaaaaacatcatttatttatctaacaaattatatgtctttgtcttaaaatataagaaattttatccatatatattttttacattccaagataaaggttatagtatatgtcagttttacataagtggaccaatactaaagaaagccaataactatctcatactacatttactctgacaacaaactcaatgtatatataatccttactattttctagctaataacaaattagcaagacattgcatgttggttgtaaagagttttgtgcatggatgtatacacttgtccattactcttatgcacaaataataaatagacatggagaatgaatattgatataacgataatttaaaaatagcataaaaatgttatatgatgatcaattgaaaataaaaatattatatgatgaccaattgaaaataaaaggagtataactcaagtgaatgggcactgcaggacaatcgtaggagtaccattcaccatgcctttcctgcataaatgcaacaaccatcaactcaaaagcagacaacaaattactgccaggtcaccccaaccccttggccccactgtcagtgactaacccccctccatcgtcctggcccactgaccccgtggccccacccaccatcttctactccctccataaaaaaaaagacaaactctggtttccgtgtccaacgattgaccgtcggtcttatttgaaaaaattattaaaaaaattaaaaaaacaaatcacgcataaaatattaatcatgttttatcattttatcatctaacaacaatgaaaatacgaattatgaaaatttttcatataagacggacagtcaaagttggacacggaaactcagggtttgtctttttttttacggacagagggagtacccatgatctgcctgtccatccggccccaccactccacaggtcagccactgtcctctctccccccgacacacctgccccgcacgtgcgctccactgacacgcgggccccatacctccccaccacgtgtccacctcccgatccgcatccgacggcgaagggaggctgctctcacggcgtgcgtgtatacgagtacgacaagcggcgtctcgagccacgtggcggtgaaggcgtattctaccggaatacgccttcgcgagc

SEQ ID NO: 14109 - DNA, 444 bp, Oryza sativa
gtcagtactcgactattggtttatcagttattactttatcaaacaggcaaaacatagccataagtgataactagcaaaatatctaggatttcagcctgaacatctggctctcctaatatagctgcaaatgatgagcacttctatcaatctatagttaacacagatttgttcttagtcaactatggctgagcttgaagggtagcttttacaagttcagagctactagatttaactccatgtatctttgtcatctgttattgtcttgtagaatcattacttcctcttgagttaatctgaatgaggaagagctctatatgctgtatcattttaccaccatgtgaaatgctatccttttgttttcttgagtgtttattttatagtgtttcctcatggtatgtttctctactgagattatagatatctaaccatttattatttgccagg

SEQ ID NO: 14110 - DNA, 1470 bp, Oryza sativa
cctgcagcccatagttttgcaggaaaatctataggaagctggaaacaacagtgcaagcttggctttctgtcgattgttgctctacgtggtaagcaacgttcatggtgtaatttatgaatgattagtactttctctgctacatattttgtcaaaatatatgtcattagattggtgtctggtgaatctattaggttgtgtgatcagtgtagataaatttgaagtgtcgactcttttctgaagtgaacagtccatgttgcagccttcagtgatccaaacttctgaatctgtgagtttcagctctcttttacttctgagcatgatgaagggtagtttggatgcttaacaagtgattgtcttgtaccaaatcatgtaatttttatgtctttggttttcaaccacctctccaacatcttaaaaaatgttggttagaaatcagatgatcttcaaaatcaacctttctaaagtaacttgggagtttagaaaaagagtaaagtgcacaggcggtccttaaacttgtagaggtgtgtcatctaagtccctaaactctcaaaatgtagatccaactcccagaacttgtcaaagtgtgccatataggtcccaaatcgcaacaactcctccaaaatcctacgtggcgctgatgtggcgtgccacacgaacgtgacgtggcatttaaaaattttccttttccttttttttcttttcttcttctctttttttttcttttattctcttctcttttctctgtgacctgagcaacccgtgtagcggtggcctatatctgcagtgagagcaagaaaaggagaagaaaggaaaaaaaagagaataaaaaagggaaatgaaaattttttaagtgggtctcatttgtcattcaatattatgccatgtcatgtctgtgtgtcattgccacatcagtgccatgtaagatcctggaggagctgtgacgatttgggacctacatgacacactttgacaagttctaggacctggatttgtattttgaggacctagataacacatccctacaagtttaaggaccggccgtgtattttactcttttaaaaacaattgaatcaatgttcctatctttggaggctagaaaaggagaaaacatgattattgaccctgtaaactatggtctcccactactgttgtatgtggttgattttatttttcaaagaatccttacgctttgattgctcaagtgaaactgatcatgcaatgggttttaaatcaatatactttgagcaacaagtataattagttgtttgattctcaacatgattctatttttctgtctatcaccattgttttatgaaatatcaccgtagcgttagcacgttcatattactagtatagtaagtcaattagtaattagtaggcatatactctctgtttcatattataagttgttttgactaatcaaactttatttaatcaagttagcatagcattttaaatacaaaacaaata

SEQ ID NO: 14111 - DNA, 1501 bp, Oryza sativa
acaactacatagtcatacagccagttagcacgctagctaggataggagcatgcatctcctgcagggcagcaaacatattgctaagcatgcatgggaggcactaggagattgttggcctgcgtctgcggtcaacatggaaggaaaaaaggaaaggggtgcacggtgtgcagcaaggtctcatcgaagagctccctcattatcgagcggtttcaattgtcgtcggctcggccttgagtgtggcggcgggtgcacaacaaaacatcagggctttccaacgtgattccatcgtccctcgacaaggacagttgcgctttcacattgaatctcagcatcgtgattcactgttggatttgtgccttagccattaaccatcaccaatgacattagcatgtattgtaaaaatcatatgtaataactgttggtacatagtagctagctctattttgaaagcttgaaagaaatgttcttaaagttctctctatccttatttttcacgttgtggtaaatcacttggttgaaaatgtgttgtccgttagatttatcaaatgtgtgttttgtttatggtcgtgggtggatgggatatgtcaatccctaatctattcgatatagcgatcaaattttctgtttgattttaatggatgggagcatccaatttatagttcggatggaaagataaaacatatatagatggataagcccaaattttatgtggcccgcttatcgtatatatgcatatttaataaagtataatcacctgacattttgtttcacagatttaataataattaatagaatagttaaaccgactcacaaattgggtaaatggtttaggagaaaaaaatcatttgcaacatgcaaacatgaaatcgtacccaccatcgtacccaacatgcatattgttaaatttctcatcatattaagtttaggtttttaagctaacttatgagtcgaatagtctaagcctaagtacacaaatagctttttcgattagactttttaaagtcataagccattcttttttttaaactataaacttaaaggcttgataccatttgcttataagacgtataagcaaaaggttagcttaaaaatacgtctaattaagaacaaacaaggtcaatgtgtttggcttaaataagtccaaccaatctcatgtaccaattatgccggaacctagctttcttcgttgtgcaaggaaaatccgtcgatgtcaaccggggtgcatgggtttggtttctatagataattgttgattgcattttcatggattctactgaacttgtcatttatccccagttcaataaatataactaattaaagaacatggccctctacatcatggatatttgtatgctataccatataacatatatatcctttcacgagcaatatataactagtaaaaatataatgtttaaattctgtggaaaaaatgtgatggggttgagaggtctctggaaagaaaaaggcacttatttggatgcttaaactgcgaacaacg

SEQ ID NO: 14112 - DNA, 326 bp, Oryza sativa
acgtaataagcaaatatatgttttaaacttgttaaaaattctaataatcatatataattagcatatgcatgatattaaattgttaaaaattctaattaacatatgtacataccacatgcatgatttaaaattaataaaaattctaataatcatatataattagcatatgcatgatttaaaattgttaaaaactctaattaacatatgtaaatgccaaatgcatgatttaaaacttttaaaattctaattatcacatattactagcatatgcacgatttaaaattgttcaaaattctaataatcatacataattaacataagccata

SEQ ID NO: 14113 - DNA, 1088 bp, Oryza sativa
cccgccgatgccgaccccgacctcgatgcggccgccaccgccgacgacgtcgcgccggcactgccgatgacgccgacgccactgctacgccgccgcgccacgccgctgggccgcgcctcgctgccgccgcgcaacgccgcagctgcgctgccacgccaccgccgcgccacgccgctgctccgctgccgccacgtgaacgaaacgtgaacataacgagaacgaacgtgaacgaacaaacgtacgtggacaaaacgtgaacttaacgagaacgcgaacgtgaacgaaacgtgaacttaacgagaacgcgaacgtgaatgaacgtgaacgaaacgtgaatgaacatgaacgaacgtgaatgaaacgttaacgaacgtgaatgaaacgtgaacggtcgccttatacgacactacgtgaaatacaatatatgttactttgcgtttagactaatacatttttttgtatgttgcagaaaagacgtcgtcatcgtcgtccctcaagccggagtggtagctagccctcgaaggaattcgcgcaggtacgtgatgtaaagatatgattgttagatttctaatataatataagactattagatttaatatacgacacttagacatagcatatatcattatctagggttctaatgtacgacacttagacatagcatatatgattatttgagttctaatatacgacacttagacttagcatatatgattgttagagttttaatataagattattagatttgtaatataggactaataatataagactattagatttaatatacaacacttagacatagcatatatgattatctagggttctaatgtacgacacttagacttagcatatatgattatttgagttctaatatacgacagttagacttagcatatatgattgttagagttttaatataagattattagatttgtaatataggactaataatataagactattagatttaatacacaacacttagacatagcatacataattatctaggactaattatataagactattagatttttaatataaaattattagagttttaatacaagattattagagttttaata

SEQ ID NO: 14114 - DNA, 1501 bp, Oryza sativa
taatttactcctggagcgccaaccacgcatttttcagatgcggcgaacgagcgataccaaccaattggcccccgcactataggagtggacctgaaatccaacaggaaatcacctttacaagacagaatcaagaactgacctcatattgggacagtgggggatgagctcctcctcgcagagccgagcccgcgcgagatccgcaagaaccgcacgcttgcagctgcggttaccttgctcggatcgagcgagcgagcgagagagagaagagctgcgactatgcgaggcaaggacgaggaaactgatgggtgatggcgttcacgagcgcgacggatgcaagggtgccatgtgttttgtttgcaagtttcctccgcttcgcctttgacttgatttttttctgttgaatctttcggtgcttaactctctctttttttcataaagatattctagttctcaaattaattatgacagtgattttcggcgttgatttcttcttcccttactttcagggtgagaaatggttgtggtcttatccgaacaggaagtatgacggaaaattcttgcatacactacctccgttttttaatatattatgtcattaatttttttataaatatttaactatttatcttatttaattttttaatataaaaaataagtcaggcttaaaaaatatttaataatatatcatgtcataataaaataaataataattatatattttttaataagatgaatggtcaaacttatctgaaaatcaagagggtagtagtcatttctatgagtaaaaaatgcttgtacaaagtgaaaaaaaactaactattaatctttcgatagatttatatcttcaaatcttgcagaacttttaaccaatagatataacccatttaaaataaaaaaaacatgtcaaaaattgtaaatctagagagaattgtaaggatctaattttgacgcaagttgaatatataagaacacaaataatgatgcaaaatccaacggacgaaaaagtgaaagacaatagccaaaaatctggcgcaagtgaaataacaaatcaaaaaaaaagaaaaaaaatggttagcgagttagcgttgaacttagaacgggcctggccaacatggctaatcgagggcccacgtacaggcctatgaacggcccacttcatgcctcgcaattcgtgcaactccccccaggtcagcacgaaaccagcagtgtccgacacatcacctcacgcaccgaacagacaggtgggcccgacgcgaggcgacccgactcgcgcaccgcgcgtgcgccacctacacggacacgtggaccccccaccgcgcgcccgtccacgtgtcatcccctctggctcgcgcgcgctgcgtggggggcaatacacccaaaccaaaccgacgcgccgccacgcgacgacacacccgccgctctcgtctcgctgctccgccgccgccgccgccgggagcctcgcctcgcagaccccactgtctcccgcgcgccatggcatcct

SEQ ID NO: 14115 - DNA, 1501 bp, Oryza sativa
caactcaccctgatttgtgctttacatagaaagaaagggaatccagagtaattttgtcatttttcaaaaaaaaagctaacactactcttgagtgacgtggatggcatagatgaacgaaaattctgtttgatggcatatacatgaactgctaatttacgatggcatataagaaaacctgtgaactttaggtggcatatgaggaattttctaaaaaaaaaagtgtaggagtacgtacctgcaccgcgtaggacagcagcgtgcagggcagtttggccggccggtcctgcatacgagagctcgtccccttgctgatgcagagcctctgcgatgtggtcgtggcccagtgagaccgccaggtacaacggcgacatcccgtcgccgccgggaagacgggcaagccggggatgcaccgaaatcagatggtcgacgagctgcttgtcgccgagcctgaccgcgtcgtgcagggccgtctcccgccggccgttctgcctctccatcacttcggccaccctgcccgcgctgccggcgagctcctcctccctggccatgtcgaggaggcacctgaccatcgccgcgttgcccgccctggcggcgcagtgcagcgtcgtgtcgcccctcgcgttggggcggtccaggaggcgcgcggcgtggctgtagatggtgcgcgcgcagcgcagggacccttcgccgtcgccggaggccgccaccacgtgtagcgcggagtctccctgtggtgtcgtcgccgcgtccaggaggagcggcgattgttgcccggagccgacgtcgatggcaacttgctggtttggcgtcgcggcggcggcggcggcggcgcccagaagtagagcctcaagcaccgcgcagtcgccgcggcctgcggctctgagcagcttgggatccatcatatcatcactaccgcgcctgatgaatcaaacttgggatttagacccgtttggtatcttgcaactacttacaattaacatttcagatgcttagtcagatgcttgccatcgacgtgctgaagcggttagcactagttgactaattaaacatggttatgcacagcactatgcactcatgcgtgtgcaaaaaaccatggacgtacgaacccgcgcgcgatcaccacctgtcttgcattgcatcccgtgtgccgagtgcgaccggaaactctttatgcggcactacctctaattttaaatgtacaatgttgctaccgttttaacgtacctagtatggtttactattcattattcaaaaaagattatataaatataagtacaaaaatgtaaaacaaacttcaaatatcttttacaattaaaatatgtcacgtcaacatcaacataaatggtactttcatgatcttttaatatgataaataataaaatgtacgtctaggagtcaaagttgcataaaaaaataaataaaaggaaaaacacgaattacccattagactatcgcagtcaaccggattaaccccaaacccgaaaaccagacatcattcgcc

SEQ ID NO: 14116 - DNA, 1501 bp, Oryza sativa
tcatgccatccgccaacaagcccctcacgggcacgggtgagattggagcttcggccgagaccgtgtaaaatatgtggtatggtatgtggcgccccctttcgaccgatgctcctggcgaaacctacattattcctgcaaatgaagtttgttacttgtgcggctagtattattttgccgcgcttcgcctcgtgcgattgatggttatatatattcttttttcctgggccgaacggaacagtattgggccttcctttcttgggctttttactgtgccgctcggtcgacgggaatttaccgtttcgcctacccttgcgacacgtggcgctttattactggtgggtaggcaaacggtcgcttgggcgggctatatattcccgttgctctttccttttcaccgccacacttgccattttaccgtgcgcgctctctttctccgtctcttcctttcacagcatctttcgacccttcaggcgtttcgccgaatctctcttttcgccaccgcaaacgcaccgttcgccatggccccacgttagccaaaccctacttcggcgaaagggccagatcctagccgagtcgatgatgacagcaccgcctttctgggggtctctcttgtggatgacgtcgagctggcgaagctggtcagctccggagcgttggttgaggggcaggctttcgccccagggaaaaccgtggtgccgaaatgtcacgaccggaaataacccaacgggcgttccttaagtgcgtgcattattccttgtcccaggaggcaaggtacaccaaaagttgatacaattcagagtttaacaagcggaagcctaattaattaattacatgggcggcgaagacccagcacacaagaagacaaacgaaaaacagcggaagactagggcgacgaccacaggcgcttgatggcaggcacgagctagacaccaaagccttcatcttccaggaactcctcttctgggtttgggaaaaattgagcaagactgagtacaaccaccgtactcaacaagacacacccacaagtgcagaataaatgcaagggagtacaagggagccataaattagggggttagggtttgcagtaaacagcattaaaagacacttagttgctcaaagctattttgtaaacacggtcctagagctatacaatattattaatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaaacactaacttgggtacattgctcggcttgcccataaccgagggcgcagctattcgaataggttatactctgatcagaggtgtacatctttacccacaagacacatcttcctcacgtgtaaccacatgccacataccaccatggtatacggacggaagacgtgacatagtttccaacccatcctagc

SEQ ID NO: 14117 - DNA, 1501 bp, Oryza sativa
tcggattcgctcggaatcatttccccctaaacctcgccagcgcatcaatggcggccggatcttccgcggccgattccccctcatccggccgctctctccccctcccaaccctatataaacactccccgtgcctccctccgccgtttccgcctctcgccgctctctctctccgccggaatcgagctcgcgccgtcgctccctctctccgccgtcaccgccgagctccggtccgccgccgtcgtcgccccggaccttctcctgcttcggcgtcgccttcttcggcttcgccgcgtcctcgccgacctcgtccacccctccgtttcgcccgccgaccgccggaacaccgccgtcctcgtcgacccgagccgcgccgccgccttcctccgctccggtcgccgttcccgtcgtcgccgtcgacccggggtgaaccgtggaccgcccatttcgtttcccccttccctcccctctcccggccgccgctccgccgtgcctatggccgccgccggcgaccataggggcgcgggcgcgccgcctccagtcggctgtgccggcgaggccgccttcgggcgcgccccgcggctgccatgtggggcccggccgtcagccgcccgcgccctcaggtgcggctgacgcgtgggacccacggcgccggccggcgtaagccgtgtacacccggtccaccgtggaccgtgaggctgccgcgtgggccccactcccgtggacccggtccgcgcgcccctcccctcggctgacgcaataaatccgatttaaaattaaaatttaaatgaagaaattcgcaaatatccatttaaagagcatataaacttcaaatggccataacttggccatttgaactcggaattggaccgttcaagtctctaatttttccttaagaagtcaagaacccatttttatgctttgtttctgctgttatgtggagtttattagagtaaaagccttttcttttccgttggtcgtgtagacgctgcagcttcggaagacccgctcttcgtggaagttgaagccgacgtttgggaaagcgagcaaggcaagtcacatcatctttgagcatattgaatcccagtttataaaattatgttgatttaaattattgcattatcgctttatttaaattcccgcgttatcactgttttatttagccatgcctatttacctttgttatgaccttattattattgttattgttattattaccttgttcaacctagaataaacaaaacctcaactagtggacactctacttatggtatccctagtatgattttaggtagatgcttcgcaatttaattaggtaacattaggtggtttttcaactatagactttgggaaatattcatatcacttggacactatggaatggtttggttactgtggaattggcttcacaccgctccttctattcaaaatccccaaaatggttttaggctgggctcggggtgcatggttttgatagtagcacctcggccatataaggaccggt

SEQ ID NO: 14118 - DNA, 1471 bp, Oryza sativa
tggagcccgagatcgccgcgccgatttccttcccctccggccgccctctctcactcccaaccctatttaaacgctccccatgcctccctcctccgtttccgccactcgccgctttctctccccgtcggaatcgagcccgcgccgtcgtcctctctctccgccgtcgccgccgagctccggttcgccgccgtcgtcgccccggacctcctcccgcttcggcatcgcctccttcggcttcgccgcgttctcgtcgacctcgtccactcctccgtttcgcccgccgaccgccggagcaccgccgtcctcgtcgacctgagccgcgccgccgcctctctccgcttcggtcgccgttcccgtcgtcgccgtcgacccggggtgagccgaggaccgccatttcgtttcccccttccctcccctctctcggccgccgctccgccgtgcctatggccgccgccggcgaccataggggcgcgggcgcgccgcctcccgtcggccgtgccggcgaggcccccttccggcgcgccccgcggctgccaggtggggcccggccgtcagccgcccgcgccctcgggtgcggctgacgcgtgggacccacggcgccggccggcgcaagccgcgtgcacccggtccaccgtggaccgtgaggctgccgcgtgggccccactcccgtggacccggtccgcgcgccctctctcccggctgacgcaataaatccgattttttaattaaaatttaaatgaagaaattcgcaaatatccatttaaagagcatataaacttcaaatggccataacttgaccatttgaactcggaattggaccgttcaagtctctaattttttcttaagaagtcaagaacccatttttgtgctttgtttctgctgttatatggagtttattagagtaaaagccttttcttttccgttggtcgtgtagacgctgcagcttcggaagatccgctcttcgtagaagttgaagccgacggcaagtcaagtcaagtcaagtcaagatccgctcttcgtagaagttgaagcgagcaaggcaagtcacatcatccttgaacatattgagtcccagtttataaaattattttgatttaaattattgcattatcgctttatttaaattcccgcgttatcactgttttatttagccatgcctaattacctttgttatgaccttattattattgttattgttattattaccttgttcaccctagaataaacaaaaccccaactagtggacactctactcatggtatcactagtatgattttaggtagatgcttcgctattttaattaggtaactttaggtggtttttcaactctagactttgggaatattcatatcacctggacactttggaattgttggtttattgtggaattggattcacaccgccccctctattcaaaatccccaaaatggttttaggctgggctcggggtgcatggttttgatagtagcac

SEQ ID NO: 14119 - DNA, 1501 bp, Oryza sativa
gatccttggcatcatcgttctttcgccggttgcacggtgagacgatcgttcgcaatattcttcttgctggaaattggacactggacactggcactgcaatttgtgatttggttgtatcagcgagatattttaggctatcttagggcctgtttagttggtgaaatgaaaattttcggatgtcacatcggacgtttgaccggatgtcgaaaggggtttttggacacgaataaaaaaactaatttcatgactcgcctgaaaaccgtgaaacgaatctcttaagcctaattaatccgtcattagaacatgtgggttactgtagcacgtatggctaatcatggcctaattaaacttaaaagattcgtctcgcgatttacatgcaaactgtgcaattagtttttctttttatctatatttaatgtttaatatatatattcaaagattcgacgtgatgtttttaaggaactaaacatgcccttagcctattacttcactgatttgtgcatgtgcagctgattcaaatgtctaccatttgtcgtccagccgaaccctgctagtatggacctccccgggatatttagggcccatcctagtagggactcggtccatccataaaatggtccgtgctctagaaatcactgttgccaaatcagctgatcggtctgcaactgcgctacgataattcagtctccacatggccccacatgtcagccctaaggattagagcatgtacaatagcagactattagctagctacaaacatattttaatgagataaatgatgagagagaagagcagcgtgctataaaactatagccagctgcagcacagactctaagacacaatatatataggataggtgggaccatgtattaataatatagtaagtaattattgtatgaattggatattagattggctatagatgaattggagttagtagtgggctatactattaaacttgctcttaggctgtgtttagtttcacgccaaaattagaaatttgaagaaattaaaacgatgcgatagaaaagtcgaaaatttatgtgtgtaaaaaagttcaatataaaagacaagtttgaagtttgaagaaaaaaaattggaaactaaacgggcccttacacgcccacgcgcccccacaagccgaaaccgcctcaacccaacgtccccaccgcaacctcccccacatgtcagcgtacgtggactggggtccccgtctcaataaacccccgcgcccacgcccacctcgcctcctccgaccaatccgcgcctctgccagcttgtcgcgacgcgcgctcccccgccttcctatttcacccccctcctccgcctccgcgccactccaacccaatcccagccatcaatacctgcctccgcttcgccatctctcccgaagcctcctctctctctctctctccccccgattccaccacacgcaatccaattccaacctcgtgtgcttccacttgtgcgtttcgcccgctgctgtgaacgtactgcgaga

SEQ ID NO: 14120 - DNA, 1501 bp, Oryza sativa
aatagagtagtaacagtaaaatagttgtatgaaaggaacataaatgaataagtacatgcaaaaatgcctaaattagctaatgaagcaatacagtttaccatcttgaatgaatgaagaacatactaagaagatgaatgaacgaatccatcttatcctatccatagatcatatagattagtagagtaatactagtaagtataagagagtttgtacttccgaaggtgtcgttggccatgcagaggaaggtgaggccatcggcggcggcggggggaggggagcggaggacgtggaagatgtagcggtcctgcgcgaagcagaggcgcgactcggcgtcgggcggaagcttctcgaggatgcggcgggcgacggcgccggcgttcccggagacggcagagaactcggcgagaaccacggtgccacgcgccaccaccgcgtaaacgatcgccatggattctagatccaacaacttaggcttggatagttgaattgatctgattgatttggggttggggttgggcggcgagctcggcggccggcgcgggatgcgagcttggcggcggcggcgagcccggaggctggagggttccgccgccccgacgaggtcgtccttgtaaccggcaagcgaggagacggggcggcgaccggcgagcaacgagattcgatggatggattaggggggtttggatcgagatttttcagaatttgccacttcaggatatgccatccaattcgtactattttcagaatatgccactgggatgcgaattttcttcgttatgtaccactccgtccactgacgtcactcctcgtcctcgtctgtccgtctgccgccccgtctatccgccgacgccgccgctcgtgtccccgtccatccgttggcgccaccaccgcgtccccgtcaatccgccaccggtcgtgtcagtcgcgtcgtccatccgtccgcgttcccgtccatccaccggtgtcgccggtcgtgtcagccacgccgtccgtccatccgccgccgcagcaacatcctgctcaaagtcgcggtggtcgaggatcttgcggcggaggtcgtaatcgagcgagtcgaggaggccgacccagctatcctccccgtggattcggcgaagagctgccgagtccgactgtcgccgtcggtggcaccggtggacgggtgtcacaccctaaaaattcaaaaaaaatataaattgttgtttaaatggaatttctagaatttattttaaaagtcttgaaaagaaaatctaagtttaataataaattccaatataaaatggggccagataaaatttcattaaatactttgcttaattctataattcctagatttttctgggatttatttgagctaaggaagtatttttaataaatagaattgcatttaagaaataatttaaattgaaaaagttttaaaaagttctcttttgggctttgggccgaaagttggcccaaaaccttctctctctctccccggcccaagtcggcccagttcgcagcc

SEQ ID NO: 14121 - DNA, 1501 bp, Oryza sativa
tggcgacggctggaacgacggcggcgcacggctggagcggcggcgaagctagggcacacggcgctagggcgactccggcgacgagaggcgaaggcgagggtggcggcgggtagaggagaccacggggaaccttttaaaggggctcggaggcgaaggcgaaggcccacggcgaccggcgacgaggaaggaaggttcgggaaagacgaatccgagacgaactcgaatccctcgatttccaaaccgatttagccaaagattccaaaggagaaaaggtagaggagatcccgaggatcatttcctctctattgatttggccggagaaggaaaggggcggccagattggaaggaaacagcggcggtggctcggcggcggcgcgctagggtttcggcccgaggaagacgacgggcctgacaggtgggacccacctgtcagcgaccgaacgcgcgcgcgcgggcggctgcgaactgggccgacttgggccggggagagagagagaaggttttgggccaactttcggcccaaagcccaaaagagaactttttaaaactttttcaatttaaattatttcttaaatgcaattctatttattaaaaatacttccttagctcaaataaatcccagaaaaatctaggaattatagaattaagcaaagtatttaatgaaattttatctggccccattttatattggaatttattattaaacttagattttcttttcaagacttttaaaataaattctagaaattccatttaaacaacaatttatattttttttgaatttttagggtgtgacacccgtccaccggtgccaccgacggcgacagtcggactcggcagctcttcgccgaatccacggggaggatagctgggtcggcctcctcgactcgctcgattacgacctccgccgcaagatcctcgaccaccgcgactttgagcaggatgttgctgcggcggcggatggacggacggcgtggctgacacgaccggcgacaccggtggatggacgggaacgcggacggatggacgacgcgactgacacgaccggtggcggattgacggggacgcggtggtggcgccaacggatggacggggacacgagcggcggcgtcggcggatagacggggcggcagacggacagacgaggacgaggagtgacgtcagtggacggagtggtacataacgaagaaaattcgcatcccagtggcatattctgaaaatagtacgaattggatggcatatcctgaagtggcaaattctgaaaaatctcgatccaaacccccctaatccatccatcgaatctcgttgctcgccggtcgccgccccgtctcctcgcttgccggttacaaggacgacctcgtcggggcggcggaaccctccagcctccgggctcgccgccgccgccaagctcgcatcccgcgccggccgccgagctcgccgcccaaccccaaccccaaatcaatcagatcaattcaactatccaagcctaagttgttggatc

SEQ ID NO: 14122 - DNA, 1501 bp, Oryza sativa
gctttatcttttgtatagcgtgattcattatagtgcgccagactgtgaaacggcgagaagtccgtgggggtcgctggggagtccatgccttgtttataagggggtgattatgatccaggaaaggtgcgctgtaatgggttatgttgtgcaaggggtattgtcacgactcctttccgaggtaccgtggtggtattgaggcacatggtgacatgatgtggggttgtgtcttgtgggtacagtggtacacctctgatcagagtttaatctattcgaatagccgtacctgcggttatgggtgagttgagcaatgtttttcgtgattagtctcacactactcatcaatggtaatgatatgataattaatttaattcctggtttggaatggttaattcctgatttggaggtttcatttgttcaactggggttggttgttcaaatgtggttgggcctatgcaacacgggtgtgttgtatggtgtttatttaatattggttaattattcaactgttttactattctcttaaatatttgttaaatgctgttttctgcaaatgagctgttttatgccatcctttgttatcctgtgcacttgcatatttgctgtgtggcttgttgagtatgttatatgctcattcttgcaatattcattcatcagaagaggagtatttcagtgaaggtgaagatcaggaggattaggcttgttctcggttaagatgcctgtggagtggagtcgccatagctgttccgtagtttgttatagttttgttttccgctgcgtagaatgttatttgttttgagaggaactatctacctctgtaataattttaatttttcgaatattcgatagttaattatttgtactctattatcaatattgtcattgtgtgcctcggttgattcctggacgagggtttaacacacatgtaagcgtttggaattttggatagaaattccgggcgtgacaagttggtatcagagccaccttgaccttaggataagccaatggtaaaccttaagtagccttcaaaatattttgaaaaatatagaactgctcttctctattcttttataaattatttaagttggcagcacatgcaaggttatgcacaaaatttatttaattcaatttcttttcttttaaaaacaaaaagttgttcttttcaaaatgtttcttttctctttaccaaatcctattgattagtcggcactgtacatttattagggtatcgatttaatcatgttagcactagtactactcatctttcctatggtgatactgtaccgggcttataatagatcataattattatagttttattttaattatttgtcaaaaatatatttgtctctgtccaaaaagtaaaattctaaaaacatatttatataatagcttggtatgcgtcttatcttttattttcttcctttttggtcaaaatcagttaagtctagttggtgcagctaacttaaaatatgctttaattcctcttctatgtctctttaga

SEQ ID NO: 14123 - DNA, 1501 bp, Oryza sativa
actatttagaagagcggagaaggtgcgcggccctgcgagcggtgcgctaccagcaaagcctgtggcgctaccatcacgccacgtccgggcccgatcactgcaagtcggcgatctcgtcttgcgccgcgtacagtcgcgcttggggctgagcaagctctcatcaatgtgggaagggccatacaaagtgatcggcgttccccagctgggctccgttcggctaaccacggaggacggcacggcgttgcctaacccctagaatatcaaacacctccgccgtttctatccatagagtcgcgcgtcttttgctttcttggaactcaggccaagccccacgctaccactgttaaatatgttgtatcttttgtcacgaccagaattaacccaacgggcgttccttacgtgcgtgtattattccttgtcccaggaggcaaggtacaccaaaagttgatacatttcagagtttatcaagcggaagcgtaaatagttaatttattacatgggcggcgaaggcccagcacacacaaagacaaacgggaaacagcagaagactagggcgacgaccacaggcgcttgacggcaggcacgagctagacaccaaagccttcatcttccaggggctcctcttctgggtttgggaaaaattgagcaagactgagtacaaccaccgtactcaacaagacacacccacaagtgcaggataaatgcaagggagtacaagggggttataatataaagggttagggtttgcagcaaacagcattaaaagacacttagttgctcaaagctattttgtaaacacgattccagagctatacaatattattaatcaaggccgtgaacccacatgaaccagccttaacccaaggcctacgatgattcagaccgaactggcgacccgaccatgggtcccagctcgtcccaagccaacccaggccaaccattccatattttaattgttaagcaagttttaagaattaaaacactaacttgggtacattgctcggcttgcccataactgagggcgcggctattcgaatagattatactctgatcagaggtgtacatctgtcacgcccggaatttctatccaaaattccaaacgcttacatgtgtgtgaaccctcgtcgaggaatcagccgaggcacacaataacaaattgataatagagtacaattattactctaattaataagcgaataaaatgtcattacagaggtagatagtttctctcaaacaataaagatctaagcagcggaaaaaaaagataaacggcgcagacggctccactccacaggcagcttgaccaaggctacacctaatcctccacacctcagcctcattgaagaactcctcctctgatgaatgattgcaaggtgagtatatgacatactcagcaagccacgcagcaaatatgcaagtgcacaggataacaaaggatggcatagtagggtttcatttgcaaaagcagcatttagcaaacatttcagaatttaataaacca

SEQ ID NO: 14124 - DNA, 1150 bp, Oryza sativa
aaccagtataattcttgtcttttgattactcgatgtcgtactacgtagatccttgtaccagcgtaccccaataccctctatatccggtctacgggtatcacccgtcgacaatcgtaatcaaaaaggtgcatcgaaacgttatcggaagggaaaaaaagatacatttttgaactaaacaaactatcagaccagcaaataaatgatccacccacacagtacatttagattaattaggtgcatgcatgtttaggaacagcccatgcaatacaccacagaccacacttttttgctaatattaaagcacaaactaacaaagtcagcagtactactccatccgtcccaaaaaaagacaaaccctaattttcgtgcccaatatttgacgtccgtcttatttaaaaaaattatgaaaaaaattaaaaagacaagtcacgcacaaagtgttaatcatgttttatcatctaacaacaataaaaatacgaattataaaaaaatttcatataagacggacagtcaaagttggacacgcaaacccagggtttgtctttttttttttttgaaggagggagtacttgtcaaacttggcccatctgggggtaagagccgcgcctatttagcatgccacagttccgatcgtgcggtaggaactagtagccctcgtccccacagtatcgtcgacatgagttcttgaggatataggtcccatatgttagtgggcccatgtttcttttgtgtgaatgactaatgggtcccatgcatattttttaattctaccgccacgtaggtgctacgtcaacgctacgtggaccgaaaactcggtcaatattgccacgtaggcaccgcacggcgccacatcagcaaaaccgcctcccaaaacggtccagggagtcaaatgcaccggttttaggagtttgggggtcgagatatccgattttgtaatttaaggtcgtggacatttgagggtcataaagtgaacttattcccgctgcaaaccccaacacactgatgggcccaaggcccatgagtctccccgctcgggctgaaaccctagcccctctcactatataaacccccggcgccgcacgcggccaacccttgcacccccctcaccacacactccacacaggtaagaagccggcggcggcggcggcga

SEQ ID NO: 14125 - DNA, 1501 bp, Oryza sativa
gcccggcccggctcaactgatcgtcctttcaagcttcaagtattttcaaattttcaattcattagcttgaaatcttatatttatttccccccattctattctcatggccctgaaacgcccgcgtattgcgcatttgtttgctccctcggtggtaagagcacaacctctctcccatctacatgaacgattctttgctaagtgtgggggctaaattttctagccttatcctagccttaagttgagccccgggtgccatcgacgcccgggaccccatgtgctggctcttccgtagcggctggctttggtcccaccggctggctacggtactcggcctggctcaactgtggacagggattgctggctctagagttttcggctctcacactcgtgcgaaagtaatcgtccatgtagaaggaaaagagattggaaggaggccactgaaaggaaagagcaaacagaatgtgtagcgtggggacacaggctcgtgggaacctgacctcgtttgctaagtggtcacatgtttcccaagatggttcggaacccatggtgggaggccctcttcgagctaaaggtttgtgtttgcttcattcatacatgcaattctttgctataagtgtgggggttatgattccaagctctatcctagccctgcgtcgagctctgggtaccgtcgacgcccggggccccctgtgctagctcttccgtagcggctggctttggccccgtcggctggttacgacgctcagcttcgcttgatcgcaggcgaagattgccggctatagaaagttcagtcctcacactcacgcgaagataatcgtttgcataaaattattattgcttatatttatctctcgcccatctcttcctcgcggtcctgcggtacctatgtgtcgcgcgccggcttgactcccttggtaacaaaaagtttgtattcgcttcatccattcaaacgattctttgcttaaagtgcgggggctacgattcctagctctatcctagccctgcgtcgagctctgggtaccgtcgacgcccggggccccctgtgctagctcttctgtagcggctggctttggccccgctggctggctacggcgcccagcttagcttgatcgcgggtgaagattgctggctatggaaagttcaatcctcacactcacgaaaataatcatttgagtagatgaagtagaacatgaacagaggttaacaaatggcaggggcaagcgaggtacgtggcgtaaggtcacgggcccgagagaatataacaacgtttgctaaatatatacagaaaataagttcatagcctaaggtacgggctagcgagtcgccctcaggctggggcgaaaaaggcgcatgggtcctagtgccagcaaagaaagaataagagatcgggcccacatatcatcagactaggaaagtggcgtcaaccctgaccacctggggaaggttttggtcagggctaacgccaggggctactgtcggtgatatgagcccgatagtatca

SEQ ID NO: 14126 - DNA, 462 bp, Oryza sativa
acaatttggtgtgacagtgtgcacatgttcgtgcaggccgcagctgatcgatgcgtgtacgtgcatgtacagctcctcctttgcagtaatccagtgcgtcgatgcagaaatttcaagctcgccattatgagctttcttgacttgtatgaaaaacatatctgatcatctcctctcaatgctctcactatatataaagcttgttagcctttttcctttttgtccatggaaaaaatggttcccaactttccaccgatcgcttagcttagctagctagctttagtggcttgtctcgatcgatcatctattcatcttattgtcgatcagagaccaaccatttcggcatatcgttcgatctatcgcctaactttgctgctagctagccatatatatttggatttatattgttgtcaaatactatatcagattgatcgatcggtgatcggtctatgccgttgctgccga

SEQ ID NO: 14127 - DNA, 1501 bp, Oryza sativa
gcaaggccggctacccgggcgcgtcggagtgagcccccaggcctccgccaatcttaatagcttttccttcttcttccgaggcattcgggcccccttcttgttataggctgatttaatctacaatcaaataaagaggaaatttttgtgtcaatttcatttgttctgtgtatgagacgaggatggtctgtgccacggtccttctgtgtcttggcttgaacaagggctcgtgcccaggtcccagcctcaaacggcgcgggtcaaggctagtgcctggggagatccacatgtcgagactggccaggccgggagcgtggtgaccgagggttatgggtgacccgattgtgggtttttgccgattcccccccggagttcaccacgccccggggcacggctcggttctgggccccgtttggcgattttagcctgacccgagcccccgagggtaggattgagcacgagtgacctatttcaagtcaagattcttcaaaaggaaacaaaagcacagacacagcctttaggaaatcgaaaatgcttttattgaaatacggaagagaaaaaagataagcccccggccaaccctgcacgcccgggggggtgcggggttggcccgagcccaagacctgacacccgatccccttttaggggtagaagcgacgaaggtgttcgatgttccacgggttaggcagctctgtgccgtcgcccgtggccagccgaacggagcccggccgggggacgccgatcactcgatacggaccctcccacattggtgagagcttgctcaatccagcacgcgtttggacgcggcgtaggacgaggtcgtcgacgcagagtgatcgggcccggacgtggcgctgatggtagcgccgcaggctctgctggtagcgcgcggctcgaagggccgcgcgccaccttcgctcttccaagtagccgaggtcagggagcgtcggcttccttctttttgtcgctcgcaggcctcccctttcgggtggccagcgaaacgccttcgacggcgaggacatgaccctcgtcgtcggaatgggccgacctcttcttcctcctcctgtcctgccgccctgaccgagcggcggacccgggggcggccgaagctgccacaccggaaccggaggggttccaagtccaggcctcctccttgcgagccactcggtccgcgagctgaaaaagctccgcggtagtctggggctctttggaggcgatcttttcgagcatgcggttgtgccgcacaccccccctgaacgcgtagatcaccgcgtgtgcagggatgcatggtatggtgttgcggacttgacagaaccgctgaatgtacgagcgaagtgactcatcatcccttcgctgtactacgtgcaagtccgcttcctcacctgggcgcggatatgtgccttgaaagttcatggtgaactgttggcacaaatcctcccaagagtggacagatgcgggtggcaagttcattagccaaccccgcgcctgtcctctcagggccatg

SEQ ID NO: 14128 - DNA, 1501 bp, Oryza sativa
aaatctcatctcaggtaacaaatcgatcgagcaggtcaaattaatcagaaggaattaattattgagaccggggagcaatgcatgaacgattggacgacgaggtcgacagccaccgatcggaacgaacctgcgcctgcgcggcgacggcccaagcccattatcagtttctgctgcttcggcccattagcacagcccaagcccctctcaatccaaccaacgacacgacatcatcgatcatgactagcgcgtttccttgcggatacggcggaggcgctgccggacgacgtggtcgtcgacgagatccaccgtgcaccaccgtccgcatcaaacggctcggcgacgaaagctcggaggagcagccggcttcctcatgcgccgcgggccgcggccgtgtcgttcgtctcgttgcggtcgcgatccatgatctccgtcgttggcttttgggacggcgtcggcctcgtcacggcctctcgtggccgccttcgacatggcacgggaggagttccggctgatggagacccctgagcaatgggcggcggcgtgcaggcccacgagctcggctgcgcgcgtagtgagaaggatacactgcacatcacccgacatcgcggcaagctgtgcgccctcgccgacgagcagctggcggccggcgccaccgacgcgttcgggggtgtgggtgctcgaggactactccgacccaagaagcagctggcggctccggtggaagatcgattactcttgcggcgccgccggtgtcctcggtggaccagatggtgcttgattctttcgcgcccgcttctcgacagctgctgtggtggaggtgctacccggccgatggcatcgatggcggcgaggagatcctgctccagctcgtttgctgagagcaaatagttataacggctaaattgtacatgagagcaaatagttagaactcttcccaaacagctatagcgggagatagcgcagtaatagcgggagttttaaaaccctggtgtttaggcgtccggttttaattagctcgtttgctgataggtttggtgtttcggatccctcttttcccaacactcccaacttgttttccgcttgtacgtttttcaaactgctaaacggtgcgttttttgtaaaaagtttttatatgaaagttgcttataaaaatcatatcgatctattttttaaaaataatttactaatacttaattaatcacacgctaatgaactgctctatttttcgtacgcactattcctgttcggaacacctcctagcgaacacacagctcggtgttgtcgtttatcagtctaactctaatcgaatcgacgtactataccttgctgctgcagtgctgcttcggcccatcaaactgatgacagcccatgcaagccccaagtccccccacactggttcgtacaatatactacgagatttgcaacctaattaagctaactatagcggtttttcctcccggtgccaatggactacgacgatcgggaacggcggcgcgggaga

SEQ ID NO: 14129 - DNA, 1501 bp, Oryza sativa
agccattggatccctctcatgtttgatacataatcatccatatgtcatgtagaattgtagtttcacatcaattactataaaacaaatattgttcatttagatattacgtgtacatgatttacaaattatttttttcgagttatctttgaaatattttcaaattttctgctgcaacacgcggggtatccactagttataactataaagatcctttcatccacaatcgttagttgattttgattttgaagtcctcattgcataatccaaacttggtttttccctagttatgcacgttaaaaagtatgaaattgttctgcagcagtaatataagtttgaagttttacatatgaaactatagccaaggatgatgggagcatgtgcatttaagagaacactaaccacaagctttcttatactcaattgtgtcagagatattgggagtaagcatatgtatcttagttccacaattccaacttgtttacatttaatattttaagaattttatggttcaatggttgatctactagttatgacttatatcttagttctacaattccaacttgtttacatttaacatttgaagaattccatggttctgtggtcgatctattagttatgacttgcaaaatatggagtgaatgtgccaggagaattatttagacacattgtcaagtttcttcatcaacagaaaataggaacacttgtctgtctgtgacaccatagaatgttaccaggaactccttacttgcttgttaggttggtttgtttcatttttgttatgtcattttatttctatattgtttgacagataattagtggggccaatccctttgaaggccttgtttgcatgggcctcaatctggccctacccatgtacaggccgatggattgaactaaaaccctggcccatacaagtggatgggcctggatttcggcccatcaaacagcttgaattgggtgcaatacctatccttgtagtggttcatgtaatggaccaaaaaagtcttaagagtcccaagtctctgatgaacttctctcctttaggttagctgttctagatcccttctcctaattgacacccttgttcacatagtcccaatgaatgtttatgcaattgtgaactataatttgcattaagaaccagctctgttttacagtttgccatgaagaaactacaaaaataatatctacgtgttatttgtcagacattagaatgaaaatgtaacaacacaagtttttttgttatgaaaattatgccatgctatcggtaattataacaggtacatgcatctactttttatttgtatttaataattttagactttatggtgcagcattctgttggtcttgcagctaaataaaagttacaaagtattggttggagtcaaacatattagcattttcagtgtatccatttattgatggttacaatccacagctatctgatataaattttattagacatttctgtacttttctgagtttctactcctgagtcctg

SEQ ID NO: 14130 - DNA, 1501 bp, Oryza sativa
cgaggaaaccgagtcgttctcgttcgcgacgttgcggtgaacctcttcttcttcttccatgccgccggcggcgcctcctttgccggcggagatggccggggttctgtgttgcccacacttgccggcagagacggcaggggcggcgtggctcccttctcccgtggtggcggtgacggccgccggggtgtcggcggcggcggcggcggcggtgagctggcggtcggcggcggcaatgcgagtccatatccggccgaactgcgcgacgtttgggcgagggtttgcttgcaatgctgccatgaggttttctgccctagcccaacggccattgccggcgccacgggcatggccggtgccgggagcggcacgagccgccatacgggcggcaggacgtctcccgccgtggcggggagcggcggcgccgccagcgatgaggccgccggggcggagtgagagttcagtagacggcgccatggcagcaggtaggccctgtggtaaggtggcggtagagctcgtgccgatgtcggcggtggcggcgccgcccggcggccgcgggaggaaggccgtcgctgatcttgccggtgccggctgctgtctcgtcgccacggtgcggcgcccaccggatcgtaacggaggcggcacgtacagttggacggtccgcgccgccgccgccgccgccggcgcgtcatcatcatcatcgatgacgatgggttgggccctgctcccggcggcgccggcggcgagggaagacgtcgatcctacgcgatccatcggcggcgcgaagctgctccagtcgtcgtcgcccagctccatcagctgcgacacgtacaggtcacgcgcgaacgcctcgtcgacggcgacatcggcggcggcggcggcggcggcgtggtggctgctcgatgctcctcctccagtcgcagcagggtggggttttcctccttccatggcgaattggcgcgatcgatcgacttcgattctctcagagattttctagggtattagggagtcgatcgatcgatcgatcttgaatttcttgacctgcatgagaagaaagaagatgcgaattagggggggatttcttgtttctactcagaaaattaatgtacagatccgaggctgactgtactatctgaatttctatgtgttcagctcataaattgtactattggcgcctatatatatatgctgaataacaggaggtagatcaaagtttattcgggagtagaattgcatatatttccaaaaacacgtgtgcatgcgacttcatcggttaatattgatgaatatatactactcttgctttttgttcaaatattgttgtattttgttctcacttatattaagcaaaatcggcccttgtacaaatggtgtgcacataaataatctgataaaaatgataaacccacaaatacaatgaaatagatcgggatgtggatttagagtggttcctacatattatacacatagttttgcaaatatgtaaatatgcaaatagttgtcttgc

SEQ ID NO: 14131 - DNA, 1501 bp, Oryza sativa
gaggatgccggtgccggtgactcggcggatgcggcggcggaggaggaggaggacgccgacgaccaccgggagaagcagggcacacaccgtcgatgcggcggtggaggaggaggacaccggccaccgtgctcacccgcctgccgccaccggcgctccgcgcctttgctccactctgcttcgccggccgctgctcagcaccgctcgccgccgcctgttccgttctaccccccacgctgacccagccgccacttagaacaaaaccggtgtcaaaaccatcaaagacctcgggtgaccggtcttgtatagttaaggaatctgcatatctgattttgcggtttgaggccgttttttatcccgctaacaagttgagggaccttcggtacactttttccgctgcaagcccactaccaaagtcccaactacgcgcaggcctgacacaaaggaggcccactgggcttcacttccagtcacaatgacgtggccagccgcgccaccaccgacaccgcctaaaaatctgcccgcgtccaggtggcacctgccacgtttcaacccccacccacagaggcgaagcgccacgtcaggatacgagaagcgccacgccgccacgcacccaaaaatataatactacgagaagtacaatataataatttagccctgtttagatcttatcttaaagctttacatcctatcacatcgaacgtttaaacccctatactccctctgttccaaaataaatcaacttctagattttaaatttatctcaaaataaatcaactcttaacttcctacctaccatcggtccgtagatcgagaaattttattccttcaatacccattacttaaccatagaccaatataacttatctactaattagggatattttggtccattatccttctccctaattctacctggggaagctagggtttgatttattgggggacggagggagtataaagtattaaatataaactaaaaaataactaattgcacatattgcgactaatttgcgagacgaatcttttaaacctaattgctctataatttgataatgtggcagtaaatatttgctaatgataggttaattaggcttaataaatttgtctctatgtctctattaacgtattttgtaattagtttttttattaatgtccgaatatacgacgccctttataatatccaaccgccgaggaaataaaatcggcaccatttccttctcgtcctcttccgagtttccgacccggcgcctgccgcgtcgctcaccctccaccagaaataaaggcaggaggcggaagcaaaagcacgcatgcgcgcgcgccgcctccacctgctctctgctcgatcgccccgctccgctgcgacgtccgcaccaagcaacaaccgcgcgacgcctgcgcttccccctccccctcctcgtcgtcttcctacttagcccaatccccaagccggaattcctcgggggtttggttcacgcggcgcggccggggagtgggaggggca

SEQ ID NO: 14132 - DNA, 817 bp, Oryza sativa
accagatccgcataaatcggaataaataaataaagaaaatgaaaactaggatttatgatgcactggtaaataggtgatgaaatgcaatggtaaaaagggactgtccaggcatcactatggtgaattttttttttagttacactcaaatttcttgccgtacgatggagaaacgtgcacgatctccctatcccgaacgagaccctccccgatcgcctcctgcacagtgcgtgcggaactataagtttgtaacccatcattattgcgtgctcgttttgttttgagaaaaagccccgtagatttgcaggttcgatttactgagcccagattgcattggcccacattgcaggaacaaactggacctagatttgtagggaaataagttcacttggactcccatagctagtgaccgaatctgattcgtatctctgaaccacaataccggatatctcgatcactcaattatcaaaacaggtgcaatttgactccctcgacggttttggaacgcagtttcactgatgtgccatctacgtggcggtgttgacttggttttcatcatacgtggcgcttaggtggtattagaattaaaaaatatatgtggaacctatttttcattcaaaaaaagtattgtgggacccacatatcccatatgtcagcctcgctctttaaccccccctctctctctctctctcttccccttgagccgtggcgacaacagagtggtggcggcgggcactggagcggtggcggcggttggcgggcgagggaattgcagcagcgagcggtggcctgcttatcgtcgtgccattggactgaaagg

SEQ ID NO: 14133 - DNA, 625 bp, Oryza sativa
aaccaaccgggactaaagatcccgggggggcctgacatgacctgacagcattcgaaccgggactaaagatgatctttagtcccggttggtaacacaaaccgggattaaagatcaaatatgcccgttacccttttgaaccgggactaaagatcatctttagccccggtttttattgcatccgggactattgtggaaatcggccgaccgacgaaagatggtttctccaccagtgcacaaacgaatagacggacgatgacgctcttggcctcttgggctctcggcttctcgggtcgccacgcgttagggttgggcgacgtcagaaggaataagttcacttcgtgaccctcaaaagtgatcgaaatctaatccgtgaccctaaaccacaaaatcggatatctcgacccccaactcttaaaaccgatacaatttgactccctcggtggtttcggagggcgatttcgctgacgtggcacctacgtggcagtattgactcggtcttttgtccacgtggcgtttgcgtggcacttaggtggtattagaaataaaaaatatgtgggacccatttatcattcaccaaaagtatgggtgggtcccactgacacgtggggctcatataaatcatatc

SEQ ID NO: 14134 - DNA, 1501 bp, Oryza sativa; identical to SEQ ID NO: 13654

SEQ ID NO: 14135 - DNA, 1501 bp, Oryza sativa
atcatccattcagctgaaaaagagtgatatattactgtgttattaatccttttcaggactcaagattacctgcaactgcaatagatagaagtcttggactggtcgcatggagtaccacattatatattatccatgaaccaaccaaacactggaataaatagttctcgtatttgaacacgaaataacttaatctaatcaactactccctccggttccatattaattgacgttttggacaagattgaggtcaaacttttataatttgatcatcaataactttaaaaatatttaatttaaaggaactagaacaacatatatatatttatattttaaagcactataataaaagtaaacatgcatttatttattatatatattatagtagaaaaataaggtcaaagatatatcttgtagaccatgttattgtccaaaacgtcgattaaaatgaaaccggagggagtagtcaatgcgttgtatcatttgttttgctacacgggcgctactgcttcaaatcaacaatcctgcttgagagacgagctagtgtctgcatgatgagcctaggggtcaggaaacaaatgagactacgaccatgtaacagtcaacatttttcagctattaattaggctcgttagtttgatgttgtcgctcaacgtagcatccttgaatttgatcatcagtgtacttgaacaagagtgggacattttctagtccaaccttgtaatatttcagtccatactttcctgtatctgacaacacatttttttcttggtattggctgtgtttagttccacgccaaaattaaaagtttaaagaaattgaaatgatgtgacggaaaagttagaagtttgtgtatttagaaaagttcgatgtaacggaaaagttgaaagtttgaagaaaaaaattggaatctaaacaaggccactattggcaagttcaaacagtggctttccaagaagacatcttccagtattgatctccacaatctgcatgctaatcaatcatctgtcaaggattagtaacatatgttgtgatgaacagaactgcctgcctacgtgccgccggtagctcaagtcgataggcaagtaggtaaccgtgcacactcgcttcagaaaatgtgaaaagtgactctgaagccagaacttaaagtcaattttgtacaccaattcttctcctccctcccatgtgaagtcaattttggcgtatactccactatatatgtattatactcataaaagactatatctgcctgcaacagcacaaaagcttgacaaattcccttctgggctaacaaaacgagtaatatgtattttcggtcaaacaatccacgctccactcaaatcaactccatcacacaccgctgctatatatgcaacctgcacctgctgccttgcactcatcacaaacaagaaccaactcgatctcagcatcaacccacatcaaacattccacacaacatataattcgtgtctctctgcttcatcacacattctatcgatctcaa

SEQ ID NO: 14136 - DNA, 1501 bp, Oryza sativa
gtttgatgcagcaccacattaaagtgttcccacttccaactgcactcaacaatgcaggtgtatttccccattcgattcaaaactttgtgcgtttgcaactgtttgccaggtgtgggcctagttagggcccaggagcaaaggcccacgaagaataatcggtgtggaccgcaaaaggcccgatccaatggcatacaaaacgccatacgggtacgaaacacatattttgacaatttgaacctttgcaaaaattaaggggccctttgaatcgaaggaatgagaaaacataggaataggaaaaacataagattttgataggaatgtaagtgtaaaacagaggattgcaaaacacaggaaaaacaaatgaatgaaatcctctaaaatttctatgaatttcctttgaatcaaagggggcctaattatacaacgagcaaatgaaccgtggccaaaacatatttcaaaaataacccttttcagcgctaaatcccatggcgctaaacttaaacacctcggcgccacatcaactggcgctgaatgtcgtgccactgtggatagaagtctgagttggcgtgccaactcacattcagcgccacgttatttggcactgaggtatctaacttcagtgtcatgggatttgacgctgaacaaaagggtcattttttaaataagttttagccacgatttatttgtataattagttttacaaagggtcaaattgtctaaatttgtggatacgaaacatccgcagccaaagccgagcgaaaccctccaaaaagccctagccctagccctcgccgccggcgagcatggcgccaccgccgctgcgcgttcgccgggcgctgatggacgaggccatagccggcgagatcctcgtccgcctccctcccgacgagccggagcgcctcgtccgcgcgtccctcgtatgcaagccttggcgccgcctcgtcaccgaccgcttcttcctcctccgctaccgcctcttccaccgcgcggcgttgtaacggagggagtagcttatattcttacccaacaacccagaagtcatatccatcgagatgccaagactgcagctcgttctccgtgttctggaacaccacctcgatgaactcgtgcaggctgagcctcaccaccggcgtccccgaccgcggcgccgcgccgggacgctgtcccagccgatgacattggcgatgttgtagttgtccacgagcttgagcggcgtgtcggggacgacgaacgacacgccgctgacggcgtaccggcgcggagctggcgagcatcagcgtcctcgacgtcgcgatggtgccgtagtggaacgacccctgcgggttgggcctcgccgcgctcgccgtcaggttccaccggaacgacatcgcctggtattatgctttattataatatcatgtattatgacggtgcctttaggttaatacaaaccgcaaccgttaataaggtgtctgttactatgagctactccagcagagttgattttatttttctttcggta

SEQ ID NO: 14137 - DNA, 736 bp, Oryza sativa
tgtgaatgatagtgtgtgtgttttgggctagactttatcaaatagaatgcggcctgcgtgctttaaatcgtttgggcaaacggtccatgtaatcaggagataaatactcgagagagagaatggctgtggccaacctggcaaaaagaaatcaaatctatctctctccaaactctgtctctcctctgcctcagctctgtttctcttcgtccccaactccgatctcgtctaaatatctctctctctcgtcggcggcgagtttcgcggtggcgtagtgttacagtggtatcagagacaggttgtgggtgtcgccgtgcgttggattcttcctgattcgccacggcgcccgcaaaactttcagcccctttgaagcaagctatggactccatggagtccaaactcttggagaagttggaaggcatcacaaagtggatgcacgagattgatcagcggctggattcccaaggtggcagtcttgagaaggtgactaccaaggtggatctcgccatggattccgtcggcaaggtgcagcaagagtgtgctgagttggcccgttcgatgaagcgggtggccagctgctctgatcaggccgggattttgggttcgccttccgggatctcgcaggttagtacaagtggttctgcgactcctccgccgttgaatccacctgttcctcctatgttggatggggttgatttgggtcgtggttttggtgatgggatttattggcgtcatcagc

SEQ ID NO: 14138 - DNA, 602 bp, Oryza sativa
attcctgcagccccacttgtattcctgtgagaatcctatgtttttcctattccttcgtttttttcattcctatgatttaaagggggctaagtgttggaattatatgtgctaaatccatgtagttagacaatagtttctaaaagaaaaaaaatcaaggcccatcacatgaaaggatgcacgtgaactttagtatcagcttactaattctatgaatatgagatcactttttttaaagtgcggtgctctctatgttactagagcaatatggatgagagataactttaagaaaagcgcaccttaaccactcacttcacggagttttgtcatgttgtcttagagtggctagaaattcaaaccgggtatgctaccttattcttttctgcttaatggatagattgattaacgatacgtttgctaaactgctaaacgatacaatgtttgtccctttttgcatgttaacatgtgagggaggatgttcatatggaccagaggatccaattgcctacgtacatgtccttttattgggcaattgactatatgtgatttatggactatgagtccatgattaacgacacgttcggcttaactctcgggcccaggca

SEQ ID NO: 14139 - DNA, 1501 bp, Oryza sativa
accatcactgtagcgtgccagaggctttgttatgggcctggcctgcttacgtgggctggtcgatgtcaatcgtgggccacgaccagagccacagcgatacggcataggaaaaagtacaccgaaggtccctcaacttgttatcgaattacaaaatcgtcccccaaccgtaaaaccagatatatgacatctcttaacttacaaaaccgttcattttacatccttcggtggtttttacccggttttattcgacgtggtgggtgagtcagcgtaggacccatgtgggtcccacatgtcaagacaccacgtcatcaggctatctcttccccctcctctcccttcctctctctctctcactcatctccctaggcaggctggccggcagaaagatttacaaaaaatagaccctgcggctctccatttgggcggcaagctgacgtggcacacggcgtcgtgatgtgccgtgtgcgcattttgagcttagacccttggggctaaatgtaatttttgccttgctaaaaaaaattgactagttctttttacatctgggccccttgctgcccttgcgaattttgcacggaggctccttgccgcccagacagagggcggcaagggggccacgtgcaaaaaatcgcagccccccaaaacgaccgtcctgcaccgtgtgccacgtcagcttttcgctgatataatatttttataaatattaaaaaataaatctaaaaataaaaaaaatcagtgttcaacatctactctgaaacagtgccaaatatttcttgtagtgccaaatatttcctgcatccttcgtacggcccatagttaaatatattttctccgctacaaaatgttggtacctagaatgaaatttagataacgaatatggataaacttttatccaaatttattgtcgagtctgtatataatttctatccagattaattgttctagtatggattaaatctcattttagattacaacattttaagacgatggtaccttcagaatagacaaaatgccaggtaaacctcaataatataaaactcgaaaatgtaaatgaagtctgctctgccttgtgaggctaggctgtccagggaagcaggaaccaagtcaagcatggactgtaacatatccatcgtggcatccaaaaagcatgaatgaacaggacaatctgcagagtgcagttatcaaagatacagggtatctcaactccccaatgttgagatgcattgcaactctgcaagttcagtaaaatttaaaagaagcttagcatgaagatttattatcacatattggcagaaaaggtgtcaactgtaaggcctttgttgtatttctgcataatctgacctttaaggctgtcataaatagaacagtatctcagtgccttataattaatggagagctcataagataatcacacctcacaatccatgcacgtaaactcggttcatacaagtgaaactctcatccatcagaaatgtctaaaactattatcccatttacaagt

SEQ ID NO: 14140 - DNA, 1265 bp, Oryza sativa
cgtcggcgagctctacgccgacgaggagaggagcttcctgctgttcgtcgtcgtcccgagagcccccgcctgggatgacgtcacccacctgatcgaagtaagctgctcttaccgagacatggagaccggacggaccacgagcgtggccggcgacgaggaggcggtggtgctcaggccgtcgcgggcggagtccggcgtcgccgagcgctccgtggaggtggaccgggagcttgtccgggtggaagccatcgacgacatcgcgctggcgcgggcggcggcggagcgcggcgagtacgcggaggcggcggagatcctccggagcaggcagcgcgcggtggcgcggtccgccgcggcgcgcgccggggacgccatgtgcgcggcgctgtccggggagctgcgggagatgcgcgcccgcgtggcggaccggcggcagtacgagctgtccgggcgcgcgtacgtgctcgccgggctgagctcgcacgcgcagcagcgcgccacgtcgaggcagatgtccggcgaggtggcgccgcgccgccacgctcacggcggaggcgggggatcgtcggagctcccgacggggatcaccgtgtcgtacgtgacgccggcgatgctggacatgctcgaccggtcgcgcaggtcgcgggagctgacgcggccgccgccgccgccgccgcagcagcagcagcgggacagggagaggagaagaagctagaacggacgaacacctcccgtgcaccatgtcacacctattgtaaatatatcgtggtaaacattgcaacaaggaagttttgttgtgttgcaacatttttgtgttggtgatgttgtagccatcacgtgatctcacgtgccaaaggaaaaaaaaccgttgtcaaatgttatgtgcctagcctaatgtaatttttcaacctcgacgcacctgaggagttgaggggtagaggacgatagcccctgccaccagggtttcacactgaattagccgggttgatcataattaacatgccatgtcactatgtcagtcggaactagacacaatagtacaatactgttcctgacctctagttatatttggttttgcggttaagagtgatttaaactcgatgtcaacatgaggacctaaagtgaacttactccaatccgattggtcccctatcttggcacaaaaacgtctatgggccaggaacgtggtacatccaaacaaggcctaaaatttaattgagagtgttatgagtggagatacgtgttaattggaatgttctcttcagtta

SEQ ID NO: 14141 - DNA, 375 bp, Oryza sativa
ggaacgaggacataatccaaaactttagggttgcttctctgctccgccatgacgccaatgcataatataattgtgtcggctacctgcacagtgcgcatgtttaatctgttacttcctttcttcttcttcttcctattaagactcgcttaggtggtgtttggatccggggactttactttagtctctatatttagacactaatttagagtattaaatatagactacttaaaaaataattacataaataaaagctaatttgtgagacaatttttaagcctaattaatccataattagagaatgtttactgtagtatcacataggctaatcatagattaattaggctcaatagattcgtctcgcgaattagtccaaga

SEQ ID NO: 14142 - DNA, 1501 bp, Oryza sativa
tgctaaagtagatgtataaaaatcttactccaaaatcattttttggttgctccgtatattattcttaggtaataataagccatagcccaagcaaagatgataagagatttaagttgcactcttttggtattcgagagaaaatatatatatatatatatatatatatatatatatatatatatatatatatatatgatattagaattctgggtgatatgaaaactaaattacaagcggagtcgtcctcctttcatcacctcctcccaactcgactcgcgcagcacgtactacgcgaaaagtaaccaccagacctagtattctattcttagtctcgctcccaacccctctttaattatatgggtatgatctgttaaaatatatgggctcttttttaaaaaattatataagcttggcccgttacaacatatgagtacatgatgtaactagtaaagcagaagaattttgtttttcaaaaggaataagttcactttgactcccttaaatgtgacccgaatctaattcataaccctgaacggcaaaaccagatatcttgacccctaaactgttaaaaccggtgcaatttgactccctcagcggttttggagggcggttttgctgacgtggcgcctacgtagcaatattgaccgagtctttgttccacgtggtgttgatgtggcaattacgtggcattagaattaaaaaaatgcgtgggacccattagtcattcacacaataaaaaattgagcccactgacatgtgggacctccctgtctccttccttcttcctcctgcctctcccttctctctctctctctctcccccaatgcgctgcagcgcctcgccgcatccgtgctcgtcgtcggcgccagcctcgccgcaccgcccgccagctgctccgcttcggcatccgcgtgctcatcctagagggtcacgcccgcccaagcggccacgtctacaccactcatctcggcgggggtcaggccgccatagagctcggcggcagcatcatcacgcatttttttgtgtgaatatttctttttgtatgaatgactaatgggtccacgcatttttttaattctaatgccacgtaagtgccacgtcatcgccatgtggaatgaagactcggtcaatatcgccacgtaggcgccacgtcagcaaaaccgctgagggagtcaaattgcaccggttttaacagtttaggggtaaagatatctggttttgcggtttagagttatgaattagattcgggtcacatttaagggagtcaaagtgaacttattcctttccaaaatgaaattcccaaccactgatcaatgattaatgggccttagatcaccattgggcctagcccgtcgcacggctaatccattggattccacattcgaagtcccaaattggatgcgctcgtgcaacgaggaaacccagagtccgagactccaatgcacccgccggccgcgcattccgtcgagcacctggcgcgcgcctccgctccccgcgacgc

SEQ ID NO: 14143 - DNA, 1131 bp, Oryza sativa
ggcgctcgcgtacgtggacgccgtggcggcgcgcgccggcggcgccggctcgggcttgtactccgggtggcgtacagcaccgcgcgcgccggccgcgcggcgagcagcctgtggtcgaagcatggcggcacgggcgcgtccgcggcgggcgcgccgcgcgcgatgctcgcccacgtctccacgaagtgcgccgcgctccgcccgtcggcgatggagtggtgcagcgccatgccgagcacgacgccgccgcaccgcaggtacgtgacctgcaccagcagcagcgcgccgccgcgcgggcagcagctcgccgccgccggcgccgcgggcacgaacaggtcgcgcatctcgtcgcacggcacgaactcgcccatcaggtcgtcgagcgcgtagtgcccggacctcgccgtggcgaacaccacgccctcgccggtgcagtcgacctggacgcggccgtcgccgtcgagcccgaggcggccggcgaccgggtagaacgccacgagcgccctggcgaggctgtccctcatggcgtcggccgcgaagaaccccggctcgccgttgtggcggtagaagaacaccgtcggcgtgtagccgcggcgcgcggcgaggtcgaggttggacagccagacggcgcccgccggcgtctcgccggcggggacgaccacctccgacgtcagcacgtccaccgtcgccatggcttcttcacgagctagctactgatcagtggtgagatggtagtgcaggtttctgcgtgtgtttcgttcgcttaaatagaggcgaagttcgtggttggtggagctgacagtttccaattccaaatgagtttttggcactgaagaattgatgagttctattttttcgatcgactaactatttaagtacccggctaatgattaagagagtgaatttaatttaaactatggaggggacgtcccctggttattcgtacgtcataaaataaattaaaaaaatttgaaaaaaattattaacatgtgatatatcacttcacaaacatgcaaattaaaattcaacttctacaagtcacaacgaaaaaacaaattaaaatacaactagtttacgtgtattcacagtcaatttttttcgttgcaaaatgtaaaagttaaatttttttca

SEQ ID NO: 14144 - DNA, 1501 bp, Oryza sativa; identical to SEQ ID NO: 13158

SEQ ID NO: 14145 - DNA, 1501 bp, Oryza sativa
atatcttttgctattttctttatatggactagttgcccagtgttactaaatggctaaatggaatagtttattccctatggactacttttgtagcacattgtggatgccctaactgttgtagattaatcgcgactaacaaaatacctgtcttgccttgaccgtgtgcttccgataatccgatgcacgtgatgtgtcgctaaagcggctcactggctcaggatgcaccgtgcgtgttactaccaccgactgcaaatacacgcggatcgacagctcagtgtggtggtggcttcagcttggcggccaagaaacttcaaaaccatattatggcatccttccaaaattttagaagggaagaagaggagctatgatatagacagtgcgagccggctaccatgtacacttgataattggacaccttcacagttcacacaatgccaccatcatatcaccataagctttattaagggatactagtcgaccctgccttatgcgcctagaaacttaagcacgctgcatgtacgaatgactaattaagtgtgtgaatgtacattggcgaatctagagatcttttagaacatgaacaaacatatatgtccaaaggattatatggatgccattgaacatcagcgatggaagctattacattgatgtgacttgtcaatgagttcggacggttgcccgaaggtaaccactagccaggtcttggatccgctcccaaaaatatacaattaattatttctttaattaattaaatgtggaaacaaaactagctaggcattatgcagttggtcacaaaacgacatgtttttttagctggaagagtacattttactgctagcttgaagtgcacgagctcgggcggtcgtccggggtcaccaggtcttggatccgccccccaaaaaaatacaattaactatttctttaaatgtaaaaacatatgtgtgtgaaaaaggttaaaaactagctagacattatgcagctggctacaaaacgacatgttttttttcttggaagagtacattttactgccagctgagaaatagtgtgaagcttaactctaggtgcacaaattcggacagtgccactcatggtcggcaggccttggatcctcccccaggaacatacaattaacttttttttgtttaaatatgaaaaaaatatatgtgtggaaaggtttagaactagacatcatccagctggcaatagaacgacatgtttttttttacatcatcgagttggcaacagattgacatgtttttgtgactggaagagtacatttttactgtcagctttgaaatactatgaagcttaacgctaggtgcacgaattcggatggcctcccgtagtcgctaggccttggatcatctcacaggatatacaattaactattttatttaaaagagaaaacatatatgtgtgaaaatgttcagaactagacatcatgcagctaacaacagaaacgacatgtttttaatttgtcataggaagagtacattttact

SEQ ID NO: 14146 - DNA, 1501 bp, Oryza sativa; identical to SEQ ID NO: 13159

SEQ ID NO: 14147 - DNA, 1501 bp, Oryza sativa
tcttgcagggtactttctgttcgaggagccactgccttctaaggtaatatgagaattctcccttctgtgtagtgcgtgcacatcaagctagttattcatgcagatcaaatagctaaaaattttcaaatttatttgtgttagcttatgtcctctgttagattgggctttttcttccctttcaaacatgggaagagtatcctaggttgatctgtcacattgcttcttagtagtatgagtaggtttatttattataaataggattaaatctagttattaagctaggccactttatctggattcatattactcgcttgaaaagtcacatagcatacaaagattatcttataatttactgttgtatgaaaaaattcttgagagatgcatgcagttggttgataggaaagaaaacacactggatctttaggttgttatgctaaaatagatgccgtttttcagatagagaaatagatggtcttgtgctttatatcatgagcaatgacttgcccccttgtataccagttaaatacaagccaaaccctgtcataaatacaacaataataacatatcacttgcctactatatctgtacagctgaatttatgtacagtctgtaaaatataataataataaaaaaagacatttggagggagagatgtccctccaaacagtttcaagaagaaatgtgagcgtgttggggattgaacacgggacctcagggttgaaaccacacaccctttgccactgcattatcaggtgtatctcagactgtagaatactgatacatcactttccccacttttgagtttacatgtatacaaaattgtaactgaactgcactcagcttttgaatttgatgtatgttcatacagtggtttgtaggtgctagtcttatcattgttggtgtttttatcctaagcaaatcaagcatcgagaagaaactgaactctgactagagtaagttttaaggccaaaattttattagctacgacacacattgtcagtttgtacttctataagcttgtggtatgtttgaccataacttgactcttttgtaaaaacttgtgtcaattatgttttgcaactttagttcatatttttgtaattagtaaataacttgagctcatctattgagacatcaatacaagattgttttaaaagtgaatgcatgatctaagaattgctttttatattgactttaagatgacaacaatcaggaagtggaagcgccatatctgaaaggagtatctcttttctcattagcagtatagtcacagcagaaattcttccctctaatattttcataatttcattgcccgagctctgactttgattttttttacggcaagaggagattttcagctgttcctgaagcactgtagatcatgatcctctgaaatgcagtgtgagtgaaaaaagataaggttctttccactgttcatgaagcacagcagataatgttcctctgaaatgacaatcctatgtcggatgctccatcaacatta

SEQ ID NO: 14148 - DNA, 1501 bp, Oryza sativa
ggcgacaacggcggttcggcgaggaggaggacacgcggcggtgacgccgccgctgtcaaccacctcaccaccttcgtctcccgcctccacggccggcgaacgaaggggtggcggcgggcggtgtctggcggcgccggtcggggatgggcaagagcggcgccgttgggttgggtggcggagtcggcctcgagcggcggcggggagcggcagtgcgcgcagcggcggaggagtcctcggcggcagcggctgcggttcggcgaggaggaggacgcgcggcggtgacgccgccgccgtcggccacctcaccaccttcgtctcccacctccacggccggcgaacgaaggggcggcaacaggcagcgtctggcggcgctggctcaggttgggcagcggagtcggcctcggcagcggtggattcggcctcgagcggcggcgaggagcggtagtgaggaaaccaactcaacttactgaatgaatatgtcttaaaatgatagtgagacttgactatagaatctaatggtgcatagcactccccttcttgaatattgtcatcgatcttcaaaacaaggttaggtaaatttatcccaatagcatcaacgttgtacgatccatttggttctcatatttttccatatttaaaggaggattcatatctaaacatatataaacacgatgcaccatataacatcctctattattatatttaccaatgacatgataattgttccaagaataacatggaaaatcataaattttcttctctaaggcatttagatcacaaagaacatcaaattcgatataacccaaagtacataaagaagacaataatttcagctcttcttggtcatcagcaataacaaagacacgtttattttgagtggtaaccaaatattcaaaaatataagtaacgtgttttttcactagttgtggcatgtgtataagtgaagcagtgcgcaactcttcttcattacaagcattatcaatatcaacacaatctgaatttttagcttgtgataaaagcaaattagaaatctgttccactagaggttgctctaatatagcataattagtggacaattgtagcatagcacaatctttcttaccttggtccagttgaccatcacttaaattacctgaaacgctctcttgacataatttaggtgcttcattgttcttctcttcaaaattgtttttaccttcctgcatgatattagataaaatagaaggagcaagaaaattctcatgtatcataggcatttttgtttctttctcaatctgactttcaatatcgcaagcatgcaaaagtaattgaaaaagatggctatgtgttttattctcaagcctatgctgaatttttaaattaagcccatgtaaaaatcttttaattgtatctcctctagactactctataacaccgtacaacatacaaattttaaactcccggtggtactctctcacggttctattcccttgtttcaaattttgcattttcttttgtaaat

SEQ ID NO: 14149 - DNA, 1501 bp, Oryza sativa
atgaaatgtttgatggtatggtttaaaattgaagaaaaatagtccttgaaatttctgtaggagttcggttgtgatccaaatccaatcagatatgtgtagtttggcccatggcggctcacgctcatctgggcttggcacattggggaaaacatatatttaaacatatactttttgaagtgtgaatcaaataatctatttcaatagtatgataaataagctaaaaagaacatgtggctaacaacattcgcacggtaatttttcgtttcaattagacggaagacttctagtcacctgttgttattttagggaaaatttaattttttttccactataaattttctcaattatctaaatgttctttctagatttgctatttttttattactcttaagaggtggtttctgaactattttccttttttctcaagtggcatgccaacatggcaatatagggtgaaaatggtgtgggaccgataattgcaattttgattcaaattttcggacccccagcaagtcattacatcgacataaattttcgggttttcttaatttcttttgttcaatttgataataatttatttaaattcagtcaaaatttgttaaaattttaaataatttcggttcaaaagtgctgaaaaccaagaagtttgtaaatttcggtgctaccgaaattttcaccaaaaacgaaactgcaaaccatgtgtaggacgcactggtcagtgtctctccctccgctggccttctctctcactgccgctgccgtggctaggccctctttgctgccatcgccgtgagggtgagcatgagggtgggtgtctaccacccgacagctgccctggtgttcgaccgcctcctcgttggcggcttgcacgatgataatggcagcatgagttacatcgtcggtgtccacctttccctcattgtcgcgctctacacggcctggaggatgctgttgtactgccctttttcactaccgtcgctccggctccacgcatgaaccagcggcgtggcagctgccaacgatgctgtgtctgctgctgcaccagcagcgttgggacgaaacgagtcaccatcgttagtgagacaactatcccatgtgtgccggcggtggggaactagacattcggaccgttgccagtatcgcattcgtgcggcctcttggcactggcacgtaacttggcgttggttatcaggaattcctcaatctagacaacgtgggcatgcgggtcataacgaaccctagcaacgcgggtgacgtcgcccatgctgttgtcgttatcgagcgagccgccagcaaggaggcaacggaggtggttgaacaacgagacggtgggcgcccaccctcatgctcaccctagtggcgacggcgacagagaaggccggcggagggagagacactgaccagtgaatctcacaccggtttttaccatacgttaccacgttggcatgctacgtgggcaaaaataataaatagttaagaaatcacgtcttaaaagcggtaa

SEQ ID NO: 14150 - DNA, 1501 bp, Oryza sativa
cttactaagcctaagagaatcttgccacacttttttgagccattgacacgtgggacccaatttattggaggggaatcttgctacaactatggctacaaccaaacacctgtcaaatttgcctaaccttaggcgtggcaaactgtggcaaagtgtggcttgcaaccaaacacacccttaagaacacaacctaaaccgtccccgtggcgagcgctgcaacagttgcaccgctgcttcatgggcgcgccgacttgctccatgggcagcgtcgtgtcccccctggccccgctgcctgaacgtggccgttccccggcccgcgccgcctcgcgcttctggtgcgagcgcctctcgcagtctgttggttccgactcggatccaccctaaatccccaatccgactatgtgccttcgcatcccgtttgtttagctcatgtggtggttacatggcggtgttacttggtcttcgtttcacatgacgttgatgtgacgcttacgtggcattattagaattaaaaagtataaacttcacgtaggtgccacataagggaaagcgccctccaaaaccgctgagtgagtcaaattacaccaattttaatagttaggaggttgagatatccggtattatggttgagagataccaataagatacgaacagagagtcaaagtgaacttattccaagattttcgatattgcaatttagggattccatataaactcgacggaaaaatgaggaacgtcaagtgaacttattcagaactgtctactatagtccattaagtagacaaggcccatacagcccatcggccatcacaatctagcagtgctacactgaatttttttcatttttagattttttttttaaaaaaaattacagaaataatctatcggccaaaaaaattgcaaaaatagaccctgccgcccacctctggggcggcaagctgatgtggcgaacgggggagggacggacggtgacggagggagggttttttgcagtaaagcccttgccgccctctgttggggcagcaaggggcccgaatgcaaaaaagccagtcggggccgaccattttgcaggcggccccttgccgccctctggtcgggcggcaagcctcgctgcctataaaaggcctgctgcccagcccccagccctcattcctccccctcaaatctagtgaaaaaaaaagaagaaaggggaggagaagagaagaaggggcgaagccctgccggattcagacgccgatttcaggtaatattcatagatcctatatgtgactattgagttaaatagtgtgtattttttaaaactttgtttgaataaatgcattatatttttagggttttagttgtactaatctagaagtgcgtattgtagatatcggtaactatgtagatctgctagtttggaatcaatactttaccgttgcattggcatacacaagaagatattacgttgtagatgtttattgcatgaaagagtaatatgatctagttatttcgttgacagata

SEQ ID NO: 14151 - DNA, 1501 bp, Oryza sativa
gaaaaaaaaacatagagagaaagaaggcaggccctggctgctctctctactaggaccgtatggcccaatatacacatatgggcttattgcgcatggacggaaaaagaagaaaaaacaaaagaacataacgcataaaatcattcgacaaataagatatactacaggtaaagatggtagataaatacgatataatatgggttaatttcagaaattgagacaagtatgatgactatatttataatatactacgctctccgtccctaaatatagcaacttctactaatgtatttggacatggccaatgtgctatattttgggaaggagagagtatatttctagaaagaaacaataaacaacaaaattaaatgatataaattatgtaacaatattgtatcaaactttgcattcctaaaaatccttttttaagaatatttagtttccgatagattctcatacatatagaaaagtacaaatcacagcaatttcgagataccatatccttccttttatttttactaatagtatatatagttatttgtcaaacttaaagagactcaatccaacaaaattaatggcaagcatatattattattactatgttattttgatttacaatccattaacacgtctttttagtgtatactttctgtaggaattaaactaagttagatagtaacaaaaataactaacccatgtaaaaattatacaaattattttctgtgctatagaagagctctaaataatatgcaagggccataaactaaccggcgccaactggggcgtctatttttctagtaaatgagtaaacactcaccggatctggcgccggatccataggaggcgggctagaggcggaggtgctggaagcgcaagggaacgacggcgtggagcgagagacttcgttggaggcggtaggggcccagcgcctccgccgcgcagccagtcactaggccgcaccagatccagacatggatggatggagacgaatgaggagggaacagttgacgagcgcgtgcccagactccgccttggcctgcgcccactctgggctgggcaccgccgaccggccgcctgctcgccgcgaggggggagctagcaaagggagacgacgagacgagagaagaggcggcggcgctcggttcaggggcgagggagagagtgtagtgtgcgtgtgcgtgtgcgtgtgcgctggtctggtgggcttcgaggagggagggtaccacggactgtttagggcttgtgggctggtcgtttagtgctacttactaggaataagtctattttgcctcccacaagtcttgctcttggatgaatctcacccctcaaccgtaaaaccgggtataacgcatcccccaacttctaaaaccgatgcaaatagagtcccttggtgattttaatagcggtgtcatcatacgtggcacttacgtggcgggttgacttaatctttatcccatgtagtattgacgtgacactaaaaataaaaaacctagatagcatccac

SEQ ID NO: 14152 - DNA, 1501 bp, Oryza sativa
ccatcgcccgtgacccgcgcgaaaaatttgataatttgacactttttttcgttgcccaattatttaaattggcacttgtgaggatgataagtgggaccatctgagtgaatgaaagtggatcatgatgtcaaataatcaaaactcatttaaaggagtggtaaattatcaaatcgctcgacgtgcgcatacccatccagacatcgaggtctcctcctcttctaagaccgacaagtgggcccaatcatatgccagttaagaataaacataaaaagatgaggcctatatataatgccatgtacctaagttgtattttttttatagtttaagggtgaagatttcagatataaatcaaactcagcctaaagtttagggatggcaagtgaacttacagcatcatcgtttggcttatctgcggaataagccaaacgacatatttgcaaacgaaaaaaaaaattatgaataaaacttttatatacgtgtttttagcgatctaaaatcaaagatcgaaaaaaactttaatggaagaacctcaaaattaactccaaatttaaagttaaaaattaaaattttagctgataagtgtaagcacaagtaaaaagataatgccattattcctttgctgaccggaggaaatgaaggcccaggcctcaagtgggccccaaataggccgtgcgtggtgctgtacgtgcggccacgtgggcaactgcgtctccgagcccaattcacgtgtcaccttcgtctatttattttctcacgtgataactaatagggaaataaaattgaaaatatacttttgtttcctttcaatttacaaaaatatacttacaaaaatatatttgcgaaaatatacctcatcctaggttagcgggagcggtacggtaagcacggtcgcgcctgccggtcccgcacggcggttgcgcggaagcgatgcagcccgcggcacgagtatgcgggagcggcggggatgcgggagcacctcgggagcggcacggtcccacggaacgggcgtgcgggagcggctcggttccacatttttttacggtatcagtactgttctgcactgttcaaacagcggtgccgccgatccaacgtggaaccggctcatgaacagtgtcaaaacagtgtgcatgtgcagcttggctgcccgctcacgcgcggccggcctgcgtgaccgcggtgccgcttggccggtccgcggtaccgagcgtccgtgctgcgggaccaccggtccccgtggaatggtagtgcgggaccgcctcgatcccgcgtaaccacatcggggaataggtatatttgtgcaaattttcgctatataggtatataaacacaaaataataaaaaaatattttttcaattttctttcaactaatatacgcagtaattaattaaaaataaaccaaggaaagttggaaggtataattgggtgatgcacctcacacttgcaccgaataacatcacttcagctaaccaagcaatgtttccttttcagtacccattttac

SEQ ID NO: 14153 - DNA, 1501 bp, Oryza sativa
gaccaccaagcttttcctaaacctgttacagttcttggcagcgttattatgattgcacatttccagaaaatgcaatggttttttatttctttatggtgcacactgttggtctgtgtccaaattgattagtattctgtctatgcattttctcatttttcctgtgctatatgaagtttgactgagctaatactgtttgaaagatatattaggtccgtagttttccccttggggtgtagtgtaacacgcagaaggctttctgtgtgacaaatctctcttttttataattttgatgagatgtcgtcctgtaattgtgcgcccatgtggaggttgtttgcctagtcctcaacttcactatagtttgcaaaagggacaatctgtgacttattgatctactgtatatttagtatctgtactatattattggtgttttgagtggtatcactgatgtgtatcattagtgttcttatatagttttttgaattctcttctgtgaaggcaagttaattattccctttacaatattttggattatttgatgattttgatagagtggaatttctactacatttgcttcaggcactcttagcttgactgaccttgtcaacaaaatatacagtattctccaagaagacttttttgaaggattagaactaaatggtagaaaagatggttctgtgtctgcttgcaagatcttaaaggttattattggctctggtaacaccaagatgtatgaggtgggttggattggtcaggacaatgcagagactaacacttcagttcttcaagccgatgatctagtaattcgcaagaaggcacgcgctagtcgtagcatgctgaaaatatatattagggagtcaacatcacagaattccccatggattatacatgcaaatcttgcaaagaaatatggaatacccactgagcccccaaaagacttattggtaaccatcttccctcattttatttactgtgttccttattatcttaaacctaaaaaaccatggcttgtagaatggtcaagggttgccaaaactgaggagaggactcgagaatggaaccacagatgatgtcagaaaaaaattgaagaaaggtgacttaacagataaccatgtcatcctctcagttcatttgatgttccatacaactacatttttgcccagcttcttattgttcactttttgcatgactatgcaggtgagccaattgatgatcttttattaaggcctacagcagatgatcccagtctgtcaaaaagacgtccactgtctacagatttcagagtgcctgtagattctgttggggatctacttatggtttgggacttctgcatgacttacgggaggattttatgcttgtctccattttccctctcggacctggagaatgcaatctgccacaaagaaagcaaccttgttcttcttgtggaattacatgctgcactcttccatttgctcattaaagatggaggcgggtattttatgtttctccagaacaagagaag

SEQ ID NO: 14154 - DNA, 1501 bp, Oryza sativa
atgttcctcactcaccattgatgtttcttagccttctcatttcactcttttcttatttttgctacagaaaagatcctcagaaggtggaaagcagggtggctcacataaaaagatcaaaaaggacaagtttgtaggaaccacagggaaaaacatgaaatctgaaactagcatggtttctatagcaccacgagttaaaccagagctaacgcttccaatgacgtacgtcgtacaatacatctttaatcacttcaaattttcttttgagaagtccaatttggtcatctaattttgaatattgtctggtttgtgacctaaggttaaaaagttctcctgaaatgattcaggattttaggttatgataaaattataacttcctctgcatccatttcctggtccgtggttgggaagaaggcaaccacatgttttttaaattcatgtggccattgtttcatttttcctgcagactgccccttttgaaacgcaggattaaaaaacttaggaatatggaaaacaaaggaattttgtaggttgattggaccgtaggaaaaacatagcaatgggcttggattataagagtaaattgggtttcttatctacttatacacatcttaccctcactaattgaatagacaagtggccatgagctactagatttgccttgatccaacgcgagataacaaaaacatgagcttggaatggatgttaaatttcctatgttttcctctagatttgtaggaacaggaaaatctcctgtgattttcctttcctcattcctacaaatcaaaggcatgaacaatgatcttccctataggatttcaattcctttgttttttctccaattcaaaggggcctgcatattctatgcaccaacatattgcttcctcatccacactgttcaaatgatttggttatcccatgtccacctgccaatatgttattgcttagatgttgtttaaccgtagaatatttgagctgttcaaaagcacttttgtaagacattaacaaaaccaaagattatatttcctttgccttccaaactatcatcacgacatggccattaaggctctgttcgcaaaaacaggttcccaacccaaacagtacgcacagaaaacggagcggtccattagcacgtgattaattaagtatttgctatttttttttcaaaaatggatcaatatgatttttttaagcaactttcgtatagaaactttttctaaaaaaaccaccgtttaacagtttgaaaagcgtgcgtgtggaaaacgagagtagggtgttgggaaccagctcttgcaaacagagcctaagcccactgataagattttctatagtgatgtttttttcttatattaagttgtaataatttctttgtacacatgtttacttttatttgttggacatctttgttgactcatcagccttacctttatctgtaagaatctgatagacgtttactgattattttttttcaggtctgttgaagttgagcagtcaattcttgagg

SEQ ID NO: 14155 - DNA, 1501 bp, Oryza sativa
cgccatcagagggaatacaacatatgatttggatgaagaatacaaggtaaggaggtgaaaagaaaaggaagcaaccttctaattttttttctctttcattttaattcaagagctaagaatattttggctgttacaatatgttcaggtcactagacatgctgagagctgggatgtctctgcattggaggcgattgggcagatattcgtgccggctccgaaacaaacagatgacatctaattaaccagctaaagcaacacagagcactagtatacatgaatatgatgctggtgctttgccacgtagtgcttctcaaccgcaatgcataactgtacatttcctttttgtgattacacacaagtaagtgcacatattatattctaactaagtacgagttagtatgtttttggtgtgagtatggttcatgtaaagcaggtgggcgaaaaaaaaaagacacctcgcaagaaaaaagaagctactaaaagatacacctaaggtacgtttgaaacataagaatttcacatatcatataagatgttttattttgtcttttaagtccaaattctttaattgtgaccaaatttgttgaaaaaagtagcaacacattcaacacaaaacagacaaaatatcctataaaaatgtattaattgtgaatttaataaaaactaatttggtgttgtatacatttttccatcaacttctccaaacttttttaaaaaattgatttaggaaaaatagaaaacacctcaaatatacaatagaggagcacatgatattttcatgaaattcgaaaaaaatatacccacggttcaaaaaggactagaggcacgaaaacaaaatacaagttctctccaaggctccttcaagacataagttccacaggaattaattcaattcctacaaagactcaaaaattcatcagtttcatagttcatagtaaatttcactttgggttactttttattaccaatatttcactttagaccatagattaactaatgtttttttaatttggactggataatcttacctttgttttattttgaaccaccctaactcttttctcaagtgtatgaacgacctcgaatatgtcagctcctattcatcaataaacctctttagttgtatgtagaccattgctttgacatagaacaaagtagatggataaaaaaattgagtgcactttaaagtgacaaaatggtaaaattacctagtccaaagtgaaaacattggttgaagggtggcccaaactgaaacatcggcaataaaaaggtagtcgaaaatgaaatttactctgatatttttttaaatgaagatgggccggcccatcggcccatcaccgtcgaatgttccacaagcttcgcggcccaaccccaaccacccaaagccaagcaaccgtacggtctcctctctcgtcaaaccaaacccaagcaaagcacccgccacatcggagaagagagagagagagagagagcgtggaagcttctggaaggttctcgaaga

SEQ ID NO: 14156 - DNA, 1501 bp, Oryza sativa
aaaccattgacttagtcactgtcaccagtaatcaatcagcgctcatcaaatacaattgttttgattctgtaaatttagattttaagcaggaaggttcgtttggtagatattcgtaatattggatgaaacatatataactgctcctgtaaaagcatgatcgacgatcccatgaactcataatctgctatcttgtttgcaggactacattgacagcatggaaggggcaactctctcaggcaggagaaccgcggcctacatctgtggtgcaggagaggagctgctcgccctccgaaagaagctcattgtcgacgacagcgagaaggccaggggtaaggtcgaggcccttcagacaagctgagcttcctcaaatgacacatgctggagtgagtggattgctatgcccaaaacaaaaacagcttcctgggtgtagtaggcgatttccgcagcgactctcatgtaaatcctacttgattgagcatttaggtccaatctgctgctgccctttttgccttgacacgatcgttcgttcgcccgtcaatggtgtgttcttcgttattgtgaatttgtgattgggaaccaaaggtggcatacgggattacatcaggcagcgtgtgttttgttcagcttaaccgatcattgaacccattgatgatgatgatgatgtttatatagtgcacacatcacttaaaatcttgtgagagatggtgcttaaatttggtgagtactgctgtactttataaggcagctttagagtttttataaggagtatattttgaacattgtgagatgagaaattttagatacttaaaagtacgagttacttaaattttacactagtaagctgttggtatcttaaaattttggtaccaagtcggtaccttgtcaaggacagtaaaatttatcaaggacagtaaaattaccttgtgagatgtcttgtgagatagtgtgctaagtgtgcgcaactaaaatatggaatatagaaaaaaaatattcaaaggaggtagtattgaattgttgtgactgaaattcgtcgatactggatggtggaaatttgactcttttttccccttgccatgcctgaagtctgaagtttccatgtcctattgaaaatgaaatgatcatcatcttttacatctaggataacactaagcatacctaaagcactgaaatttttggtttggtcagaatatggattgcagcacgccagcaccatcatggaggcagcaccgtttcatattacaagtcactttaatttttctacaaattaaacttttttagttttaatcaaatttatagaaaaaaaatagtaataaatctaaaacaccaaattagtttcgttgaatctaacgttgaatatatttttataatatatttgttttatattgaaaacactactataattttccataaattttatcatacttctaaagcttaattgggaaaaaaaatcaaagcgacttgtgtttttctttgggctctctggcaaaacagcaactgccat

SEQ ID NO: 14157 - DNA, 1501 bp, Oryza sativa
aaagaagagaggtggacccatatgattttctctcacttacatgtggccccacatacttttttttaattttttgctgactagtataccacatcagcaaaaccaggtatatatactgctataggacctaaaatgcacggttttacatagtataggagtgaagatttctgatattgcaaataagggatgtcaaacaatctcggtgtaaagttgagggacgacaagtgaacttattccgctcgcaaacgaacggacgtcccatcacgtccgtcgatgctccagccagcactattggccttttctggcgacagcggccgccatcagggatgggaataatatgttcattttgcgtctctcattatagatcgagttatagtcccgtcccttggccacgcaatcatgtataatgtatctctcatattgcaataccactgaaatcgaggttccaagacactactaagccgtgaaatggtgcctacgtggcacacaaattagaaaaaaatagtaataaaaatactgatggacccacgagtcagtgaaacatgcatcctttttccttctcaaccctctctctcctcccccgatttctcctaccacaaacatcaacggtggcggctagtgagctcgccagctcgttagcaagaaggcgaaagcagcgaccgatggtaggtggaaggcaaggagcttctcacctaggtgtcacgcccagaaattcacgaaccagaatttctaagctgaacgtgtattaaacccctgtccaggaccagccagggtaaaaaacgacaattgttgacatacagatccacgtcttacaaaaatataaaagattacaaatgcagcgaaaaaagtaaaagcgagctaagcctgaagacttgactcctgcagcgggcgattccattccacaggcaacccttcacggcagcgatgaaaccaacctcttcaagacatctccaactgagaagaacttcaattctggtgtggaggaaaagagcaagactgagtactacccactgtactcagcaagtcataccagaagaggaggtatgatgcaggatataaccaacagaggctacggggttcatttgcataaagcaggcatttaaaaccagtagttgaaaacagtaaaaacagttgtagtaattaagcaatattaaccagtcactgtccaacgctacgccacgttgcaacaggcccaaccaaccacctgaactacaccagttcattaagctaaactaggggtgagactaatcacggtgaatctggtcgaccgcccataaccgcgagcatggctattcgaatagttttactctgatcagaggtgtacaactgtacccacaagacacagccccacgacacgttcccgtgcgccgacatgccaccacgacataccggaaagaggccgtgacaggacccttcgcataaccctctctaaccgatcgcaccacaccttagcgttcgcccccgtccccagcaggcaacgggcagccccccgttcgtgccgcgg

SEQ ID NO: 14158 - DNA, 1501 bp, Oryza sativa
ccccgcaaaaggccgtaggcttcaacacccccctcacaacatgaccgtcgtcgccgcctcgaccagggcgctcgtgttccaacgggtgcctggtcgcatcgtcgtcgcctccattctctcactgcggcagcctccgtcctcctcaccgtccactgccaaccaccgggagcgtcgccaccgccgacaggctttacaccgccctcagccgctccatcgcgccgtttagtcatctcctgttgccggccacgcgcgccagcttcagctgcggctgccaccgtggcctccacgagcgccggcctccgctgccaccggccgcgcctttgcacacgccggtttttgccgtcgccagccacgcctctactgcctccgccgccggcggccattgcgtcctccgcgcgtgccagtctccaccgccgccggtcgcagcttcgcacgcgctagcctccttcaccagctgccgccagccaccagacgccgccgccttcgcctcccgtcgtcgctgcccgagagcggcttgctccggccagatccagatccacccatggggaggccggatccagccgcggcggcgctgaatctgccgcctccacgccgtgtcttcaacctctgctccgcgcgccggcccgccttccatgcacatagcgccgtcgacgtttggccttgccgccgccgtcccagctggccgctcggttctccggtagctgcgaggggagggagaggaggagagagtggcagcggcggtgctaggtttccccccgagtcgcccacgcgtgggcgacctactacatttctgaattctttaacctaaaggaatacagagataacctttctgaatcttgaagccggaagatgttgcttacaggagatactgacatgaagcttaggcgatatgagtttgcaagtaacgaagttgatgaaatgataaggtttgggtgtttcttttctccccctggagcactcttcatggagaactgcattcgtgagtaaattcatcgactctaaattcatagtggatttgtgtttaaattgcttagttgcatctgaaataattcatgaatactgtaatttgaatgtgaccattcgtctgaaacgttcaacctgaaagaattataatccatttgcataacttctacatgaagattggtctatcgatgtctttcctgtgattattgacatgaacacatactgcctgacaggaaacgttaagtccttaaatttaaattaaatgtttttttacagcctgatgtcctgccgtcatctgataccccagcaaacaagatagacattgttatgttcagtcgttgaaagcacagaagacgcagcagaatcattggcattcagagcatgacagtagcgagccacaggaaatgtgaaactctatcagaaagagaatcaaaatccaatgagagtagcaattctcagacgaactacctgtttttgtagcctgagaccttgatggaaaaaaatgaattgcagaagccacccaaatgcagcatagttt

SEQ ID NO: 14159 - DNA, 1501 bp, Oryza sativa
agcagcgacgcggcggcagcaccaccaccggtggcgcctccactgccctcagccgccgccgaggccgccgccctcagccgctgccccatcctaccgctgaccatgagagagagaggaagaatgaggagagtgagagagatagaagagagagaggaagagtgaaagagagagcgcgtatgacaggtgggtcccatattttttaaatatagaatgctgactggattgccacgtgtacgccacgtagaccaaaaccaccgcggattgggtcgaggaggataattcgtccggtttgtatagtccggtttgtatagtccggttttgtggttcagggggtaattcggacgaccgcgatagttcgggggtaattcgtactttttactttcaaatataagtatttctaagcttcaaaatatgtaccaccatataagtatttttgcactaatttcaatgcatgaaaaaattatatattttttagttaatgagatagttggaaaaatataagtaattcaaaacttgaccactgaagtaactaaaagagatttgttttctttatctttttaaatacctaccagtacttaaattttagaacaaatgaagtatttggcaaagaaaaagaccctcaaaactcgacaccaactacatttgacgtctcagtgagtgtttattgaaacaaatatcatctaataaaattgaaacaaataagagggaatggaggtgcattgctttgtcaattttactgctaataactggcaacttaaccagattttaggagaggagagtctttgaaggtgggtttcaatcaaggttgtcagtatccggatctgtattctattatcttacaatattatgatcctaccaagccgaaacgataccgatcccactattcattatcacatgatcctttaaaatcttagatagcatcccgattctacgatcctaaaaaatattagttaaaataagatggtttaaaaataatgtaaataaatatactcaagtttatacttaaatatatcaaaactaatgtggtttctcttgataaatgtctctttgcatgtcatatattattactatattttttttatatagaatggctatatgtaactaatacaaatattaaacttgaaaaaagaaaaatctcaaatctcatagtatcccatgctacgatacaatactactttaagaaaaacggtactacctagtatcctgatactgataaccttggtttcaacccaatgttaaataaggttggaaacaaacagaaaggaatgaagcagtgtatattattgccaagttcaccactaaataaaatgaatttgaagtaagggatggaggtagggatggcaatttcacccgcggggccgggtgatatttctgccccgcggggatgcggggccggggccccgcatttggctgggtacaggggcgggggaaacattccacccgcgggtgacccatggggccccgggggtatattaaacctctcaaaatataatccattgca

SEQ ID NO: 14160 - DNA, 1501 bp, Oryza sativa
gatacttctagttgctcattactcatgcttttgtcttgatttagtcctaaaatttaaatttaaaggtctaatgtggtactccctccgttcatctatagttgacagctattttgaaacaaataagtgagcttggcggttaaagtttgttacgtgttaatggttgttagacatgacacgagatttgcttggtacgtgttaatgcttgctacatgatatcaagaaatacggcgcattgcacatgccctacatgtaaactttgtgaaagctgttcagaactgatcgagtttgtttgcatgacttatatcatgctgctgcaggatggcaacgggcaacatgttataaataaacagtttctctaagttattggttgagaatgaaaattagcatatgtttttgttttagagggtataattagcgattggagagatattggaggaaaccaaatgttaaatttaaatttggggtgtgtaatagttggttagatagtcagcaactctctttaatgtcatctattgagttgctagtagatgataaaaaaagttacgttaatttcatctattgagttgctagtagatgatagaaatagttgcattggaggtgatttgggatcatctagtctagtacaaatgttgccatgaaagatgcggtcgctaagtatgcattcaataataatgaactagtgatctatccaaatgaggtaactcaccaagatcgctatgttggagtccgaggagcaccacttctagtcgagccatgtcagactccgaggagcaccacttcgagtcgaaggccgaggcccggaaccatccgcaagaatgggtagatcgttattaggtttctacctcgaatactggtaagcacggttgttggcggatggcatgaggcccttcgaccaaatctgccgaaacccgtggcgaagactatggagcaagaacggcgtgaggcaaagagtcgtacgagtgccttgccaggccagaggcgtcttaggcgaagggtgcaagacgaagactatctgccgaaggaagacgacttcgccatggcaagttcgcccccgcaagggccgaggaagcctttccggcccatcaagcctaggggctatagggccggcgatcgccagacggcccatcaggggcccatgagcccctataacattatgtacccctgtaaatgtccctttcgcaagggtaatcatgtaaattcccctgtacaacctaaaccctagtagtaagaacctataatgaggctataaatagtcccctagggccatgtaatggggggatcccgaagaagaaattttaaattcaatacacttcgtttctttccaaccattgttgagtaaccacgtccttcgacgtatgcggttgtcatttcgacaacagtggcgccgactgtggggacctccgagcgaaaccactgagagcgaatgccaccgaagagagtcgtgaaggagaaggttgctaggcggaaggaaagcgacgccggaccgggcatggccgttgag

SEQ ID NO: 14161 - DNA, 1252 bp, Oryza sativa
acaactccactccagacttaattcctgaagttatatttaggagttggagttgtaccaagcagacccttagcgtgtcttggctttgttgctctctgcacacacaagaacggctcctcggttcccttgcatgcatgcaagcaagcaatcaatgacatacacacgatactagccagaaactattctaaactgagagaatactgagagaatgtttactcgttgtttatatgtgacttaaatgattatcaaacttttttaaaataaaaatcaacaagatagtttaataggagtatgtgatagatcgctccataaacatgcaatatatcaattttaacttttacatattgcaaaaaaaataaatttagttgtgaacatatattaactagctgtagtttaatttgtttttttttcgttgtgacttattttaacttgtatatttgcggagctttaaactatctttaagagtttaaaatcctctctgatactagcgcttcgattgacacactttgactacttagcttccctatacatgtgtgttcaccatcatttttctatatgcaggtcattttcaggacagcttattggctccggttttgggcacaactacagaggtgtgatgaagatgaagagtttctgaaagttgtatgccgaaaattggagagcacggttatacaactttttgccaattatgattggagatttacaagtagacttcaataatcgtgatctccgtacgttaggttggtttctttgtttttctcttatatttacactatattcatcatgaaaactaatatgtaataattggctgtagcttttttgagtaaaggctgggatattatattttattatcttaaaaaaaaatacatgtgtgttcacagctggcacatacataccgcacgcccaccctccctcaggagggctctggtggcgtttcccattccgcgcgcaccacactgccggtctcgtcgacatcgatcattctcgctccgcccagccaccgcctccatctcgacctcgagccagccccacgccgggagaaaccgacaagaaatgagaaggagcagggaggctgaccaggggtcccacgccttaatcacgcgcaccgtggcttgacagttggcaaaaggataggagggtcatttcggcgacgcgaccgagaccgagaccgagtctagggttttactagtactcttcatccgcttgccggtcgccgccggtgagcgtccgactcctcgtctcgccgtggtacagc

SEQ ID NO: 14162 - DNA, 1501 bp, Oryza sativa
tctgattatatatgggctgacattttgacgggctacactagcttgtactgcacgaaagcccatatattaatcctgcatagcaatatttgcctattcggcatctgtctgagaatctctttcttaattatcatcagggaattagggcccttcactccttcaggccctctggattcatttcaacgagaacctcatgctccttgtctacctcctcttaatctgtttttcttccggcatttcatacgtacattcattaattgcttctctttggcttttgctcaagtaaaatatggttaaaaattaatggatttacaacagaagacagtttgtacatcctaaagcaatgtacatataaggcttttatcgcgggaatttgaacttccaatcaagtgaaaccgattatatatcttccaatgaagaaaagaaattttacttttaaatgggaatcgggaggtgctatttcttatcagtctgttaaatttgatctcctaagtatacttcatttgtcttgttaataatgacaatattttcccatcataattaacctagagctagatttgctttgtatacctacttcttaattagccagcaacatatagacaaatgcatgggcatggaatgtttttctttgttttgtgtgaggaattaatagagagagggatttattacaaccaaggaaaaaatatatccagagagaaatcaataaagaaatatttccatggatagagaaatttgagacctcatcattcatcgagacaaacatacgatcggctacaatatatcgaggttccttctcaaggaagatcgatcgagccaccggccaccatgtgtgtgtccatgtccactatacgtgtacacgtacgtactctcggcgcaataattaattcatttctctctatcttttttttcatttttttttgctgacatatatagttaagcaattgttttcagatacttattattagtggacacaattttcaattgcgaccttaatttttaatcatgaatttgttcaatattattattattgtacataaatatttgtacatacctaacactcattacttaattagtcataatatatcagctagccatctcggcaagatcaggatatatatgaaggattatatatatagaaggatgggattttataacctccgtttgatattatagatgcattgttttttttctaagccagttttttttaaatatagttaaccatgttcacagacaaacttagcatgaaattagtttcattgaatgtgatatgaattatttttttaaaaaaaaatgttgatacatttttctagaaacttgcttaaaatttagagaaagtttagttttaaaaaatcaaagcctcttataatataaaacatagagagagtagacgttaaaataaattgagcctcaggataaaacaggccatcactgtatcatgtcacaatagtgatttgcctggaatttaatctatttctctgaaggaagatcctaattaaattaagag

SEQ ID NO: 14163 - DNA, 562 bp, Oryza sativa
tgttgatggctcccctgaaccccttgctcatatctttggatcattgttttacctggctaaattatgttatattgaatggaacatcatattttgttctttctattggtgatatcatctctttttctgttattggtttggtgcttcatccgattatatatgtttttctgtctgaaggctcaatagggataattgaaaaaggagctccagcctccaggcaatggcgttctatggcggtgtgtgcaatattctaattgctaaggtcaatattctaattgctagggtcaatattccgacggacctaagccacaccgctcgcctcacctcaccggcgccgccatctccatagccctccccacgccgccgtgccgcccgcctcacctcaccgctgagccgcctccccatgccccgccttgctcccctctgccctactcctcccccaaaccgcatcttctccccgactctcccaagctcccaacaactgcatcggcacttcgtcaccgcgcgccgctggtttctccgccgccgcccaccccagttcctagccaacgtcgtcgccgacatc

SEQ ID NO: 14164 - DNA, 1501 bp, Oryza sativa
gtcttctaccacgcctcgtgcgaggccatggccgcggccgtgccagccatcgtcatctccctcgactaccgcctcgcgcctgagcactgcctccccgccgcctacgtctccgccgtgctctggcttcgcgacgcggcggcgggggacccatggatcgacgcgccacgagggaggtcgcgggtgcgggggctgtcgccgccaggtgccctgcccgctcctgcccgtcccactccgaccgccaccgctccttgcccaccccacttcggcggccgccgctccttccccacccactccggccgccgccactcctccctgccgctccgccgctgccacccccaccgctccggatggagagagaagagggaggggatagagagaaggggtagtgagaatgacaggtggggtccattagtgtgtgtgtgtgtgtgaaactgacatgtgggtcctgtaggttttattattttttttatcgaattgccacgtaagcgctacgtcactgccacgtcagatgaagaccaagtcaaattagccacgtaggcgccaccttagccaaaacaggggtcaaatactgcccagggaccttatttaaacggtttcgtaagttgggggaccagtcgtacccggttttacgatcaatggatgaaaatcagactgggtgacaaattgagggacccaaagtgaacttattccaaggaggaaacagagagaaatatttcaagtttcaacctatgtctaaagcacgcgtttaaatatttgcggcaagtgattgaccaaaccgtgtgattgtgatccattgattaggtcaagcatcgccttgatacatgcctctgttctaaagcagtggcagtttattaacctgcaaaacaacccaaaaacagctgttccataaagcattttatacgcagtgctggagcatagattatagcgttcggatggtttcttatcgtgttaaactggctcattataaaggaggatatgatcagtcgattttgctggtttctgcaagaaaactatgctaacaaacttgcttaacaaaagtagttcctcattattttacttatggacgatggctcatattcaattcggtaccaaaaaggttcatcaggtaaatatccgtgtaataagtaacattttgttaagaaaaagcctgtattatgtttcagaaaataaacaaagaaaaatcctgtaaagaggtcggcattactcgcaagaaaccagtagcactttacatgcctgtcacaatttggtaattgataagatggagaagaaactgatctcttctttgacaagcctcgcattgacgcattctgaaagcctggatttgcattagatctctatcatacaccgaaaaaaagcaccggttgttaacctggctaatagtgacgggtcaatcgcacatatttagcccattatataagcacacagtctcatcagcatcacactccaaaccagcacattcgaccatctcactagctaatcgctggtactggaagcagtagta

SEQ ID NO: 14165 - DNA, 1501 bp, Oryza sativa
ttttcgtaagttgagggacgggttgtatctggttttgcagtcaagggacaaatagagggacccaaagtgaacttattccaccctgcctgtgaagacctaagagcatcaccaacagcttacgtataatctttccctaaaaatttgtttttgggtttcctaaatcgaaaataggaagtaaaaaaactactccctccaacagatagcctaaattcaatccccaaaacttaaaagtgggcccttctgttaaactaccaacagaaaattcagttttttttctttcacgcgcagaaagatcgctttctccacgcgcgggaataggaggagaggggcgggagtgcgagattgggagcgagtttcacgtccgcatataaacggagcgaggaatcgggagaagggaactccaaaactcgggtaggagagaaggggatctgttggagctaattttggactaaaatcccttaaaatcagttttgggaatcagatagctagactgttggtgatgctctaaggaactcgcagcaaagtctgtcgtctagatatgggccgccgcccgccggccgacacaacctcgccaccctcgtcggcggcgcagtgctgctcttgtacggtgggtggcgtccttgccgccgccgttcctctcctcgccgtgggatgcgcgtcgctgctgctcacctctccggtgattggtgctaggtgctccccaatcttcatcatcaaccttctggtacttgttcttctctctattatttctgtacatcttgtggtgattgatgttcttcaggtgtttgatgaaatgccaatgcagaaagttttgttgtatcaatttgtaagccttgtttcttgctttttaaaatgatttccatgcggtgtgaactagtaatttaatactatctttttattaaatggatgcaagcattctgagatctgtgtagtgcgtggcttaactagatagggtggctttcttttattggaatgggtggatcagcttttgaattgtcaatacagaattagtgcaagctattcagtgtgcatgtcaaacaatgccatttaattttcattttattttctactatgcttattagtcttttgtgcttatgaaaataacatactattttcagatgttaatgcatagatgtttaggttctgaattcttctcatattatatagggactaacctaaaggttcagtctactgaagaaatatcagtaacatcaccaaacaccaaacaccaagcaccaaacagatccgttgaagaaaaaattacaaggtaaagcttgagatgcaattttgaatcaaattttattttaagttacctgccaccatgcatgtgcttgctgaattaagttttcctcttcattttaccaactaaacattgttgtgactatctagatatatatatgcacatatatagaattgtattaatatagctactagtactgtatatagtgcgtcgttgcaataaaactagatagttagtttaaacacacgaaaataactttta

SEQ ID NO: 14166 - DNA, 1501 bp, Oryza sativa
aatatatgctggtccagtcttccgaagttgataataagggtaggatgtacgtgtatgcgttgggatcagtatacgcgcattttgagtgtctgcatttgcaccaagtttgaaaaaaaaagagtttgcctaggctcacagcacaggacacatgcattcctatctgtatgtgatcccgtggtgcctgatctgattgcgacgctggagaaagggacagcatgctaacttattaagcatgcacgtcagcacgtgtaacaaacgccgttgataaaatagatgtggtggtgttcacccaatattatatatggtttgattgactaaaagtaagtttaatagtatagcctactgctagtagtttcaaatcatctatagccaatgtaatagataattcatacaatagttgcttactatatacaattagtacatggtcccacttgtcatacacacattacgtcttgaagtccgtgctgcagttggctatagatttgtagcccgctactattctctctcattttttctctcattaaaatatgtttacagctggttaatagcctgctattgtacacactctaagagaactaaaagtaaaataataggcaaatatgaatggtgtggtgttgtgggagcatgcagcatgctaccacctattacaatttaaaatcctgatgtacctaataatgttatgtatatgtgaacgtaattttaatataattttattgaggctagggaatttgttgttgatctctgtctctaaggacgtgcgagatattcgtggttgcaaaacaaagtggtggtcaatctatactattgcatcaatttaaaactcgtaaagtattattattgataaagatatagatctaaatatatatatatatatatattacatgatgtcgtcagtcttgtcaactgctgtgtgaatcacctattagagggtaaggtattgtagaactgctgtttgtagctgtattgtgatgacgtgggaataaattttaaactctccgtctcattgttgtttacatgtcgtctaaatagttacgacaaaatttaacaaaattaacatggtaaattaatatgatatatatcactctacagatatacaattcaaaatttaacttctataagttgtaacaaaaagagctaatgaaactatagcaagttaatgtgtattcacaatttaaacttgtatatttgttgaatgatatatcacatgcatatttattctttttcttaacttgaatacgttgaatttaaatatgtacgtacgtttgttgagtaatgtatcacatatcagtgagatcttacctaataatataggcgccgttgttttgccttaattagccagatctaatccactgttcatctgatgtagcagacatgacatagcataaattgcacatgatcggacactatctttgcctgcttgctttgctacaatacagcctgcctgagcagtgtatcacactgtcgtctgtcgtcgtcgtgccgctgatcaatttggccaaag

SEQ ID NO: 14167 - DNA, 1501 bp, Oryza sativa
gagctgattaagactattggtactatgcatagtacgtgttttccttaagtgtaaatattgctgcctgcccctacttaatatagcaccagcaattgttgtcttggattcaaaaaaaaagtatatgtagttttgtgaaagattgaataaagtatgagtagtttgtgaaatttactcataaattcactagggctatgtgtgtggagcgaaagatttagcgagaatataatattggattgattgagacagttggccgcgctatccaagcatagtgcagctcaccttggtattatagtgttttccttgagtttctgcctacaagccttgcttgcactttaatttgtaatatattgctgcccctatttaatatagcaccagcaattgttagcttggattaaaaatatatatatatatatatatgtagttttgtgaaagattgattaaagtatatatatatatatatatatatatatatatatatatatatatatgtagtttgtgaaatttactcatatataattaagttattaaattatttgtgtttttctatgtttaaatggagcttgttaattagtttataaagtgatgtatgacaccaaaatatatgtggtcaaatgtttgtctattttgttttcaaaaatattttgatggcgtgcatgaaaacagagccctagctcaagcctctgaaaaggggtggcacaacattttgtagcgaacacgattgaatagcatctgtgtggtgtactcaactatgtaggccaaaaaagaaagacatctcaaacaaaaagtgaaaaaaaagactgaagcaaccaaaaggtacttcctccgtttcaggttaattatgagatgttttaactttggtcaacgtcaaactgcttcaagttttactatagacaatttaagtaatatttacattaccaaattacttttattaaattagtaattaaatatattttttataataaatttatcttaagtcaaaaagattactatttttttttctataaacttggttaaatttgaagcagtttgacttctttgaccaaagtcaaaaatatcttatattataacctgaaacggtgggagtacttacgtaggcctctctgtgatgtgagtgtgatatgcaaattagcctacgtacgtgcgacatgcataacatacacgcattgcatttgcatgcatgctacatagctatcgcttgcatttcactccacgaatgagtatatttcctgtgcaaaagagtacttgaagttataccttacgaatgggtaacaaagacaattactgagtcacatatcaatgcacaagcaaacaatatcaaatttaattaacatagagagaaaaaacataataaatcattctttttcaaaacatagtacaagtattaattatgcactcctatacacttacgcacacccactaatataatataaacatacacgtacaccatacacctccgaagaccttcgatatatctgagatagataaaatcatcaacacaagt

SEQ ID NO: 14168 - DNA, 1501 bp, Oryza sativa
aaataattagccgtaaatatgatcacacctataaatccaatatttagatcacatccgtacaacaaataaggatgcattctcaaaggctcgaattctaattaaaaaaaattgaaggtagaggcgtccctacattttttaagaataaattgcaagcgtgttggggattgaacatggaatgaaaccgcacacaaattccaattccattcgtggccaggctcgacggcaacggcccacgggatctagagttggcgacccacctcttcgtcgacctccgtccaccctcccgccggcgatggaggatggacacgacaatggcttcgtggagctcgattttcatttctttttcaaaatctggatccgatttctattttttttaatccaaaaaatgttttcactggcggttgtctttatcttgccgcggttatcttagcatgcctcctgttaaactcgattttcgctagcagctagctggccgctagtaaaaaaacattattttcactggcctttggtcattggcggtgccgttggccgctagtgaaaatccattttagccgtcagcgaaaatgattttttagtattgggtgagaaaatatctgtttgggtgtgagcatgagctcaccgatttttaaaatattgtgtcacgtaagattaaaaccactttgattgaaaagggggtaattcgtctggtttgaagagtttaatttaaggtgtaacatgtttggtatttgtattgaaaggggtattttaggctgttgtttgcttaagacaagtatcatcatgttgtttgcttactagatgtttatcttttgaggaggacatgtgcatggctgtcgatccaacgatcatcaaattcaaaagtcataagcatgatggtttcaaagggtcttgtcaacatggatcaacctttaagagcactcatagtggctagaccatctgacagctgctgcatgccctttaccgagcagggaatccatccaacttcgattctcatgtgctccttgccttttgctgctagctactccctccgtccaatatatctctagtcgtaggttgctatattctgggacggagggagtatctatctctctcatccgtcctaagaggatatcacagatagatcgatgagcattcaagtttacaacggataagtctgttatccaaagtacatactctccccgtctaaaaaaaagacaaaccctgagtttccgtgtccaacgtttgaccgtccgttttatttgaaaaaattatgaaaaaaaattaaaaagacaagtcacgcataaaatattaatcatattttatcatgtaacaacaatgaaaatactaattataaaaaatttcatataagacggacagtcaaatgttggacacggaaacctatgatttatctttttttttaacggagggagtatatatgctgttttgatctgttcgcgatgaaaatactacttatgatgctgaaagaattacatgtttccctagtcatgtttgttgtcctggtcgt

SEQ ID NO: 14169 - DNA, 1501 bp, Oryza sativa
gcggctacgactcccgcggatctgggaaggtggaggaggaggagggcggcgcgcatacctgcagcgccggcgaggccacggcgggagacgaggcgggcgagcggggaagacgaggaggacgccgccgccgccgcaacgagacgagatgccatcgcttcttcttggattggttcttccttccaggcaggcaggtgggtgaatgctgttcctcgcttttgtttctaggcctagggtccctgtctccgactttttgcgggctggaccagctgtaagaagcatttgggccggatgggcttactcacaacggaataagttcatctgaggtcccttaactttacaccgaatccgattttcgtccctctatcggaaaaccagacacaacgggtccctcaactatcaaaaccggtgcagattaggtccctcgacggttttgagggtggttttggctaacgtggcgcctacgtggttaatttgactcggtcttcgtccaacgtggcattgacgtggcgcttacgtggcaatttgacccggaaaaataataaaattcgtgggacccacatgtcagtctcacataggaaataataaaaaaatcgtggaccccccacatgtcagtcaaactcacccttcctcttcttcctcctctctccccatctccctctcttcatctctctcccatctcctctcctctttcggtgagagcggcgagctggagggggcggcgagaccggcgcccaccggcgagagcagcgagctggaggaggaagccagggcgataaaaggggatcggcgacggcggtgggcggaacagatcgacccgggcggcggcaggtccccccggagcaacgccagcaatcgagatccggtagtggcggccgggagaagggcggtggccggcggggagaaggggcggtggccggcgatggccgtcagaggaggaggagatgcagccatgcggggaggcgtggcggtggcagccggaggaggaggacgtctgctgtgcgctactccccccggtagtggcggcggcgcgggggccctgggagtcgccgaggatgctgaggtcgacgtcgacgtcgtccgcggccacggccatggcgtccccgtccgcatccggcgtgcgccacagaaccggtggcatagggagcggcgcctcagctgctgcagcggcggcgtcaatggggggaaggggaagcggaagctcctcgctccggtgggctgccgctgacaagctcggtggtggtgaaacgcgacggatcgagcgccatcctggtggttgggggccctcctccgacctctactccaaaccgccgccttcgtcctcttcacccgtcgccggctgtcatcctccttgctccggtgggcggtcgctgacgagctcggtggtggaggcgggttgtggcggagggcgatcgccgctccctctcccgctggccgccgtcggctgcacatctctccctccgtccatcgtcatcaagcacccgcccacggcgctcggccatcg

SEQ ID NO: 14170 - DNA, 1501 bp, Oryza sativa
aatcgattcctagactctgagccaaattttttgttttatagtatttgcttgtgaatcactaaagacatatgctttacagataaatatagtaatgagttatttggaaaaacataagcgagaggatgattgaaagcatacattttcagattattgttaagacaaacaaaggcatacaaattagtaatactaggtgaaaccccgcgcattgctgcgggaatttagtacgataacaataaaaaaaataacgtgtaagatagctacataacattagattaagtaaattattatggtttatgctaatttaaatttaaatagtatgtagaatgatgattcaaacgtaaaaagtaaggtggtatgactttatggaagaagaaaagtaggaagatagtttggaccgtagattaatcatctaaaggctaaaaataattgatgtgatatgacttaattagaggaaaaaaggagaaagataatttggaccatagattaatcatttaagcactaactaagtgaagatgaactatataagtatataggatatcataaaacataataaagatatacattgaaacattatgtaaattatgttgggtgataatttaacatgtttgtatttgaaaagctcttaaactataaaaactataaagatataatatgtttgcatgatgtttaaatgtgatgattgttagtggatgatgatgtggcatcttcttaatgagtggattaggccattcacaacccaagacactagacataatttccataaactctacatcataaaaaaactagtactagacactactcttccaatgcaaacatcactattccatacttaaatttaatgctacttatctcacatgatgtcttggatgttgtgtagaaaccatgtctcatacaagacatggtttctttctctttcctcatttattcactttgacacattatttttcatcttaggtggtaacttattcaatgatatagacaccatcctaatcattgggttataaatggtccagtacggggaaggccgccatgtaccacggcgtattgagtggctgcagcggccgagtggcgagagcgttgacgatcaggaatgggaatttttttttccttttgttctggttcttttctttttattttcttttttttcctgtgcaatccgtttccggttccgtatgttttgccacgtgccgtgtactgatgggcattgagaacaaccaatcatttattaagaaatcacagattggaccgttgcatcatatctatcattgatttacaatcaaacggctgagggaggcctgtgaatacgtggcacatcatcaatcaataactcccctaaccattcctttttcttcggtttttcaattttttctggctatctcattttttacacgtcttcgttttgtgtttaaggctcctcgtgcgcgcgaatgtgactggttgttcgcggttcccacggtcatttctctgtttccatagacatgtatccccttcgtgtccggtg

SEQ ID NO: 14171 - DNA, 1501 bp, Oryza sativa
tgataatcggaaaggaaaatgcttcacgtacgattttcacgtacgatattactacgatcaaacacacaagataggtggcacggcagtcgctgatgggccctgaagcccatacacaagctcatcagcaccctttgcctcttaataatttgcttattattatgctgtaagagatttgctctggtctaataaaaatacttcggggtaccgatacctcatggtgtcaaatcatttccgatcgttgaatctagttggacagaatgcgtattgttagatctaacgataagaaatgatttaataccgtgaggtaccggtacctcgaggtatttttattggaccggagcaaatctcttaattaattgttgttttagaagatgactatcgtaaatgacctaaagatatatgtcactatttctttgtgcaattatcttcttattcaaaacaagtttatttttaagcaatctggcatttttttccgagcagaggcgaatctagcataggggcagcggggtctcgaggcctcactactggcatgaatactatgggagcccccacaaaactcttgctaaaattttttgctacatgtagatggaaagatcgtatgtggctttgtctagtttatttagaacccctgctatcccttcctagatccgccactgctccggggttccggcgccaaaggattttgagtggattattcaattctaatatgtgcatgtattctctttgttataaaataactcaattaaaggaaagagtagtatgtataggacccgccccggtacaatactacgtcaccacggcacgtaactatcgtggtcgtgagcaaacgaacgtgcatatctgtaatgtacatatgcctattaatcacaggagacgccaccagctactatacgagtgtgtttttctccatgcttttccaactcacatttctcgtttttcgcgcgcacgtttttcaaacggttaaacggtgtgtttttttaaaaaaattctatacaaaagttacttttaaaaatcatattaatccatttttaaataaattaaatacttaattaatcataagaaaatgtgtcgctctgttttctgcgtgcgcgggagggaaattccttttcattgacggttaacaccgaatttttttagcagtccgtccgataagaaaattacggtcgttattagcttttcatagctctaagaaatcataaaaccaccaacttaatatgatctacaccatcaaggtaacatgtcatttttggccctcccaaccgcgaagcaatatggatctcttcatttatttccaggaaatagcttggcgtatagctaatttcttttgcggttaattttaattcaccaatatttttgctagtgggttcattactgtagtattaatcgaaagggattccgaatcgctttcgatatttttttttccgaatttctctttctactgatcctattaggattcacgtacgtatactagattataattatccctttttaatcgtgtgct

SEQ ID NO: 14172 - DNA, 1501 bp, Oryza sativa
cctcctttctccccatctctctctctcttcatctccctatctttgctctctccaggcgccatggaagacaacagcgcgcggcggcgcgcggccggcggtaggagaggagggagcaacatgtaaagaccggcgaggcgagcagggagggaggacgcagggaggccggcgatggccgagcgccgtgggcgggtgcttgatgacgatggacggagggagagatgtgcagccgacggcggccagcgggagagggagcggcgatcgccctccgccacaacccgcctccaccaccgagctcgtcagcgaccgcccaccggagcaaggaggatgacagccggcgacgggtgaagaggacgaaggcggcggtttggagtagaggtcggaggagggcccccaaccaccaggatggcgctcgatccgtcgcgtttcaccaccaccgagcttgtcagcggcagcccaccggagcgaggagcttccgcttccccttccccccattgacgccgccgctgcagcagctgaggcgccgctccctatgccaccggttctgtggcgcacgccggatgcggacggggacgccatggccgtggccgcggacgacgtcgacgtcgacctcagcatcctcggcgactcccagggcccccgcgccgccgccactaccggggggagtagcgcacagcagacgtcctcctcctccggctgccaccgccacgcctccccgcatggctgcatctcctcctcctctgacggccatcgccggccaccgccccttctccccgccggccaccgcccttctcccggccgccactaccggatctcgattgctggcgttgctccggggggacctgccgccgcccgggtcgatctgttccgcccaccgccgtcgccgatccccttttatcgccctggcttcctcctccagctcgctgctctcgccggtgggcgccggtctcgccgccccctccagctcgccgctctcaccgaaagaggagaggagatgggagagagatgaagagagggagatggggagagaggaggaagaagaggaagggtgagtttgactgacatgtggggggtccacgatttttttattatttcctatgtgagactgacatgtgggtcccacgaattttattatttttccgggtcaaattgccacgtaagcgccacgtcaatgccacgttggacgaagaccgagtcaaattaaccacgtaggcgccacgttagccaaaaccaccctcaaaaccgtcgagggacctaatctgcaccggttttgatagttgagggacccgttgtgtctggttttccgatagagggacgaaaatcggattcggtgtaaagttaagggacctcagatgaacttattccgttgtgagtaagcccatccggcccaaatgcttcttacagctggtccagcccgcaaaaagtcggagacagggaccctaggcctagaaacaaaagcgaggaacagcattcacccacctgcctgcctggaaggaagaaccaa

SEQ ID NO: 14173 - DNA, 1501 bp, Oryza sativa
taccaatttcagataacacaagaaatgaccaccaacctttgctgcacaaggagttcaagtgcctgcttgttgttaccaagaacagggtggttttcatcgctctcatttaaacccagccgtctcaattgatgccagagatcctctgaaatgtgattggcaaacttcagaaatataatcgtcggtgaacttttcctgactgacatactgataaaacggaaaccattaccttcagaaatttttccaccggacagatgaacaatgctaatgacaacaaaagcgaagccagacacatgggcagcctccttatgctcgacgtacttgctgtacacctcagggtctaacttactgaccaggacgtagctcttcgcatccacattaactaaaacgaattccaattcgctagtcattttatcaaattcctcaaggagggaataagagcagaaggtaagttaccctgctgctgggacgggcggccagagcgggtggacggggcgcgtgtcctctggagctccctcatctcgtagccaaatgtggcggcgagcctgtccccggcctccttgatgacgagtgccgggagcacgcgctggcggtagttcttggtaacgatctgcgtgagctcctcccgcttgatggggcagccggcggtctggtgcgtcttgaagagcacgtggcgcatcacctccgctacaagcttgtccttctcctgcagccgcagtggcgcaggacgggctggtcaattcgtcaaacacctcgcgtgcgcggagcctagtcgcgagacaagcgggaggaggacggagggggcggagagagagagaggagtagtacctccgtggagatgtcgatctgcgcgtagtcgtcgctgacggtcgccatccgaaccaacaagggaaggaacaggcgggggaagagaagaggaagaggaagcttctccctaggtcaggaatggaggattgggtgaggaatcggcggtgaggttggtggagagtggggcggcggaaggaggaggacgcgtcggccgatctggttgcagcggtcggcggcggcggcgcacggggggacgaggggagaagggcggcggcggaggggttgcgtgcaggttgaggagggagggagacggcggagttcgcgcgcaaaagctggcttttggcgccaccagttttagctgaatactttatgggcctaaagaggcccaaatcatgaagcctctgtcgctccccccggcccactatcataacaaaataaatttataaatttttacaaaacttattctaatatagttttttttaaaaaaattaaaaatttatttcctccgtctcaaaatataagcatttctagttattaatctgggcaaatagttattcagatttgtagctaaaagttattatattataagtgagataataatagtaatacagagtacttgtgttgtggatgataagacaaaatccaatatatattacctaataagtggaacggtttattagaaaatactttctcaatt

SEQ ID NO: 14174 - DNA, 561 bp, Oryza sativa
atgtggaaaagcaaacctgggataatgccggcagatggcaacagctttgctgctgtgttgtaaaatcattcatcgatgagaatactggcacaacagaaagaaggcggggggtgtgcatcaacctccgcggtaggagtcatctctcctcgggcgtgtagataacgaagaagttgcacacgatggagaggaggacggcagggatggaggttgtccggtggcgtggagttgggcagtgggcgtccggctccggggcgtcgagggtgaagacaactaaacatggcgcacggcagggatgcgcacgatgaagacaggcgatgagtgcggcggaggaggcagcgaatgggaaagacctcgcctccggttcagtgcgcgacggcggcggaaggggacgacctcgtgggtagcggtgaactgtggcggcggcggtggatggggaagacctcgtctccggcggcagcggatggggacgacgtcggctccggccgcgactggggacggatggggaagacctcgcctccagcggcggcggatggggacgacgtcgactccagccgcggcgga

SEQ ID NO: 14175 - DNA, 1501 bp, Oryza sativa
aactctggttgtcattccttatccggaactcctcctatatccgaaggtgcttccgtataggatatggtatatagtgggtcctgccgagatttagtcaactactattaggtatgtggtatccataaccctgacagtagcccccgacttcgatgcaaatgaacgagttcatattctcaaccgcagactttggaggaactgttatcgagctcatgtgaccgttctcggtgagtttagagataacgttagacttcctctatcagcctcgtgcgggcaccgaaagggtttgtctaagtcaatctctgatgtcgaccgagaaagtacagagcgtacgactaagtctcccgtcttgctgtaatcgagaatttggattgaagtcaagaaattttatctcggcgggtacaccatctcttcattccgtattcctcaacaatactcagaaaagaatagaattttcctgaaatcaatactcagaaaagaatattagatagaaataacccctgagcgaatgctcaaagggtgacatgttataatatgacagattagtgaattgaatgtacagaccagtgttttgtatatgagcgtcttctctcttaccgactccaatcagtcagtttgcagagtcatacactctcccttgcccctagccttgtcgtcggagaatcgttctcggatgacaaggctcttggacctttgacctgcctcggttgaacaagcactgatcctagcccccagccatgaagttggaaaactcaatttccgattacacggcttggttaatacgcacggcgagaactcttacactaccagatcttacatggtctttcgtctctgaaggatccgacaaggccttattggctctgggcgtccccagccgaagttcccttaggttcctcggaggccttgtcatgacagcgtaaagggacaatatgataggtttcaacgctaggtgtcttttgtgtaagggatctctgggtaaaacacttggcgatcttgtgtacctgatatcaactttgttggagtacaggtaatgggagaatcgctacaccgctggtcgaggaccaagcagtggtcgtaactcgaccacttaaagtggaagtagtgggagaatcgctacaccgctggtcgaggaccaggcagtagtcgtaactcgaccactagaagtggaaatagtgggagaatcgctacacagctggtcgagaaccaggcagtagtcgtaactcaaccactataagtaaatgtacgagagatcgctacgattgactggttgagaaccagtgagtaggtgtccctcgatcatttgaattcgtggtgcgaggaccgttgtgttattgctgtagtcgtacctcgaccatctaagattgcggtgcgagagattgctacgtactggttcgaggaccagcgaacgcgcagaatcatctctcgacactaatggaggttgcggtgcgagagattgctacgtactggtttgaggaccagcgaacgtgtagaatgatctctcgaa

SEQ ID NO: 14176 - DNA, 1501 bp, Oryza sativa
ttccgtctcgtttgattttttttctggttaaacattttcaagtttaactaagtttacagaaatatagtaatattttcaacacaaaataaacatattcaacattacatttgatattttatatgttgctaattttttctgtaaactcggtcaaacttaacaaagtttgattagaaaaaaaaagtcaaactacttataatatgaaacggagggattaataatgatcttatcaacgttgatgatcttctcttaagttgaaaaaaatggcctcttttttcatttttatgaaattggaaatcctcaacaaacccatccttcacaaaaagaaaaaaacaggccatctctatttgtgtttaattatgaggtgctcggtgctccatgcatgtgtgtcgacatgtcgctcttgtacgcacttgaggacatggccatgcgtaaaacagacttagaagagtttagcgacaagatgaccgaccatggaagagtgtagctgcgcatatgcaaatcaggagaaaaggagttgaccttacttagtcaatgttgcaagtaaatcaggtttgttgcttttcttcatttttatttattttaatatgcttctgcgaacaatcttaaataataaattcacatattagcgggagtacatatttttaattaataatttaattgttagaattgttaataaatttaaattattttgctgcaaattttaaatattcaactttgcaattaaattttgaaaactcattttcatatgaatagataaaatgatataaaaatatatcagttgatatctatgtgtaaaatttccaataattttttagatgatttcactaatatattccggaccaacagcctacgaaaaattagtcacatggaagctgcctggatttatcattttcaaccaaatcatacctgagcagattagaagatacatatgtaattgatcaatacatatgagaaaaccaaatgggaagataacaaacaaattgggcgagaccaagagctattgagcagtaggagcattgtttatgccacaatttaaacacggtgattacattatttacgattgcaaccaattgatcgggtataactattttatgatttgcatagttgatatgtgatttagcatttaaatactaagattgactaattaactagtttctaattcgacttattcaatataaatgtaatttttgattaataaagcatttaaccaataagattaaaacacatatgtgataactcaatcgatctgtgggggcgttcctaacgttgcttcggaatgaaaatctcgtagctctgaaattattaactttttttttactaattcttgactaattttgttttatcttgcttagctacactactagaaaacagcttttcataggcggcctaaacagatttttgcaggcggaccagttcaccgcctgcaaccgaatgattgtgaaaatagttgattctcgcaagcggacaactggtccgcctacgaaaatagcacctggaatta

SEQ ID NO: 14177 - DNA, 1501 bp, Oryza sativa
ctaatctcacccctttcctatatgcaatttctcgagaaaacaaacctgatatgggttcttgtctgagttgctcatcagttgtatttgcacaaaatactatttcttcaaacttctagctacaatttcagaacctagattaggacataagcttagtcagcaacatcttaggcatggtgaacgtcatgacagttgaagttgcaattccagataagagaagtataatttctgtacatcctattaacataaccatcaaataatatttcaggcagctaccaaatattttcagacaataatacttcttaatctacatagagattaaacctatgtccatgcataaaaaaagacataatgtccatgcataaaaaaatgagattacatttacatagacattttttgcaaagcggatgccacccggttggataccaacattcttacactgatcgccttaaagctgaatgacctacaaccatttaattatgttatcaacatacccgtgaagcagaaaattgagaaccagttaagcattgccaagtgcatcatacctagccaagctctggatcttgggactgcagtaccattgtaacagaatctttttcagatcattgaggatctttttgtaactgaattccttctagccctgaacagtagttctattgctggatgcacacatgcacataatctaaacataaacagacctaaacagatgataattgaaagttactgtgggaaccacctcggcggggcgacttgcggcagcggtgaacttcggcaacgacgacgacgctggatggggatggcgtcggctctggccgctgcggatggcgatggggaaggggatgttgaatgtaatcttgtaggtgggtcaatttagtttttcaaatttacgaaataatcgagcttgactcgtgctgtgttcacgaggagttcagaacgtagaagtagtcgctaactgttttttctgttatttcgtctgttatttcttagctgcaaactcggtcgtgatcgatcgtgggatggtgcgattcagtaggattggagcgagttttgtggatcttttttcagttgtaacaaactcctggagttcggagtataaataatagaagagaaccgagaaaatgcggccaggttttactcagcgccaaactctgtttcctctgttcgtcttcagtttcgtcagttactgtagcagtctgaaaactctcgtttcttcagaacgtgggagtgatacacagagctgagtggtgaggtttgagtgctaggtttgccaatttccaacaagtggtatcagagcggttcattgccgattatgtggccatgtcgagtgaagacggaaatccacggtacaccccgccggggcggcgtggagccgccggcggaagcggcagctcaggcgccggcaatgacgggcagattgtgatgcagcaggcaccgcgagagacatgcgtgccactgcgttaccccgtgctgacgagaaccaactatgccgactgggcgttgttga

SEQ ID NO: 14178 - DNA, 1501 bp, Oryza sativa
ccactaaacctcgtgtgatacttgggccacatctagggcttaggctctttgtctttcagaagcccaagaaaattgattcatttggatagtgtaatgttatcaaaaagtgccaagctgaacattggcttcaaactgaacccaccagtgtctactatttaagttaccaaaatattagtagaacacgttttaattttaatccaaaatagtactgtgattagtcatatccggtatcaccaaagcaccttgtaaaaatgtacggagattaatgaaacgatgtagcttcatgtggtgctctttttattaaatagcgataattataagtcatctcgttgattgtatctgttaaaaggatcataaataaacacaaaaataaatacacatcattaggagtagaaagttacatcaatctagcatgagaaattcccccacactgaataaagatttagcaatcaaattgtttacctgataaggctgcattcggaggtagaggttgaaaacttcacctccttgtatgtaaaatttgtatgtaaaatgaagttgtctattaacacattattaattagaaattagctaaaatgaacttaaaaaatagattaacagatttgttaaagcagcttttctatagaatttaaaacacattgttttatagtttaggaagcgtgcgcataaaaacaatgaagtattagacgaaagaggtggtaaaagaaaacaccataaggctgagcgactcattagtacctggttaattaagtattgattacatactccttccgcttcaaaatataagtatttttacaacagtgccaagtcaaactttcttaattttgaccattaatagcaacaaaaatcaatcatgtaaatttgatgttacttgatctatcattgaacaaactatcataatatactactatttttatttaaaaaatcttacttttgtagatattgttagtcaaagtaacatctcgaatatcatatcaaaattcaaaagtgcttatattttaggatggagggagtaccattgaacaatttggaaagcgtatgcgtaaaaaacgagaaatataagttaggaaccatggctaccgaacacaacctaagttgtcttcttatgtgcttgttcttctcaagtatatcctttctttaactttattaggttgaacttttgcttttggtttatccaaaaacattataattgataactatagctttttttttctaagtaaaggctggatgtatccaatttctaagaactctatcatcacgagatcaatttctcagaacttccacgaaaaccaaaaacgccgtcccacgcggacgagatgcccgacggttcacgaaagcgcaaatacttacgttgatacgtcttccccactgaaaggcgtaaaatgaaatttcccgtaaccgacgagccggaggaatcgatcacacgagcagagtccagaattttccatcgcttctcctctcctctcctttctgcttttctctcgccttttatttcttcttc

SEQ ID NO: 14179 - DNA, 1501 bp, Oryza sativa
  unsure (1)..(1501): unsure at all n locations
tgggggcatactttgagagaagaggtgggagaggtggcctcatgcttggacttcttcgtgctcccctccgaccctgccgcctcctccgacctcttcttcttcccctccttcccgccaccgccgctgctgctcgtcttcacctgcgtgtgaatgcaacacgtatatgatcagatcatcagtgcgtgcatcgctcgatcactggcgatgaaccatatatattactcccttcgtgtcaccgaattttttataccgtttaactattcgtcttattaaaaatattatgtaaatattatttattttggtatgattttcttttattaatgtaactataacttaacttaaattttatatatttgtactaaatttttaataagatcaataatgcaaacgttatatggaaagttgacggcgtaatacattttggatagaaatattatgtatatatacattacgtactggggacgagatctcctgctgcccttgctgcttcttgtagtccgccgacgacgtcctcgccggcgctgacgacggtggcggcggcggcggcgtggccatcgcgcctccgccgaacgatatcaggtccgacaggctcctcgccgcgccggcattgctgctcccccacggcacgtccatggtggccgtgccgccgccgccgtacatcctgctgctcagccctagcatggagctgtacgacgacgacccggcggcaagccccatcggcctcaggaagtcctgcccgccgccgccggtgcccgtgctgctgctgctctcctgctgcagcatcgcgccgccgccgcccccgccgctgtcaaggaagctgctgccggactgcttcacgttcccgccgccgtgggctgctgccatggccgcggccaccgctgggttatcgcatgcggcggcgccgccgacgtggtggccgtggttgggcggcgcgatggaccagttgctgaccaggtcggagaggttggccgtgagccgctccggcgcgcccgcggcgtggtggtggtgcgccagcgcgccgccgtaaccagcggcggcggcggagctcaggtgcttctccagcgcggccgccgccctgcagtggtgntngggccagcctccccctcctccgccgccgccgccgccgtactccatcttcttgaggtagtcgcacgccggcggctcggcgaagagctccggcgcgagcgtcctcgagttgagcagctcgaggaagttctcgctgtcgtcgtgggcgtcgtgcaccgccggcatgctcctcccgacctcgccgccggcggcgcccctggccatcatcgaacagatgagctatatatgagctgaagtgaacaagctagctagccatcgagttgcacatatatataattgcatattattatgcttgctaatgataatccattgcatcattaggcaatcgattaaagtatctggttagctagctagtacacatgtggagaatgtaaagagagggatcatctttgggaattgggattaaagtacttgc

SEQ ID NO: 14180 - DNA, 1498 bp, Oryza sativa
aacatacaacgatgccacatcatccactaacaatcatcacatttaaacatcatgcaaacatgctatatctttatagtttttataatttaagagcttttcaaatataaacatgttaaattagcatccaacataattcacataatatttcaatgtatatctttattatgtttcaggatatcctatatagttcatcctcacttagttagtgcttaaatgattaatctatggtccaaattatctttctccctttttcctctaattaagtcatattacatcaattgtttttagcctttagatgattaatctactgtataaactatctccctacttttcttcttccataaagtcatatcaccttactttttacgtttgaatcaccattctacatactatttaaatttaaattatcataaaccacattaatttacttaatctgatgttatctagctatcttacacgttattttttttaattgttatcatactaaattctcacagcaatgcgcggggtttcacctagttaattagaatgtgaagtgtcaaagccaacttacctcagtcttctactcttttttactgaattgtcccatctaacatagaaaattcagctgcaatctcaaacagaaagaagtaagaacaccataaaatattagattggcatgtttgtacggagagctcatagagtaaacccctcgtctcgtcaggtaatcgagaacagtgatacggcagcagatgatgttccatggcaaagcgatatgaaggtgcaacctgttagctacagggcttggtgctttgacagggaggagtggaagtgagaatgtgagatgagaggaaaggagattaaatgtgaataaaagtggtagtaaatagcttggcacaacttaatttcatgtccgtacagattcttgtaatggaaaaggcagtcgaccggtttcaggcaatgactcctgacgtcaggtcgacctccctagtgctgattggatctaatgatttttgttaatcctcgtgagctcgtcagctacttgatcggctaatcttgcgtcccctcggatctcgcccgcttttgaccgaaagtgagccaaacgatcggatggctgaggacgtgtacatggaagaaagagattgaatggctgatataatattgatgacgtggcgaattgaggaggcagctttgggtttatagaaagaaaggattaacacatgatactattaatatttttttagaagaaatataaatgctaaaaggatgtcgtactattaattctaccatttgagatttattattagtgaggttgtaatcggactacgtgacaaacagaaaataggaacgagcgagtagtacacgtcaggcctgttagtctctcagaaaaaacaaaaggaaaaaaaaagaataaataactttagttcttccactttcccctctctctctcaaaaaaaaagaaaaagaactttagattcttccactgagaagtgggtcccacacacttaaacctcccttc

SEQ ID NO: 14181 - DNA, 1501 bp, Oryza sativa
tatcgatctgtatataaacaatttctatgtatgtatttggttgttggctaaaaaataggaaataaataggagagacacggatggggagggtagagggtgtgggaggggagtaagtacatacatgcgcacgtatttcctcttttctttcggaacgtatattacctgaacttgtgaacagagaggggaacgtgccgatttttttcttgaagataatatttaatggtggaaattattaatttaattgtttaaaatattaggtccaccagtttaaattaaagtgccacgtggcggtataggagcatttataggagtgctacgtagaggtttagaagcgtttgtaggaagtttaatggacttttagtatataatagatagtgataccactaacttttgacatgacatttgactatttttcctataaaaaatatatatctcatttaaaattatatgatgtttcttattttgttgaggtatgtttttaattaaatatactttaaatctgactcacacttcagcatatttacactattttttaataaaacaagtagtcagatgttatttctaaagttaacgacgtcatctattaaaaataaaaatggaagtagcactaatattaatatttatgtctgacagttgagtccgatgaacagaaagagattcatctatggttgatcacctcatctgtaatctacacatgtacagctgaatttgcatcttctattaatttcaacacattctcggatgtattatgccaaacatgcatgttctatttgcctaattcaagacatccatgaatttgctttattttgattgaaataataaattatgctgctaatcttatatcaattcaatatctgttttctcataactcataagtacattgtcaaagaaatcaggttgattaacggcataaatctcatgctcactataaaatttggattatttatttgatcttaatctgtaaacaaagaatatatattgatctatatctttctgaaagaaaactaacaactaataactaattttcaaatgtgttgtccatattatccttatgcgtactgtatacagcccatggcatattattgctattcatgtcattggatattttaaaagtattattgcgaaagtatattatattgagaatttgtgttagatagaacatggcatgggcgataccaaggactattcaggatttgttttttttttctctaaaactaagaatcaatagagatacagaattgtatctatttggactttatcaatttaattttgaaattccaaattgataattgtaaattataagtgacatttttatcctaaaccccataattcgtaaatgattttgaattaataaatacggagaacccatcttggattctcaatttagcttcccatattaatttaattctaaaattaataatcagaaagttgtaaatgacatgaaattttttttattataagccgctatgaataaccaacatatttaacgtaaaaattttta

SEQ ID NO: 14182 - DNA, 1501 bp, Oryza sativa
aaggcagcatttcatatagaaccaaagaaggggaccatgtgtacatatattacagttgtatacgtacgtgtaccaatataagccggtggaatattgaaatatcaatcgtatattgtaaatgcatagttacacataattagccctcggtgaccatgatctgaaagatacttcatatcgtgttgggttttgtgctgatcctatacgtgcgatacatcatttgtagagattaaatggtcacgatagatttttctttttcttgattgatgtatgcgagaataataaatttttagataaatatagcttatatatatttacttggaattaatgtagggacccttaaaacaatctcgaattaataatatagaaaatacaattacagctaaaattcatacttactttagaagaggaagatctgagagagcgtacttggaactatccactagacagtcaataaatgtggctccagaggagtaatattatacatagccatagcatcctatgagcaaaaaacatgtaaggcatgttcaatttgttttcttacaatatgttcacataaataaaggagggaccatgcgtacataggctgtacgtgtttagttgccctgaaaattagaagtttggttgaaattgaaacgatgtgatagaaaagttgaatgtttgtatgtacgaaaattcgatgtgacgaaaaagttagaagtttgaagaaaaaagtttgaatctaaacccggccatatatttgctagacatcaaattgttttggtttgatctagctcgattgtgcttgcccgattgactagaaaaagaaagcatggctcatatttacattcgatcttgcgagataggcccattaatatcttaatagagagtaggcagacaagagctagagatactgacacaacatttaagggtctagcactcgtctagccaataggcccactgggtctagcactcattagaagttttttccttcaaaacgtgtaacaaaatttcaccctaacctactggcacattatttttttttcccaaatctaagtccgagcaggcaacgtacaacaagtcagcaacgtcgtctcggctgaagtgacggctccttcttacgacgcgtgacggaaagtgtcggctgaccaaacggcgccgtgcacgtcgtgcgtccgtccgcatctacagtccgtgatacagtaaatgaacagtagtaactcgttaccaaccccaactgcacgctcccaacgggcgctgtcaaacgcaggttaactagagtagagaagccatcggtatgctaggtggaatcaaaatatgagtactttggattccgatcagctgcagtcactataacttaagcagcagtagtgcatgtcattagatgcaaatcggatggtccagattgcatgctgtactgcacgtagtactgtagcacaatactgtagcataaagtactgtatatatatatacgtatacgtatatatatacacgtatatacgtatgtatgtatgtgtgtgtgtgt

SEQ ID NO: 14183 - DNA, 587 bp, Oryza sativa
cagttttggtggagctgaagctgtttggctgagctccagctccaggaggagtggagttggagctggagttgtgccaaacaggcccgaagtggggaaatgagtgagaaacgtcgctgattcctacactaatctcgacgcacgattctacggccaataaaatgtcaaatatcatagtagaaaaaactcacccgacaaaagtttagcaaaatcgttcgtatttttttccgacgtaaaaaggccacccgtttttactcaaggaaaaagtccacttagactcccttaattgttcaccgaatattcatgacccttaactagaaaactgggtaggacgactccccgaattattgaaaccagtccaatttgactcctccagcggtttaggatgtcggttttgctgacgtggcggtgctaatctagtcttcatccccgtggcgcttacgtggcattagaattaaaaaaaatatctatgggacccatctagcattcacacacaaaatatattatgggacccaccgatatgtggggcctacatgtctatcctttctccttccttcttcctcctccctctctctctcttccccttcaga

SEQ ID NO: 14184 - DNA, 1501 bp, Oryza sativa
aaagatgctatgtttttcaagttaatatcattctcttttgtactgcattgttatgggaaaattatttttgaataccaaaatccaatcataccaccagtgttagttttgttggtattttctggaacataattgtggttcaggtgcttgtgttcagtgcattgatattccattaatttctttttcatcaatagaaaatcaaccaaaggtgggcgtaaggtgattgcgcgcaggattgccaagggcaggcacagaatttcagtgtaacgaaaaacccatagctcttctgcaccttcacatcatccatttcgtgaacatctaagagctcacagtttctgcaccctttaccgccctcactgtggagggacagctgcagcagaagcagtagtgccatgtaccgaattatctttacgaaataaactaggcaattggactgattggccaaatttttacacatccaacatctgcacaatcgcagctggcagggttcaacttcaaacagccgtctgtgtgcgcttcttggctctcctaaccactgccttctgtccttgaatccatttcaaccattcttttgctagtagtttattcgtgaacactaatcatgatctctcatctggacgccatgctgagctttgcttgttgggtgctcttgttccctgcgtatccaaccaggattattttattttcagactggtgaatgacaagcagaagatgagaagaaaaatgcaagctgcggactcctgttgccgatgaattcgtcaggaaattctacacgtaccccgccgcttcaaaaaaaccattgaaaaaatatagaaaaaatacttgggtttgatgactaaccggggatggagtcgctgcctgcgcggcgcatggcaggttgttgtttggctctgtgcctcgttggctcccctacccttgtgcgacgtggctgtagccttgtgtacgtggatgctccggaggcgataccagtgtgtgtgtgcctgccgcggatgacttgccggagatactgtgctgcactcgagataataaagcagtcaagcaggtgtcagctagacggactagtcgtgagctcgcacgtgtcagctagatttattttgttgttttgtgcaccaactttggagggatagtataatcatgggcagccccatctgtagaaaatttagaggattttaattctatataaaatatttctataaagaacttcgaatcaattaattgaatcttatcaatttcttttaaatttgtatggaatgaatggtcttagagattttgaagaaaattagtaagagttttaacctcttagaagagtttatctctctcgacccgttcttgtgttttttctgggtttatccaaatgataattattgttttttttcataatcttctatttgcacttacatttatgtaaattttcttcatttttttttctgtttctctattttgctaattatgtgtttcaaaggggtctaaaactcattgaaaatttaaatggtttttttttaga

SEQ ID NO: 14185 - DNA, 1501 bp, Oryza sativa
cccgtttaaagctattattttatttcaattatgcatcgttttcgaatgtcatcgggtggtgaaccttccccagttaattaatggccgaagatgatcttattttcctatgggttataatttaattagcatgaaccttatatattggattggttcagctaaatgctatatgtaagtttgcttagccatgcttagaaacattagctaactaaagggtttaaatataaattatataatataattattattattaattatggttacgttaagtggtagctcacgatgatttatcgtgtgatgttaattaattgataattaaaacctggataaggtgggttgtgagcatatggttttgatggttgtgctcatgacaataaaggaccggttcgcgagctactgttgtgaaacatttatcgtgccaaccacaagccaacgtgggcaacggctttaccttttgtatagcatgattcattatggagtgccagactgagaagcggcgagaagtccgtgggggtcgctggggagtccatgcctctggttgtagagggggtgattatgatccaggtatggtgcactgtggtgagttgtgttgtgcaaggggtattgtcacagttcctttccgaggtatcgtggtggtactaaggcgcatggtaacatgttgtgggattgtgtcttgtgggtacagtggtacacctctgatcagagtttaaactattcgaatagccgtacccgcggttatgggtgagttgagcaatgtttttcgtgattagtctcacactactcattaatggtaataatgtgataattaatttgactcctggtttggaatggataattcctggtttggaggtttaatttgttcaactggggttggttgttcaaatgtggttgggcctatgcaacatgggtgtgttgtatggtgtttatttaatattgattaattatacaactgtttaaatattctcttaaatatttgttaaatgctgtttctgcaaatgagctatattatgccatcctttgttatcctgtgcacttgcatatttgctgtgtggcttgttgagtatgtcatatgctcattcttgcaatattcattcattagaagaggagtatctcagtgaaggtgatgatctggaggattaggcttgttctggttaagatgcctgtggagtggagtcgccatagctgttccgtagtttgttatagttttattttttttccgctgcatagaatgttattctttgagaggaactatctacctctgtaataatttattatttgcgaatattaagtagttattaatttgtactctattatcaatttgttattgtgtgcctcggttgattcctggacgagggtttaacacacatgtaagcgtttggaattttggatagaaattccgggcgtgacagtgtcctgaaaagaagataccttttgacccgagcgtgaagaacttcttcaagggaatgtccgcaacaaacaacgaggcgttacagatattggacta

SEQ ID NO: 14186 - DNA, 1501 bp, Oryza sativa
catgattactaattcaatctaatggtcattcgattaatgttatttttaaattatatgtaggaatttccaagttgacaaagactggcgtcgtggagttgctacaaagttttgtccatctaggcgagcatcctagagtccgtgtcccaagtttcatttgttgcttaggtgttcagttatcaatttagttatggtcttagttgaaatgctctttgtatgagcactttgttatcattcattaataaaggatagtttcctctagtgtgaggaaccctttttaatttaggtgatatttcaattgagttctgaagtgctctattccaagcatactgtaatcattcatgaataaagaggtgctctgttatgaatgtttaaacttgccattgctctatcgagatttcatcatcagattttgtcattgttcacatgctggatattgtcataaaagacgtgttgtttgtggcaagactttagtcacatatataaaacttgcatctggatatttaattttttagtgataaaagttttccttacagcaataccctttttttctccactgatgcattacttcatatgtgaaaaaggtattgtcacatatacatattagcttggtcactactacatttgtaaagaatgaccagttttcgcaacaaataacacgtcatttcaccacaatatatcttacttcttgtggtttttacttctcaatataaactaatatcttatcacaaaatcccctgtcatatgtgagaaaagttattagcaaaggtatatttgtgatggtgagttatcggtaattagtaatatgtagtgacgggcaaaccaacactaaccgtcgacaatattgtgagaaaaaaattccatcactacacgttcacatatgtgagggcactattgtcactagtatctcctgtaattgtgaccacgataccatctctaatgtactgcttattagttgcgacagtattatcacaaacagagccattatctgtgatgaaaaaaaaatcatcactatgctacttgtgatggcagtagtggtgacaacatagtgacgaccccaaaattcgtcacaagggggtaattgtgatgagaaacagccttttagtgatgaagtttttcatcacaaaagacttgatcccttgtggttgtcctaccaaagatatactccctccgtcccattataagtgtaatggtggttttcaatatccaacgtttgaccgtccatcttatttgaaaaatttataaaataattaaaaagataaagtcacacatcaagtattattttatcatctaataacaataaaaatatcaatcataaaaaaatttttaaataggacggacgatcaaatgttaaatatagaaaaccacaactgtacttataatgggacggagggagtaagtgtgtatttccatggacaacccatctcatacctgttttctttcctatcatacaattcctcactaatacattacctcagatctctaacaggtcatctatgatggc

SEQ ID NO: 14187 - DNA, 1501 bp, Oryza sativa
ccaccggcgtagcggtcctcgtactacgacttccaatagttgagttacggttacgactggtactcgaccagcaacatagcggtcctcgtacctcaatttcgagtggtcgagtgatgactacaactggcctttgaccaacagtgtagcgatgcccccactatttctgtgatttgttgagtacaactacatacctagtcttcacccagtgtggtggtcgtctcatcatcttatgtatgacaaacttctgtaagtttttatatgtgcaatatttatccattgatcgctttttcttatatcgctttcgtcttgaagttggtcctatcgtccctttacgctaatcagacaaagcctccgagagacctaagggaatttcagcaggggacaccaagagcggataaggatttgttagatgctgagagccagacgaccatgtcagatctggtcatgtaagagtgctcaatggacgcgtattaactaagccatgcaatcgggaattggtttttccaacttcactgctgggggctaggatttgttagcttcagcatggtttgctataagatttaagctgcctttgtggaaaatggcttttccataaaaacggttgggggctaggaagagtaccaaactccatttgctgagggcaattctagcgagcgtactcttttattgtcacacgcaaattcaattcattttcaatttttccatacatattataacatgttaccctttgctgcatctttgtataagtctgattcagtcaaggccatgtgttcaataccccaagaagactcttttgctctacccctatcagatgaggcttattcagaattcttgcaacttcaggggaatctggacaacttaaacttgcaaccagggatgggggatgcttggatttttatctggggcacagataagtacactgctaagaaattctataagctaaattatgctgggatgcaaccccctaggcctatgatatggctatggaaaacaaaatgtgtaatgaagatcaaggtctttgcctggctaatgttctgtgatagacttaatacaagagatatgttggatatgagacattgtgccaaagaagatgattatctcacatgtgttttgtgcaatgctaactgtagagagataaggctgcacctcttctttttatgccctttcagcaccaggtgttggcaatacctgggaattgagtggaatagcaattgtgaatttttccaaatgatctcttttgcaagaatcaagttcgcttagaagggtttcctggaaattttctttttggcagcttggcacatctggaaacaaagaaatggcttcatatttcagaacgtacaacccacttttcaggcatggagatctctcttcgttaaagaagttcttctgcatatgtgcagaatgaatgagcctttaaagcaaattgtttctaattgggtacaaaccttatagtatctttgtgtgaaccacatgtaatttttgtaaccttgtaaatattttc

SEQ ID NO: 14188 - DNA, 1501 bp, Oryza sativa
caagatgggtgaatgaaaactcgcgttgggagaatgaatatagccacaatgggcgtgggacgaacctgcgaaggggtcggttaaacgaccaccttggaggggaaataaggtttccccgggatggttctgtcccccccatcttgcggagccgtttcttcttccgctccccctcgggctgcggcgtcggcgtggccccctccgggcgcctgctgctgacacgcgccgccccgccccctcggggaggagatggggaggaggtaccctcttgcttcctcttccctcgggcgtcggcagggcggctgccccccgagcccccatcacggggcccggaagcacgaccccctcctggggtagattgatctcccttgcggctcccgctcgcaccgtcatggcccttaggagctcgctcctctgaggccccgaccgccatcatgatggtcaggatgttggcgcgatctggatcgctgcagagggggaggactccttgggggatgagggatgcctccacggagctgagattcagcacccgttggatcattaccttgaagtcttcagggacccagtcccatttgaccccccggtgggtcctcatacagtcctcggacccagtgtactcccaggcgccccgggcgcgccgctggagtggcgcgatccggcgacgaaggtagtcgccgtacaccatcgcccctgtgagcccctgggatcgcaggcccgccaggcggtcgaggacggcgtcgtagccatctcccagatctaccggcgcccgctagctggaggcctgcgccgggggctggctcggaagtcggaggcgcgcttcgtcggcgaggggggtgtagaaccagtcgctcttccagtcatcccacttcttgcggaggacgcagggaatgtagcggttcagcaccggcccccgcggctggaagtagcagccaccaaccaccgacggcggcgacactggctgtacggtgaagaaccaccggaacagccgaagggatgggcgcaccccgatgaacatctcgcacaggtgcgcgaagatggccaatgtcattaccgcgttgggggtgaggtgcgccatctggagatcgtaaaactccagaacatccatgaagaaagaagaaaatggcggaaccagccctgccattgcaaaagggaggaagaagacggaccgccccgggtagcgtggcgccgggtgtccctcgcccagcgtgactatctcccggccggtggcagattccggcatgaagcggcgcggcagcccggcctgcctctcgctcacgatgcgggaaggcggcagcacgctaccatcgagcggagcggagccccgtgccatgacgccggaagaagagatgtttgagagcgagcgcgtgtggcgagggtagggcacaggaaacaaggagttagggcgcaagcaaggggaataatggcgagaggaaggaagcaaatctcttcctcggtgtctttatacccttgccaacgctgtacccggctcctcgcttctcgcgcc

SEQ ID NO: 14189 - DNA, 396 bp, Oryza sativa
catttcgaaacggaggtagtagtattttcctgaagttaagtattcacacgtcgtctcttgggtagggtagcaacttgaaaaaacacaaaaaccacaaagcttgaagccacagaggatccacgtcctccacctccaactccaagccccaacacaaaggcaaaggcccagttactgaccagtgggccccactcggtcaggtcccacgtgcacactggacgggagggagggagccatgtgtccggaggaagacgacacgaggcgaagcccatcccaccacccaccactaatcccctcctcctcgtgactccctctctcctcgccactctcccccctcccatcctcttccactctctcctctccccttcgtggcggcggcggcggcggcggcggcgtgac

SEQ ID NO: 14190 - DNA, 410 bp, Oryza sativa
cagacctaggagaatacttaacaaaagatactcgatgttgatgtatgtgtatgcttaggtggtgtttagatccagggacttaactttagtccctgtctttagacactaatttagagtattaaatatagactacttacaaaactaattacataaataaaagctaattcatgagacaaattttttaagcctaattaatctataattagagaatgtttactgtagcatcacataggctaatcatggattaattaggctcattagattcgtctcgcaaattagtccaagattatggatgggttttattaatagtcaacgtttaatatttataattaattttcaaacatccgatgtgatagggacttaaaagttttagtcccatctatacagggccttattacatattgtgacca

SEQ ID NO: 14191 - DNA, 1501 bp, Oryza sativa
tttgaaaagtcaaaggacacaggtaggacgtcatcagaccctcggagaaaagtcagagcaacacgtcaggcgaaaaaaaaatagaaaaaagtcagagagccgtatatcatggtgcgtgccagatgatgagctagttgcgtcacgtatgatgcaaacccaaattgtgtccgtacatgtgtcctgccggatccctctgaatttgataagctaagggagctgattaaattataaaagctcactaataagcaaggttacgtgtaatacgcgagcctgcgtgtacgtgttgacctggacgttcttcgtgtgataagatttctagataagtgatgggttgattgtaaggggggatccatctccatagcaacattaattaaatgcttatatatatatatatatatatatatatatatatatatatatataaagaactccatagcaaatactttatttcaaataagagttaattttctcgatttcttgagatgtcactgagctagttagcttgtgtatatatataaatggataaaatttactgcatgatatctaaagtttatgtttttttagtggacatcgtaaaaaggtgtcacgggcagaggacaccttagaaaactgataatttgctgaatggcattttcggtccgattgaagacaaaaattattcaacaagataataacgtctctagggccatatgcctctaatacgggttagagtgcaaattttaaaattatgcaactatcaatttttaccaggccattgcctaagtatattgttagcatacatcatattcaatattcactccagcgttaggttataatcttgtagatagtcccaagggtattctcgcctttctaaaaatttatctcttcaattggatcagaaatgtcctccagcaaattaccatttttatgtgtctttcaaccattacatatttttacgacgttcatcaacaaaattacataaatttagagtggtctgtaggaaaatttaccataaaaagtaactgaaaatatgccaaaagctaaggaagactcgtatgatcgtcattatttttgttctaaaaaaagatcgatcctgatctggccgccaaaatttagatgttcagattaagcttattagattcatgggatgagtaatttacaaggtcaaactaacagcacatcttgtacagtgcatcattggagtatgttaatgatgtagcttcgtaaccggacggagcattaattacacaccgctagttccagaataagataatataaattgaaattaaataaaggacataatattgtcatcaacttttcatatgcattatttggctgaattagtcaagtctcatgcacatatgcatattattttcgaggcttttgtcgatgtacattgacacttgacgacacatccctaagttaaacagcatgatatagcctgtgtttagttcagcgcaaagtttggattttgattaaaattggagatgatgtgactgaaaagttgtgtgtgtatgacagg

SEQ ID NO: 14192 - DNA, 1501 bp, Oryza sativa
gatgttgattctcgtccattttttggtcattctatgcaagaggttagtaatcctagtgctagaggactatttattattaaacataaatatgcattgcaagtataactagttctcatttattttagtaatattgacggtcaaaactgatcgctaacgaccgtcaataaaaccggatctgctgccgccggaactatggacatggtgtcagatcagccctcagcccgagtgctctgataccacttgttggcgacaaacctcggatcaaacactttgtgtgcacactgcagcaatccgacacggcaacagacgagaacatagaatgcagaaagggatcttcagaggaagaacagtgaagtttcagagaacaatcgatgtactggaaattgtggggttgattttctgtggtttttattcaactgaatagagtaacatacaactcaaataacatgactagaatccaaggctcaaatcgcgccatcccacgataccacttttcgaattcaatgactcacacatccgcgctaaactcacgcacgcgaaccctactgacacagtctgcttaaggacttgatcgccgcatcatctgcatctgctaacaaactccagcagacttattccttcaacctttgcaactgctaacttctggaacacgtaggagccacagctgaactaacaaactcaacaacgtgtgactatattcatcgcagcttgttagcaacggccaccggcaccgacgccggcgacctagccgatgtagtacatggggtcaggcagcttgaaggtgcgagcgccctccggtgcacccaagatgtcactccactggtctccgatgttaccgacgatgatgaagccggcgtcctgcagcttctgacgctcgccggacttgtacgccacagccgataactggagcccgccggcgacatgagctgccggcttcaacagcagcttctcccatccagtgtagccctgccggcggaggttcgcgacggtgatggccctctggtcctcggtgcggcctgtcaggaacactggcttgacaccgagctccagcagccgccggtacaggcgcctcgtctccggcagcgccggcgcgctcccctctgccacatactcacgaaagctcgtgtcgttgtacggcgtagctctgccaagggattagtaaagataattataattaattaatttcttcatatgcataaacgtatgcatcgttgcatgcaaggcaaagttaattattcgaataaaacagaagctttcaatggaactgtcgaactcatggtacaggaccgaattcacgaataaataaagttgcaagtttgctggaaactgtacaaacttaatcattagtaaaaagaatttatagcatatgagcgtgcagtgcgtccatagctccatacttgtctaggattaaattttcgatatgatatatatagcatgcagacaaaaatgtatctgtcaagttatcttgtcttcactgttcatatgcatacatgcatcatgc

SEQ ID NO: 14193 - DNA, 1501 bp, Oryza sativa
cctaaggccctgttgaatcagttctctcgggaaatcttacttaagaaatactccctcggttgattttcatactaatcagccagccctaaggtctggaccaaaatttattgtctaaaaatcataccaatatactccctccggtttcataattcttaacgttttggacaagttttttgtcaaacttttataactttgactaacaataacttaaatatatttatttttaaggtactaaaacaacatatatagtttgccttacaaaatgctataatgaaaataaaaaaaatatgtatttattgtacatattaatataaaaatatagtcaaagatatatttcaagatcgtgttattgtctaaaacgtcaagaattatgaaaccggagggagtactcatattgtatgggtattcaatggtcaaagtttattctcaaaaagacaatgacttttaaataagatacaccttacaaaaatcgcgacggaggtagtacgctttagaccttttcctattttggagctcactggagccttgatttttcttttcctccctaagctgtagaacagaactatcatatgctaagatttgtgtgtattttcaatagattattgtagcacatggtttaaattttgaactgagtatgctttccttattttgtttcagctttgccatggcctttggatagagggtccatatcctggtgtatcagtttagggagcgacaatctactgaagaatgtcaatgaggactactttgcagctctgcaaagttctcctgcgccagtttaattgtacatttggaagtaatttccttttacttccattgacgaagaaacttatagagtgatgtacaaaatatcatgcaaattgcacaggaaccttagcagtgccaacattctggcagttttgttgtagaagattttatctgacattctttcactgtacataaggacttgtaaaatttgtgaaaccattcttggaaccacacgatgttaggaaattcttggaaccagattgtcccagttacctaatctgtttgtttgacagtgagcgagcagaattgctcgctgaatgttgtgcagtatgaatcagaaaagtgaagtatggtgcatgggcagcatggctgctgtcgtcagaaagtgaaataagatcttcaggattcgtttgaatctcgcttattttactgattcgatttacaacctcatcttttcgcttatacttatacttatcggtcaaaatttaaattttcaaccttaaatttggagttgattttggagttttttcatcgaagtttatttttcaacttttgcttttagttcgccaagaacacatatataaaagttttattcacattatttttcgtttgtaaataagccaaacgatggggccattaatttccatctaagttattttgcgtagtcctgatttgtttatacttgcaaaaggcatagtcatgatttatttatactggtaaaaagataaaggtggtgaatgcccatccgaccatt

SEQ ID NO: 14194 - DNA, 1187 bp, Oryza sativa
gtgaattcgggccaacatggattgggaaaagcagtctgtaaaaatgacgtcatagccgatacgtgttataactaggcggatactcagcggaatacgtacagtaacccttgttcaaatgcgatttactcaaaattgtctgcgtgaacatataccgtacttggtatcattcaaaagggcacttcattgcggtcagtctgaaaccattttaatatacacataatgtactccacgcatttaacgggctgttacgtgttgcatagtaaatatcaatcatcatatcgtcatcaatttttaccaaacttgacaaaccattgtcaggtgtatggttacatttgtctgctaagtttcgttgacgtaggtatcaagatcgccatttttgaggaagttgaagttatttcgcaattttcttgaaacctgcaaatttagagggcaattttttaaaaagtcggtcagcgttagggtatatatttgtatattttgctggaagtcttgatattcaagtatctaaatccaaaatggctccgggttcggccagacacgatgaagctacggccacagaaagaaaaccaatttcagaaatttatagagggcgctatttattttgtgcatagccattagagcgtgaaattctgcatgggtatgctcaattatgatataaagatactgtaagaaattgagacgaaacagagttggtatgagaaatttatggtttttttagatttttaggggtcattttttcatacagggcatacggggcaccaacgagtcgcacatgagcactactcaccaaaaaaaaaacaggtatgagcaaacttcgaaggtttttcattggtttttccagtattgtaaatggtagttcaaaatatcgatgattttttttcttcaaaatggtattttggatgtgtaaatgagccttatgttgtgatttccatatggtcacaccaactctgttaaacatgaatggtgaaatacgattaagcatcaatcagatttcaactgcggcagtttcaattttcttcaatgacttaaaatctttagcaaacacagagctgagacgcgtagtgaactatgttgcgcagttgccatttatgcacacatggacatggtggaaatgagaaaaagccgtttacttctgaacgagctccatagaaaataccactgactatacccctttgctttgatctagg

SEQ ID NO: 14195 - DNA, 1501 bp, Oryza sativa
gtataaccaggcaattcaccggcggtcagactggcagcaaggcggcggtcagaccggcgggagcaaggcggttcgaccggcggcgtgcaaacggttcgactggcggcggcgacaggactacgttgagattttcatcgatttgagggtaacttttatttccgctaaaagttttgggtttttggttttccctaccattcacccccttctggtaggcttggtttcttgtgttcgattcttcactattcccacgttttccacacatgttttccaaagtgctaaatatgtggttttgttttaaaaaaaatctatagaaatattgttttaaaaaaaaatcatattaatctatttttataaaaaaaagctaatacttaattaaaatatgttaatgagtcactctattttacgcacacgagggattagtttccaactgtaaagccgaacacagcaaaagctatcaacctgagaggtttatcagtgtgctctgtaaatttttgcgccaaggtacaaaattattgtaaaaagaaaacctctaaatagtgcaaaggagatgggacagggggtagtggcgcagggcagggggacttatattacggaatgcacatttcttcccggtgcaaaacagaactttggaaattttgtaaacttctaaccaaaataagttaaaattttgattcgatttgaatgaaatttgctaaattcattttttatcatgtaaaaggaatatttcggtcaaagcaatatcgtaccatgggacgatatacctagatatagatggccatggcccgaggcccgatggcccgcccaaggtctggtgattttggcccagcccaggcacggcacgggtcgggcctgtgcctgtccagcccaacagtcgtgacgtgcctagactgctacctcggcatgttgggccagttcagggatacaaaactaacttattctcaaccatatgtaaggcacgtcacaaagaatagagagcaaaaatagacttattatatggcacaatccaagagtagaggcgtaaaatagacttatttttaactatatatatgtcacaacacaaagaggagggagaagaaatatacttattttaaagaaggcacgataggccacccgtaccttcaggccggcatggcacggcccaaatattggtgggtcgtgcttgggtctgaggtgcagcccgtggatcgacacggcaggcctggtgtgttggtcgggccgtgccggcccgatagattctggcccgagcacggccgtgcctgggccgtggcgcccagatggccatctatgtatccactatccagagtttccaaaattccgggaataccattcccaaatattgaacctcaaaatcgagaatttaaaattagggattagtgttcgaaaatacttataggagtaagtaagatgtgtgcttgtaagaacgagagtgcgcgcgtttatgagcagctaggttgtaccgtttttcgaaaaagaaaagaagaaacactacttatctccgtcc

SEQ ID NO: 14196 - DNA, 1501 bp, Oryza sativa
aaataagtgatgaacaccgggttatgcaggtcgatgaattttttagtgtattaaaaatgtattatttgttttagtggtactaatacagttttatttattaaaagttgacctaattcttaaaacaatgatagtaagtagtgatgacaaacgaccagtttatatatgaccaggacaaaggtatttttatttaaatctaagagacattattatcacgttagaagtatattaaaatctaccgtctattttatggtaaatatatctcttatttttcttattgtagggtaatctaaattctcttacagtgtgtgtctctctctatatatatatgattccttttagcattattttttttaataacaaataagatgcctgtgcatatgtgtgaatttcctttccgatttatatttcataaatgttctccggtttatatccagtcattatatagtttgaaacacaaactataatacatgcccgcgcgaatgcgcgggctaccttcctagtttaaaaaaaaggctgcatatatccgattggatccagaggccgggtaaaaaataccattgtctaaaaaaatgcttaaacaagcatttagtagctagtaaccattttttttattttagagccctgacaagcaaacaatagtaatacatatacgtgtacactccctccatcttataatttcgcaccatgtccatcgcccccttctcaaaaaaaaaaaaagcttaaacaagcatttagtagctagtaaccagttttttttattttagagccctgacaagcaaacaatagtattatatatacgtgtatactccctccatcttataatttcgcaccatgtccatcgccctctcaatggctcacctcccatcactgctgccgcctcccgtggacaggctcgccatcccttggccctctccccgccagtgagctcctcggggagagggggagaggtgaaaggccaattacatgtgggtcccacatgttctttaatattttttttctaactaggatgtcatgccatccaaaacaattatccatagtgtcattgggtctaacttaaatggttttgtcaagcttgaggtgaagttttttgtattataatttacagatgtcaattaaacttgatataaagatgagggataaaaagtagacttactccgtataaattataggagagtacgaattaccccccgaactatcgcggtcggctgaattccccccgaacctgaaaacagacatcactcaccctgaactttcaatgccggacgaattactccccttgacccaatccagagtggttttgtcctacgtggcgtacgcgtggcaatccagtcagcattttctttctttaatggcagggtccacatgtcatatatactctctctcctcttcccctcttccacacattctctctccctctctctctcgtctccgtcgtcgagcggcgggtggcggcgtgggacgcagaggcaggagcggacacggaggcggcagtggcgaggga

SEQ ID NO: 14197 - DNA, 1501 bp, Oryza sativa
cgaatcgttctgatcggactagcggcctccttatatagcaggagagattccgccagttgccgcacacgcgtcgtgggatcgtgggatcgtgcacgcgccgttatggaggcagtcgtgggagcgaatcgttctgatcggactagccagttgccgcacacacgtcgtgggatcgtgggatcgtgcacgcgccgttatggaggcagtcgtgggaacgtgggatcgtggttgcaaaaaggatagagatgtgacggcacgcacatatagcaggagagattccgcacacgcgtcgtgggatcgtgcacgcgccgttacggaggcagtcgtgggagcgaatcgttctgatcggactagccagttgctgcacacacgtcgtgggatcgtgcacgcgccgttacggaggcagtcgtgggaacgtgggatcgtggttgcaaacaggatagagacgtgacggcacgcatgcacgccagcctcgccccggcccggcgcgcgcgtgtggctttccgattcccacctcaaccggtcaactgggagcctccaataactccctatttaagttgagatactcctcgcttaattcctgaggtggtattattatccttaacacttattatgggcctttgatatttaatagaataaatcgggcctagcccaattattctaacagctttctcatttattactacatgcgtagagtagagatgttggctgacatgcccatttttggttgtgatgaatgtgtatacactgacgtgacagtttgctaagacctggttttattttgtgcacaaaataaatggtatatactttgtgtgaactttttcatagaatagggaaacaaacacatgacgttctttttttaagaataaatcttatgtttgtgtggctaggaaacaactttttttgttttgtattggtgaagttgtggccgcattatcctcaaaggtatcataattaagccaatatccacacatgtaactgtgagttatttttcgtagaaacttggtgtggttcagggttttattcctatcatcccctctcgagccttttttaaaagagggcacacttttgtgtctatgcaatatatgcgggtgttggggatctttcatataatcacaaaagaaagtatacatatatctgtagtaagatatattgtctttacatagcaaggaatattcaaggaagggtaattgtggcaaataggatatgcttgttacaaaaatcttactgcaaataactatgtattcatgctctaccattctcctttaatgtacattattgcaaatacattttcatcagagaatacattaatcacaaaagctgaagacaaaaggtacggaaaaaaacaaatcttcataatgtggacacgaccgcgatgtcttgattatgacattatcttctaaggtatcaaacaaaagactctccacttgaaatgaataaagagaatctttacagtgtttgtattccagaaatagtaacaatgaggatactgtatatgacaagg

SEQ ID NO: 14198 - DNA, 1501 bp, Oryza sativa
tgcacaaaataaaaccaggtcttagcaaactgtcacgtcagtgtatacacattcatcacaaccaaaaatgggcatgtcagccaacatctctactctacgcatgtagtaataaatgagaaagctgttagaataattgggctaggcccgatttattctattaaatatcaaaggcccataataagtgttaaggataataataccacctcaggaattaagcgaggagtatctcaacttaaatagggagttattggaggctcccagttgaccggttgaggtgggaatcggaaagccacacgcgcgcgccgggccggggcgaggctggcgtgcatgcgtgccgtcacgtctctatcctgtttgcaaccacgatcccacgttcccacgactgcctccgtaacggcgcgtgcacgatcccacgacgtgtgtgcagcaactggctagtccgatcagaacgattcgctcccacgactgcctccgtaacggcgcgtgcacgatcccacgacgcgtgtgcggaatctctcctgctatatgtgcgtgccgtcacatctctatcctttttgcaaccacgatcccacgttcccacgactgcctccataacggcgcgtgcacgatcccacgatcccacgacgtgtgtgcggcaactggctagtccgatcagaacgattcgctcccacgactgcctccataacggcgcgtgcacgatcccacgatcccacgacgcgtgtgcggcaactggcggaatctctcctgctatataaggaggccgctagtccgatcagaacgattcgcatgctttcctctccctggtgttcttcctcctccgcgcgcgcctgctgcttctgttttcgcttcctcgcttctgatcgctttcacgcacgagagatcggaaggagcagggcctccggaaccacaccttcgcctgagatctgcaccgggtaggcgggtgatcaggtttttggggagtgcttcccgcacgactgctctgttcgttgttgtctcgtcgtccaccatgtctacgcctggacacctggagccggagctgccgccggcgccggtgctgctgtctctggagatggcacgccgggagccggagccgttgcgaacgtcaacaccaacggaggcaattctgcctcacaatccagcggagggccattctcggtgtatgtccttctcctgctgttaactcattcgttcataccgctgttagtcgtgttagtcgcaagtcagttgcgtccttggtatgtgcatgatgcttatgataccttaagcatgctactggttatgctacatgttgttactagatcaccccacattgtttatactatgattattgtcttaatattttggattaaaatatgccgatatatgaccatattttcaacgattcaaaaacctgataggtcattttcggtagttggctttgctgctgcactgaaaccatatgcatttgatggttctaactataagaggtggaaaacacgtgcactattgtggttgatagcga

SEQ ID NO: 14199 - DNA, 1100 bp, Oryza sativa
cgaacaggtcgagttggaaaacacggtcggtgtacctcggaaccctgcagttgcaaatcaacagaccgtgtccatgaaagtgtagaactgtagatgtccaaaatcgcagaaaagaaagaccgggacacaggacactgccggcacagtcttagcctgcatgtccaagtctccaagatcgatattcgatagcgccattcggtgcccgcatgggccggtcggccgtctgcgccaaagcgcacctcggcgccgcgagtcgtcgctgcggtgcggagccacactaccgtctacaggggctaccgcctaccgaacgcactgattcctcgtcgatgtgcgcagctagccgcggtggtgctcgcgcgtgcgttgcgtgcacgagcgaggaaagagcgcgccagcgctgtagaccaggaccaccactggatacggagtaccgtaccacaccgtccatctgatctctcgatcttacaccggcgcgcgcgtgatcggcgaccacgagacgcagtggcggacgcgccgcacgcgcgcaaaagtccactccttatctctgcctctctcgcgtggtcgcgtcgcgcgccagggcgaggctagctgccacaaagtccactatcccgtagtgtgctacagtaatatactccatgtcatggcgcgtgcgtgcgtccggtgcactactcgcaaccatgcatctgtgtttccggtgcactagctgttttctggcctctgttgagttctcgtcatgggcaagcaagggaaaggagcatacatcgtcctgcagcggcaacacgtaggcgtgcactataccttcatgcgaagttgcgaacgttcctacaagttgcagcagttgtgaaggatgggaacccatgctctctttatgaacgaaattaaattactccctccctttgtttcaaaaattatataacaacttagtacttgattaaattcgtacgattaaaatctgttcaatctagtattaggttgctatataagagtaagtaacaccgtagctccggaggtacgtgttcttcatcagcatggatcaaaatcatagtttcagcaatcagcacatgcaaagtggacagcgatcagaaaatcaaatcaagaga

SEQ ID NO: 14200 - DNA, 1501 bp, Oryza sativa
agctgcaataacctgtccaactctaaggctcaacaactccaggaatggctatcagaaggccagaactaacaagaagcagctagcttttgtactagtgtgtgtgatgcctgccgttcttttctattggcctgctgcttcctagtgcccctagagctgagctctcctttttatccttgcacttttcagcctatctgttcttggcaagcacgcagttggatggctcaacctgtgaatgatgcaagtgtgtactagtaggcatgtagcacgggttcctttgcgttcgtgtgtacgtgaccgtgtgtatgggactggatcgatgattgggaggggggccaggtgcaccgagcatcgatcaaatggatctagcggaattgagatcacctgcagttgtttatgactgcaactttcgcagtcatacaaccattgttggatcaaatatcaagggctcaaatcacacaaaagtactgttcatcagatactgtagcagatgaatcctgtagcgcgtactgtagcaagtgataacaaacagtactggtactaaatcatggcgttgaaatcttcgatccgatggtattgaagacctaagactgctaattttgcagtccatgttcaaactgcgtgggatcccaatccgatctagcgacgcctacggggttatggcttatccaggcaagtggggggattggtgatgtgatggatgcggggtttgttagtattggtttattatatcatcgtgtagttgttgtcggatggtggtggtgtcatggtgacacatgctgcaatgcttcttgttctttcttactacactgcccttctgggaccactgtcggcgttgggagaatgcgttttctcttgatttgattttctgatcgctgtccactttgcatgtgctgattgctgaaactatgattttgatccatgctgatgaagaacacgtacctccggagctacggtgttacttactcttatatagcaacctaatactagattgaacagattttaatcgtacgaatttaatcaagtactaagttgttatataatttttgaaacaaagggagggagtaatttaatttcgttcataaagagagcatgggttcccatccttcacaactgctgcaacttgtaggaacgttcgcaacttcgcatgaaggtatagtgcacgcctacgtgttgccgctgcaggacgatgtatgctcctttcccttgcttgcccatgacgagaactcaacagaggccagaaaacagctagtgcaccggaaacacagatgcatggttgcgagtagtgcaccggacgcacgcacgcgccatgacatggagtatattactgtagcacactacgggatagtggactttgtggcagctagcctcgccctggcgcgcgacgcgaccacgcgagagaggcagagataaggagtggacttttgcgcgcgtgcggcgcgtccgccactgcgtctcgtggtcgccgatcacgcgcgcgccggtgtaagatcgagagatcaga

SEQ ID NO: 14201 - DNA, 1501 bp, Oryza sativa
agataaaagaataggaggaaaaagaaaaggggaaaggaaaaataaacccatgtcatcgtccacatggcgtgccacgtagacaagaccacggtcaaacgaccctttggaccaggatgatacaataaaccaaatttagagacctcgatatgcgctttgcaagttcgtggatctaagtgaaacctcatgataagtttaagaaccgccagtgcatttttctctaattaatttcacgtaaggtttttctcccacatgttttcaatccttgctcaacattaacagccccaaatgtcgtattttcaaacgaaaaataatttctgaataatacttttatatatgtgttcttaatgatataaaagcaaaggctaaaaaataaacttcaatgaagaaccccaaaatcaccttcaaatttaaggttgaaaattcaaattttggctgataagcatataagcataagcaaaaagatgagaccgtaaactttgtcgattactttaggatttttttgcgaaaattttacgccaatagcaagaattagtcatcaccaaatttttaactatgtgtcaatattaggtttaacaattaaatctccaaatacattttctaggtttgaacttgtaaaattgtcacgtgatttctttacctatttgcaactttgcctacgtggagtgcgagcgtggaaagagccgtgggacccacaagtctgtcagctcgatctcccccgcggcatgaagtggtgaggcatcttcgcatcctgcacaagccggtcatagttggtatttcttgcaaccacagataaatccgcaagtgtacggaataccactgtagcactttattttcgggtgacccaaaaggatatcgaactcaggaaacatgtgtaatctacctaagactaagactatccaaggacaacaactagtggtaggcaggctaagctagacaggactttctatgagttttaattatctatgctaagcaaaggtaattttctatctgttgcttcgggcaccgatccctgctggtctgccagtgtggttccggctatagctctatgatgtatccgaacatggaggattactaggacgggcttcagggctgtcaccacctgccgcctacttctgacaaatccgtgggatacacaacaaataaaggtaatctctaacctagacaccacgtctaagttattaattactactctaatacttgcgcaggaacttccttctctatctggagtcctagtactagagcacttagtatgaatactaaacaatgaacccgcaaagatggaaatataacttactcagactaaataattaaataacataagaaaggaacacgaatacttactttacagaagaagttctccgaacccagagcagagtgtactgacagctccggtactcctccagaattgctcctaggaagctacactcgtcgaggtagaagttggatgagcgccaaacttccgggcactcctccaaagcttcccctcactctctaccttatt

SEQ ID NO: 14202 - DNA, 1501 bp, Oryza sativa
ggaagagtctagcaagctagcaactgtgcttgtgggaatatatactgaaacaaacactttatatgaaactgatttagtattattttcaatacaaaacaaacacattatcaaaatatatttaatgttgaatttaatatatgaatctgatttagtattatagatgttgataattttttctataaatttaattaaagttaaaagaattttaaaaaaagttaagtattttataatatgaaacggagggagtactcagtactagctagggtctgaaagtcccagagagtgtcttatacgcagatatcctccccgttccatgacatacgatgttacgtagctgtagctggtagatcgattgcagttgttctctcgttctttctatccatacttgcattatattggcgtattccactgttcctactcaccttgtactagttggctgataggcgtagttttctatgggtgcttgaacgaaggatttgtaaatggtttgagttggattctccgagggtgtttatgcttatacttatcagctaaaatttaaatttttaatcttaaatttgaagccaattttaggattttttttatcgaagtttattttctaaccattgcttttaggtcgctaaaaacacgtatataaaaattgtattcacaaattatttttcgtttgtaaatatttcgtttggtttattccacgaataagcgaaacattggggccacgagtttctcgcactacaagtaatttgaaaatgaaggtagtacgtgtcttcgtacataagtacaagttatttattagttttagctaaaatattaaatgaaattatgtacgataaccatatgtagtgtacttcctctgtctaaaaataggtttattttttatttatcccacatataacaatatgaaggaaaagattacaatacctcaactttatcaaattttaatgtaattgttcaactatatctacttctcagtgcatttatactctattttcacaaactctaattaataccatgattttaaaaataaatttattttgaaacaaataatcttatttcggaacggatggtgaaggatgtacatgtatacaagttatttatcatagtggctactatagcagatagctgggctggctatgtgcggggagcactgaattgttaatggttcgacggagtctacatcgatctctactcgcttgcagttgcagggcgaggtggcgggggacgtgtagtggactacataccatgttttcttatgctaggtactactatattatttataggaaaatattgtgtatgtttctattatacagttgtagaaggtgtgatgaaaaaacaaaacactgtgcacggtgtgccgtactcttaaaacactatgatgatgcaaatcataggcaaccacggatagatatttaattagcgaaaataattttcttttaatgtttatgcaagtaatataatattagcttttattgggtttagctttctcacctgtggtgttacagca

SEQ ID NO: 14203 - DNA, 1501 bp, Oryza sativa
gacctgtatcattacaattcgagagctattttgagatatgctagtacttacccgtttggtgcattcattaaatttctgcgttaattggatccatgtcattacaaatctgtcattttggatgaatgacactactattctcatcgattcgtatatgtcattcaaattcacacaaaatttaagctgctcttggatttcattatttagttgcaaatgtctccagcaatggcccttttaattgttgtcaatgatttttttttatttcacgcaattattgtgacacttgggttgctgaagttagttacataaattgtccagctctgattgtaaactgtcctttggcacttgtaccacactccattttcttgcagacgcatactaaaggaatattctttgttgcagtggtagtggctcatcagcacggtcattgatgatatctcttggtctgaaggatcattcccaggtattatttgaacttaccttcatatatgactgtaattctccatgtttttctcctgaatcttgccaaatcagcaagcatggtcgattgtactgtgcatattagtgtgttctgaggttagaccccgttattttgcattggaatcaatagtattctcgtgtatgtatatgaaacaattttgttacttctgcaggcaacaatgaaatatattgtttccaccataattgagaaccgcctatggtaatactacctccatcccaaaatgtttgacgccgttgacttttttaaaaatgtttgaccgttcgtcttattcaaaaaatttaagtaattgttaattctttttctatcatttgatttattgttaaatatatttttatgtatacatatagttttacacatatcacaaaagtttttgaataaaacgaacagttaaacatgtttaaaaaaagtcaacggtgtcaaacatttaggaaaggagggagtagtttaatttgcataccgagctggggttggaatggctgggcacatgtctattcacttcatcaacagagatgttgacatgattagtgctgagcaattaacactctcttaccaatctagaatttcgtaactatgatttcttcggagtcgatgtatgacaaactagttatataaccaaagttatagcgagaattgcactactagctttgatgagtattccatctacgaacttctgaatgctaatggttgtattatgttgctttgctaatttgtggcctaaaattggtgaaagcaaagcacttttcaggggcatatttattcggaatttcaaggtcgcttcttttttgatggaattttgttaataatctataccctctctagagcaacacataacttgtactgttgtggtgcagaggccaggagtatcctaagaacaatgtattgactgataagaaagcccgttgttggctgcaatataataggtgaacacgtcacttgtagttagcgttataactaaggtatacaatagagatatcctatgcttaatgtaacataaatattcta

SEQ ID NO: 14204 - DNA, 1501 bp, Oryza sativa
actactttgaatcgttattgcaatattgtcactaaaattataaaaatgccactagaactgtcatccgagtggtatcctaataatattaaaaaaactgatggcaaatttgtaaatgcctcgaatattttttttgttggtgtgatgggctgaactggcgattttttttcgtctctcatctggacttctcgttattctgcttgattttctatacgttacgtgtgtgtagtatgaagtcctggatgttgtaaaattttttgtggttcatagggaattgattttatgaagctgtgagaaaccgagtaatatcacatatcctatatttttttttctagagttaaatacgctggtggtaccacaaccgagaaaaaaccagataatatacgtgtagctattacttctcgatcaccatctccatataaataattgatggatagttatattgctcgatcgatgcccaaacatatactcgctccgtctcataatataagggattttgggtggatatgacacatcccattacattgaatttggatagacggtccgtccatattcactgtactaggatgtgtcacatttacctaaaatcctttatattatgggaagaggtgaatagtggattggtggtccttccacgtatgtatgaattagtaggagacattgaaagtttattaatactaatagctacttgtcctagctagcaagtcacatatatctacttgtacctgcacgtacaatagtgtacgtgtacgttgccctgagcctgaagatcttttggctcgagttctggctgtcttcttttctaagcgataaaccaggaaaaagtatatgcacggtcatgactggaggattaattgaagtaggagtgtttgtcacatattcacatatactccttttaattatgccatcattaaattggtgtggctgaaattatttcagcgtccgggggacaacctgcgcaattaagcagtgtctaaatcgtattgtcgatcatcgatcgtggtcacgagggatatgtatatatatttgtgctaaagagccatcactgatagattatggatggtgggagaactagagcttatcatgcatagttatttaggcacaaatgaattaaataactattataacaaatgttgatgaagaaatattttataacaaattgtatcgtttagtagcttagaaaacatgctcacaataattttgctaccataatagtaggaattaaagaacgggccctaatatgcacgagcttgcctgaacctcccacacatgcatgtagaagtttttagatagtcggtacatctagcatttgtttcagtatatcaagttgcaaccaatctcacccccacgttcatatgcggccaattggttcaccataacacatacaaaagacagagtgaacgtagcccaacatattaggtttctagggatggaacctgcacatccaagttcaacattaaccacttagtatgagtgctctcaattacggctaattatttttagt

SEQ ID NO: 14205 - DNA, 660 bp, Oryza sativa
cgggctacaaagaaactaaaggaaagatgtatgttgtaatacgctggatatcttatatatatatcaactgaaaacaaaaagaattgggccacattagctgcagaaggactcaaggaagtttctgtgtcatatggaagtgaaggtaaagaggagcctaagaaagcattccccatgggacgatatatgttagacaaggaacgagaaatgacttcatgtatagataaaggttagaacgtttgaatttggtatattgtatttttgtatatgtcattgaaatatataaagaactaaataaattgtttctatatgggccttgaactagagacaaactcaaagaagtccaggtattagagaacattagcgtattgtatatttgtaaaagttgttaacataaaaagaaaaaatataaaaatattttctgtattgcctatgaattgtagaggacctcagagaagtctcagtgtcatatgactcaaacgtgaaactaagcaatttgttcccaacaggtatgcacatcagaaatatatactaacaagcggaggttacattagaacttgtggatgttcatgttacatgtagtgtatatatgttgcatacatgtatatttggaattataaaatgggggcatatgagttgcagcgggactaaaggaagtctcca

SEQ ID NO: 14206 - DNA, 1501 bp, Oryza sativa
gtgagaatcgttcatgcccttctcttattcattcattattccccaaactatcaataccataatcgccttggtcctgtccattcgcctcctccttccgtcccctattactattatttttcagcaattacagcagaaactgtcacaatctattagatcaccaggatccacattattacccttcattaccctctttcaatcccttctgcaacataacatacaacaaatacctttcaccatcctcacaactcatccttcgagtcaaccatgtcctatcatatcccccaattgaattgagcagatgaagagaatcatagcatgaaaggttagtatactacatgtaactaaagttttcaaatctgtttatgtatcctccaattgtattccaatttgtataacaattatgtatatgtgaattgcttctgtttacttattgagcattgcctacgattttcctcttgcaggatcgagctgaaagtttttgatgaattgtttttgctaacttaaagaaggaacaactattgttagtcctacacttatgtattgactattttttagtttcttaaaagaagattatactgcttgtgacctatgcaaattgtgctatggatttaatagatagaaggaatatatgttccagcacatggggaaaaatgcgaggattgtcataccagtcttccaagcaaaaaggactctcatcaaagcagataaactttactggcatgcgtttttttttttaccttatcctttgttggtcatgctgcgtgcacccgtccttttctttcgatatcctatcattggcatttcatgcttcaaatatagctcatgcgtgcatcctacacttgcaaagttccaataattttaaaatgtatattctgcaaagttttaataatttgaaaatatttaaccagtagctctgttgattgaaataaaaaacaaagggcttacccaatggatgttgggcaaagtacaccacgtttctcaaatgtggtgtacacctaacaagctcaaaccacaaatttcagtatgaatttggtttcaaaatatatatatttcttagaatacaggttagagatgctataaatatggcctacatgtagcctagctttatcaagaggatgagatgaaggcagccatgttgctacttcctaggattgagttgcagttctagtagctttgcttaaaggttcaagtctgctgaaggtgagataccatttatgttttataaagttttgaacttactcagttcatcatattgccaagaggctaatcctgatttttacacctaccatatcttcacagcaattcagcaaatcgaccagctcagcacgctagaataccatgtaccattaattggggttgctttcctgattcaattgtatatgttcaaacgaacatttatgcgcatttctatcacaacagtgtaaatctccttttctttgaatgctgattcagtgaccaatttgcatcaattttatgcactaagaacattttatagtgtgcc

SEQ ID NO: 14207 - DNA, 1501 bp, Oryza sativa
gatcattgatttaattgtaaactgatggataaatattttacttttttatataatttttcatagattctctctaatttattagagcatcacgtggcatcttaggagtatttgtagaagtgtaggaatagtattactcataggtgtaatgtacttgtagtccactattgtttgtagtatattgtttttatattctatttacctataatttgttgatggttgcgcacttagtatcaccctttatcttcggtgttggatgacacacgtgctcattagatatcagctatcgtttggtgcattgtgcatggatatctcgtaagtaatattatttagcgatttgtggacaatggcttgtatatagaattatatatggagataagtgaggacatatgttcgatattttaggttatgattaaccaagaatattgtatactacatatgtttagtaccctaagtaacaaatttaagattgtgttctaaagtgcttatcagattggctactctcttatttatattgaacatgtttcccgaaattgctaaacatgtttcctgaaattgctaaacaatatattatatggtgcatgttttgcaaatactttttatataaaagtttttttttagaaagatcaactaaatttatttttgctttttaatatttaatacaaaattaaacatgtgctaatgacttgcattattccaagtgcctacataaactcacccaataagcttgatctaacgaagtttaaagtaggagataaaggacaacgacacgatgtaaaaataatatatttgatatttaatttctaataatatataaataaagaaaaaacagtacataataaatttactaacctcattttaatatattagttttttttacagtatggaatgagtaatttttgagggtgctatttataactgggttttttcattttcaaaacgcaggtctaatagtgtacttcctccgtataaccttgtaagactttctagcattgctcacattcatttagatgttaatgaatctagacatatatgtgtttagatttattaacatctatatgtatataggcaatgctagaaagttttacattgtgaagcggagagggtacatgttatgtttttttctttttccgggggtacgtacgtgtgtgtgtttttttctatatagtattcgtatgtgactgggtacgtacatattttctttttgtcaaatagtgtacgtgttatggtttttttttcttctccgccggcatgagaagtgaaagaaaagcgtacacacacaaaggggaaacggaggtcagatggatacgtggatagtacgtacgctacggagggatcatacttgcgttggacggatggatcgagattttgatttccttttaagataaatctaacgatcaaaattaatgggtccatcaatttaaaggaaaatcgacggtcagatttctctattttaatagagtgacatgtggcgactcgagagcgtttataggatgccacatgt

SEQ ID NO: 14208 - DNA, 1501 bp, Oryza sativa
tagtgctcgaaccctccatgacaccctatattatacccgatgtgacacgctaaaactttacgcccctaaatctaagcttttgtatctagtgaaattatcgcagctctacagtacctagcgttgcaagcggcaaatgtactaaatttagtttttgaatttagtaccatttaaattgccatgtactaaaaagttggtgaaattaaatggaaaaatggtatgatttgttgagaagagtagataagtatagctgatcgctaacaacacgtatataaaagttttatttataattatttttggtttgcaaatatgacgtttcgcttgtcctaccgataagtaaaacgatggagtgtgtagaaatttttaatggtgtaagtttcttattggttaagaagaagatgtaggggaagaagtaatatttttaataaattttgaaagtaagaagttgttatatttaggacaagggagtaacatttcctacctacctaaacgagacacgtaaatttgtggtggatttccgtcgaatcctctaccattggattgaaccacaattcgtgaggcactccttcagctcggacgatcaccagtaacccaataaggtaaggattaggtcgtaggagtgggaagcctgacaagttaggttttttttgcgccaaattaaggtaggggatgagggttaggaaggggggaagatgtcacatcctgaatattgtttatttgacctttttttttcctaattacatctttccaccttaggtttatccatctaaaatagcttaataaaaattcatttaatacgatgatttaatatgatgaaatatttaagtactgaagttaatcatgaaattataggtggataatgacctcggctcgtaatcttaacaacacaactcggcttgttaactctaacgagctaggcctagctcggctagactctcgaggtgatttgttaagttcgttaggttcgttgacatatttatactactttcgtaatttataatttcagttgtaccattttatcatatataaacataataataaacactaactaataaagaactcacttaacacaaatagtttatgtgtaattaaatattcatattataagtcgttctgacttttttcaacgcaacattctcaacgcaaaacaaacgtaccaaaatatattcagtgttacatttaatgaaactaatttggtgtgatagatgttactatattttcatataaacttagtcaaacttagaaatgtttgactaagaaaaaaaatcaaaatgactcatagtatgaaacagagggagtaattaagaagcacaaagcacataaaaggaaaaagtccacattagactgaagtatcctataaactcgaatatttaaataggacaaataacttcccgactcaattcaaagtagttttagtcctacatgacaattcagttagtagttttttataaaaaaaaatcagtcagacccattctcacccaacttttttcccttcacatagtca

SEQ ID NO: 14209 - DNA, 1501 bp, Oryza sativa
atataaataatcccccccagttgctgaagaagatgaagcggatcctgctgatgaggagttcttccaggagcatgccggctacgatgagttttagggtttcagcctagttcccaagtcgcgcctgtgttgattggtccaagtcctggcttccgctttccttttgtaatgcagttgtgagctcgggatctgtccgcagcccaacatgactgtacatctactctataataaagagacctctgttgctgtgatattctgtctccctgtgataccagcactgtttcctgggactggtatcgattaacaggttaatttggagcgtcacgggctagttccggtcgggactagttcggggcgtgacagactacaatgctagtattacctcacaacaagcccaatgattccatggaatcaacctcgatcaggctatatgatgaatagtcgatgcgaatgtgagacacagactttcactttctacacacaatggctctgcaacctcctcctccacctccacttccacctccggcggtggcactcatcattgccgccggcggcatctacactcatgcatctgtcgactccaacaccaacccaaaggccaacggcagcaagatgagtgtggaatcgctgttgtatatggtggcgacgatcgccgttgccgcactgctcctcgtcggcgtcagaagcgtaatccattggtgcatcagctaactgaagaagaagaagcagagtgtcagcaagcagccgacaacgatggagacggcgacggccccgccgtctgggccccacttcaccggccccatatacaccgtcaacgtcttcaactacggcggcgtcggcggctacagtgacgtcggcagctacggctacggcgacggcgacggcaatggcgacggctacagctacagtgacggcgacggcgacggcgagtgccaggctccccaagcggcctggaattactttatgagctcataattgctggaaataaactcgccatggtatgttcatggcgtgagtgagcctgtgcgtgtgtgtgtgtgtgtgtctgtgttgtgtagtgtgcgttgtgtgcgtcttgttaggtcgatcgagtcatgatcgcgagtgcaggggtgctgcagagcgctcggtcggagtttgttagaggagtggtgtgcgtggcgcatggttcgggaaggaagccgcgtcgtctgggcgagcgtgtggctcacggcgacatcaagcgggtcctgtggaacgtggcgtaatggccggcatggaggctagctcctggtgtgtccccggactataagaagcctctatactccttcatttgttattttgtttgtgttcatgagtgtgagagtgttcctaggctaagccaacatttggtatcagagcctggagatgaagatcggagatggctcgacctccgatgcctccgtggagcgcgtcgtgcccaattccagcgtcatggagctgctgctgctaaccagggccaactaccatcagtgggccttggtta

SEQ ID NO: 14210 - DNA, 1501 bp, Oryza sativa
ggctggcctcctcgccatctccgaatccgactccgactccgactccgacaacgcaggcacagcaatccgaggagttcacggaaacccgagcgcgcacctggattggatggacgacggagaaacccttggaccttgcgaatccgaagaagaagaggaagatccggaggaattacctagcaccgcaagatcgccgccggaggcccggagatggggagacggccgccggagagggggatggtaacgagtgctccgctccggcggacggcacggggaatagttggatacacgagtacaaacactagccattaagccaggcctaacgggccggaatgtgttgatgggccctcccacgattatcttccccaagagtaagttaacttgaggtccctcaatttatcatcgattctgaaattgatccctaacaccgaattaccagatagaacaggttgctgaatttacaaaaccaaatcacctgaaattctaggcagtattaagcttggttttagcttacgtgcttttagatgcaatatcaagttctgaacacatatttactttgaatcagtgacaattatcgaactatagggtgaaataaacagtcaacttttttttctcaacaatccaagttggcatgcaaatcattgctgctatgaagttaccttctgcactctgcactaattaaactctagaaattttcttaattttccaacaaagagaagatgatggtgttactttgttacggttattttcagtttgcgtgagcacttttattatggatgtttgcatctcacggtgcagagtctgagatatttattacatcatcaaaacaaatgtgaacacttatctttgtttttgcttattaggacaaggcattaaggatttctagcaacatgataatattatcgtcacatttgggctgtgatttgtgattataataccacgtaaacgtcaagtcggatgaaaacagcggcactatgccgcataggatcaaacaaccctcatcgatactacccgggtgtacaatataagagaggctttttgtacccgatgttgtggttgagcgacaaaatcagacttggtccatagctgagggatgttaaatgaaccttttccccatcaagctcatcccaattgatctactaatccaacccagtttacagcccattaattcagtttggaataagttcacctgaggtcccttaacttgccaacgaatctgattttcgcccttcatccagaaaactatatacaacgggtccctcaactatcaaaatcagtgcagatgaggtccctcgacggttttgacggtggttttggctgacgtggcgcctacgtggaaaattttacttggtcttcatctgatgtggcattgacgtggcgcatacgtggcaatttgatcgaaaaaataataaacttagtaggacccgcatgtcagtctcacacacaaatcaataaaagaataatggggcccacgtgggcccacatgtcagctaaaaaataaaga

SEQ ID NO: 14211 - DNA, 1501 bp, Oryza sativa
tgcaaataggctcagtatgattagtgatatctgtataacttgccttgctcttcagctgacgggacctcggcgaccacttcaaaataaactggagcgtcggaactgctggagtataaacgacaaacaaggcacacaataaatacaagctaaaaggctactgaaatagccaaaagaaaccaattttaatggattcttgacattttaacgaatttactacaatttgaatagattaaaacggagcacagattacttagttatgaattttacaaggtgctctgtgttatttactattgacagaaaaaccttaatcagttgacagggattagagcccaaaaggaacataggattaaaggatagattgactggcaagcgagccttacgagataccgactcaacgagtcaattcgacgtgacacgagatcactcaaataatcaaccgaaaccggcgaacggaactggcggctttgaacggctctagactaaaagacgactcaggacggatgaacgaaccataggggaacaccttgctaggtttcaacgacgcacggctgcgacacggcgacgctagggcggctcagctcggcggctacgtggcggcacacggcggcagcggcggctcggcagggcggcacgcggcggcggttcggctagatggcggcagcggcgtctcggcggcacggctctagggctagggcaacgacacatgacacaaacgctaggaacagaaagacttaaccctaaaaggacggagaacctcatcggaaaacaacggcgagcagagggaggacgacggtagcggcggtggttccggcggcgagctcgggatagacgacgatgacgctagaaaagattgaacggaaggaattagatagatgaattgatgaacgctgcatcaaatacatccaaagtaaggagaacggagtaccggcgacgcaacggcagcggctcgtggctcggcggcgtcttgcggctaggactcgggtgggggtgaaaacggtacggaatttttccggattccggtcatgttttcggaaacggaatcggtctgtcataattttttcagaatttctcggaatcagaatcgaaaacggaaatattttctcggaaatagaattgaatatgataatagcagtttccgtcggaacccggaaacgatcggaaacattctggaaaaattgtcggaatttccgaagttcaaaaagcccatagattcaatagtccataattcatccctaacttcctagcccaacccaaatcgcagtggcatctaccctaactagctaaccctagaggagagagacagtgagacgcgacttgcgagttggaggcggagcaccggagtggcggctgcggcgtccagatcgcggcatcgcggcgcgcccccgtgcccaccgcccgcgccaccgcccaccggtggtcacctggcccctgctgtcctcgcccccaccatctcgcgccgccctcgctcttcgccgtttcgccaccggccgccgccaccatc

SEQ ID NO: 14212 - DNA, 1501 bp, Oryza sativa
tccagggcatcccgcgaaccggtccttaactgccatgggtgcgaccagcaaaaccatgcacccacagcccaccatgtgattcattttaattaaccaacaccagagcggtggtactaatccaacattatcattagaaccaacagtctaaacattaatatgattttccccattgtgaactagttgaactaagcatggctaagcaattcctagtccaaactctaatcatgttataaccccaagctaacaaaggagcatgatatccaaaaacatggctgtaacaataggtaaccatcccatagtaatattataaaacaatgcaacatttgaaagaaaacaatagagcatttgcaatataggatcaatatgatcaagtgacaagcatgacttgccttgctctgctgctggaggaacctcggcgactatctcgaagtacaccggagcgtcgaaagaaccggaatctagcgacatacaaagcaaacattgcaaacaggctataagactactgaaacagagaacaaaaccatttttaatggattctacacatttttcttgatttactgagacttgaatgggattaaacggagctcggatgaattagttatgatttttagaagattcactgtgtttattactataaaagaaaaaccttaaatcatttattgcgcaatattaaccagggctgacgtcagcacaggggagtgcggcgccgacatgcgggacccaccggtcagcggcacggggaggagagaggaggcgtcggcccgcgggcccactgtcagcggcacgggagatggaaggggcggcggcgccacgtggcggccgaaccgacggccccgatctacccaagggtagatcggacggcggtgggagctcgcggccgggcgcgcgggcacggcgcaagccgaaccggcgaccatggcgccggcggcgcagcgctcacgcggcggcggtgcgcatgcggcagcggcgcaaggcgacggccgacggcgaccgaccggcggcggagagcggcggctagaggaggagcggcggctacgcagctaggcggcgacgcggcggctaaacggtgcgggagagagagaaaacgaggaggagggcctcaccgacaacggtcgacgacggcggcgacggaggacgatggcgacggcgggacgagctccggaacctcctaatgaacaaaaggagagggattagagggagagggaagagcgcgagagagcgagagcgccggccgaaggcggcggccatggcgtcactcactggcgcacgacggggatgggtctccggcggcgaacctcaacggggaaggggcggccgaggtagatctcgaccccgcgaatctaacggcggcgacggcgcaagacggcggcgagcctagcggcggctagcggcggccgaagtagcaaaaacggcggcggcgggtggttgcacggcgcgaggacgattgggagctcgggaggggtcggcgaaatggggaaaaagcgagagggggtgccggcga

SEQ ID NO: 14213 - DNA, 1501 bp, Oryza sativa
cgccgccgccgccgtcgccacgccaccgtcgccacgccgtcaccacgccgccgccgtcgccacgccgccgtcgccacgccgtcgccacgccgccgccgtcgccacgccgtcgccacgccgccgccgtcgccacggcgccaaccgccgccccgatgccgccacaccgccattaacgaacgagaacgagaacgatcgaacgaacgagaagcgagaacgaacacgtcaacgtacgttgccgtgagaacgtgaacgagaacgagaacgatcgaacgaacgagagcgagaacgaacacgtcaatgtatgttgccgcgagaacgtgaacgagaacgagaacgatcgaacgaacgagagcgataacgagaacgatcgaacgaagacaagtgagaacgagggaacgaacgtgaacgagctagggaacgtgaacgagcgaacgaacgaggacgaacgttaacgtgaaatgcaatatatatatatatatatatgtatatgtatatatatgtatatatatatatatatgtatatatatatatatgtatatgttacttcgcatttgactatatacatctttttgtatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattactttatttgtaattagacttagtatgtaattattgactacggaagtggtgcgacaagtagcaattgactattgtagtcttaattagacttagcatatacgcacgaaacacttagcagacatgactattttagtcttagcatgtaatattatttgagttttaatataagattactttatttgagattagacttagtatataattattgactacggaagtggtgcgacaagtagcaattgactattgcagtcttaattacacttagcatatacgcacgaaacacttagcagacatgactattttagtcttagcatgtaatattatttgagttttaatataagattactttatttgagattagacttagtatataattatttactacggaaatggtgcgacaagtagcaattgactattgttgtcttaattagacttagcatatatgcacgaaacacttagcatacatgactattttagtcttagcatgtaatattatttgagttttaatataagattactttatttgtaattagacttagtatataattatttactagctagggttgtataatatacgtcacctagacttagcttatatcacgatttgtatttagacttagcacgtaagtttgtgtagggttctaatgtacgacatttacacttagcatacatgacttagattgttaaaacataaatgtctcgtggcttagcagatgtt

SEQ ID NO: 14214 - DNA, 1187 bp, Oryza sativa
gttagagtatcaccaacaatactccaatattatcctcaaaactgattttgagggccataaggaccgcatgatctatttcacacggatggaggaaaactgagaattttgttggtagtttgatagaaatgctcacttttatttttttaagataaaatttagtgtttctcttggagagttaagcttttttgtactttctatttttagtttagaaagcataaaacaaatttttagagagattatatataatctcttggtgatgctcttaaaaaaaatttcatcgtgataaggagcggagggaggggggaagaaaatatttttccaaacatctagtattacatctagtattacaattgacacttgcttagggtataatccataaattctggtttattttaattttttttctttctttctcacttaaatcccaggatggtatctctttcctggatgttggatgggccaagaattcagtcttcttaaataggagtttcaatatactccctccgtttcaaaatgtttgacaccgttgattttttagcacatgtttgaccgttcgtcttattcaaaataatttgtgaaatatgtaaaactatatgtgtacgtgaaagtatatgtaacaatgaatcaaatgatatgaaaagaataaataattatttaaattttttgaataagacgaatggtcaaacacgtactagaaagtcaacggtgtcaaatattttgaaacggagggagtatttgagaaaaaaggtcggtctatcatactatctttactggttctttatatggtgccgggatgaactgaacgtttcacttaatccagctctggccattaactgactttgtgattgtagcgatttggtatttttatatagtcgggtctgaatagccatcttttttcacctaaagcagcaattgtttatgaattttgcgatttcccgtaactatttgtgcgagatgttccctctagtatgaactagtcttcacttatctggccttcaactttgtttaggaacaatggttttgttataaaaccagctccgaaaacgacatcggaaaccaaacgcggaagaaaacgtcataggagatccaaaacgatgacgacaccgaggcacgatatttgataacggagttcagctgaagcctacatctccgaggcactgattactgacgctcctccccaatccagc

SEQ ID NO: 14215 - DNA, 1082 bp, Oryza sativa
gggaggggccgactaggtactggggactggataaggacaggggactgggggaggtgtcacgctcatctcaggtcggttttttgtgtcagtgttttgtaagaaccgacacctataatattgtataggtgttggtttttctttaaaacagacacttataatcgtgtaaatgtgtctttttttgtattttcagcttgcggtggtgggaaaaacactataagtgttggttttagctgttctagcacctatagtgccgatctgtatatgccttttagtactagtgtgcggcttgcactccccactggtcctttgcaacgaatgtgggagacaacagtattgtcatgcatggatgtggaggagaaagagaagagctcgacgacagtgagtactgcttcttggtagggaacttcttcttgagataggtgttctggaagttctctggaagttcttgatgtcgttattggtgtggtcatggagctcgaggtggtagtaggatagtagcccatcggttacaaatcagtacctagagacggtatcaaaccaggtacttacttgagacgggttgggccacacacaacacccggcttcatcgattcgctgttgcaactgctgattttcagcatatgcctatcggcttgcttattaggccgaatgctgatcagccatcggtagtgtgccccagccatgccaacacccatctacggccacataggcaggacattacacctatttagtgttgatcaatggatttaattgtgtgccctcactaatcagtactaggactggctagtgagttactaatttatcatatgctcaataatttagttctcaatttacaaattttccaataactacccgtttagggaagcaccaatacatatataatctctcaaataaatttactcccttcattgatccaccatgccaccctagatccactaatcggccattattccttagaagcaaaacgatggaattgcttatgctgacaagcatcacccagctcttgtgctgaaacgcatcagcgtaagcaaaaccatgaacttgaacatgtctaacttaaaaattcatgcacctcagcattg

SEQ ID NO: 14216 - DNA, 1501 bp, Oryza sativa
cccggagtagagtgtaccgatagctccggtactcctcccgaattccacctaggaaactacactcgtcgaggtagaagtcggatgagcaccatacttccgggcactcctccagagcttcatctcactctctaccttattctaatgtataaaagatacactagagcctcttgtaattcagctcaaagttgtgtgtgttggaatgagatgaagacctccttatataggctccaaatgatggttaggggcatgggaattgtccaaaacaccctgcaaccgcctctgggaaggaatccaagccatccacgtggaagcagatggcgaacggccgcagaacgggttcggccgaattggtgggttctgccgaacccaaaaatgtgtcatcccggcctctcctttggccggtaagttgcttaatgggcccccaataacctgcaccatgttttggcccaattctaaatggtttttattgacttatggggcctccaattcgtgtaaacgtgtcctgaatgtgcagaggtgcattttgtcgcatgacggatgtgttttctcctcaaaatacctgcatacacatatttcaccaacactagtggaaatgattagtaataatacctaccactaagttggataccatgttttatttcattatatgcaggtattgacggtcagatattatgatttaaggaccgtcaacaacacccccacacttaaccttttctcgtcccgagtgaaggctatgaactctacaacagagttatgacttccttactaataatcatgcaaacaaattattcaaagccatacctgtacttgtggatctttgtagtgtctaccatacaatcttggacaattgaggaatggaacaatctcgactcaagtcaccctaacttttcatgaagaacaacttggggtttttcatgtaacacaaaattataactttgctttactccctccattgattctctcgatcactcaaagtgtatgattcctaacaaaggcatatgattgtgccttttcttttcctaccatctaataaggcttatgtggagtttagggtatggaaaagagtagagcattgcttgcatcatatatattgcaaagtcaaataatggatccacggaaatacaagacatactttctggtcaagaatgtgcatgtgtatgtgtatggttaatttcgtgggtggaaaacggaaaaataaaaataactccttttgtatacctcctccttcatttatttttttttgaaatttgagagagtgcatggctatctttttttttcttttctttttttttcatcatcatgctccatacttgtattagcattttttttcttttgtttttgcatagccatgcttctctccctttttttttgaaagaactttggaggaagaggcataaatgacatggagtatttatttgatggatgaaatgaatgacaaatgggagatgctaacttctagtgtagaagtcaagcatatgtgcgtgtatgtgtgatgtgacca

SEQ ID NO: 14217 - DNA, 991 bp, Oryza sativa
ccataggggcgcgggcgcgccgcctcccgccggccgcgccgccgtggccgccttcgggcgcaccgagcggctgccgcgtggggcccggccgtcagccgcccgcgccctctggtgcggctgacgcgtggggcccacggcgtcggccggtgtgagcccgggtgcacctggtccaccgtggaccgtgaggctgccgcgtgggccccactcccgtggacccggtccgcgcgccccctcccctcggctgacgcaataaacttttttttaaattaaaatttaaatgaagaaattcgcaaatattcacttaaagagcatataaacttcaaatagccataacttggccatttgaactcggaattggaccgttcaagcctctaatttttccttaagaagtcaagaacccatttttgtgctttgttcctgcttgttatatggagtttattagagtaaaagccttttcttttccgttggtcttgtagacgctgcagcttcggaagatccgctcttcgtggaagttgaagccgacggttgggaaagcgagcaaggcaagtcacatcatccttgaacatattgaatcccagtttataaaattattttgatttaaattattgcattatcgctttatttaaattcccgcgttatcactgttttatctagccatgcctatttacctttgttatgaccttattattgttattgttaatatttccttgttcaccctagaataaacaaaaccccaactagtagacactctactcatggtaccactagtatgattttaggtagatgcttcgctggttaattaggcaacattaggtggttttacaactctagactttgggaatattctcatcacctggacaatatggaatggttggattattgtggaattggattcacacctccccctctattcaaaaccctcaaaatggttttaggctgggcttggggtgcatggttttgatagtagcacctcggccatataaggaccggt

SEQ ID NO: 14218 - DNA, 1501 bp, Oryza sativa
agaaaaaaccttttaagcatatgcatgtgcagcagtgcacgtacgggggtggtgatgaactggtgaggccgttgtttgtctagctcgttacaaaacctctaccccctaattcgttctcacgtcaagaagagaaacgtaacatgccgtaattctcgctgtaattcagtcattctgatacggcgcgatcgatctctgaacagtattgaattctgaaatagtacgtctgctactagtactagctgagctactgagtttagcagtaaaaattgcgcctgctttgccgaggtttctgctgtaaaaatattccatccacgtactacctcttatgcccgtacgtgcaaatcaagagagaattcagagcagtagtagtaccactccgttttttacccgaactagctaaattctttacccgtgcagaaggtatatcaggcgggcaaccgggtccagcgtacgtccgtacttcgatcaccttgcacaagctaggttaatgtccgggccggagatagatcggaaacacatgacacatctgttgcatgtacacacaaaagatctagctgcaatatactccgttgcacggttgcaaggtgattccgatttcgaagcattcatcagtgcaaccggccggggacgtgatcgagctgggccatgcaccgcatcgatcgctgggttggtacacgcagcagcaccggccggtttgcttgctgctgcaacgatcgatccagatgaaaatcagagcgcgtcgcacgcgggaatctccgtatgatacgcgatttccccctcccgcgcgcgcggccgcgacggcgcaaccaccgatcagcaggacggggaggggtagttccagtacgtgctcgccacggccgcctgattgactgctgctacgaaatgcacaacgtcaaaacggagaggatcggatcggacggctacgtacaggtacagcgccagtacgcgtgcagctacatcacgtctccgagaccatttcgctccgataccgtattgagttttccgtatatcaaaaatcattagctaaaccctagaaaaagcagcagcgataaaatttgatggagtaatagatatactacatccgtcccaaaataagttcttttttagctttctgtatctaaagtttgatcgtccgtcttatttaaaaaaattacgaaaaaataaaaaaaaattagtcacatataaagtaatattcatgttttatcatctaataacaataaaaatatactaaaaaacaataaaaatattgatcataatttttttaataagacaaagagtcaaacattgtatccaaaaactgaaaaataagttttttttaatggaatggaggtagttcatgagtttagtaaacaaaattttaaatcgtagtgctcgtaaatattacacacgagcatataatttcggtaggattatagtatggttttgaattcacttctggctttggttttcgtcattttaacatgtgtacaagagggggctcatttacgtgcgtgtgtgtcct

SEQ ID NO: 14219 - DNA, 1501 bp, Oryza sativa
  unsure (1)..(1501): unsure at all n locations
ctcccttggattcatttggaaaccctcccctaatcccgccggcgccattgatggagcccgagagcgccgcgccggtttccttcccctccggccgccctctcccccttccaaccctatataaaccctccccgcacctcctccattcgtttccgcctctcgccgccctttctcctcgcagattcgagctcgcgccgtcgctctctctctccgccgtcgccgccgagctccggtccgccgccgtcgtcgccccggaccacctcccacctcggcgccgccttcttcgggttcgccgcatcctcgccaacctcgtccacctctccgtttccgtcgccgacccgccgaacgccgtcgaccccgtcgacccgagccgcgccgnccgctnccttcgntccgggccgctcctccgtcgccgccatcgccccggggtgagccgtggaccatcgcctcctttcccccttcccacccctctctcggccgccgctccgccgcgccggtggtcgccggcggcgaccatcgggtcgcgagcacgccgtctcccgccgaccgtgccggcatggccgccctcgggcgcgccgagtggctaccgcgtggggcccggccgtcagccgcccgcgccctcgggtgcggctgacgcgtgggacccacggcgccggccggtgtgagcccgggtgcgcccggtccaccgtggaccgtgaggctgccgcgtgggccccactctcgtggaccccgtccgcgcgccccctcccctcggctgacgcaataaaccctttttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgttcctgcttgttatatggagtttattagagtaaacgcccttttattttccattggtcgtgtagacgttgcagcttcggaagatccgctcttcgtggaggttgaagccgacgtttgggaaagtgagcaaggcaagtcacatcatccttgaacatattgaatcccagtttataaaattattttgatttaaattattgcattatcgctttatttaaattcccgcgttatcactgttttatctagccatgcctatttacctttgttatgaccttattattgttattgttaatatttccttgttcaccctagaataaacaaaaccccaactagtagacactctactcatggtaccactagtatgattttaggtagatgcttcgctggttaattaggcaacattaggtggttttacaactctagactttgggaatattctcatcacctggacaatatggaatggttggattattgtggaattggattcacacctccccctctattcaaaaccctcaaaatggttttaggctgggctcggggtgcatggttttgatagtagcacctcggccatataaggaccggt

SEQ ID NO: 14220 - DNA, 1501 bp, Oryza sativa
gggaatacacatgagagattaagagaggagcaattcttgtcgttgccatcaatccttcaaccgctgcgtcgaagtcggagtcgaggccgttgatgatgtacgctatcagctcttcatcgtcaaggagcttccctgccgccgccatctcatcgccaagggatcgcatcttggcaatgtactcacttatggacatgggtcccttctgagtagtcgtcaaggcgaggaggacgttgatggcgcccgccttggatttgcaggagaatatgtcgttgatcatgttccatgcttgggctgtcgtctgcgcgccagccacctgctgcaggatctcccgtgatagggaggagaagaggaaccccaggacttgttgatcctgactgaatcacttgatgtattccgggttggagatggtggtcttgactttcttgtcgccatcttccttctcgcactcggccgccggagcttcaactgtgccggtgacatgcccttccagctgcgcaccccatagggtggtaaggatttgcgcagaccagagggggtgatttttcttggtgagtttatccgagatttgaatcccgaacagaggattggagatcgccgctgctgaggaagagctcgccatttgcagaaacacaaagacgaactaatctaatctagcaacaggctctgataccatgtggaagcgaggaactcctacggtgaggagattacgtgttgatgattgccacaaaatgggtgccaggattacaatgaggtatatagcttcggttcagagtttgttgtgagaacctagattacatggataagttctatcgcttctaactaacacaacaaactctgtccgacagctatatggagcattatcacatgtacaaagaatatccggactctaacacagtgtgcaggcaagcagcgtgtggccaggcggacgatggccgagcgtttgaacggctggcatgcaggcggaggccaggcgtgcaagcggaggtcgaaggccctgtggacgacgacgacaacaaaggtaggaaaaaatcctcaccttttttggggcgatcttggcggaggtgggtgggggagtcgatggcggccgtcggaggagatctggtcgtagtgccgcgcgggcgaggcgagatcgcgcgaagcggattttttttcacgccaggaaaaaaagtcgatgggggccgtactcggaacccccaggactgggggcttgggaggagaatctagggtcctcctcactttgggggctctagtagggtccctgctgaatctagtttttatctctaaaccctcaaaaactgattaggggctgagtttagggtctctgctggagttgctctaatggggattgatcgccaggggcgatcgggtctcccccctctcctccacgtggtttcctttttaggcaccgctttactttcctattttagtaaatttatacacctaaagtttgtacacctcaagtttacacatctaaagtttacagacccaaagtttataaatc

SEQ ID NO: 14221 - DNA, 913 bp, Oryza sativa
atcataagataatttcaccatctattccaaaataatttggcctgcacaaatgaactaactataagccaaattatgatcaaacacatgcatgcatgtccaagaggttgattaggtcccatagatggtgcatgtgcaaagaatcgatgaggggctcccagcgaaggagaatttggtcatggcgacagtggccgaagttgaagccgatggaggccgatctccgtccatggtgctccattcttctcggttcttgaggggtttttaagaggatctcatggaggagttgatggcgcgatggctctgcttgatttggtccagaacgacgggaacagcgacgaggtcacaacggcgtcgcgcagagcacgccccaaggccggcgatgacacagtggcgttcccgttgattcgctgtacgaaagaggatgaaatcaaaaggagaatcttgggcatggtgaggagagtatggaacgtggaagagatagggttggcgaagactcgtcggcgacgacgagcatcgtctttgtcacggctggtggtgagatcgaaggcgaggagagcagcaagagctctctccctcggttctctcggcacaggactggaggatgaggcgaggcgatgcgactgtgggagagatggagagtgagctcggtgttagagttcggatatattgcatgtacatgtgataatgctcccgtatggctgaggatagagtttgttgtgttagttagacaagataggatcaatctctgtaatttagctgtacacaacaaactctcaccgaagctatttatctcttgtatcctgtcgcccggtttgtggcattattatcaacacgtaacctcctctctgtaggagttcctcgcttccacatggtatcagagcaccccgctagattagattagctcgtttctgcatct

SEQ ID NO: 14222 - DNA, 1501 bp, Oryza sativa
gggaatacacatgagagattaagagaggagcaattcttgtcgttgccatcaatccttcaaccgctgcgtcgaagtcggagtcgaggccgttgatgatgtacgctatcagctcttcatcgtcaaggagcttccctgccgccgccatctcatcgccaagggatcgcatcttggcaatgtactcacttatggacatgggtcccttctgagtagtcgtcaaggcgaggaggacgttgatggcgcccgccttggatttgcaggagaatatgtcgttgatcatgttccatgcttgggctgtcgtctgcgcgccagccacctgctgcaggatctcccgtgatagggaggagaagaggaaccccaggacttgttgatcctgactgaatcacttgatgtattccgggttggagatggtggtcttgactttcttgtcgccatcttccttctcgcactcggccgccggagcttcaactgtgccggtgacatgcccttccagctgcgcaccccatagggtggtaaggatttgcgcagaccagagggggtgatttttcttggtgagtttatccgagatttgaatcccgaacagaggattggagatcgccgctgctgaggaagagctcgccatttgcagaaacacaaagacgaactaatctaatctagcaacaggctctgataccatgtggaagcgaggaactcctacggtgaggagattacgtgttgatgattgccacaaaatgggtgccaggattacaatgaggtatatagcttcggttcagagtttgttgtgagaacctagattacatggataagttctatcgcttctaactaacacaacaaactctgtccgacagctatatggagcattatcacatgtacaaagaatatccggactctaacacagtgtgcaggcaagcagcgtgtggccaggcggacgatggccgagcgtttgaacggctggcatgcaggcggaggccaggcgtgcaagcggaggtcggaggccctgtggacgacgacgacaacaaaggtaggaaaaaatcctcaccttttttggggcgatcttggcggaggtgggtgggggagtcgatggcggccgtcggaggagatctggtcgtagtgccgcgcgggcgaggcgagatcgcgcgaagcggattttttttcacgccaggaaaaaaagtcgatgggggccgtactcggaacccccaggactgggggcttgggaggagaatctagggtcctcctcactttgggggctctagtagggtccctgctgaatctagtttttatctctaaaccctcaaaaactgattaggggctgagtttagggtctctgctggagttgctctaatggggattgatcgccaggggcgatcgggtctcccccctctcctccacgtggtttcctttttaggcaccgctttactttcctattttagtaaatttatacacctaaagtttgtacacctcaagtttacacatctaaagtttacagacccaaagtttataaatc

SEQ ID NO: 14223 - DNA, 1501 bp, Oryza sativa
agactaatcttttgggttgtataggcctaggacctaaagttgtgactccggttgggcctgtgttggagtaggcccaatgtgaccctgggtggcccatgattggtggcccgggctgcgcactctaacaatatgaaaatgttctattaagagaatccgtttcattttgtgtttgaatgaaaatgttctattaagagaatccgtttcattttgtgttccatcaaacactgtttcaggaagtacactcgtgttgtttcactatgtatagattaaatgttgcagtgaattgaaacatcattccattattttgctgaaacattgtttttttatatggtgaaacagtttcaaaaaccgttgtgtcatacgttgtcgcaaaatgtttcatgaggtgatttggttgtgtttcagctttttaaacgattgaaacatttttgatctacttagtgaaacaattttgatctactcggtggaatagcgtcggacacccgatttgtaggtggtcccctctttttcatgcacaacttttgtatacaatggtcattttcaagacacattagtgagtcagcatttttacggggaatataataactttcatctctttataaagcttattataaaatttatgtaaaataaatggcttagtaaggaaacacacagatgttagggtggtgagcgtgtgagtgggtgtaatggtgcgtctgctctctactattataaaaattaaaattaaagatgtttttatcggtattttggtacgtcatccgtgtatgagtcggtttttaagttcgttcacttttgaaaatcatattcgtatttgagatggtttgtaagtttgttcacttttggaaaatacaaaagagtcatataaaaaatctctttaaaaataccacatgctaacttgagacgatcagattcctaactgtagctcatgattttcttatatatatatatatatgtatatatatacacacatgtacatatatacacacatatacatatatacatatatatatatatacatatatacacatatacatatatacatatatacatatatatatatatatacatatatacacatatacatatatacatatatacatatataaatatatatatatacatatatatatatatatatccaagtgaattctcacggtgaatttcaccttaactaaattatataacaataataagattaaaataatcttcacacgttgtaacgtatgggtattttttgtagtcaaaataaaaggtcgtagtactccgtataattattctgcttttcagcgtgtgtagtggtgtgctatgtctttgccatgtaatcaaaagtttattttgaagtgagcgtagcaactggttaaataacttgtgggggaatcaatatattcggttcaagttatagacttgaggtgctcgcatttacggctaattattctttcagtaatagacggcacactcatcaacaccgaaacatcattgatgactttgccgatcttgagat

SEQ ID NO: 14224 - DNA, 1501 bp, Oryza sativa
atagattgttatcgtaaaaatagatagttaatagtaagccacatttcaaatatagatgatagctcttattggaggccggaggcactgaggcagcatcttatcaagcgttgggctgaagtatatataattttattttcaaagactatgtaaaattgagtgtttttcaatgaaatttgttgccatgtgtggggctcaggcccaaacgctgccccacatgtgactccacatggttgatcttcttatatgcatactagctatagactcaaatatatttttttttacttgaagattcattggatattgtgaaatactccctccattccaagttgatttacatattttataggtacactaagactaaaaaaaagctaataattctctcatactatatttactctagcaacaaactcaatgcatgcatcatctccactatttgctagccaatagcaaattaagatattgcatgtgggttataaatacttgtgtgcatggatgcatgcatcatagcaaattaagatattgcatgtgggttataaatacttgtgtgcatggatacatgcatcaatatccatttactccaatgcacaaataatgaatagacttaataaattaacacaaaaatatagatcatttaggaataacctaaaaaaactatatgtagattaatttaaaatgaagggagtatacaatatgcatccacagtatcaatagagaactagttaggtcaaatatacgatcgagatggaatacaaatagatctccggtaatgacaaatattctggaaactataataggactgactaactatggtgaagatgataatgagttaatgacagacttatcgcaaaaggacctagaggaaccagctgaatggagctctatctgataatgatatatattcttgacattgaagatagtgagtgtttagaagatggtgagtgtttttcatcctctcatggagataacaacaataaaacaaatgccactaggacaagcttatggtgaacctaacattaaattcttagcatgatcttaaaaagtgcaatgggtttttgcggtgttttgccgcatcatgctctccttctgcaacttagagcaaatttaatagtatagctaactactagctccaaatcatctattgacaatttaatagccaattcatacagtaattgtttactatactattaatacatggtcccacctgtcatacacacattacgtcttagagtccgtgctacagttggctacagatctgtagcccgctacacttctctctcatattttatctctttaaaatatgtttataactagctaatagtctgctattgtatttgctcttatgactataggaatgtagccttcgggtatttggtgaggctttggcttcttgcttaggtccggtttagttcccagctttttcttcaaactttcaactttttcatcacatcaaaacttttctacacacataaactttaactttttttcttcaaactttcaattt

SEQ ID NO: 14225 - DNA, 1501 bp, Oryza sativa
tcacgttaggttcacgttcgttcacgttcacgttctcgttcacgtacgtttcgttcgttcatgttcgttcacgttcgtttgttcattcacattcacgtacgtttcgttcgttcacgatcattcttcgttcgttcacgtggcggcagcggagcggcggcatggcggcgcggctgcggcttggcgcggcggcggtgcggcggtggtgtgccgcggcggcgtcggggcgtcccggcgtcgtgccgccgcggcggcgtggcgcggcccgacgtcgtggcgcggcttcgtcggcactgccagcgcgacgtcgtggctagtggcggccgcatcgaggtcagagtcggcatcgtcggcgcggcggagtcgtgttcggccgcgacgacgtcggcggcggcgtcggcaacgaggcggccggcggcggtttggggagagagagagatcgaggtcggagagagagagagagggaggcggcggcggctctcaccccagagatgcggcggcggcggaggcagcgatgacgacgcgcgcgaagcaacggcgagatacgacggcggcgtcggtgcggggatgccctagggagtggcggcgaaggagaagccgagagagatcaatcggggaaaaaacttctaagtgttggtggagaagacgagggtgcgcatctggaatatatatacacccctagatctttagtcccggttgttctcaactaccgggagtaaagatatctttactctcggttgttctcatcaacggggactaaagatattttcccgctatttccaaattctttttaaacccggttagggttaagaaacgggactactgataagcgcaatgaatattaatttccattacatatgtgtttctaaaatagaaaataatgcattaaaattatttaaagtcgaaaaattaatgacaattacttcgaaacattattgttgtctatagtaaattaagtggataaaacgtaataagcaaatatatgatttaaaattaataaaaattctaataaccatatatacttagcatatgaatgatattaaattgttaaaaattgtaattaacatatgtatatacatacgacatgcatgatttaaaattaataaaaattctaataatcatatataattagcatatgaatgatattaaattaattgttaaaaactctaattaacatatgtaaatgccacatgcatgatttaaaacttttaaaaattctaattatcgcatataactagcatatgcatgatttaaaattgttaaaaactctaagtatcatatgtaaatgccacatgcatgatttaaaacttttaaaaattctaattatcgcatataactagcatatgcatgatttaaaattgttaaaaactctaagtaacatatgtaaatgccacatgcatgatttaaaacttttaaaaattctaattatcgcatataactagcaattacatgatttaaaattgttaaaacctctaataatcgtacgtaattaacatatgccata

SEQ ID NO: 14226 - DNA, 1501 bp, Oryza sativa
gaccgggttgatcacgatgatgctgccgcagacaaggggatgtcgcttgagccacaggcagttgcacgagccaaccatgtcgtcgttgtcgttactggctactggtccaggtgccgcgtgaaggccatcgccggagagggaaggcggcgacgagggcgccgcctcgccgaggtcgccggctgctgctccactgcccaccagcccgtccgttccggcgctccccgcgaagaagagagagagggaggagagggaagaagagagagaagggagagggatgacgggaggagtgaggctgatggtgtgcaacatctcgtcttccccgacgacgtacacctcctcgcacggcttcaccgccgcgccgcctagccgccggccgcggacctccacggaccacggcctcagcgtggagcgtgcacaacacaagcctgatcagtgccattgcgaagcaccacgacgccgtgtccgttgccgacgcggtccccacggacagctccgccgcgtcgttcatattccggaggtggagagaccaggcgcgcacgcccggagtcagccgtcgctccatagctagcagggagagggagaaacaggggagagaggaagtgagaagagggacttgtggggcccacgtgggccccacctttttttgttaatttgtgtgtgagacagacatgtgggtcccacgaagtttttttttgtttttgggattgatttgccacataattgccacgtcaatgccacatcatatgaagaccaagtcaaatttgccacgtatacgccacgtcagccaaaaccgctctcaaaaccgccgagggacctcatctgcactggttttgacagttgagggacccgttgtatggtttttttagttgaaggacgaaaattggattcgttgacaagttaagggacctgagatgagctcattccgtctggaaatgggttcggtttttcttagagggaataagttcaacggagatacctcaacttaacaccaacattctttgaggtcccttaaccatagaactagaaatgtgtatccctaaactatgtaaaaccatttaaaaaagggacaatttcgtttctgcccctattttgatgtctaatattgattttacccctacttttttcgttttacttttttgaactgaacgcttgttttgcccctactttagaggtgaagttaacggtgttaagtaattgacaaaatgacatttataccctctcatgtatgttcattaattatgtttttgtccccattttatgcatgtagctttataactttatttttgtgagtatatttaaaattaaatgaagcacattgactagtatctaaaggaacagataattacattttagaaaatgttgttaaaatgttgtttaagttctatcaaaatgctgaaattttgtcaaaattccatcaaattcagaatttgtccaaattgttatattagtcaatgcgggtcatctaattttaaatatactcccaaaaataagttctaaagct

SEQ ID NO: 14227 - DNA, 1501 bp, Oryza sativa
ctcgtggttgcaactgctcgacgcttcctagtacgtacgtggtgcgtcgccgtcgtcgccgtcgcgcgctcgtgcggtgtgggtgccgcgcccacgggaggcatgccagccaggccttgccggcgaggcaggccgtaccgacatgccagcgatgagattcttccggcggctcaggatatatatcgcatctgtccatggtgcatgcattcgtcttcctcgatcgatcgccattaattcccaagaattgagggaagctagtgtggtgatctgcagctatggaggagcagcagctgtgcaggctgaggcagaacgtggcgtcgtcgtcgtcgtcttcctcggcggcggcggcgatggccggcgcgctggagggcgtggcgcgggtgtacgagcacgtcgggccgctcgtgcggttcgcctgcgccgagcaggtggaggaggagctggaggcgtcggtggcgctgctcgacgcgtgcgccgcagcgagggacagcctgcgggcgatgcgcgcctgcgcgcttgacctcgaggtggccgtccgccgaggcgacgccgccggcgcccagagcgcggcgagcgcctacgcgcgcctcgccaggaaggcgcgcgccgacgtcaagaagcagcagcgccgcctcacgaacagcaggaggcgcgagcggccaacccgcgacggcgacgacgcgcagtcgctgcaggaggcgcggcggctcgccgtggacgtgctcgaccgcgtcgtggcggcggcggcggcgggcggcgccaccgggccgagcaggtggtcgacgtgcgtggcgcgcgcgttcaggaacaggacgcgcgtggcgtgcgaggacgccgaggagatcgcggccgcctcgccgccggcgttggctcacctgtactgcagctcgttgccgtccaaagatctccacgacggcggcgagacggcggcgcgggtgcagaagcagctgagaacgctgggagacacgatccagaggctggaggatgggctggagctactcttcaggcgactcgtgcattgcagagtcttcttgctcaacatgtgcagctcactgtcagagtgtgtatgaacagatcagagctcaaaaaatgcaagagctgcatgtacagtagatagctgtcagctataattttgacacctggatatgagtatatggtgaacaataaaaaatagcagtagaaaattttgagccattctcttggactactgtgctctccgatgccatcatacccatcgaaaggaagaagaaaagatcagaattctcatgtcacatatgctgatgaacacaatttagctttgtttcataactactactcctttagtcttttacattcgtacatgtacgaaattatttgttgtgaaacaactttcacataaactggactaacaatcagtcattaactaaggctgcgttcgttcattggagataggggagattgtcactcgttttccgcgcgtacgcttttcaaactactaaccggtgcggtttttgcaaaaaat

SEQ ID NO: 14228 - DNA, 1501 bp, Oryza sativa
tacggctgcgcttattttgggacggaggtagtacttactatcatggaaccaattttctcttaaataattctcccattctttttcgtaattttattcttctattgatgttctggtggttatcttcctaatcctactagctactagcatccactccacaggtcaacactagtagtagaattggtccattgacgtcagtgcccactacaaagattttggagtagtgcttatcataatttaatttgtcagcttgatgggttgctcaatggcagttactttaattcagggtggcagatgaacagatgattgcgtgtacatgcttttcctgtatctcggcatttttgtctccataacccgcgtttgatccaatcttatcttattcgattatgtctaattaagggttcaaccaattatgctctgatcatttcatcaacggttgatatagccgtgggaaaaaggaattatgcaaccattaatagtaaaactttaatttatatatgttctagttgtttaaaagttgaaaaataaacagaaaccttaaaattaactctaaaatcaagctctataatttaaattttattttcaagattttcattagcatgtttttttaaactgttaaacggtatatttcgtgcgaaaaccttctatagaagttgcttaaaaaattaaacaaatacattttttaattctttataatggagtcatattaaatttatcatatatttctcatttcatgtgtggctattggctaattagccatttcccgcctctgtttagaacgagctcttgtattgaagcctacatggataacttacggtacatcctagccatggggacatattaatttcggcatcgtacggtggatatacaacatatatacttcctccgttttccgtttcatattacaagactttcaattattatccacatttatatagatgttaatgaatctagacacacatatatgtctatgattcgttaccatatactctatccgtttctaaatatttgacgccgttgacttttttaaatatgtttaaccgttcgtcttatttaaaaaatttatgtaattattaattcttttcctatcatttaatttattgttaaatatatttatatgtatacatataaaagtctttaaataagacagacggttaaacatgtgctaaaaaattaacagtgtcaaatatttagaaacggaaggagtatataaatgtggacaatgctagaaagttttataacctgaaacggaggcagtagttcgaattgtgtctgatcgttcaaaagaaaaaaaaaacacccaaaagagccgtagccgacatgtataaagctccggctcgtactacgtacgtacacgcagctggttgtatgtaacgggcgagacgaaggcgatggcctatcttgatctgtctccgtgtacacgtggcctctgaaatttacgctttatagggtggtttagcgtaaactaatcatgcgcaatgatgcttgcaactgcgccgccgcg

SEQ ID NO: 14229 - DNA, 1501 bp, Oryza sativa
tcggatccgtccggattcatcccgtaatcctcgccggcgacatctatggagcccgagatccccgcgcccgtttccttcctctccggccgcgttctccccctctcggtgctatataattgctccccgagctccgctcttccgtttccgccgctcgccgctcgctctcgccgtcggcatcgtgctcgcgccgtgctcctctctctccgccgtcgctgccgagctccgttccgccgccgccgccgctccggtcttcctccttactcggcgacacctccatccgcttcgccgagtggttgccgaccccgtccgccgctccgcttcgcccgccgaccgccggagcaccgtcgtcatcgtcatcccgagccacgccgccgctttcctccactccggccgccgttctcgtcgtcgtcgttgtcccggggtgagccgaggaccgccgttcgccttcccccttccctcctctctctcgggcgccgctccgccgcgccggtggtcgccggcggtgaccatcggggcgcgggcgcgccgctcccgtcggccgcgccggcgaggccgccctcgggcgcgccctcgcggctgccaagtggacccggccgtcagccgcccgcgcccgcgggtgcggctgacgcgcgggacccacggcgccgaccgccgccagccgcgtgcgcccggtccaccgtggaccgtggggctgacgcgtgggccccacttcccgtggacccggtccgcgcgcccgctccctcggctgacgcaataaataggatttttaattgaaaattaaatgaagaaattcgcaaatatccatttaaagagcatataaacttcaaatggccatatcttggccatttgaactcggaattggaccgttcaagtctctaatttttccttaagatgtaaagaacccatttttgtgctttgtttctgctgttatgtggagttatttagtgttaaagcctttttcttttccgttggtcgtgtagacgctgcagcttcggaagacccgctcttcgtggaagtcgaagccgtcgagtgggaaaacgagcaaggcaagacacatcatcttgatcatattgaatcccagtttataaaattatgttgatttaaattattgcattatcgctttatttaaattcccgcgttatcactgttttacttagccatgcctatttacctttgttatgaccatattattattgttattgttattattactaccttgttcaccctagtcaaacaaaacctcaactagtggacactctactcatggtatccctagtataattttaggtagatgcttcgcaatctaattaggtaaccttaggtggttttacaactctagacttgggaaattctcatatcacctggatactttggaattgttggtttattgtggaattggcctcacaccgccccctctattcaaaatccccctaaaatggttttaggctgggctcggggtgcatggttttgatggtagcacctcggccgtttaaggaccggt

SEQ ID NO: 14230 - DNA, 1501 bp, Oryza sativa
ctcgtttgcaaccgtcacaactttgccgctgcggacgcagtggtggggcacgaccaggcctatatatgacatcggtgatcagctttagcattctcaaattaattagaaacacagtctttttagggaaaaaatttaaatgatagaaaaatatataatgtttttcgatggaggtagtacaaacgttaaatttcgagtgtttggttgtcggtgaatgaacaccggtagtgagaatccggtgaaatttcgtttgggtttggctaagggatgaacacattgtgttaccttgggtgcctcgatcggaatgaaaaggtagatggagaattaagtacgtgttgcacgtgcagcttcagcaccaagattcggcggcggaataacctgctctactctgtacgtagcagcaagagatttgaaggagtgtaacttgcttgctcagtggtagcaaagcaggccaaccgctggagacgcctgtcaccgtacgtgtaccgaccgcgtgaacccgagcctctgagcagagtacaccgcgcgggcggtcgtagctcgtctcgccacgccacgcccgcaccacgagcaacgcaaaccgctttgcatgcatggctcaatcccgtttcccgtacgtacgtgcatcgccttgatcataagttgataacacacaccgtacgttcctatataccaaaaggtctcgtccgtcgaccataaccgatcgaggtccaagctggtggagaaaggggctttactctcggttgggaaccccctatagtcccagttatataaccggaactacgaatccgggactaaagatagtctcggttgattctttttttttttgttgttgtttctttgctcaaatcgatctgctccctaaatatctcaaatcatccacaagcatcacagatttgggaagaaatacatcacatattgcaaagaaatgcatcacagatcacaaatacatcacatcacaaaatctcaaacaaaaaatacatcacaaatactaaaagaactgcatcataactcaaatacatcccagatcacatccaatatcacatgcatcacagatcaaatctaatgaaacacaaaataaaaaaaaaatcggcagagcagatggggatggcgccgccggcctcccggtccccgccctctcggcgtccgcgccagctgtcacgccccgaactagtcccgaccggaactagcccgtgacgctccaaattaacctgttaatcgataccagtcccaggaaacagtgctggtatcacagggagacagagtatcacagcaacagaggtttctttattatagagtagaagtacagtcatgttgggctgcggacagatcccgagctcacaactgcattacaaaaggaaagcggaagccaggacttggaccaatcatcacaggcgcgacttgggaactaggccgaaaccctaaaactcatcgtagccgacttgctcctggaagaactccttgtcagcaggatccacttcatcttcttcagcaactggggggg

SEQ ID NO: 14231 - DNA, 1501 bp, Oryza sativa
atggagattgcagactacagtaatgaacagtacagtacaatctcgtgatgcattttcccccaactaataccctggtgcccgattttaataaaataatttcatatatttttttccagtgcaatctgcactgcaaaaattctgaatcaagtatagattcgaatttactgtaaaatttcacagaacagctcagaaacccgatctaaatcactttagagatcgcctagcttcaagatcttaattaaatgcaggatgaattgggaaatgctacccggtgtattagaagaaaaatcgcatgcaaatccagaattcttcatagtatagaacaaaatgcaatcaaattcttgatatgaacttctgttgactgaagatcacagctgcaacagtgtatttttctatagagacacaggatcctagtagataagcaattaaggatatctgtactcgcgctgcaaagtctactgtaattttgaatttgagaaaggagacgcgaattcaaaatgcgaaagactgtctttttaaagcgcaatccgagctcgaattattcaaaattcagagcaagaagggagattcaaccacgggtttaatactcgcagattcagataatgcaacttcgatttgcgattacggacctaatcacggaatcagaaatcgaatccatcccaatcgagcaccaggaatccaaatcaaatcaaatcaaagctagtacaaaaaccctgcaagcgagcagcgcaaaacccgctgaattccctccgagctcaaaccaccatttactcccaatccatcaaaaccacaattcattccgcccaaaaattcaactccccagaagacaaaccaactaggtaaaatgcggatcaaaaaaggaaaaattcaagagggcaagccgaggggggttttcttggctcacctgctccgatctcgccgcaatggccaccgaatcagcccgggaaacgatcgagccgggcggtgtcgcggatcagggacccgattccgagcccgaattgtgcgccgaggcgacggatcgatgcgcgagagagggaaatccgagcatgaagaagaggagagagaaagtgaaggagaaggagagagagaagagcactgaatgctttccaactgcacagaaaagagcaaacggatgagccggctttaacgcgcaaactcggctcggctcgggcttgatctcggcttggctcggctcggctcgtggagatatggctgcgatctactgtgacgtgggggttgcctggacccaaatataataaatcggtggtgtaccaagcaggatcatgagtagagagactgacgcgtggggccagttaggtcgcagaagtaggtgggaccagaagtcagtgactgtgactcaaacaatggtggtttgtggggatgtttcctaaacgacaagataggggcaaaagaaaaaaaaaagaagaaggcagatgatgatttctatttttatttaaagagtaaatttcataaaattacatatactttacacgatctatca

SEQ ID NO: 14232 - DNA, 1501 bp, Oryza sativa
gattagcttgacgggcgcggcgagggtggcgtcgaggcaaacggactcggcggcggaggcccagacggcgggggacgacgacgtcgcggcgtagccgccggcggcgcggatggcggagaagaggcggagcaggtcgacgcggctcccgtcgccgagcttcgccgggagagggcgcacctcgcggccgcccgggtagacctcgcggaggaacgcggcgaggacggtgtcgaacaggtccgagggggggccggaggccgcggcgtcgccgatccggagatgggcgcagaagccgagagactgcagcttgctgaggatggagaggatgacgccggcggagtccatgggcaggggaggcctcgccggcggcgaggtcacggcggtgggccacggtggcgcattctttttcccttttttgtgcgagtttcgttgtttattttgggtttggatctttccggtgtgttcggtaggtgcggagtgaatgttaggtggtttttacatccagggacttaacttaagtccctgtctttagacactaatttagagtattaaatatagactacttacaaaactaattacataaataaaagctaattcacgagacaaattttttaagcctaattaatctataattagagaatgtttactgtagcatcacataggctaatcatggattaattaggctcattagattcgtctcgcaaattagtccaagattatggatgggttttattaatagtctacgtttaatatttataattaattttcaaacatccgatgtgatatggacttagaagttttagtcccatctaaacagggctaaccataaaaaaaaattataaccatgccattataattttctaaatatcgaatgttagtcttaaaaaaatactttctttttctatttctgttcatcggtcattaaataaatatgatgtgaaattgtagatggataaggtccatggtttagtaaagatgcgtttatttcgcgaaaagaaaatttttgggtgtcacatcagatgtttgaccggatgtccgaagggatttttagacataaataaaaaaaactaatttcataactcgcttggaaaccataagacgaatcttttgagcataattaagctgtcattagcatatgtgggttaatgtagcacttatagctaatcatggactaattaggctcaaaagattcgtcaagcgattttcatgcaaaccgtgtaattagtttttatttttatctatatttaatgttccgtgtatatatccaaagattcgatataacgtttttggaaagaactaggcctaagaggagatgccaattgagtgagacgatgaagactcctaaaagcaagtttaatagtatagctaactactattcaaatcatatatagtcatataatacactactaatacatggccctgttgacggtcgttagcgatcagtttcgcccgtcaatattactaaaataagaactagttatgctcgcaatgcatatttgtattt

SEQ ID NO: 14233 - DNA, 1501 bp, Oryza sativa
ctggaacaaaaacaaggaatcatatgatcagtcttaggtggagtcaaaaatataatccatctgcctaggagagagaattagttagtatgagttagtcataaaaaagaactttccgtatagcagccgaatgctattattattcctcaaagttatctttaataatattgcagatcgacccagagtattgctgttgcctgtgcgaaacatggttcaagctgaattctgtactgttctgtaaattccacagtgatgaatgccagagaaagataagaagcagagaaattcaagaaaagcttagctaagattgaatacctaagaaagatatagcatgtgaattataagttgcctatctatgggagtttccacaatttcatttcattataactaaaaaagctttaaaagtatcattgatagttttcccatcataaaaagcttccaaaatagaatttggagtgctgcttattgctgttttccacaactcgttttgatgtaaaaaaaacttggatttatttgttttttatgcaatgcatatcctttgaaattcagacacttaaccattctcacaaactcaattgaatttatgaatcaatcagaacccaaagaaaacctttaaactcctctaaattttattattgtgaaggtatcaagttatcaaagagcgaaaaggtatgcatcttcttatcaagattactatagaacatataaatagatatcaaataatcaagtattggaggtacgattagaatgatcattttagcatgtatcaacaattatagccaactcccgactcaggtagcaacttatgtcgagtatctaactatggctcagaagggaggaattgacggaaataatgttttcgcctaggctttctgttggcattatactatcttccaaacaatcatatcagtgtaatctctaagaaatacaaatgtactctccaaattacactaaaatgccaaatatcacaaagatgcgtcaataagttggtctattctcaacaagcattatcaattggatttgagcaaaaagatttaggccctgtttaattcccaaaacaaaaaaattcacgttgtcacatcgaatgtttagacacatgcatggagtattaaatgtagacaaaaaaaaattacacaaattgcgtataaattgcgagacgaatcttttaagctcaattgtgccatgatttgacaatgtggtgctacagtaaacatttgctaatgatggattaattaggcttaataaattcgtctcgcagtttcctggcagaatctgtaatttgttttgttattagactacgtttcatacttcatatgtgcgtccgtatatccgatgtgacaaccaaacccaaaaattttccccaactaaacaaggccttaatacaatcggtgaatcatcatagttaagctaacctcaattcagttagtacatcaaaatacgattaaacaacatgaatgatgccaaacatttcgataaagtgctactgaaggtattggaataacct

SEQ ID NO: 14234 - DNA, 1501 bp, Oryza sativa
tcgtccatggcggtggttgaattgttcgtttttgcagaggctgtacgggctcggcgcgaggaaggtggtgttcaactcgctgccgccgctgggctgcatcccgtcgcagcgcgtccactccggcaacggcaagtgcctggaccacgtgaacggctacgccgtggagttcaacgcggccgccaagaagctgctcgacggcatgaacgccaagctgcccggcgcgcggatggcgctcgccgactgctactccgtcgtcatggagctcatcgtccaccccgaaaaacacggtaattaatcaatcaatcaatcaatcaacgcaaacttccggcgcgtgtcggcgggcgtgtctcaccgttggcgatgcgtgtgtgcgtgtgtgtgtgtgcagggttcacgacggcgcacacgtcgtgctgcaacgtggacacgacggtggggggcctgtgcctgccgaactcgcggccctgcagcgaccgcaaggcgttcgtcttctgggacgcgtaccacacctccgacgccgccaaccgggtcatcgccgacctcctctgggacgccatgccgagcgccgggagcgggggcgccgccaccacccctctcgccgcgtcgccggcgccgtcgccgtctcgggcgccttagttcaccgatcacgacgtactgtagtgtgtcaattgtgatgtgtacttttgtagcgccgtacgtgctcgttcgcgcggattgttcttggaagcgccggtgctgggtactagtagctggtcgaattcacaaaattcgttcaaattatgtttttgggaccatcccaatgggacatatcagatgtgtgatatgtaggatcatccttgagttcaatatactccaatatttgtaagagtcctagcatcgatgcttttcgttttatcactcaaagccaaaaattaaaattttaaatttaatttcatagtagttttttttatcgtgatttattttcagcattggtttttattcaatctcttctctatctctattattataaaaattaaagatgtttttgccggtattttggtacgtcatccgtatttgagtcggtttttaagttcgttcgtttttggaaatacatatccgtatttgagttggattttaaccttgtttccttttggaagtatagaaggaatcgtataaaaaatcttttgaaaaaactcgcatgctaacttgagatgaaatacagactcctaattgcagctcatgattttttttaaacaataaatatcaaagtgaattcccacattgaattttaccttagctaaattgtgtaacaataataaaattaaaataacatttacttgttgcaatgtacgtgtattttttctagtaaggacaaatatattaaagttttaatataaaatcatcacgacttataattagctgtacgtaaaataatgagaccaagcatgatactacctattccacctacgttaaagaaaaaagaaatgaaaggagtatataaccggatggtatttggtagctt

SEQ ID NO: 14235 - DNA, 1501 bp, Oryza sativa
tcggcggagcgaggagagggtagggggaggacgtggatggcatcatcgccagagctcctgtcatggcggcgagcccgccgtgtcgccaccggagtgaggcggaggcctcgccgccttggtttccctctcctccgtgtctctttcacctctctccctatcctcgcacgcgacggggggctctcttgctttccagattttttatcggccttcgtgtgtcggaaattttcggtccatctcatctgttagaactgggaaataatggcccaaaatagtccaaggccgatctgtctggccgtgtatgggagttataggggccgtaatgggctgctgcgtactggattattagcccaaagaaaaccaggcattgccccagcccaggtcaggctcacgctgggtatgagatgctagcttctactagtaaaggagtttcacgcaatctcctgaagatgaagatgaagtgtttcacacaaaacgagatgataataacgtgagattaattgagttttaattattacaaacttaaaaaatagattaatcttataatttagaataattttcatatagaaagttttcgcacgaaacacaccgtttagcagtttgaaaagcgtgccacgagtatccaaaatttaattcaacttttgttggagaaaagaacagtgcctaaatttgaaatctattacttcgatcaaattattaagtacagctttaataccaaatttaccataaatgtttaaggtttgcaaaactatagatttaataataatgttatcacaaactatatgttttagaatttaattcaccatcactaatgttatgttagagttataaacatctaaaatttgttattaaactgacacctagacatatagttatgtgttgatttgattactaaatttgtaattttgcgacactccagcttaattatatagtttgtagtattaagtttgatattaaatcggtaagtttcattttgaatatatagtgttctgtaatagtttaattaaaaaatgagaactcttaaaaattctatagtttggggaaatttattcagagaaaaagggaaacctcttgttcagtcatatggtctatttgattgcaaaggtcgctgatacccttcccactaccgatttaaaccgtcaaagctgctctatagagcaaagagagccaagttcttcaaccacctcagctaccacacatgccaattcctctctgaattcgttcttcagatggccacacgaatagatatatgttgcacggttcatcactgcactcaagctgacaagctgggaaacttgaaacggtgcgcttagattaacccaaacttgtagagaatggcacgacttaaccacgccaccgcgtacatccgcgcgctataaaaatccgtgcgtgccacctcgtcatgcaacacaagcacagcatcagcacaagtgcacaacacattcacagaggcgcagatactgataagccgaagcaacaatggcagctcaagctctcgccgccg

SEQ ID NO: 14236 - DNA, 1501 bp, Oryza sativa
cacgccatcgcttctcggtcggatccgtcatccgcgcgctcggaggagggcagttggatgtacatgcagacggggaggagctcactagccatggcgtgggcaggaaggacctagccgaccccgggtgcgggggataaactcgtcaggcagctacgaacgtggaaagaacttggccaacccaatgagcatggggaggggggagctgttcccgccatcccgcaccaccgacaccctcctcctatgccgacacaaccgcgggggaaggaaggggaatgaggcacgtggtcgaaggagatgctcccacgccgttgatgccctcctcctgcgccgacgctgacaccatgctcatgcggtcctgccgatgccgtagctgcgggtgcaccaatgatgacaaggaaagggagagagaggaggaaggaagagaagaagggaaatagggggttgggggtgatgatgttgggtttgccaaaactgccatccaaactgctaaccttatttgcactagttttaagagttgacggacaagccatatctggtattgcggtttaggaacgaattttacactcgacgataaattaagagatctaaagtgaacttattccttctccaaatcggataaaccgagggacgctaccaccaagtggcccatccgccatatccgggccatgatcccaaagcccaacaactaacggaaccgtatacgtcacccacgccgtccacctgatcgccacatcgcgcgagggcgatgcaccgtgggatccacatgaacagcacaggcgcacagcaataactccatccgagtttactgctacccccacggtgacgcaacgcctctcaggctctccgtgtccgtccgtcccaacggtctcgcagtaaatagacccggagcagcggtacactggcacggagcagcagcgcaggctgcgctgctagtgctcgtcccccgtcccgcgcgagcaacggtccgctcggtcgcgatctcgcggaggccgtgtagccgaccggccgcgtgcatcggcgggctgaatacgtacgcgaacgcgaggcgacccggaattcgccgcgctctctctctcgcgcgcggtcggtgatcccgccggcgcgctccccgggcagagagggaaaacaaaaaacaaagaaaagcggagacgccacgacgccaactttaacgaaccccaacgaacgataaagccgccccaaccgctgcccaagcgccaaaaaaataataataataatacacacacatactgacacatacacagtaacacagagaggagagtgagagagagtctctgcttccggtgagtcaaagctcccggcgcggccggcgggaacggcgagcggcgaccgagcatgagggagcaggaggagggtggcctgcaggcggcggggcgccggggtggggttgtcagggcgctgctcggcctcggcgcgatcgcggagggcgccgccgccgccgaggggggattgccgaggaaggcgggggcgggggacggcggcg

SEQ ID NO: 14237 - DNA, 1501 bp, Oryza sativa
agtacctgtaaatcacctgtgaaatccaatcatctccaaaaccacttcgtaaataaattccaaatatcaaaaccaataatcttcaatgccaattgttcatcacagaataataataaaaaacacatttgattttacaatattttcattttttaaatatcttacattgtcaatagggcaaggactatctagcactttgcgagttacttaaactaaacgacgtgcatcacacccttccaccatcccacaacactagcatcccaaggtcatgtttcccattcccatcctcttcgcacttctcccattgtaactctcttcaactattgtgtttatatcttatactatgtatctgaccaactctttctgccaaaaccactccagtaatttttggatcttgctgcactggatagaaactgaccgagggaagaggccgttcattttcccttcagcttcccctttacctgcgataagcataggaggagcaaatggtgaggaagaaaccatgacgtggaagggagcgtgccagagaagaaggttgcctacaccgctcagagaccggagacttccattgacctcacctttgctggttttgtctaccccgcacatacctggcttcaaatctgccacctccatagagcaaaccaatcttttccaaattggagctctcaacattgttgggacaacttgggaggagcatccttaatggcaaccccattctccctctccgcctgattaggttgagggcatttgcctccacatcaagctatccctcctcaacccatcaacgatgaagacctatcctcgtctcctccgctgtggccaccaccgccttgtgccgacaactgcacagtcccaggcatgcttaggctgccttcttccactgaaggatggatcagtcccaacactaatcccccgatgtcattgagatttctgcacatggacgtttccccaatggcaatgtgacgccggcgacctcgttcgctgccccatgacttgagctaccgatctcatccacaatgccattagttcaaagggcggtgataaggactagattatgattgcaaatccagacctagcgacgcaatgatggctagccgacagcagcagatctaactagcaaagtttgcacccggaggcaggaaaggtaattggtggcggtggtgccatagccttcgagcggagagtaggagaaatgccattaccataactctccaatcgctcctctctattgggtttagttccatggagctaaaagtcaaggcctaggtcgcatgggctatgatacaacaaaagagattgttgggcctagattgaaataagtcttcgaggccacatgggttgatgtgacggaggagattgttagggctgctggtgatggaggagattgttaatttcagtcttaaattggtaaaaccgacgatacgagagcacaactcaaaatatgagggcagtctgcacctatcatctactcatttgggttgtgtaggttcactacactggtcaa

SEQ ID NO: 14238 - DNA, 1501 bp, Oryza sativa
ggaacgcatgatgcgtgtcttggatggatttattgtgcttgccgcccatgagaaaagaggaagatattgacagatgagttgtgctaaaagtacgaaaaaaaaagggtggcacattttatatcaccaagcaatataatttcttaattaggctcactaatatgtctagttaagtatgacagaattaaattgacatgagcactaaacaattttaccatacttgatttataaatatatgagcactcgcatttatcgaatactaccttaattgtcagagtttgtttggaacacatgaatttcctgtagagaataattcaagacctgcatagatctgtcaaaaaaaatcttaaggttctaatcagtgcctttaattaaactgtttaattggagcatgtataatactgtttaattggcacatacatgatgattacaactttgaagcgttgggttccggttgtaatatatacagcgttaggatttaccttttctttctgcttgatgacaacacttgcaagtgacatgcaaatgtgcaataaactttcctctattcttttcatgacgatcgtgacacagaaacagagagagccgtccacattggatcgatcacaccaagatatgttttcctaatttgccctagtgcttttagaaagttcacgagccattttgtcaaaagaaagaaatattcaggtaaaataaaaaacgaaatgctttaatagaaagagaaaaactggctttaataatcatgttgcaaactaactcttttcttgttgcttcatcgcttaaaatttcgcaaattaagggtgtgtacgtgtgtgcatctgatgatctgaataacaaacaaacaagtttatgcaggtaaccgtatgcatgagcaatatccatcgtatcatcccaagagaagcaagcaaagatagcagagctaaaaattccatgaacatgcaacaaaacaaaatttcagcgaaactgccgaaaagcaagtttgtatgtttattatatataggtgtacacggacaatctaccataacaaacatccaaatgctcaacagacaaagctacagtactccttccttgtacatcaatcacatttgatcaccaacactcaactactacaaatcatataaattagttttttttaaaaaaaatcataaaataaaactatacattacaaagttttggtggagaccgctggattatactcttacggtcttacctcataaagagacaacgatcaaccgatcatatctaatctatgcaaaatttaagaattttcggatgcacttaaagaaggacaagtccttgattctcataagataaataatcgatattgtggaatattctccactaaatatcaagaaataaaaacctccacagaaagagctcccacatgtgcaacaccactaaataatttaatccctaacaaacccaaattcccagctcccactcacccatttgctcctttaaaatgttgccaccaccttctccttccctcctctctctctctctc

SEQ ID NO: 14239 - DNA, 1270 bp, Oryza sativa
ccgtcagcttggtgatggagccgagcctcgcgggcggtgtgccttccgctcggttgcctgctcaagaaagctcatcgtggaaacctaactgtaggtaaatttcttgtccaagttcagttttgatgaacactagctagtaatcggtaaattgttcttgtgttctagagagagagagaggagagagagagagatgctttagttatgtagttgttcttcactctctcatctctcctctcccctttgcaattcttggagcacttgctttctcaccgattaaaagaacaccaatggtgaggtttatggagagagagaagagactagagagagagagagagaggagggaaggagaaggtggtggcaacattttaaaggagcaaatgggtgagtgggagctgggaatttgggtttgttagggattaaattatttagtggtgttgcacatgtgggagctctttctgtggaggtttttatttcttgatatttagtggagaatattccacaatatcgattatttatcttatgagaatcaaggacttgtccttctttaagtgcatccgaaaattcttaaattttgcatagattagatatgatcggttgatcgttgtctctttatgaggtaagaccgtaagagtataatccagcggtctccaccaaaactttgtaatgtatagttttattttatgattttttttaaaaaaaactaatttatatgatttgtagtagttgagtgttggtgatcaaatgtgattgatgtacaaggaaggagtactgtagctttgtctgttgagcatttggatgtttgttatggtagattgtccgtgtacacctatatataataaacatacaaacttgcttttcggcagtttcgctgaaattttgttttgttgcatgttcatggaatttttagctctgctatctttgcttgcttctcttgggatgatacgatggatattgctcatgcatacggttacctgcataaacttgtttgtttgttattcagatcatcagatgcacacacgtacacacccttaatttgcgaaattttaagcgatgaagcaacaagaaaagagttagtttgcaacatgattattaaagccagtttttctctttctattaaagcatttcgttttttattttacctgaatatttctttcttttgacaaaatggctcgtgaactttctaaaagcactagggcaaattaggaaaacatatcttggtgtgatcgatccaatgtggacggctctctctgtttctgtgtcacgatcgtca

SEQ ID NO: 14240 - DNA, 879 bp, Oryza sativa
ttagaaggaatgtatttagtggaccaagttttcaaaaggagattactctgtaaagaggtgatgttagaggagacaagataaagataaagattaagtgcttcacacaaaacaaggtggtaataacgtgtgattaattgagttttaattattacaaacttgaaaatagattaatctgatattttagaacaactttcatacagaaagtttttgcacgaaacacactgtttagtagtttgaaaagcgtgccgagaatatccaaaattttatccgctccttgcagtggaaacgaactggaagtgagaaatattagaaacctgcttataattgctttttgaagtaatgctcttgaagaagtaggaatccaatagagtttgtcctcattatcctgaggaacaatctgaacctttgatatgatttgcaccatttcctagtcaaaaatttgattgagcttgtttttagaccaagatctaaaacagtttgtaacgtatgatttccggacaaaaaacccatcattctactcacggataacacatcagcttctttaccagctaatcatgacacttacgggcttagagcattcctagctgcttgcttatctatttcgtccctcatcaacagcaataacatcagcagctaatctagtagatgcaccaaccctatctttaaatttagcatgtgtgctatcttggaaagagaaacaacaactttggtgttgctctcttcttacggagctcccgccccatccggatcgaccgagcaacgcctcgtccatcattgtcatcattactagccagcgtaggtgagtccctatattccctttacttttttttcagcgatggtggtagtggcagggcttcaaagggtagagccatggcggaa

SEQ ID NO: 14241 - DNA, 1335 bp, Oryza sativa
cggtccctccccgccgtcgcctggagcgccacccgccgccgaccagggccacccagccgcgcccgttgccgctcgctgccaactagtgttgtgcccacagtcggcggagacgcgcccgccgccgttcgcccagccgcgcccgtagccgagtggaggcacccctccacgcccgtcaccgctcgtcgctcgccgccgaccagttgtccctccctgctgcacccatccccgaccggaaccgcgcccgccgccgcttgccccaccgcgcacgttgtcgaccggagccaaccagccgcactcgttcgtcgtggcgcgcgcccgccgcccgcgctcgcgcgccgccgtgcgcggccgcccacctcccagtctcgcgcgtctttcgcccgccctcgcacgcccgccgccgtgtgcgccgaccggccgcacggccgctcctgacgacgagccaccgcccaccgctctcctaacgacacgagagggagaggggtaggaggggaagaggaaaacgaggtgagagaatgacaagcaggccccaccgtgtttaaaaaaagaaatgctgactgggttgccacgtgtgcgccacgtaggacaaaactgctccggattgggtcgaggggggtaattcgtccggtattaaaagtttagggtgagtgatgtctgattttttggttcagagggaacttcggccgacgacgatagtttaggggggtaattcatattttttcctttgcgaaatagtggaacttgaagatgaaggcttgatataatgtcaagattgatatttgacgataacaagggtgggcatgtcatgtcccttccagtcccagatgcttgtggggaaaatatcttgttcattttgcatcttgctgattgcatccatccatatgttaattggtgttaatgaattgaaccggttgcttcttggtcgggattggattagctgcagcctgcaggcctgcatgtgtatgcaacgatgtatgtatgtggttgcttccattacttgacgctatatatgtaagggtgttgcggtctgaataagggtaagagatggtgatgtgagagatgcaaattgaagtgattggatgacattggatttggcggtggaacggaacggatgattcctcttcgatctgttgtttgattcaacgtagctgctggctaactatacgtgtttggttaataaactgctgctgcgcttcatgtacgttcagtgaagtgaataggcagctaaccttcattaagaaaacagcagaaagttaaaaaggttggattctgacattgaagcatatatatgttacatggtactagtcctgaacacggctggggttgagcagacca

SEQ ID NO: 14242 - DNA, 1039 bp, Oryza sativa
tgcccaccgccgctccgccgtgaggacgaggaagagcggagaggaagaagagggagagccccattcctctccctccctccctcccgccggccggcgtgcgctgccgctcttctcgcgtcggaggtacacgcgacgtcgttggcgaggtcaccgccgctccacccgcccctccgctttgcccgcaccgccgccggcggagcggcgtccttggcgaggccgccgtcgttccgcccgcccctccactctgcccgctgtcgccactctgtcgagaggacgacggagagcggagaggaagagggagagccgacagaggagagaatgacttgtggggccacgtggggcccaccattttaaaattattttttgtgtgcagctgacatgtggggccatggtttttattatttttctgagaaataattgccacgtaagcgccacatcaatgccacgtgggacggagacctagtcaaaccagccacgtaggtgccacgtcagctaaaaccgccttccaaaccgccgagggacctcatctgcacagttttggtatgttggggaatgcgttatatccggttttgtggactgaggacgaaaatcagactcggcgacaaattaagggacctaaagtaaacttattcctttctctccttccctctttcccctctcccggcccagcctcccatgtaatgccgcgccggcccacggcccaattgcgctgcgcgcatgccgacagcgtggccccatttgtcggtagtgccgtctcctctctgccacgcgtggttctaagggcattcccaacccaatgactaggatggtgtccatagcattaaataagttgccacctaggacaaaaaaatgatgtggcaagttaataaatgaggaaagagaaggaaatcatgtcttgcatgagacatggtttctacacaacatccaagacatcatgtgagataagtagcattaaattgaagtatggaatagtggtgtttgcattggaagagtagtgtctagtactagtttcttgatgatgtggagtttatggaaacca

SEQ ID NO: 14243 - DNA, 1501 bp, Oryza sativa
acggaaatggttttgctgttataccgatcgtttccgtatttaccgtattctcgcggaaattaccgtttcttataatatggtaattaccgtattctaaatatgtcgatattataggacatgtctatacttgacccacagcttatagattgaatgactcttcaataaaatctctaacttttgtacatggctaaaatgaagttaatttataatttatatagtataagcttgaatttatgtatatatatataacatacttatgtaaagttaaatatatgtttttatagtttaatgtttccatatttgttaccggtttctgatctgtaccgacatgtttccgtccgtattgttccgtttccggttttccgatatttccgatatcgttttcgtttccgactttaccgtttccgatttcgtttccgagaaaaatatggttacggaaatggttgaggctgttttccgatcgtttccgaccgttttcatccctagtcagaacatacgcaactgctgccttattgttggcacggttaaatagttaatgacatgcttttcacttaccttattttggtaacatttcattaatatctataacttataataaagtaatagaaaaaatagcctccacattagctctcaagatctagaaactttcatattaattggaataaaatgggaaaaaaaaaggaaaactcattgcagacaaggattctttctttttatttttttaaaaaaatcacattatagatgtgtagtgtccgatcggacacctgctgacctgcatagaacaaatcttttgcagtttgcaaaagaaaaatcttttgcaaggaaaaaatgacctaagctggctgctagagtacccgtgtacaacacaaatcacaagtgtgcatgtaagtagtactcccaatattggctcattaacagcacatcgcaatcaagaaaaacacatacaaagataaaatccgtacccctatcactgtgtttgttacttcgagcagagacgggttgtagtgcctgtatgccagtttatttcgatcaatttgacttgtgcaaacctgatgatagctttagtgaaaatcacagcaagcccaagccatcacagacggtccactacagccatatgcatctcaaattgggctgagatgggcccacgttaaaaacttacttataggccggcgcatactaccacaattctggcccatatggaggcacgtcaaccgcgaccccctttcggcccagcgattcgtcgccactagaagaattttttttatttataattttttttattaaaagtttgacaaaaataattttccattttgaaaattgacggaagtagtcgcctaccgccctctgggagggcgatttttaaaaatcgccctctcatagggcggcgaaaatgacgtggcagacggccgttcgctctcgggcgacggccgtcaacgaaatttgcaggcggcccccttgccgccctccgcgagggcgattttgtactgtgcggggggccgcc

SEQ ID NO: 14244 - DNA, 1501 bp, Oryza sativa; identical to SEQ ID NO: 13190

SEQ ID NO: 14245 - DNA, 1501 bp, Oryza sativa
agaggtaggtggtctgaggggatgggggtggggaggcctccggagccggaaaccgccgcacccgccgagccgccatgcgccagggcacagcaccgacccagcgctgcagaggctcgcgactgccggccaccacgccgccacgcgaacgcctaccaccgccagccgccgccgttgtcagccatcatgtcgccacgcgccgtggagactttgacggccgcacccccgcctcgaagcgccgcccgacgccgccgtcttcggatctggcgacgacgggcccagatctgtcgccgcccagcctggagatcccactgccacttgcggacgccgcgtcccccgcgtagagacagggcgccgccgccatcctcgttcaccaaccggctttgccggtggcgatctccggcggcggcgaggggggagggaggggaaaggtggggcgagggtttcgtcccccggtcgcctgcgcgtgggcgacgcagggggacaagcagcaactcagatatgcgaatggactaagaggagatatctatctatctattatatactaaaagtccattaaacgtcctacaaacactctcaagacaacacgtggcattcttataaacgctcttaaaacgccacgtggcactatttaatctcaccatcgattttcatttaaattggtggactcgttattttagaccattagattatatctatatctatatctatatctatcccgttgattttcacttaaattgatcgacccgttatttagatcattagattagatatatatctctaatactaatactttccacctatacatacgagagagaataggttcgccaaaaaaaaaatgtaagtacgtaagattgaaaaggaacaataaaacctacatacgtacggcaaaagaataaagccatcgtgtcaaaaaaagataaaaccaaaaaaaatatacgtatatagtatcatacaaaaaaatttaaaaaactcccatatactcccacatattagttattattaataaatttgaaaaaaaacaaatatattcttcgaatcagtaaaggtgtctcatgtgattatcaactataagtattgaaaataaaccaagcgctatactatagatgttggtcaaaatataaatgtttaacaccataaacacacgtggtgtctactgtatactaggaatctactcaaaacttaaaaaacattcttttgatcacctccatcttctcttttagtaccgtcgaattacaacttcactcattttcaaattgcgtaatgtttaacaccataaacacgtggtgtctactctataccatgaatctactctcaaaacataaaaaaaacattcttttgatcacctccatcttctctttttcctttcatgaagggcataagcatgaataatatagtttgctacgttgctattgtcatgaataatatagtttgctacgttgctattgtcagggttacgggttaggtataccttctacccttcgacatacgtcacatatcgata

SEQ ID NO: 14246 - DNA, 1305 bp, Oryza sativa
tcctgcagcccaatataaacatttcatatggaaaatagaaaaataatcatcagtgacgggcattatttaatgcccgatagagattaagtcatctcaatcgagcattagtatagggtctgtcactgatgagtatttaatacctggtagagattaagtcatctcaatcgggcattagtatagggcccgtcaccgatgactcatctgtgacgggctttagttaatgcccgatagagattaagtcatctcaatgggggcattagtatagcgcccatcacggatgactcatctatgacgggcactatactaatgctcgattgagatgacttaatgtccgtcacggatgagtcatctgtgatgggctctatacttatgcctgattgagatgtatgtttgactataatatgagtaaggtttctcagatccgattgaaaatttttctaagtccctccactgttagatatcaacaagttacaacttcttctccagaaccgatctccaaaaaactacaatgttaagcgtgcttggcctgaagcaatttcagaataggtgaccgatcgggaaattcttcctgggtgcacacgagtgaagacaaagtgtgtagaaaagactggtccagcctgggagaggcgggaagttatatttgtgatttctaggctatgatggacgtcgtgcccaattgagatggtggttaccgttctagtgctgcttgatgcaagtcaattcatctaaccaacgtattactccctccttcctaaattgatcatcatgtaatagaattcaaaatttctcaaattgatcattatataactgcatggacacggatttcatcggaatacaattaatgcagtatgggagaatatgtgcatacttaggtgtaattggcatgagattttaatcgatgcatgcattgtaggagaatgtatgcatggtgtcttgattgatgtgatttaaattgttctcgaacttggtgtataaacttatatgatgatcaatttagaaagaagggagtagcatctactacttccttcggttctaataacacttatcattttggacaaggatacggtatttaaataataactttgagcactatcatctattatattattattgttactattattattattattattttgtggaagtactttttaatgctaatctatatttgtgtctctatatttccaagagaaatattttataacttacttatagttaaagattttaaagtttgatatcatccttcctgtcagggttacggataaggtataccctctacccttggatgtacgctatatggcaata

SEQ ID NO: 14247 - DNA, 1501 bp, Oryza sativa
attcgtctcgctatttaccgtataattagttttcgtttttatctatatttaatgcttcatgcatgtgtccaaagatttaatatgacgtttttggaaaaaaaaatttggaaaataaaacaggcctcagtacggctctacctattgaaagcatatttctccggctatgaagtgtagctagttttatctgctttaacagtagtttctttgtaaactccgtaatctgttatgaacctttcttttccattaacggaagagggagaagaatagtttcaatgttataaaaaaatccagcgtgaacaagaagcgtcttgtgcccatagtagaaaaaaccggaccgaacaggcagttcaaccggagaaaaccgaaaatagaggttggcatagttcggtcgaatagaaagacaggacatgcaattgaatcgattcagaccactttaaccggcaggttttatgatgaactgggcaataaaccgccttcagtcggaccagactaaggcaagtcattgaatgaatgggcgacaggacagcctagttagttcttaggctcgttttttgggccgcacttgttttttttttagcaaaaatcaaatgaaaaggtgcgttggtggggagtcaacccgtggtcaagggttgcaaggcaactgccgactgccgtagccatcctaccagccagatgtttgtattgtaaaatcaaaggtgtttttgattattattgtgtgatgaacaattgggcattggaaattattggttttgttatttggaatttattcacgaagtggttttggagatgattggattcataggtgatcgcaggattttattattttatgtgaccggtcagaccgggctgtgtatgccggtcagaccggcggtgaccaagcggtcaggccggtcagactgtgtcgttttcggtttcgggttatttgtttggatatccgtgattatttcatgattatggcttctagatggatactatacgtatgtaatactgttatttgctactaatgagtcaagttggagatagcttggtctcggaatatggtttctttgtttatttcatgtgtaggtgactcgatgcctcgggagagtatttgcggtgatggaccgggagtcggcttggggataagacgacgtccgtggtggtcagagatcatgcgggatacttaggctagagttgatgagcgtggttgatggagattccatatggcatacgatggaggtattgtgtgcgtatgggatgcggagtcgaatttggaaggagtccgaatttgatatgattggttatgtaaagtttgtttcttgtactagagggttttctaaggtgtttaggactcctagtatgagtttggttcgtggctttaggctctctacctcgagtataaatagagggggagcgtgaggcttcccggtatcgctttagagagcaattgaattgagttttgagttagggtttcgagtttagtcaaaatttttgtaaggagtgctgttggtgcactttgtaa

SEQ ID NO: 14248 - DNA, 1501 bp, Oryza sativa
tctcgcgttcaaacgggtggatttgcccccgcaaatctcgccggcgccattgatggcggccggacctcccgcgcctattccttccccgccggccgctctctcccccttccaaccctatttaaacactccctgcacctcctccgtccgtttccgcctctcgccgcccttccacctcgccggaatcgagctcgcgccgtcgctctctctctccgccattgccgccgagctccggtccgccgccgtcgtcgccccagaccacctcccacctcggcgctgcctccttcggcttcgccgcatcctcgccgacctcgtccacccctccgtttcgctcgtcgaccaccggagcgccgccgtccccgttgacccgagccgcgccgccgccttcctccgctccggctgccttttcgtcgtcgccgtcgacctagggtgagccttggaccaccgcctcgtttccccctttccctcccctctctcggctgccgctccgatgtgcccatggccgccgccggccaccataggggcgcgggcgcgccgcctcccgccggccgcgccgacgtggccgccttcgggcgcaccgagcggctgccgcgtggggcccggccgtcagccgcccgcgccctcgggtgcggctgacgcgtgggacccacggcgccggccggtgtgagcccgagtgcacccggtccaccgtggaccgtgagactgccgcgtgggccccactcccgtggacccggtccacgcgccccctcccctcggctaacgcaataaacccttttaaaattaaaatttaactgaagaaattcgcaaatattcatttaaagagcatataaacttcaaatggccataacttggccatttgaattcggaattggaccgttcaagtctctaatttttccttaagaagtcaagaacccatttttgtgctttgttcctgcttgttatatggagtttattagagtaaaagacttttcttttccgttggtcgtctagacgctgcagcttcggaagatccgctcttcgtggaagttgaagccgacgtttgggaaagcgagcaaggcaagtcacatcatccttgaacatattgaatcccagtttataaaattatgttgattaaaattattgcattatcgctttatttaaattcccgcgttattactgttttatctagccatgcctatttacctttgttatgaccttattattgttattgttattatttccttattcaccctagaataaacaaaaccccaactagtggacactctactcatagtaccactagtatgattttaggtagatgcttcgctggttaattaggcaacattaggtggttttacaactctagactttgggatattcatatcacctggacactatggaatggttggattattgtggaattggattcacacctccccctctattcaaaatcctcaaaatggttttaggctgggctcggggtgcatggttttgatattagcacctcggccatataaggaccggt

SEQ ID NO: 14249 - DNA, 1501 bp, Oryza sativa
gcattttacctctaagtacaagctaaagcatgtgcgttgtaattatattataaagagtaaatttcataaaactacacgttttatggtccaagttgtagaaaaccacacacactttgacacttagcacttaattacatatatttggtagtgtagttttacaaaaccacactatcaatgaatggattcacccgcgagatgacatggttgtttcacataggacgaggacgtgtgatcctattatcagccatcgcacgaaattaataggatatgccacgtcatcatcctagatgtaacaaccacgtcatcacatgggtaaatccattcatcgatactgtggttttgtgaaactaaactaccaaaatataggtacttaagtgccaagtgtcaaaatgtgtgtggttttcttcaacttgaaccataaatcatgtagttttgtaaaatttactctattataaaaggtaaaagcaaaagtaaaaattacaagtttataaaatagttaattgattagacatataatattatcttcaagggacaattgcttatttgaccctgttttaaagcctaactaccaatatgaccctattttttttagtttgcttatttgaccctacctttttaaaacaaacactccgtttggccctttttccgtagcaccattaagtttttatttaaaaaaaagaatgaaatataattacttttcttaatgaccaaaataccatcgaacaaaccctatccttatctatcctgtctctccccgtttctcgtctatctctctctcggcgagtgccggtggcggctcgtggagggagcggccgtggcagcggccgcagggcgcggagcgggggaatccacacggcgctggctcgtggagggagggagcgacgtcggcggcctaagagcaacttcctcccgctgccctccttgtgcaacggcagccgcgctgcggtcggcggcggctcgatgaggtggaggagtggctgcgacgacagcggcatgggagggatggcagtggctcaacgaagaggaggagcgacggcggcttgatgaggaggagggtcggcagtggctcaacgaggcgaaggagtggcggcggtggctcgacgaggaggaggaggggcgacgccgacagggtggatccggcaaaggctcggcgatgaggcgacggatccggtggcgccgagacgcacatgcgatggatctggctccagcggtcggcgaaggcggcgcggcggtggcggacttcggtggggaggaggcggttctgcggggagggagggaacaccggtggcggcggcgcatggtgaggcaggcgacgatggctcgcggagggtcggagggaggattggtggaagcggctgctccgcatggatgggcttgagagtttgccgtcggcggcgcggtgtcaacatgtttttttcttttctttttttggtacacataaatctgtgccatgtatttctgtttgaggcaatttaatatatactaattagtgcacaaaact

SEQ ID NO: 14250 - DNA, 1501 bp, Oryza sativa
tttgtaaggattgctgttggtgcactttgtaaacacagagagaatcaataaagtcgtcatccactttaagagttcttcgatttgtgtttcaccgggtttcggcggtgtaatcggcggcacaccagcggtcagaccggcggcatcgcggcggtcagaccggtgggtgacctacggtctgaccggcggcgacatcaggcgcgacagggattccagggctgtccaaccggtcagaccggctaatctactttggtcagaccgatctcatcgaaattgagggtaacttttatttgcgctaaaagtttttggtttttgggtataccaaccattcacccccctctgattggcttagttcttgtgattcgatcctacaagtggtatcagagccttgttttcttctttggatttttatcgatctagagtttttgccatggctactcctgctaggttttcaactaagcctcatgttttcgatggaacggatttttctcattggtgtagtaggatgcaatcttacattttggctgaagattatgatatttggagaaaagtttctcatccttatgtaattcctgaagctattaatactgctgctgaaaaaactgcatttgaacaaaattgcaaagctcgcaacattcttttgagtggtatttctcgttcggattatgatcgtgttgcgcactttcgaactgcttatgaaatttggaatgctttgagtaactttcttcaaggaacaaataacattaaagaacttcgtcgtgatattttcaaaaaggagtatattaaatttgagatgaaacctggagaagctttggatgactatctctctaagtttaataaaattttgagtgatcttagatctattgattcttcttatggtgctaattatccacaatatgagatttctcgtcactttttgaacggtcttgatatgtctatttgggagatgaaagttacatctattcaggagtcagttgacatgtctactttgactttggattcgctttatacaaaattgaaaacacatgagatgaatgttctttctcgaaaagttgattctaagtcgagtgttttggtttcttcttcttcttctttggatgttgaagcttcttcatctaagtcttcttttgttgctgtttttaatgccacatccgatgatcaactcgaacagatcgaggaggaggatttggctttggttgctgacagaattgctcgagctatagtgccaggaacaggaaaagaggtggtccaaatcgttgctttgaatgtggttcaattcatcatcttcgttcgcattgtcctaaggtagggagaggcaaaagagaagacaaagatggcgagaagaccaacaacaacaagccgaagggttcatcccaagggaggaagctggagaatcttagtaaggcttttcaacaagtttgcgccgccttcgagccactaagtgatgtagatggtgaaagtggagatgatgataagggaaagaacatctccgatgtttgcttca

SEQ ID NO: 14251 - DNA, 1501 bp, Oryza sativa
gatgtggcgagttcacaagtagataaggacactggctcggtcgatcaacttaaccgattttttttaattatatgtgttagcttttaaagaaccaacccctataataatataggtatcctttttttaaaaaaaaacaaaatactaacctagaacagacacttatatgttctttaaagtaccgggtttttaatccctttcaccctgtggagtgggaaacggttaatagcactccattcgattatattacaaataattaaggttttataatgcatgcaatcgatgcatttatacttaaccattaactttgaattttacctcgcattaactttcaaagatagttatagttttcttaaaaatagtttaatgatatataatcaatgaccaatcatcaaactaatgtcttcgtgaccgcatcactacccaaaacatcttctcttttaaaataatgaatatcaaacttgatctttatttcactcgaagctacaacacacaaaatccaggtaaaaaaacaaaaataactagagtcgttgggaagcatgctaatgttaatgttaatttagaaggtcgttgataaaagagtgaggtgcacatgcggtccttaaacttgtacggatgtgtcatctatatctctgaactctcaagatgtatttctgggttcccgaacttgtcatgagtatcatataggtccaaacgaacttcaacccgctccgtaaaataacgtagcatgccacggtgacgcttacgtgtgaatgggatttacatgtcagtcacatagaaaaatataaaatttaaaaagagaagagagaggagaaaatgatgtttttaattttgaaaaaataaatgaaaaggagtggagaaaaaatatgttcttaatttttttctatatgtgaatgacatatgggttctaatgacacgtagtcgccactgtgacatgccacatcagcacaagaagcgggttagagcccgtttggatctatatgtgatccgagaaaagttgagggacctagaaatgcattttgagagttcagaaacctaggtgacatatccacacaagtttaaggaccgtccgtgcactttactcttgataaaatgagcgtctaacatggaatcctccggatattgaacctaagcacttttgcttcaatcgaagctacatccacttattacatattttttgacacaaataagtctaaatacaaaaaaaacaaaagaaaggttaggtcgttaagtcgtcggcaaacatgctttttcgtcgataaaatatagccacacattaccacaagtacacgacgacacaatcaacatatccacctcacctatgattagcttaattagctccaacgacaactaacgaaggcatatccatatgcatcgctcttcttctatctagactacaggtcaacaaaccccttgccctatttctactttttttgtcgatcacgccattgatcacctccaagcttagcttcgagctccagattgttagatgcgtgcatggcga

SEQ ID NO: 14252 - DNA, 1501 bp, Oryza sativa
ccggtttaaataatcgttaaaatatttttttagggacaatggttaaaatagttggttcaccgatcgatttaagtgaaaagcaaaggttagatgttttattataatattttttcatgttaaaattttcatctagaaataggaagagaaggattggaagaggggagaaagcatggcattgtattacgtacatacatacgtactgaggagagaaggggtgggttgtgggatttttttttataaagataaatataatagttgaaaatagtgagtctagcaatttattaaacaaatagcggatccaccgatttattagaacgccacgtagcggtttagaaacgttttgtaggatgccacatggtaattgaggagcgttcgtaggaagtttaatgaacttttagtatataatagaagatttttctttctaactaataaagcgtaaaaaatatgagaaggaagagttaatctaggaagagggtggtgtaataataataataatacatgaggtatattattattattttcatatatagtaggtagttgtatatgagatataagtacgtacgctgggtggggttaggtttgggtggttaactttttctataagataaatttaatggttgtaaataatgggtccatcaaatataatgaaatcaacggttatatattggagtggcatgtggcggcttaagagcgtttctaggatgccacgtggcgacttaggagtgttcatagaaagttttatggacttttagttaatatacagatctaataacgacgtaaaataatgtgtccatcgattctagtgaaaaccaatggttggacgtttctctaatttaagagtggcacacaacggttagaaacatttatatgatatttaatggattttaacgcgtttgatgtctatttgtgggggtattcttttctataaagataggttcaattttaattaggattggaaaaagaaaagaaaggaacaaacgaaaaaaaaaagtactaaacagatgcacgtactgcacagaggtggtggggccggtgggaggtttttggtttttaaaatagatctaacgatgtaaaataatgggtccaccgatttaaatgaaaatcgatggtcagatttctctattatattagagtgccacgtggcaatatgagagcgttttgagggagccacgtggcagcttgagagcgtttatagggagtttaatggacttttagtatataatagatataatagataaagatgggctgaggaagctgggattacagtggggtccaggagatggtgacagtaaaacatcctaaagttattatggaagtagtattgaaactttcattgacaacatcatcctcggcagaggtacacttaagtacctattcctttttgattgtccaattgctctacttgaaatactgctgttgcggtggggaggatataaaacacctgagttgagaattgtcttgcgtggtaacctcataagggtaccaggagaatttgtcggga

SEQ ID NO: 14253 - DNA, 1501 bp, Oryza sativa
acttttaaatataatttccacacttttttaatacttaactcgttatcgctgtatatgtagtaactcgttattcatccatccatccagcggatagcatttttcgcatttctcttttcttcctttattttttcctccttgtcgctgccgttgccgtcgcgaggcgcgggggggcgcccaccttttctacggcgtcgttgcgtgcccggggttctcttcttagctgcgtctgcgttgccagccagcctcatctccttcctcgcttccgtccacttctccaccaccacctcttcgctcgctgactcgctctcgcgctcgcacacatcgctctcgctcgctctgctgctgccgcgccccgccgctcgcgctccgagcggggagcattgcgtggcgtggcttggatccggcggtctcgatctgatcgaggcggaggcgcgcgctgcgcggcggatggtgtgatcgggggaggcggcgatcgatgcggggaggtacggtgcggcgtggaggtggggttgggttgcgggcgctggtggtcgtcgccgtcgccgccgctgcattggtggtggcgcgcgcggacaccgccgccgctgacggtaagttggttcgtgctttgacttggtttttttttttttggttttgttcggttggtgtcgatacggggagacgactcggattcctcgctgctcgtgctgttcgtgtggtgcgtgctcgcgtgcgtgcgtggggtccgtgggtttcggtttcgtcgagatgagcagggggagcagggggattggttcgttctcgttgtgctccgccgctgcagctgcttgcaagtttgcaactgcttcgagatgagtccatggttcgtgttgttttcgctgttattttttttagccgctgcaattaactgtgcgtggtgagattgtgtcggtggcggcgcgggcgtcgtgggaatggatcatcggttctgtgaattggcccggttcgactccatcattgggattgattagtttttgtcttgagttcagcacaaatgccatttggcaaggcggttgtggcatgttctaattcggattaattgatgttctcttgcttgataaagcaatctggctgtccctttcgtctgggataacgaaaggaacttttgaggcctgtgatgatgtggtgtcgtgtgcttcatgtcttatcatcctcaatagaaatgggagaaagactgaaagagatggattgttcgcatttggattggtggaaacaggataacatgcaggagaaaacatttgtattggctatgcaagtaatagcagaatggacacctttaattgccatactgatgaacaactgaacataatgaagggggtaggatatgatcataggaagggaataatgtaagtgataggtgtatgttgttctcattgagtcattgtgatgtgcacattactcaatttagttaggtttatgctctaaaatcagggactgagcaatttcttttcgtgatgtgcacatgttattcctgcaattgttc

SEQ ID NO: 14254 - DNA, 299 bp, Oryza sativa
atcgattaacacatatatgatgtagcttttgcttcttcctccctccgttccaaaatatttgacaccgttgactttttaagtacgtgtttgaccattcgtcttatccaaaaaatttaagtaattatttattttttcatatcatttaatttattgttaaatatactttcatgtacacgtatagttttacatatttcataaatttttttaataagacgaatgatcaaacatgtgctaaaatatcaacggtgtcaaatattttgaaacggagggattaattaatttcctagtcttgccacagg

SEQ ID NO: 14255 - DNA, 1501 bp, Oryza sativa
gcatactgtgacgaaattgtcggcaagcgacaatatatatatactactgcatgatcgtggctgcaacaacaagagtacacgtacgatacgcatgcgggcaggcatacgtacaaaagaaactgttgaactgctcgaccggctttactgatgcgtgcattacgtcggctatacaatacagcatcaaataggtcccatgttactttcatgtgcaaaattaattcgtccgtagtttgattgagcgaatctacaacttgtttagaaaaatatcgttttcaactgctacagtggtctagctacgtgttgtgttaagtcaacaagtcaacccaaaagggctactattaaacgtgtaaactgattgataagatgatgcggctgtggatggaacaccgttgtgatggactgatagcattgccatgtactcaaccatggaacgaaatggaaatattatttcaggccgcaaaagaaagcatttcaattttcctgcttatttggagctcaggtatccaataacttttttttaaaaaaaataatttttttgtgtatgttatcagatgccgagtagattaattctgatgcgggactcagcatataacccatttttctcatgtagcagtccttttcatcctctttcgctctctgtaaatatgatcttctaagatgcctgaatatgaagaagaacaccgcggtactcaagccaatccaacagtgacacacaccatgtcgtaagtgtagtggcactaaccagtagtcaagattcaccgtggaaaactgaaggcatcggggtccctgaaagaaacgagccagggctaacccactgtgtgctcgaatggccagtcaggcaatgggccaatgacctcgggggcacaggtcaaaaaagatgctccaatcaagctagtattgctattattccctctattataaaatatgtatgacataactataactatatttcataatataaggtgtgcatgcatatatgcaattgactagcatctcttctccactatattattgtttttcttaactatgcatatcactctcaaatatataattttattatgtgcacttattgtatttattaggatgattcaaacaataatatgataataattattttttgatccttaaattaagaataattatgccttatattttaaaatgcagatagtaatacttttggcctgtcgctagggcaaaggagagagtacggctcaagctggcttgttcgcgagtcaaaggcacgcgctggacaaaataatacgtttagcaggcccaatgttcagttggtttcccactcgatcgagacctcgtactgaactgctcaaggctctcaagcatgggtgcttggatgatccgaataatcttgattctgtaaatttcacaactacagataatactttgataaaaactatcacaactctacagatttagcatcaattttataccatcaaaatatagatttaaaatcagatcataaaaaaactacatatttatgaattta

SEQ ID NO: 14256 - DNA, 1501 bp, Oryza sativa
ttggccttcattaagtgcaaatgaatttagatcacaactcaacaaaggccacgtggaaaaggtttttaacggtttttaggtgtttgttcgggcctactcccttcatcccaaaagaacaaaccaatccatccattcgcaaaaatacatgcaaaggacatagagagaacaatttggaaacttctgtttttattttttatataaaaaatccacttgatacgaactcctgtaataatatgatggtagacttttaatgtgtgtttgtcaccgtaaccagcctacctcattaaaaaaacacatcttaggacaaaaacacgattatatacttaaaaaaaatgaggacgaaaaacctctagatctccaactagaaaaagctataaaaaaactaaaaaaaagaaaaagaaagagagatggtcaccataagcaccaccccaatccatgtccacatcccagctggcaatcgtcgttgcttactgcgctctctttccgtacgcgctgatagatccagcacaatataagacgcgggtctacatgcgaccccacgccgctctcttacctcaccagcgacgtgttctccacagcacacacccaaagtaaaccccgttctgacggaaccaaaaccaaaccggggcagcagcagcagcagcagaagaagaaaaaaaagaaccccacgacgatccaaccccccatccccaaccacaacaccgacgacacgtcaacaaacagtaaaaaaaagatcgctttctctccacccgtgtcaactcatctcccagtcccagtcccagcaaatcagctcgccgacttcgcacgagagagagagctcacgctgttcccttccctgtactatacaaaaccagtatagcaacgcaacgcgtgcaccgtggcgtggctggctggataacggcgacgccgatcgatcgctcgctcgcccgatcggaggcgtttgcgctgcgttggcctgggccagccgccgctgccgcctttttttccccccccgcggcccggccttatcaacaccggggggatgcaaaatccacaatccaatcccaccgccgctccgtgcctgtgccccctgcccgtgtgttgtccactcgccacgcagtttttgtacgtgaaaaccacacggcgtgtggtgtggtgtaaaaaagggcgtggcacgtgggcacgaatcgcggggcgggatcggacggtagcccgcccacccaccaccaccccgcagcggaaagggcaacgtgccggattggcaccagcgagcgagcgagagggggggagtgtgacccacagtggcgcgggccttccgcctcatcatcccgatgcctctctgactcccaccgcaactcccccaatagaaaggcaagcgaaaattagagagagaagagagaagcaaagggagactgcgagagagagagagagagagagaaagaaaaaaaagttttttttttccttcccttcccttcccttcctcttcgccccgtccaccgcccgccgccgcgcagtagcgcag

SEQ ID NO: 14257 - DNA, 1501 bp, Oryza sativa
ctatgatcttctaactgcacactatacttgcaatgtttatactccaggtctccagcacgaatgtcaaatccaaagaactctgaaccaaaccaaacactcgaaccgaaatgagttttctggagaggcgaacacgtccgcgcctccgcgatttcttttctcctattaacatttccctcgttgccacgatgccacggtgcaacgaggcaacgaccacacggccgcacaacacgcgcgcgcgcgccaggttgatcaccttgatcctgcggcgtgcgtgcgacgaccggccgcccgggtcggggtcggggtccggggtcggggtccccaactcgatcgccttcgcctcgcctttcaccggtgcggcccccgcgcgcgaggcgaggtggtgactggtgagggggtctcgggacttgggccacgcacagaaaccgcctctccctctctctctctctctctctctcgcctccgcctcatcatcctctcctctcctctcctctcccactaccactccagcgctgctcccctcgccgtcgtcgctgccctccccccgatcgatcgatcgctccccctcccgcgccgccgtggccatggaatccggccaacccaactccgccgccgcaggtgcgtgctcgcctcgctgctctccccccccgcccgatcgaactggattgccgtccggaacagcggcccgatcgccccccaacccgggggtggaattggatcctcccgcccggatcatcctctgcccattttctccgcttgagctgctggcgcgtgctgccgagtgagcccgtgctgagcgggagcgctgctctccctcgggttgtgtaggggggcaggtgggggtataggtgcccgggagctccagttgagctcgcgttgtgcggttctcggggccaatgtggccagtctgctcgccatttgcttgtagggggttaatcggtcatcggtggaacccgagactgtcatttggcaatcggatagggttctgagattttttttggtctggccgttctgtgttgttaaacggtagagtgaccacaacttggatggagatgctcaagctcacccatggatggaattgattgagcccatctctagtttcagttctgagctaagtgaagagacttttctggtagtttctgcagtgattgcgtctgcctggaagtcatatctacatacacacgggatgatggattaggtatgagaaaatgcataataggaagacagttgcaaaataagaaatcggtcaggctagaagaaccaggactgttgtgaatccatcacatcacatggcttggaaaagccctctacatctttagaattgctggtcgataacaattaatatacatatttttttatgttccagagagatattttatttatttattaggattttgagtttttgacttacatgcatcagagataaatctttggagcttaagttccagtgacttaatccttttccttcctctgaccgcagcagataagacgcagaacagtt

SEQ ID NO: 14258 - DNA, 634 bp, Oryza sativa
ctgcagcctgttatgtatggatgatggaaagattatgttctgtgcatgatattgtgtgttctgtatgaatatctctattattatatatgatgctattgatgctcttattttaccataatcaatttcttgtacagaggaaccaatttcttctatagagaaaactgatgactgtacagacagtcagcttttcctgatctattatttttccaaacaaaaagttcattatattgcatttttttcagtgccacaataaatttgttatacgctcattatttagtctcataaaatacacatattgttcagttaacattttttcaattttttcaatctagctgccactcctacatctacaaggggattttagacatttggaaccacacataacgtgaaaatgaaggaaacctaacgggaggggcatggaagggatcacagcgaaatttcaggggtacacaggggattggataaaattcgggggtatagaagggattaggtgagttttggataaaattcgggggtatagaagggattaggtgagttttcatgggcacacaggggattttctctatattttagcattgcatttacatggaattagaatgaggagtattggaagaaggaagacggcggcggagca

SEQ ID NO: 14259 - DNA, 1015 bp, Oryza sativa
cgctctctcgcgcggataaggaggagaaccagacacacgcgtggataaggagatgaggccggctcagctcggtttggtatgggtgccgttttttaattaactagtacctatcatatattataagtgtcggttcttcttaaaaaaacgggtacatatagtattggtactggtttttcctaatgaactggcacctattatccttaaaggtatcggttgtatatttttttgatgtgcggatgtgggaaaagtcccataggtgccggttataaatgaaccggcacctatatggctgatctctattagggttttttagtagtggaaaaaccaatatccaactgtgagtcagacttacatgtagtcaaattttacaaaatactgatagtatctaactgacattacgaatggtgtaatgttatttctttagtttaacaaagctgcaatataatggtatagatccaattaacccgttaaaatagtggacatataatatactagaatgatatgcgcggcgtgtcgccgcgcacaatgggagatgcttaaacttgttatgaagtataatgtttgaataacttgtagagacgaaatacatatttatcgtgggtaacccagagtttattatcgtatttgcgttgaaacattcagttatgctgtatatatcacagttaaatactaactcaaattttatcgatttcctttcggaattaattaccaagaacagaatcctgtacatgacaaacaattggctctctcctctagtcctaccacatctcttgctcccaagtcccaatttgtcctcttcctgaatcagacaagtttatgtaattgtgttcagtaattatgcatactccacagtaaagatccttgccttgaggcttcagcagcagctggcttacagaaacaacacagatcccaagagaaaatcagtacctcaaaaattcagagaagaagcaagagaataagacttcatcacttgggtagcctttaaaagactgcttccagcctctttcggaagcaa

SEQ ID NO: 14260 - DNA, 740 bp, Oryza sativa
gatcagtgtgtttgttttcgtctttctctatataaatatttatatattgtctaataacgatgacacgcatataataagaacgtctcaaaactcatctgtacagatgagacgttccaaaacgtctcaatattcatctctaaacgatttaattttgtgctaacctgtaaagcgtcttaaactatgtcctcaacaaataaagcgtctcaaacatcgtccctatttcaacattaaacaatggttctgttgtagtatatcctctccttgcgtatgtacactacatggttacattatggtgcccttctttatttaaaggattgtcgggttatatagtccaaatctaactccactccctgcgacatattccaactccaagtccaactcctagtagaactagtatcttcgacaaatattctaacaaagtccagcttcgaatatatgatacctagaagcagtagaattaccataccgatccatcggtcctccaaacttgaattgtcttcatttgaatcttcactgtaagccacccgatgagcctacaccaaactcaccgtcattaagagactccaccttaactcaaccttctctcgactccacctttccaccttctttcctatcattaaagtcgtattgcaaagcgaaaatggactactccttagctgaacaccctagactcctcgaagactgtcagggttatggataaggtataccctctacccttggatgtacgctatacggcaata

SEQ ID NO: 14261 - DNA, 1501 bp, Oryza sativa
ggcaacggcacgccgacgacatggccggcggcgggccggcggctagctggagctcgatcgatcgccgcctgaattttggggtggtttgcttggatgcaggggtgaacaggggttctgcagcgaggagtgcaggtggcagcagatcatgacggacgaggcgagggagcgggacgccatggccaagaaggagcggctaggcctgcatcatcggacgccgcggccgccgccggcggcgatccgcggcggctcgccgaggagactactcgccgtagcctagcacgagcgaagtacagtatgctatacttgatgagaccgtgacccatgcttggatgatatatgatcaaaagaaaattttctactgtactctctgtaaaatatggagaaatcgatgtaattaagaaaaacttgataaggaggaaggagagagagagagagagagagccaggttttgagtaatttgaggcaaatttgaggaaacgtatacgcataactgcatgcagtttcatatttcaaatgaacacgaaatgtttggtgggggaaagaagctttccaggtctcatgggtacaagtgtgcaacttaactgtaacctgctcctgcttatgtgcaaaaaacctggtaaattctggataaattagtttcctgtgcgtgtaaatttcatctcgattatttttagaggatgcgaatgattctcagtcgagtagaactcgtggaatgattctgaacacaagtaaaaaagctctgatgaatcctggggcatctgccatcttttgctttcgagatgccgaggtgccagaaatttgatgccaaagacgaagtggagggaacgaaaggatggtggccgtggcatcaagcaccttgatcgatggggagacagtgagacaccaatcgaatcaaagtggaatcttctcttgctagaaaacgaccaacaaaaattggaagcagctagaagcctataaacattggtcaaggaagagggagcagcctaagagaggcagacagcgattgctacattttagtgccacgaaaatctattaggacagttcgaaaagaagccatcacgttcgtggtgaagactaaaaacacttagatcctgtttagataggactaaaacttttaaatccctatcacatcggatgtttggacactaattataaatattaaacgtagactattaataaaacccatccataatcttggactaattcgcgagacgaatctattgagcctaattaattcatgattagcctatgtagtgctacagtaaacattctctaattatggattaattaggcttaaaaaatttgtctcgcaaattagctttcatttatgtaattaattttgtaagtagtctatatttaatactctaaattagtgtttaaatacagatactaaagttaagtctctggatccaaacaccaccttatattaatcagagaaaaaattaagtaaaaaataatttagaaataattgaaattcagaaaaaaagaaatattgaaagaa

SEQ ID NO: 14262 - DNA, 1501 bp, Oryza sativa
cgggacgtgtcacctgcatacgctgcctagcgaccgcccaagaagctctcgcgtcgtcgcccatttagcagcgcacgcgcacgcacacgaacgcgccgtgcagcatcagcaggcagcagcagcagcttcctcctcctcctcctcatcttcaccgacgacaccgcacgctccgcttgctcgtctcgccggcgccatgtcgtacaaccattcgccgtccatcaccgcagagaccataaaccagaaggtacgtggctacgtgcgtcgttgcgttcctccgtcgatctgaacctcagctcgcgatcgatcgatcgatcgatggctagctcgatcgagttttattaactgatcaaatatgtgcgcattctcattcgtcttgaaggtcaggatcttcacctacgagccatgtggggagattgtccgccacgcacgggtaactataaatctcatcaacctacactgagggcaaagccaatgtttgaagcttacaattacttgagatgagacccataaatagttaatttttgttgtagtatgttatacaatacttatgatcataagataagggcaatgtatacgggttaagtagtccttatggtacggttaggccctgtcacaatagacttcagttatctctatttctatcgctacaaacatgggatgggaatcatgggacccactaacaaataaaaatgtattccctccgtttcaaaatgtttgacaccgttgactttttagcacatctttgaccgttcgtcttattaaaaaaattgtgaaatatgtaaaactatatgtgtacatgaaagtatatttaacaatgaatcaaatgatatgaaaagaatacataattacttacattttttgaataagacgaatggtcgaacacgtactgaaaagtcaacggtattaaacattttaaaacggagggagtagtaagtaacatcaaacacaaaagatgaagaggggagcaaaggagagagatattcttatttcttatgggtagtcgttagttactccatggatagctcatgctattgactcccataaagactccttccacaatatatacattggtacattgaaacatgagctcactacataccctatcttattataagttgatgtccactatctcctaaaattcaacatgtaagtgtaccatatcatcaccactagtaaaatataacctttcagtgatggtgggagtatagatggccaaaaggcctgaggcccgacgggccgccccacggcacaacattttggcccgtgcctccccccccccccccccaccggcacgttgggcaggcctaggccaggcccgacacacaaagaatagggagtaaaaatagacatattatatgccacggttcaagaatagggacgcaaaatatagttattttagctatatatatgtcaacctaaagaggagggagaaaaaatagacttattttatgtcacagcccaaagaggagggaagaaaaatagattcatttaaaaaaaggca

SEQ ID NO: 14263 - DNA, 1501 bp, Oryza sativa
gtgacagcactgttcttgtaggtgggaattgtatctacaaggcaaaagaaacagtttgggtttcctgtttcactttttgtgggtcgcgcatgccatgacattgtgttgggctgtccggcctagacagttctgctaggcccaccaaaaagttttcttaagcctacggcctaccaaaaaagcagcccacgtaccgtcatggttagagtataatgggctaatggcatatacaaagttgactggaataagttcactaaaggtcccttaacttgtcaacgaatccgattttcgtccttcaaccgtaaaaccagatataatgggtccttcaactatcaaaaccggtgcaaaaaaggtccctcagcggttttgatggtggttttggctgatgtgacgcctacgtggctggtttgacttggtcctcgtcctacgtggcggtgacgtgacattggaagaaaaatataaaaatagaaaataaaaacaaaatgtggggcccacaagtcagttagacaaaagaaaaaagagtgggacccaccatcctctctatccacggacgagtggacgacgggagagggagcgaccggcgcctcctctctctccctcccggcatccttcgttgctggccggcgagcgcgcacggagagggaaaaaggcgttggccggcgaggggggcggagactgccgctggccgctggccgctgcgcaatactcttcggcgggctgcgacgcagagctagggttgcaggagtcggagggctgcgggaggatggcgtggatgacagtgaggagggtgaggacgaagtagtccgggaggtcggcgccgttggccttgagcttggtgtcgaatgttggaaataaacacgtcatggtgtattcctggcgtggttgagtcagtgtgtgtgtgtgtcgtgctgctgcatgtgtgcgtcgtgtgcgttctgttagtttgattgagtcgtgatcgcgagtgcatggctgctgcatggttgtttgcatggccgttgcagtgttgatcgagtcgtgggagtgcgtggtgtgcgtggcgtcggttcttgcggaggaagccgcgtcgtccgggcgagcgtgtggctcacggcgacgtcgagcgggttctgcggaacgtggcgcaatggccggcatggaggctagctcccggtgtgtcaccggtctataagaggcccctgtactccttcgttgtttctttgcaaggttcagtgaggaataaagccaagatacaggagcgatcggctccgcggcgttcgtcgctgtaaaatccattgttcatcgtctccctcaccggcgtttgtgttcgtgagtgtgagagtgttcctgggctgagccaacatcgaagtcagcaactccatctccaaggttctctggatggccaccctcagccccacctcgctgcccagtaagcttattctacctcaaagctctcatccgccattgttgcaaccaaaaactacatcaaagctctaaccaatctatggatttcacgcagactgga

SEQ ID NO: 14264 - DNA, 1501 bp, Oryza sativa
ggaccaagtcaaaccagccacgtaggcgtcacatcagccaaaaccaccatcaaaaccgctgagggaccttttttgcaccggttttgatagttgaaggacccattatatctggttttacggttgaaggacgaaaatcggattcgttgacaagttaagggacctttagtgaacttattccagtcaactttgtatatgccattagcccattatactctaaccatgacggtacgtgggctgcttttttggtaggccgtaggcttaagaaaactttttggtgggcctagcagaactgtctaggccggacagcccaacacaatgtcatggcatgcgcgacccacaaaaagtgaaacaggaaacccaaactgtttcttttgccttgtagatacaattcccacctacaagaacagtgctgtcactccgttgaaatgaaaattttcactctacgtccctcgtctaagagccgaatttcaatctgatcattcaacagtaaaactaagtgcaacacatcattatgttgcaaaaccggtgtaagtgaggtttcaagccaatattgagtccaatttagactaacgtgatacctatatggcttatttgatttggttttcatcctacgtgttattgacgtgacacctacctatatcacttaaagcaaaaaaaaaataaagtaaataattaaaacaattatatagggcccattgacagcaaaaaattaaaataaataattaaaacaattatatagggcccactgacagcaaaaatttaaaataaataatgaaaacaatttatatagggcccacatgtcagtgggtgcctattaaaaatatacaagtaataaacctacatgtcactcacctggattataagttgtcgatcgaacactcgaactcaagaattttttttttcaagaaaagctgtatatagatgtgttacatgcgagtgcaattttgcgttccaaagtgcataaacaagtttggaggtttgactatcagtcagggactaccgccggcgtcgagcagctcgccgcagtccgggttgggacagctagcgcgcgaaggcgcctgagccgctgaccgacggcgagctcgcagagcgcgacgccaccacgcgtacgtcgaagccgccgatgtagaggtagagcaggttaattcttaaagtcctccggggtgcacgacggcgtcgcagtcgcagtggaagtccgggaaagggcagcgcagcgcacgggcacctctcctcctccgccgcgacgcggggcctcgctcgcgacgtggctgacgacgacgcaggcgatgcagagctcgcgtacgtgcgcgcacccgtcggacacgcggcggccgtcgtacagaagtacagcagcctcggctcgtcgcagatctctcgcagtggagccacccgatgtcgtcgtcgctgatcgagcggcggcacgtggcgggacgcctccctggccgatcgattacgccgacggcatgcaggcctcgaggaactcctggttgggctccagcgc

SEQ ID NO: 14265 - DNA, 684 bp, Oryza sativa
ccgcccctgaccaattccgaatacaaactattatttgctaattccaaaaaaaatctcaagccaacttatgcaaatccagattagagaaaatatattttggaattattcatctgagatggacagggactttaatttattaatactaaaaaattctgaagcaaagtcatgcaaacccagattaaataaaaatatattttcagattgttaatctgacatgaatatatttaaaaatatctgagatgaacatacaaaattatttactatttttttaaaaaaaatctcaagcaaagtcatgcaaatccagctcaaagtaaaaaaagcaaaaatacaacgaacttttgagctcgaacaatgtatgtatgtcacagaaaaacacctgttaaccaatagaccacaacaagtattgagattctctacacgtatgtttgtaaagatacgtgtagtagtagtagtagcgttcctgttttgccgcctaaggcggatttcttttggcggcatatttttcgaagcgttcgcggtatatatatcgactgccgttcctaaatatattttgttttgccgcctaggctgatttttttggcggcattttttttttggaaagcttactgtatatatatcacggacctacttttccacgccacatccctaaacctctccatctccatagtactctcctgtaacaga

SEQ ID NO: 14266 - DNA, 1501 bp, Oryza sativa
ttatgcagcccgccgccgtcctccgagccagatccgcaacagcgccggtgttgcctgctccaggccctaccgcccgccatcgtcgtcggatccgtcgcccctaccaccctcggtcgtgcgtcttgagctctctggactacgggacgtggcgggagcttagtggcggcagctgatgatgacaccatggtcatggtcatggaggccttcctccacggaccaaacggtgcctcgtccacgcgactggtgagcacttcaggttccactcccacatgttcccttcacttcagtttgctgatctaatacctgatgagaccaatgtatttgttcccccttcaaattttgtctgctgctgcttatgtgatgttcgatgttgcatcgtaaattccactcaacatcgcaccgaagcagaattagtataatgcataatgctttacctgcctctatctactcttcgcttggagctttaaagttaattaatttaatttgtgctaaattaggattggttactctggatttcgttgcttcatttgtccactgcaactgcaactccacgctcagctgatcctccccttcgccaatcggggctgccttggggaactctcgcccatcgcgcgcctgatgcgatcgatcctgccaccaaaccgaagccgaaccatcccggccgctgcctttgatcgattgccaccaaccacgacgcctccaacgtttcagaatcgatcagaggttcatctctttttacaatcacagtttcatgctctatggttgcactatttatttcgaacaacatattatcagtgaccctatattcttgcttagtggaatacatacatctatgattagtgaggttgacatgtggggtccactttctcttttttttattgtcacataagcaccacatcagtgaaaccagatatctataccactagaggatttaatttaacccggttttgtaagttgggagattatgatttctggtattacggttagggtattaaattaactcgacgtaaagatgagggatgataggtggacttattctaatctgtcatgcatgcatggacagcccatacgccatagtggcatagagagcccactagccaaattttgatatctgaaagtgtggcccgtagtagccaaggtcaaatgtaatgttcaagcccaaatatgatcctgcacgtacgcatgtctactgggtggaaagaagccttatgtctacggtctactgaacacgatttgtgggctacattctgggcaccgttcacccggctaatttttgcggaaaaagtccacattgaatcccttaaatatcggccgaatctaattcataccccttaacaagaaaactggataagatggctccccgaactattaaaacggtgtaatttgactccctagatggttttgcaagcggttttggctgacgtggcacctacgtggcggtgctgacctggttttcatcccacgtgtcgcttacatggaataagaggaaaaaagaagtggg

SEQ ID NO: 14267 - DNA, 1017 bp, Oryza sativa
tatgactagcctaaaattgcaccaaaagaaacacaaacaataattaaaaggctagcatatctatcttctccatttctcatactcaaaactagttggtggtctaccctaagccttagattttgttacctagactctcgttgtaatatacagatttatgtctagatgaaaaaacaggtcttttatcctagtatgagaaagttttttttttcttattttctttttcaaaaatatattgtagggtcataaccggatttagttactcgtgatcaatctccacaaaactatatttgttgaaatgagctacataaacacgacatgtttttcacatgcaaaatttagacacttcttagataattcgttcgtgagcataatagcctttgcccacgatttcttgaaataaacacccacttaacacaaactaaacatcttccctagctaaggctaacttatgccttttatcattttgttggtcatgatgtctctataacaagctataattggcctcgaaactaaaccttggtgaggtcagcttttaagcaaatgacccccataggatcatagtctctcatgctatgtactgtagatgacagcaacaaattatatgagcgtgtgctttcaatagaattttagcaaaggttaaggagctgctgctagtctccatctatttgaccttatgttcgggcacatattcccggagcgcgagtatagtgatatatgtgccttcactcttatcttgaaaaaaaaagagacaaaatttaagactttatttaaaaaggatggtcatttataaaatttgaaaagtataaaaaaactacttctgccttactttcactacacgaaacaaatgaaggatcatgctgcatgaaataccacattccacaggcacctcccgcaaaaacaccgaaggtccccgtatgaggaggcagctcgtgctcgggcggcgagactgaaacgagacgcgagaccaaaccttcccctcacggacagcgccccgcccagatctcgccccggacgaga

SEQ ID NO: 14268 - DNA, 1501 bp, Oryza sativa
catgcaacctaaagttaatgagtacagggttcatgtaccctagagttaattagtaaggagaatttacatgaatacccttatgatatgggcatttgtgagggtaactagagtctattgtgccttgggctccttgatgggctttgttatgggccctcaggtggcaaaagtgtcttggcctttagtgaaccccctatgcttcgcccgatcgagcccaccaggttttggcagccttggtcgaaggttctcatgatatgccttcaacaaatatatttatttattattgaaaatattactgtattttcctatatatttgatcaaacttaataaagtttggaaaaaatcaaatgacttactccctctgtcttaaaatataagagattttgaccggatgtgtaatatgaaatggaagtagtataatatgaatcggaaggagtacttcagattctcacatatccatgtatcatcgaacaatattttagaacagaagaagtataatatgaaacggaaaaggtactacagatcctcacatatccatgtttcgtcgaacaatattatactccatctgttcggtcctataatataacaaattttgggtagatgtgacatatcctagtacaatgaatagacacatcctactacttatacacgaattttcataaatatttttgttcctacttaaaatacttgatttacctgattattcaatagtagactagcaactaatgtgttagaaataggactaaaataaggtttggagatgtgggactacatagaccatagctggaccagccgacccaccctgtctaatgggtgtgtccgttattgattaggatgtatcacattcttctaaaatccattatattatagaagagagagagagttcatacaggactgcagaggagaccgccgaggtgtactcactccagttttgcattggattccgatgtgatgccgtagctggtctgtgttgtccttccgataggggatgcatgcatgatcagagtacgtcctacgcgcgtgccctcgacgctatcgatcgatcatatgcatgcgtgtggtgtttctcgaaccatcctctactgtacatgcatgctcatcttatcagtgatcgagatcgtcgcactgtactggacagcaatacgaccgcccggcacgcgcgagtagcctgcgaccaaacgaatatgcagctttaggggcctgatcaagccgaaataaactttatcaacttttaataaaattgtcaaatatgcacacccatttaattttttttactaaactttgaaaaatacataaaaaatcccaccaaaacatagcaatattattaaattgctaaaattttagcaatgtcaaaaatttagtaaggttcattttagctacaacctcaacaggtcctttagtggctacccgcggtatactcccccatcctaagttcttttagcctataccgtttgtcctaaataattttattttagtaatcattatattagaatttgtataagta

SEQ ID NO: 14269 - DNA, 1501 bp, Oryza sativa
aaaagatgaataaatccattttcaaatttacaatggtttactttttcaatcaaatcacacaagatagtgtgaggttcatattgatataggataaaaaagttacaagatcatagctatgggagatcatgactataatcaggaaaaataaaacaacaagccatatcacacgcctacaacaaagcgaacccctctaaggaaacaaacaaaagcgtcgtgttttatctacactcaacgccatccacgtccttttgttgtagagggagagggcgatagagaaatggatccattctccctcacatgaacccaccaacatggtcattttgtggcggtcagaagcgtcgccgcaagaggacaaatcgtctgcataagagattggtagaaaatggaaatggaaaagcatcgccgctgtcaacctggaagcagaccaggatgtcgcccaaaaacatccttccctcgcatgctgtcgtgccccagtcatatgtgacggttgccaccatccgaacaccttcgacgtgtggccatcgtaccaatgctccaataccggtcgaccattgagatgatcaatggcccacacgcggaactctggtaagtcgtcgacgtgtcggccatcatctccccacatcatacttaattaatgaagtgttttttgtgccaatcataaccatctttcatttatttttttcacatactttcttttctcaatcaataacgatcatctttaatttaatttttactctccttttatttttttaataacttcagaagtgatttgcgacagaggtggtaacatttaaacaaacaagtacacccaacataaaagctttcgttgtactttgtagaataaggctgtgtttagttagttggccaaatttttttttgacgtatacggacacatatttaaagtattaaacatagagtaataacaaaacaaattacagattctgcctgtaaactgcgagatgaatttattaagtctaattaatccgtcattagcaattttttactgtagcaccacattgtctatatcatgacgcaattaggctcaaaagatttgtctcgcaatttacatgcaaactgggcaattagttttttttcatccacatttaatgctccatgcatgtctccaaacatttgatgtgacgtttttggctaaaattttttggaatttaaacacagcctaagtgaataacttcattacttccctgctggatgtaatgagtgcacctggttgttcggactgcgatgctactaaggctaagtttgagatgataggaaaagaggagattgagaagatacgcaaaacgcggtgagctattatcttatgattagttgagtattaactattttaaatttcaaaaatagattaatatgtttttaaagcaacttttctatataattttttttgcaaaataaatatcatttagtagtttgggaagcgtgcgcgcagaaaacgaggtgttttctactcaatctcacagcaatctctcctatcaaacgaagc

SEQ ID NO: 14270 - DNA, 1409 bp, Oryza sativa
gctttctgtcgattgttgctctacgtggtaagcaacgttcatggtgtaatttatgaatgattagtactttctctgctacatattttgtcaaaatatatgtcattagattggtgtctggtgaatctattaggttgtgtgatcagtgtagataaatttgaagtgtcgactcttttctgaagtgaacagtccatgttgcagccttcagtgatccaaacttctgaatctgtgagtttcagctctcttttacttctgagcatgatgaagggtagtttggatgcttaacaagtgattgtcttgtaccaaatcatgtaatttttatgtctttggttttcaaccacctctccaacatcttaaaaaatgttggttagaaatcagatgatcttcaaaatcaacctttctaaagtaacttgggagtttagaaaaagagtaaagtgcacaggcggtccttaaacttgtagaggtgtgtcatctaagtccctaaactctcaaaatgtagatccaactcccagaacttgtcaaagtgtgccatataggtcccaaatcgcaacaactcctccaaaatcctacgtggcgctgatgtggcgtgccacacgaacgtgacgtggcatttaaaaattttccttttccttttttttcttttcttcttctctttttttttcttttattctcttctcttttctctgtgacctgagcaacccgtgtagcggtggcctatagctgcagtgagagcaagaaaaggagaagaaaggaaaaaaaagagaataaaaaagggaaatgaaaattttttaagtgggtctcatttgtcattcaatattatgccatgtcatgtctgtgtgtcattgccacatcagtgccatgtaagatcctggaggagctgtgacgatttgggacctacatgacacactttgacaagttctaggacctggatttgtattttgaggacctagataacacatccctacaagtttaaggaccggccgtgtattttactcttttaaaaacaattgaatcaatgttcctatctttggaggctagaaaaggagaaaacatgattattgaccctgtaaactatggtctcccactactgttgtatgtggttgattttatttttcaaagaatccttacgctttgattgctcaagtgaaactgatcatgcaatgggttttaaatcaatatactttgagcaacaagtataattagttgtttgattctcaacatgattctatttttctgtctatcaccattgttttatgaaatatcaccgtagcgttagcacgttcatattactagtatagtaagtcaattagtaattagtaggcatatactctctgtttcatattataagttgttttgactaatcaaactttatttaatcaagttagcatagcattttaaatacaaaacaaata

SEQ ID NO: 14271 - DNA, 1501 bp, Oryza sativa
gagccagaacggacgttttcatttttgcgtcgaagacggccccgattgcacattgcaggccggaaaccggccgagcccacccattagaaaggacggacccaccgtgcagagctctcctccgctccccggcccggtcacgccgccaccgccgtcgccaccgctccccgccggccgttgtccgtctctctcgccgcaacctcgaccacgacctggggctggggcaggctccgcctcgccgccgcccggcgactgccagtcaggctcgcctcgagccctttccgagcccaacccgtagctataggccctaaagtggagttaggtccaacgccacattgcctcgccgacgcaagtagcccaccgcaccactgtctcgtcgactccgctgctctacaacgaccactccccgaacccggattgagagcgagcgagagcgcgcgcgcggggagaagccgagggtgaagtcgtcgtcgtcggcggcggcggcggcggaggaggaggaggaggagacgacgatgcagtggtacctggtggccgcgctcctcaccgtcctcaccagctcgcaggcaagccccggccccccctccctaaaccctccacctcatcttccccttcctcttcccgcgacgcgctgtccagatctacgcgctttgggtttttcgtcgacgcgtggagcagaggcctctgtaggaggcggcggcggtggcggcggttgctgctgcttcgatctgcggcgatgtgcgtaatttgatccattggagttgtggtttggagaaatgcagttcagataaggtgtggcctgggggtccgtgcctgcttcagggagcagctacctgagcaggcgtgttctgaaggtgtccattttattcccttgttggggatgggtttttggtggaattgtgaagttctctaggtgtttgcaagttgatgtaaatggtcacggggacgcaccatgtagaacaaacttataattccattgcgggaatgtgtcattccgttcggttagtatggcatgaagatggcccttcatttttcatactagacaactatccagaccattatggtcattttgcacatttcctggtgttccaaacagaattctacttacagttaattccagaaatggaaaaataataggagtaaaatatccttatgagaagaaagagaagaagaaatcaagatattaaatgcaaaagaaatcaagaacatgaccaatcttcagcgcgcaaccaagggctatgacctgacgaagaatctcgggctagaaatagtgcggcattagggaggttaagatggtgagtgacttctctggagcttgcccagcagttatgagatagtagtgtactccagaagggtacaccagaatagcatggtactgaaatgtttgattccaagcgccaaaccagaatgacccacagaacaaaactgacaacttgatgtagaaaacccaatcattggaggttaacgagcagacttcatggtcatagttaaattaacttaagtt

SEQ ID NO: 14272 - DNA, 728 bp, Oryza sativa
  unsure (1)..(728): unsure at all n locations
cacgtcaccactgccgcaaagccaaagagctcgatccagcgccgggtcagcaatcacgcgcgacacgaggccaatattagaattattttactacacagcttttatcgtatccgagagcagtaaaaacgccgcctaatttacccggatccggattttgnaagcgtgtgcgttgcgtggcgctggtgggggcgcggagcaaatcagggctccgggacatgtcatagagctgacgtggcgccctcccattggccgagggctgtacaggtacgtgtacgtagtcggggcgcgcggtgacgtggcgttggccgtcgttaattcccctgccttttttgaagtcacaggattggatttatccctcgggaccaccccactttcgcccccctaattccacttaattacacatcactcctcatcaggggcatattagtaatttattacctctagttttagcacatctcagcctcgtggagggatgatttgacgatgataagtacagggggttcatcgcaaatgttacctgtaaatatctcgtgactccggtgcgccgcgtccacgagggagtccgcggggtggggcccggtgggcagtttcagggtcgatgtggacttggtccacgtgatccggtaaacccccccctcgcgtactccgccctattaaaacccgtgtgagaagcgtgtcgtctcagggaaaaattccgaaagccacccacactctccgtctcctcctca

SEQ ID NO: 14273 - DNA, 1501 bp, Oryza sativa
ccacataggtgccacgtcagccaaaaccaccgtcaaaaccaccgagggacctcatctgcactggttttgatagttgagggacccgttgtatctggttttgtggtgaaggacgaaaatcggattcgttgacaagttaagggaccttagatgaacttattcctagaatagaataggatggtgcttgggctacaatagcaagcccagcctgcaggtcaatcaaacctgggcttcaacaataatgggccgaaccactagtctatccatgcactaaaatctcctaatgcggccggtatactgattccaagcaatgaagcaactacagctgcataatatatccatgcgtcaggatatataaaccccgaacgaaaaattaaagtatgtaatgggagggtttttttggagcgaaaaacttttagatataactataatataatttaagtgtaactatattgtaactacactataactatactgtaactatgatataattaatataaaacttttatttaactatggtttggttggttagcatcaggatcttatgtatgacatgtgtgaaaaaaattttctagcatttttttctttacgcacaaatctcgaagtgatttgatggtcactaattaatatggaagttttgggaacaaaatgcttgcaaaagttttccaggagtaacaattatgtaaaaaaaatggcagagaagcacgtactgttttgcacgaattttgacgccgaaaatcgacagtccagaaaacaaatgatgtggaaataaaaaaatcattcggcagatttctagcgctcctataaaaagaatagcagaggagtccacactgttttgcacgaatcttgccacccgaaatcaatggaccacaaaacgaatgctgtgagaatgaaaaatcattcggtgaattaagattgacttttttcgtttgcagtttgctaggacaaattaagaatatctataggctattggcgaggtcgtctaagaatgaagtgaacaagtaatctgcaggttggttggtgatcgatcgatcgtacccatacgtacgtggtccgtcatgcaggtaaactttcccatccgtccaccacatatgtatacatgtacgcatcaacattttcctatatatatcgcgcgccgtcgtcttcaaactaaaattaacaaaatatttgaaatttctatgggtacctaaacactttctcatcctaaagcactaaacttttgaacccttcgttaaactttaagtccatgcatgctattgactcatttgatacggctcatacagtcatgctcaacatttttgtcctgtaaaactggggttacacacaaaattgctcctctatagaatagagttactgctccgatcctaaaaattgcaatttaaaagcggagcggcattcccaccacttctcaactccgcttcactcttggagtaggagttatatcaaacatgccttatatcttttctaacaaccgttttccttttccttaattaatgcatggaca

SEQ ID NO: 14274 - DNA, 1501 bp, Oryza sativa
aaattgcaatttttaggatcggagcagtaactctattctatagaggagcaattttgtgtgtaaccccagttttacaggacaaaaatgttgagcatgactgtatgagccgtatcaaatgagtcaatagcatgcatggacttaaagtttaacgaagggttcaaaagtttagtgctttaggatgagaaagtgtttaggtacccatagaaatttcaaatattttgttaattttagtttgaagacgacggcgcgcgatatatataggaaaatgttgatgcgtacatgtatacatatgtggtggacggatgggaaagtttacctgcatgacggaccacgtacgtatgggtacgatcgatcgatcaccaaccaacctgcagattacttgttcacttcattcttagacgacctcgccaatagcctatagatattcttaatttgtcctagcaaactgcaaacgaaaaaagtcaatcttaattcaccgaatgatttttcattctcacagcattcgttttgtggtccattgatttcgggtggcaagattcgtgcaaaacagtgtggactcctctgctattctttttataggagcgctagaaatctgccgaatgatttttttatttccacatcatttgttttctggactgtcgattttcggcgtcaaaattcgtgcaaaacagtacgtgcttctctgccattttttttacataattgttactcctggaaaacttttgcaagcattttgttcccaaaacttccatattaattagtgaccatcaaatcacttcgagatttgtgcgtaaagaaaaaaatgctagaaaatttttttcacacatgtcatacataagatcctgatgctaaccaaccaaaccatagttaaataaaagttttatattaattatatcatagttacagtatagttatagtgtagttacaatatagttacacttaaattatattatagttatatctaaaagtttttcgctccaaaaaaaccctcccattacatactttaatttttcgttcggggtttatatatcctgacgcatggatatattatgcagctgtagttgcttcattgcttggaatcagtataccggccgcattaggagattttagtgcatggatagactagtggttcggcccattattgttgaagcccaggtttgattgacctgcaggctgggcttgctattgtagcccaagcaccatcctattctattctaggaataagttcatctaaggtcccttaacttgtcaacgaatccgattttcgtccttcaccacaaaaccagatacaacgggtccctcaactatcaaaaccagtgcagatgaggtccctcggtggttttgacggtggttttggctgacgtggcacctatgtggcaaatttgacttagtcttcatctgatgtggcattgacgtggcgcatacgtggcaatttgatctggaaaaataataaactttgtgggacccacatgtcagtctcacacataaatcaataaaagaa

SEQ ID NO: 14275 - DNA, 1501 bp, Oryza sativa
acatgaggtagcagcgcgccttgtgcttcacaaggcgcagctgtccttcttctccggcgacggcgacgacttggacagccatgaggaggagggcgaagcgcgtgggcatattagaatagccgtattgctcgccgaactcgacgatgatggtccagccgatgcacaacctgccatctcccaggtaggccaggctcgccggcccatgcgggaaatatccccgctccaggcactcgcgagggtacgtctcctccacccacgcgtacctggtcaccggcgccgccgccgccggctcggcggaggggacgtcgaaggcgcagaggcagtaccttgtccggcacatggcgaagcaaaggttgagttcgggcacgaacacggcgcgccgcacccatggaagctcccagtcgcctaccttgcgccacgccatggcattcccatgggcggtggtgtcgaaggagtaggtgcccctgtccggcgcggacacccagatgcgcgcgccggcggccacgaaggccgtggtgttgcagaagatcatcgcgggggccggacggaccatggagaagtcggccggtggatcgggcagcgcgcgccacgaccaatggcgccggcgccggccgccggacccggcgacaggggtggcgggcgggaggaggacctggaagcaggggtcgggctcgcacgggcggttgtccatggagtagagtcgggtccccagcaggatgagggccgtgccgccgatcgtcgcgtgccggagctcggaccgttcgacaccactgcggcggcggtgtcgtagaggagggtgcgcttctgcgtgctgacagcgacgacgttggatccgaccaggggcgaagtcgaggcgctcggcgcaccgctccagcgaatcgaacggggcgattggaggaggtaaggccctcatcgttgcccaatcgtggtcgtcgccggcgtcggcgaacatgggcttgagatttagggtgaagacgaagtatatgccgttgccaccagtatccagcctcttctcatccaccacgaaaaatatgcgatttctcctcctccccttgctcttcttacgctgctgctcgcttgcgccgcctgattccatctgccctgccctgatgaatcggtggagacggcgaaaatgctttggtacgggagatgcagagatcacccaagaaagacgtggcagattatcgccttaaaaaagtttactctattttatcgacatcatcgctccctcaccgacatcagcgtggcggccgccaatccgttccgcagtggattccgactctctgtttgagttccctgccgacggaatcagaataggactgggagaaaataaatactccctcgataccaaaatatagtagtaagcatatctacaatcaaaactaaattagagtgttctcgctaactgaggatgatctccggaaaactcatctcttaatggcggacactccagatggactcctcaaaatctagagtaagttggaagagatactccagccta

SEQ ID NO: 14276 - DNA, 1406 bp, Oryza sativa
attaagttttaaaattcaaattttggcaacggctaataagctgaaaggcaaaagatggagctcattactgtatggggttaatttgtattaccaaatcaaattcattcatcctaccaaacgaattcccgtacgataccatcccatatcatacaagtaaccagacaaactgttgtacgtttccatacctctaagcaaataactgagttgtatcatgtactatcgcatcctatacactctaatccctccaaccaaatacatccttaatcggccttgtatgcggtaaatgggttgcatatccgcatgtgctgcccacttaacatcataagccttgaaaacgaagcgattacaatactcagaaaggtttggcaaccttgtacacttagggtgtgtttggttcatggtcatgcatggatgggatatggccatccatatttaagcggctgcacgaccactttttagaacactagctgggagtgcttgaaagcaataggtagttctcaccaccttcatctttcaagggcagtacattaccactccaatcatcaaagaatcatctgccagcatacaatattataatttatgccttatgatgagcaaagctcattttagtaatttcgaacttgaaagtgttgtgactaagagttaagaattgtgcgtggaagcgccgatgcagtggcatatccatggaaactaggcttatcagaattaacacccttagcaagaatcctattcctaggcctagactatctggacttagtcaggtatatgtgaatattttttgtgaaaataactactgctgataacatgtgaaatagaagtgatttctagtctccagctaaatcatgagcaaagcatgttcaacaactcaccctggacatcctatctaatacacttcaattatgcttaaaatgacaacagtgccatatagagctagcaatttgctggacaaagaaacacagtactgtgatcatgtataggccacaggtttggactcatacaaacataagcaagcagaaatcgaaaggttctggaaaaccagattgatcaaatatactagcatctaaacaggctacatgtctaagtgaaattctgaggcatcatcaacctactctaactaaacacaaactgacttgctaaaatgtagaagctctaagcagctcgattgactaacaaagaacacaactcgcttaagcaatgtgctcaagtcacgggctcacgccaactctgtgaaacattatcctcatcaggcctaaagttaagctatgaagtgcacaatttcttccttgcaatgcatgagatggaacactcatgtgcattcacaaaatgtaaacacgaaatcacgaataatccaagcagacatttagtgttgaaatggtagcattaaaactgggggttgagataaacca

SEQ ID NO: 14277 - DNA, 536 bp, Oryza sativa
atagagagcagggtgggccgactgacatgtgggtccagtattttttagattgacacatgggtcccaccttttattttgcttccaagtaccacgtcaccgtcacataggagtaggagtaagtcaaactagccacgtcagcgccacatcagttaaaaccgccatctaaaccactgagggatctcatctacaccggttttgatagttgagggacccattatatctggtattgtgattcagggatgaatatcgaactcagtgtaaagttaagggaccttagatgaacttattcctatattgagtggcgatctgctttgtggcagatcacctacctggtccaagcgtgtgacctccattcgggcctcaggcccattcaagactgaaaccttcagttttgtcagtgcttattactactccggtcacacaaatgcagaatgattcagtgaattttgggtatgtacgtggtactacctcagtttcaaaatataaacatttcgatctagaattcaaaattgtatcagaatataagcatttgtagg

SEQ ID NO: 14278 - DNA, 1501 bp, Oryza sativa
gaggggtggaggccggcacggcacaaggttcgagattcaccgccgccgccaactccaccctacaaaccctaatccgatcaagagggggcgcagccagtgacgggaagcgccaccgccgcgccacacctcatcgccgggacatctacaaccgtcacttccgcagccgtcatcgtcgtcgacctcaccggcgccgcatccacgacaacgagcgccaacggagacgatggccggcacttcttcatcctccaacacctcaaccggtcggtctatttaaaccctctcccgttttcaatctctatagttcaaacctcaagcccaaatagaaccacccgactagatctaacctaggtgatcctagtgcaaagtataacattggtatcagagcaaccctagggcttagatcggttcgggaaaagaaatccaaagagagaaaagcacagatccgcacggatcaaaagaaccaaaaaccctaaccctaatcttacctcgtcgccggccgtcgtcgacgccggcaacggagggggggaggggcaaagaggcgccgcctaggagccactcgacggccgcgcgcgcacctgcacgcgcgcgccggggagggggcccgcgccggcgccgccatctccgtcgtcgccatctctctctcacacggtgggggttagagacggtggggggagcggagaagagaaaagaaaggagcgccggccatggcgcggcggcgcgagggccgccggcgtcgcgacgccgctcggcgcgaccgcgcccgcccgagagagagaaagagaggagaagctagggtttcggcggccggccggggcgcgaggggttttgatccccgttttcggcgcccggccgtccgatcgcaaaccctaagatcgacggccggcggcggccggaccgaaatcggcccaagtggggagcgcgcggcggcggctttcccggcccaggcccaggttgcggcctgggggaggggagggggcgctcgcccgcgcgcaaggtggccatgggccgaccggcaaaggccggaaaaagtccatataaggtccctccggggccgaaaatgaataaaagagaacagtagcaatttttccattttatttttgtcaatttttcatgcaaatttcaatagaattttgaatagatttttgcatgttttacctctgtttaaatttgaaccaacgggagaattttcacagagagagaattacagagattttgctactgttcatatgattttatatagttttccgctgcaaatagatgtaattgatgaaaattagtgtttctaaaattaaatttcgaaccaacgggagaatttaattttaggaacattaattatgtgctatgatgttgtaatttttctgaccaacgttgataattgcaatattatagttatggttatatgtgttatgtctatttctgcccaacggtgatgtaggcttaatgcataatattttaatgttaattttgttctcaccgcacatgattatttcaggtggctact

SEQ ID NO: 14279 - DNA, 1124 bp, Oryza sativa
tctttggacacatgcatggagcattaaatatagataaaaataaaaactaattgcacagtttgcatgaaaatcgcgagacgaatcttttgagcctaattattacatgattagccataagtgctacagtcgtgtctgaaaaccatttttgacatccggtcaaatatccgatgtgacaaccaaaccttttcttttcacaaactaaacacaccctaacttttgcctagcctgtcagttttgacgtagctgatactgtgatacatcataccacttttgtgtgatgtcatatttttgaaataaaactcttaggaattttttccatcactacggatacaacgttcctagaaatatagtgtacagagtatgacgaagtgttcggtagtgttttttttaaagaaaattacagcaaaaggtggtatgaagtctactaaaaacaccgaggttttaaagagacgcgtcataatctagtccatcatcaaactagtacgggttatatttattttgagatgcatgacagcgaaagagtgatccaaagtccacataatgttatatattatgttttcttaaaaaaatgatgtgttgatttttctatataagtttaaccactcattagaaaatttgatgtaaatatgcaaagttgctagtctaatttaaattaactctagtgataaaatatatcataataaaataaacgatgctgacaaattaagttttttcaatgacaaattattagatgtcatgtctaacattaaaattctcatatattataaagtgggattgagattctctaatttacttactgacggtgatacatggatccgctataaagtaggtcaacatctcaataactcacgtaatcacggaataagcgaaacaacatatttgcaaacgaaaaataatttatgaataaaacttttatatacgtgttcttagcgatctaaaagtaaaggctgaaaaataaacttcgatgaaaaaaaccttaaaattaaaatttaaatcaaaaataaaacttttatatacgtgttctcagctctaaatttaaagttaaaaattcaaaaattttcaaataaacataagcatgagtgaaaagatgaggctctcaaagtcacaacgtactagagaatttg

SEQ ID NO: 14280 - DNA, 1501 bp, Oryza sativa
ttttggcatagggccactttttgcgttttgtgaactaaacgaggggcaaaattttttggcagatgtgcagtaactgttcacccatggacgagtagtacccctcaccctgctcctcgtcgctccaccaaaatccccaacgtagccgcttgccccttcgttcgtcccactgccgccgcatgccatccctgacaccgccccctcccaaatcgaccccctcctcccctacgctcgccctccctctctcagccgcctctcgccctccctaaaacagccagccgccgctcgccgtccgtgagacccctgccgcccagatccagcaggttctgctgcttcggcgttcgtcgctcatagcggagccacccgtcgtctctcacaccgctgccgcccagctccaattcttccaccgcttgtgtggtcgtccctcccccgccgacacacgtcatccctccaaccgccgccgcccacccttccgattcaccgttggcacccagatccgccttcattcccgcaatggccagctacgggggtggctacaatggcgacgaaggcggcaacggccacgacgacgacgtgtacggccacgacggctgcaccaaggacttccttgcgtccgggccttggtgcgcacgccaagggggcgcggtcggcgctgacgcggcgcatcccccgcctgattcctctagcggcaacacctcccgggtgcggttcgagtcgctcgacctcaacgacagcgacagatggccggaaatggctatgtacgcgggcatgctgcaggccgacgacgacaacatcgaaattcctccaccgcccgttcgagttcctccccggtgaatatctcgcaacctcggaatccggcccactcacagcgtggggggaggaggagtacaaggcgcggccgccggaggaggacgagcaggggccgcaagcgctggaggaggagtcgcaggcgcggtcgtcggaggaggaggcgcggccgtcggtggaggcggcgcggccgtgagcgcacggcctgcatcacgcgcatcagtgcgccgcaatgtctcagaccttgcggccgagcactccgatgctaacgacggtattccggtacgtacaacaattccaattacaattgattgcctgcttccaactagtttaaaattttgttaaatgcaaacttagttcacatgttcggtgttgttttccataactattgatgcatttaggttaggaaagataaggcaaattggtcagcgagaaatactcgcaccttctgttccatctggtgccatcaaatggacataggaaactatgttcgcggtattatgcaaaaaaatggctggagggacatcattaagaggtacttccaagccactggtttagttcacgacagggagcaattcatggggagacacaggcaacttaggaagcaatgggcattctgtaataagctccgctccagctctggcttagggaggaaccctgatgggacttttgtcgccgaggatgattggtgggctgc

SEQ ID NO: 14281 - DNA, 700 bp, Oryza sativa
  unsure (1)..(700): unsure at all n locations
ttttctacgggatactgtgtatggagattgtctgactgtgcgaggtcgtgacgtacacaggaagggtcgaaaaggactagacatgcccatcaaaaaaagaaagtaaagtgaaagtgtgcgagacgaaacggagcaacaagaagccaccaccaccacgcctgctgtctcgtgggaaccggacacacaagcagccgatattttctcccccaccccgaccctgactccgaccgatgcgttcgcgacccaacccaccaacccattcgtctcgagacggagtcgccgcgatccgatcgatccgggtcagattcgggtgccgccgcagccggcgtcatcgtcgtcttccccaactccggcgacgtgtacggacgatgaacagtcgcactgcctgcaaaaggcaaagccgacgctacgctaccgggtagtagtacatgtacatactcgaatanagaggacgtgtctttttgtggccaagcagcggtgcggtggaagaagcagaggctgcagcatgtgcaggccaatcctgcaccatcgattccaccaaagatgacaacgactcgccggcgactccgccgccgtcgcactctccgccggtctctgtcacggcaggttccccggcaccatcgcccnccgctcagctccacaaaacacatcgatttcgtcactaatgaacaagatattaagatgagtgttattggatcaa

SEQ ID NO: 14282 - DNA, 1501 bp, Oryza sativa
aaaatcccctaaattggttttaggctgggctcggggtgcatggttttgatggtagcacctcgtccatataaggaccggtcttcgggcctctgttgcaaagcactaccgtacttccacatgtctagtgggtaaggcttagtttgtggctcagtctagtcataaacaaaagtacacggattggagatggatgaagtcgggggtcgatggacattctccagggcaaatgaaggctacacgagctgcggcccggtagtcgagatgtcgaatggcagagggttggtgccctgctgctaggggctcagtcctgcctgcctgtcccgggggttccggccgtaggtaggattgggtcggtactcttgtctaaggctaggatgggttggaaactatgtcacgtctttcgcccgtataccgtggtggtatgtggcacgtggtgacacgtgaggaagatgtgtcttgtgggtaaagatgtacacctctgatcagagtataatctattcgaatagccgagccctcggttatgggcaagccgagcaatgtacccaagttagtgttttaattcttaaaacttgcttaacaactaaaatatggaatggttggcctgggttggcttgggacgagctgggacccagggtcgggttgccagttcggtctgaatcatcataggccttgggttaaggcaggttcgtgtgggttcacggccttgattaataatattggatagttctaggatcgtgtttacaaaatggccttgagcaactaaatgtctttaaatgctgtttactgcaaccctaacccctttttggtataattcccttgtactcccttgcatttattctgcatttgtgggtgtgtcttgttgagtacggtggttgtactcagtcttgctcaattttccccaagcccagatgaggagttcctggaagatgaaggctttggtgtctagctcgtgcctgccgtcaagcgcctgtggtcgtcgccctagtcttccgctgtttctcgtttgtctttgtgtgttgggccttcgctgcccgtgtaataattttatatacgcttccgcttgttaaactctgaattgtatcaactttggtgtaccttgcctcctgggacaaggattaatgcacgcacgtcaggaacgcccgtcgggttatttccggtcgtgacaatttattctagcattattagtactgtacatctattactgtactaatggctcatttaccagcaaaagttttacgatattgttttatttaatcttgctgcaaaaaaaaataaatttagcatgttgattttataactttcttttatttcttttggaacctgatgttcaaaagtacaaaatttgtaaccttgtttccaactgtttcaacttatcttgcaagcttgttttactttatttacttacctttttactttgattttctaactttattcaaattaatccaaaaacttgtgctattaattggataaatgtcttaactccctcctttcacttgtctttaga

SEQ ID NO: 14283 - DNA, 1501 bp, Oryza sativa
ttgtttactgactcaatgtctaacattgtcatccaaatctaacaaaacaaaaagaacaaaacatagaggggcattgctttaccgtttaatcatctgatctccaagctgacaaaattttcaagaatgatctgaagacgccttctcggtaacctcggcgacaatgtcgccgatgaacttgatgagcgagcagagcccgcccaagaagttgtggtcaatcaccccgtccccatcgtcgacatgcgcgaagtccaccagcttcacccttacaccgccgcttccacctccgggagcagccgccgccgccgcattggcgtcgtagccgaacagaatcgacgccgagtagaagtggtacagggtttgctcctcgaaccacgccttgagctcccgcagctgagccaggacgccgccctcccctccgtacaccgcggcggcgagcgcgcagtccaggccgtcgccgccgcccgtggacacgtagcggcggagcacgcggcggaccccggcggcgtcgatccccttcagctccgaccggtccgggcgccacacggcgccgccccgggcatcgaccacccggacgccggagacgcggaagccgaggagcgcgctggtggtctcgcggtccttggcgaggcacttggcgacgtaggggtccgggatcgcggcggccacgtgcaggcgccgatcttgacgtcggcgacgcagggggacgggaggcccgcgaggaggtcgtcgaggacgatgtgcgggtagggcgcgccgccggggctggctggggccgggaggaagcgggtgccgtggaagcgcgggaagaaggcgccccggacccggggcgggacggccgggtgcgcggtgaacgcggcgtaaaaggcggcctcgtgctccccgcgctccccggcctggaggggcttgtagaagagcccctcgccgtcgacgagcgggcccagcttgtcggcggacgcgcggtgccccgccacctggtgctccggcgggcgcaggtcggaggccatggcggcggcggcggcggcggcggcgggtggtggaggtggagggggattcggcgagaggaagctttttaaagagattgttgggaatcgcgagcctcgagatcgtgacgtcagcggcttttgttttttttcgatctgtttcctcgctgaccgggcgcgggccgtgggcgcccacgttgttgctgcgaaaccctcctcctctggcttttggtcatttggagcgagagcgtggaaaggtttgggaagtccgattcatcagtggaagtttcgccggatggatgaatggtgagaaagtttcaccgttcgatcaagagagcagcaaattttccagatcccctatccagagagacgagggaatggacgggagctcgccggccacgccccgcgcttgggccgtgcgcaggtggaatgggagggggcgccgaccgagttcgctctcgccgccgagcccgattccaccgaggtgagatcagtgggccccagaacgaaacgtaaattag

SEQ ID NO: 14284 - DNA, 1083 bp, Oryza sativa
gccgttgcgcaacgccggcgccgtgccgcgcgcttcgccgccgccgcgcaacgtcgccaccgggccacgcgccacgccgccacgcgggcaccgggccgtcccggcgccgtccgctgccgccacaccgccgtccagctgccgccacaccgccgctccgctgccgccacgacatcgaacgaattaacgtgaactaacgtgaacgagcgaacgaacgtgaacgagaacgagcgaacgaacgtgaacgagaacgtgaatgagcgaacgaacgtgaacgaacgagcgtgaacgaacgtcaacgaacgtgaacgaacgttaacgaatgtgaacgtgaacgtgaaatgcaatataggcaggtgaatgaatgtgaacgaacgaacgtacgtgaatgaaacgtgaccttaacaagaacgcgaacgtgaacgatcgtgaacgaaacgtgaacatcaaatgcaatatatgttacttcgcgtttatcctaatacatctttttgtatcttgcagaaaagacgttgtcggagtcgtccctcaagccggagtggtagctatccctcgaaggaattcgcgcaggcaagtgacgtaattatatatatatgattgttatatttgtaatgcaattaagactattagatttaatatacgacacttagacttagttttaatataagattattatagtttgtaattagactttagtatataatttattgactagctagggtcctataatatacgtcacctagacttagcatatatcactatttgagttttagtataagattatttaagttttaatataagattattagatttgtaattagacttactatataatttattgatagctaggggtctggtatatacaatacctaaacttagcatttatcactatttgagttttagtataagattatttaagttttaatataagattattagatttgtaattagacttactatataatttattgactagctagggtcctgtaatatacgtcacctagacttagcacatgattgttagcatataagattgttaaaacataaatgtctcatgacttagcagctgtttcatgtatgaacaga

SEQ ID NO: 14285 - DNA, 1501 bp, Oryza sativa
tcctaaccgggccgagcgccgcctccctcctcgcccggccgccgcgcgtcgcctctcctcgcccggccgccgtgcgccgcctccctcctcgtcgggccaccgagcacctcctccctcctcgctgggccgccgcgcgtcgtctccctcagcccggacgccgcgcgccgcctctcctcgcccggccgccgagcgccacctccctcctcggagggccgatgagcgccgcctccctcctcgcccggccgccgcgtggcgcctctcctcgcccgggcgacgcgcaccgcctatcctcgccgggacggcgagcgtgcctccctcctcgccgggccgccgtgcgccgcctccctcctctcccggccgccgcgagctgccatccctcacccggacaccgcccgctgcctcggggatgggagaagggagagagaggggagatggggagagaggaggaagaaaaggggtgagaatgacatgtggggcccacgtgggccccaccattttttttattaatttgtgtatgaaactgacatgtgggtcccacgggttttattattttttggatcaaattgccacgtaagcgccacgtcaatgccacgttagacaaagacctagtcaaattagccacgtaggcgccacgtcagccaaaaccaccctcaaaaccgccgagggacctaatctgagccggttttgatagttaagggacccgttgtatctggttttccattcgagggatgaaaatcggattcgttgacaagttaagggacctcagatgaaattattcctaccaaaaaccggcgaaatcgcgatgatatgggcccaaaaaaatgtggcactctgggcctgtgattgttcagacagtaggtatgggcttaaatatttgggctgctcccggttagtatttgggcctgatttatatacgagcagaatctgcaaacacattctatattttaaactggatttttatagtatatttcatatagctacaactattttttgtcaaaaaaaaactatcattttgttacaacgttagctcaacattttccagagaactacaaaaatatcgtatgatttcataaacaaaaaatacaactctacttgaatgataaatttgcacttacatatcatatacacgtcataaaacttataggaagataaaattatagtttcctaataaaatctttggtaatgctgcagctttggggaaataccagttaaagctatagtgataattctgaaaagaaaataattgtagttttgtatgattattagtgtgtaatccagcatgtaaatattgtactaataattgagtgcatagtggggattgattgctccaccactcttggctggatccttcttccatggcatctgatctggcgccaatgtttcccgccaaattcctttcctttccattccctccaactcaaccccattctctctggagtcttgctggtcaaaaaatatcctcaaaaaaggaaaagaaaaaagaactagggtttacgctcca

SEQ ID NO: 14286 - DNA, 287 bp, Oryza sativa
cggtgcaaaagaggtccctcggcgggttagaaggcagttttggctagcgtgactcctacgtggctagtttgactagatcttcgtcccacgtggcatcgacgtggcgcttacgtgacaattctatctcagaaaaatataaaacccgtgggcccacatctcagttacacaaaaaaaattaagaaaggtggggcccagccccacctgtccttcacactctcctctcctccttactctctctccccatctcccctctcttcatctctctcccctctcctctcctcttccga

SEQ ID NO: 14287 - DNA, 1501 bp, Oryza sativa
agataaatcagtgagtttcagttcccaaatcccaatcagtgaattttagtactcaaatcttcaatactcaaactcaatactcaggctactcacctgtgtggctgtgacgatgtgttcaggggcgatgtgcggctccggccgtgccgctgtggccctggtcggcggctcggcgctcgctaccctgcgcccctgcccgcgccggtgcgccctcgcccctgggccctagcggctggcgccaagccgtggcacgccacccgccacccgctgcctgcccacctcgctggcgccaagccgtggcacaccgggcggccggatctggcagaggggaggtcgcggccgccgccgcctccgcctccgccgtggccaaccccgtggccgccgctgcgaggcctccgccggccagccatgggagcccgtggtcggcggctgccgccgtggtcgctgctgccgcctccgccgcgggatcccgccgcctcccctcccgccggatctggcggaggggagggcgcggtcgccgctgccgcctccgccgcgggagcccaccgcctcccctcccgccggatctggcggaggggagggcgcggccgctgctgccgcctccgctggccagccgccgaccgcgagacggcgggagaggggagggagagagaggacagcgagagagagagagagagcagagttagagagacgcgagagatcgagaaggggagggatagataaggacgcgatgggtgccgtgcgtgggctcggctcgaatcggctcggccaaacgctataggtgccggtttttaaaaacaaccggcccctataaaaattattaggtgccggttcttttaaaaaaccagcatctatattataggtgccggttcaaatgttcttaaaggtgccggttctacattttttcaccgcaaggaggtaggaaaagctctataggtgccggttttaaatgaaccggcacctatgaaccggtctctatgagagttttttagtagtgtaaactcatctttcaatattttttaatttttaattttgaatttcagttacttctaaattgtattcctatattgactttagactcttcttcccatttttttaattttgaattttagttatttgtaaattgtatttttatacgaactctgaactctagttttaattttattatgtttatttcgaattttacttagttttaaattcctatatggactctatactctacttctaacattccttatttttaattctgaatttctactatttcttaattgtatttctatatggactctatactctacttctaatattccttatttttaatttcgaatttctattatttcttaattgtatttctatttggactctagtctcctctttcaatatttcttatttttaattccgaatttcagctatttttaaattgaatttctatatggatctgtttttctttttcttcaattaatatgagaatttctagtaacataatataaatccttctttgatt

SEQ ID NO: 14288 - DNA, 1501 bp, Oryza sativa
ttgaaggttcgtcggagttgtcttcataggtagcatagacaacattttgaggttttgtcctaggcctagaatctagactgacagaaggtctagactggagaaaggctttttgttttgaagcaaatgttatctcaacatctccgtctggtgtttcaatcaaggattcgacttccgattgatccatagacttaggttcaacagcttgagataaaacccatttctctggcagggtgatctcatcccattttagggttttgggggtagtacatctattattaggattggtttgaaggagagtggttaggccttttggtgtataatgtttggcacaaggtgctaaagttgtcatggctttgtagtaaactctgtaggtaacggagatgttttcactccctggttctagttcataaccagatgtttgtaagttgagagtgagaactttatggatatttgtgtctgagagggatacagaaaaatcaggaaaggtgttaaaataaacaggaccattactgaggctggcttccaccatgccaagtaaggaatctttgaaccttttatttctgcaatctcttagacaagccagaacagagacgttcaaaccctttctagtcaaggatctgatagcaacttgtataagaccaaagtgaaggtagtgatattgatgtttagctcttatagaattgatttctctttctgaaagaagatgtagggtttcgtgcaaagaactaattggaatagttttttcaattgttttaatatagtagtcactaagtaatgaaaaagtacctacatgatatatttccttaatattaaccttaggaatcttccagttggaaatacttttctcaatatcctcaaaagatatagatgaagcattctttaccgacatagtgccagcagacttctcgctactgcacaaggctacagatcgatcagtggctcttcgtgatctaaccaaccaagacatcttatacgaaagataggaagataggtaggtagttaccagacaacggcggggaaatctcccacaattatgatcaacctatttggatatgatgtgttccagtcaacggcagggaatatttcccacaattaagttcaacctttgcctttgataagtgcccagtcaacgaattacgccgacaaacgccttctgcggctcaacaaggcaacgcgacttcaggcaaccgatcaaaggttcgggaactccgcgacttcagaacaccacaacaccgttcgggatcaccgcgacttcagcacgctacccgacccctctcccccccctttcggagaagatggctggggaggttatatatatatatatgtgtgtgtgtgtgtgtgtgtgtgtgagaaaaaaatataacaatgctagccgcgcaatctgcgcgggccaccatgctagtttgtgtaaagtgatatatctatatgaggggcagatatagcatgtaagcatgattagattaactaaatatattaaaacatcaatatcaggtaagatcgg

SEQ ID NO: 14289 - DNA, 1178 bp, Oryza sativa
ctttacccgcagtccacgactgccaaatattcattagcttagtcatggcccagtattaggttattaacaattgtggtacctgttccatgaacttatatcctcatgcgctctgaacgtgacgttaactgcagcgagaggagttctggcgttaccggggtctttagagaggactgattgtatgacaccatgtcatcgcaatcagggttcacaaacgtgatcaaatatatctcaaatacatatttacctgtgcctcggtaaatatcacaattgccctactcggcgtaaatttgcctcctacacgaggactttaaaatagaaccactgtacagaggtaccacattgctaattaacataatagctaggtttgtccctattctagaagctgcggtcgtactcgttcgtttgacataagtatttggtataaacttatatcgactgagacagtactagccacccggaaatcaaccatttctaccgtactgtcccaatctaagttcattaaattttatgcataatctaactaggcagggctaagcaaaagctagcatatctggtttgctatatgttcaggttatgcattgaaaatcatgaatggctaatgcatgagatatcagagatatagaatacagggcatttatgctcaaaggagatgaataataacttgccttgctccaacgcaaataaatccgagataggcaacctgattatccgattctcgaaataccaaaggttgccatccaaaataaaatagactctactaagaaagacgaagaaccaatttcaataaaatccatagaatagcaagaaagagataaacagttaggagggctagggtttagggtatagtctatctcttttatagggtatatggattactgtgctaatatcttatgcggaggttctagagagttggaggctagaggggattaagcaactactatcgcttatatttcatatgtgggtttgattagtaggaggatgggaagtaactagtttggataatggtattggttaaaagggtatgtggttggtattcattggcggtagctaggtttaggtcgtatggaaactaaggtctagttgtcctcgagtcgatactgaaataggatagcatatcagctcggctctataattttatgtgtaggttctggtaggtggagagtaggtggtggagagta

SEQ ID NO: 14290 - DNA, 1501 bp, Oryza sativa
gtccgctgctgtttatttttgattgtcaggccttaagtgcctttgtaataatgtaaatattatcgatataataaagaagtgtctcttatatcatgtttgtgtggtgtaccccggcttttcctgggacggggattaatacactagcgttcgggaaaaggcaattttcccggtcgcgacaccgcccttcctccccgtcagaatcgagcccgcgccgtcgcactctctctccgccgtcgccgccgagctccggtccgccgccgtcgtcgccccggaccatctcccgccccggcgccgcctccttcggcttcgccgcatcctcgccgacctcgtccacccctccgcttcgctcgccgaccgccggaacgccgtcgaccccgtcgacccgagccgcgccgccgccttcctccgctccggccgccgttttcgtcgtcgccgtcgactcggggtgagccgtggaccgccgtttcgtttccccctttccctcccctctctcggccgctgctccgccgtgccggtggtcgccggcggcgaccatcggggcgagggcgctgcctcccgccggccgcgccgccgtggctgccttcgggcgcaccgagcggctgccgcgtggggcccggccgtcagccgcccgcgccctcgggtgcggctgacgcgtggggcccgcggcgccggtcggagtaagccgcgtgcacccggtccaccgtggaccgtgaggctgccgcgtgggccccactcccgtggacccggtccgcgtgcccctcccctcggctgacgcaataaatccaattttaaattaaaatttaaatgaagaaattcgcaaatattcatttaaagagcatataaacttcaaatggctataacttggccatttgaactcggaattggaccgttcaagtctctaatttttccttaagaagtcaagaacccatttttgtgctttgttaatgctttttatatggagtttgttagagtaaaagccttttcttttccgttggtcgtgtagacgctgcagcttcggaggatccgctcttcgtggaagttgaagccggcatttgggaaagcgagcaaggcaagacacatcatccttgaacatattgaatcccaatttatgaaattattttgatttaaattattgcatcatcgctttatttaaattcccgcgttatcactgttttatttagccatgcctatttacctttgttatgaccttattattattgttattgttattattaccttgttcaccctaggataaacaaaacccccaactagtggacactctactcgtggtatcactagtatgattttaggtagatgcttcgctgattaattaggtaacattaggtggttttaaaactctagattgtggtaatattcatatcacttggacacattggatttgttggattgttgtggaattggattcataccgccccctctattcaaaatccccaaaatggttttaggctgggctcggggtgcatggttttgatagtagcac

SEQ ID NO: 14291 - DNA, 1501 bp, Oryza sativa
tgccggcgaggccgccttcgggcgcgccccgcggctgccatgtggggcccggccgtcagccgcccgcgcccgcgggtgcggctgacgcgtgggacccatggcgccggccagtgtgagccgcgtgcacccggtccaccgtggaccgtgaggttgccgcgtgggccccactcccgtggacccggtccgcgcgcccctcccctcggctgacgcaataaatccgattttaaattaaaaatttaaatgaagaaattcgcaaatattcatttaaagaacatataaacttcaaatggccataacttggtcatttgaactcggaattggaccgttcaagtctctaatttttccttaagaagtcaagaacccatttttgtgctttgtttctgcttgttatatggattttattagagtaaaagcctttttcttttccgttggtcgtgtagacgctgcagcttcggaagatccgctcttcgtggaagttgaagccgacgtttgggaaagcgagcaaggcaagtcacatcatctttgaacatattgaatcccagtttgtaaaattatgttgatttaaattattgcattaccgctttatttaaattcccgcgttatcactgttttatctagccatgcctatttacctttgttatgaccttattattattgttgttgttattattaccttgttcaccctagaataaacaaaaccccaactagtggacactctactcatagtaccactagtataattttaggtagatgcttcgcaatttaattaggtaacattaggcggttttacaactctagactttgggaatattcatatcacctggacactttggaatggtttggttattgtggaattggcttcacaccgctccttctattcaaaatccccaaaatggttttaggctgggctcggggtgcatggttttgatagtagcacctcggccatacaaggaccggtcttcgggcctctgttgcaaagcactaccgtacttccacatgtctagtgggtaaggcttagtttgtgggtcagtctggttataaacaaaagtacacggatggagatggaagaagtcgggggtcgatggacatctccagggcaaatgaaggctacacgagctgcggcccggtagtcgagatgtcatggcacagggccggtgtcctgctgctaggggctcagtcctacctgcctgtcccgggggttccggccgtaggtgggattgggtcggtactcttgtctatggctaggatgggttggaaactatgtcacgtcttccgtctgtataccgtggtggtatgtggcacgtggtcgcacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacc

SEQ ID NO: 14292 - DNA, 1501 bp, Oryza sativa; identical to SEQ ID NO: 13190

SEQ ID NO: 14293 - DNA, 1501 bp, Oryza sativa
ctccgtagcaaggatttgcatttctctcatctacgtttcacccggttttaatcatgaagaagtgaagggcggaagggcatatagctcaccaagttatctttctgatgcacgatggtctccgcgaccaccatctccgtgtagagccacgcgtgcttcgagatcagccgcgcgagcgtccggtagtggttgtccgtccagtccatcatcggcgccacgctgcaggagaagagggggaaaaccacgaaatcaatcagctatccatgagcagcaccgccatccccgcccgtctccattgcctaaaacacggaataattccgctccccgctcacctgaacagcggaggaaggtgcccgccacctccagtcgcggaggagctcgccgcgcgagcgcgggcgcgacacgggcccacgccgcgagcgcgctgcggcggcaggagcgaggcgccgcggatgctgccgggcgcggccagcggagggcgcagggagtgcctcgccaccgccgcagccgacctcaccgcgatggccatgcgagctgagctctttctctctcccgcatacggccgccgccacctccgccgccgctgccgccgcctctccttgggaagggtacgggccgctgcgggtgaggaggagaacgtgtggcgagtggtgtcctgaccgcccgatctgtggccaacggtcgtgattgcgtcttgcaatacgactacacgagtccgatccggattacaaacggcttcaatctaccctttcctcctcttacacgggcacgttttttaaaaaaagctgctatataccggtatcccgttgaaaaacaggatgattctaaaaccaacacggtatcgtcaccgcgcgcgtcaacaaaaacagaaagaatcgtatcgtaccagtgctcgccgcgccacctgaacacatcccaccgaatcctcctcggaatcgccggcgcgagctcctcagcaaggcatgcgattcctcgccggcgcaaggcgagctcctcggcaacccgacgaatcctcctcgaaatcgcgcgcctccgcgcacgattcctcgccggcgcgagctcctccgcatccccaagattgatcctcggaatcgcgcgcctcctttgttgatttcgccggcgcacacgccgtctaccgatttcctctgcaatccggtgctctgctcctacctcctcgaccgattctgctccagctatgcgctgcaagctcaacatcagcccgcgtaagaattctaaagccagttctctgttatctctattttatgcatgcaatgtatgtgttttgatgttttgttgctattttgtgtgatttcttttgatgcccaggagaataaaaaaaagtgatgccccctcgagtgaatctcctttgtgtgcactttctgctagtgtgtctgtagctagcgagtcagttgtgacaacaatagtagataagttagtgttggatgagttaagtgctgaaatagagatgttaaaggaggcccttgttagagctagatgttaaaga

SEQ ID NO: 14294 - DNA, 591 bp, Oryza sativa
cccgatccccccaacttccccctccccagcgccaccttcccccaccccaccccgaaacccaaccactaaccctagttgtcgtgacgcggtcggaaaacgcgcgcgacttctctccctacctggccatcgccaccccggcgcggcactgcccttctgtgtgctagtaccttgatctgattgtgtgctgaatcttctctctctctttctctctctgttcaatgctctatgctctatctttctctctttctacttctcctttttttattattttcttcgagcgaaaatatttttaagttctttgctagcagttctggtttattagatgaagcacaaaggataacgagtagctcttcagtactccagtttgttttttcaattccggtgatgcattttgtcctacgtttgcctttgaaagtgtgtaacgaatggtcatcagttgcagcctaaaatacgctgtaatttcatttcctctatgtttcacatcgacgtttttcaaaccaagcaccatctttatctcatcgtactcttttttgttttctgttttaccagtttttttttacagttcttgatctgaaacggagacaatggcga

SEQ ID NO: 14295 - DNA, 1501 bp, Oryza sativa
gtttgattgtccgtcttatttaaaaaaaatatgaaaaaatttaaaaagataagtcatatataaagtattattcatgttttatcatctaacagtaataaaaatactaatcataaaaattttatataagacggacgttcaaacgttggacacggaaacccaagaattgagtctttttgacggagggagtacttaattaatcacgcgctaatggatcgctccgttttccgtgcacaagagattggttctcatctccttcctacgaaggcaacctaacggtgtctcgcttacagtgtttgaaatgtcagttgaccgaccaaatttggatttcaaaaaactgatgtaacgagcctttcaacaaagatcaagatgcacaaatcttatatgtatccttcatgtcttaatacaaagatatgcaaatcttataccgtattctccatatgtttatacacatgcgcaaatcttatgttaattcttaaaaaaaaacattgcaacaaagaaatctcatgactggacaaccaggacagcagtttttttttcttacaacatcattttttctctcaacttctcatatcataagtcataactttttttaagggcctaagttataactacaacgggtaggaactcgcatattaatgcaccaagaaaataataaaaaaactattgcagcttagagtttcagggctcaaaatatttcgtgcatataatggtattccctctgttcttttaatatacgacaccattactttctcctcaaactttgaacagcaatatttattcaattacttagttataagtaaagtgaaaagagtaccccctagatctatccaagtacttaagtgtgccttgtatatttgtctatttgcacaaacatttctagaaaggacaaaaaagtcaaacaaattaaaaaaaatcaaaggtaccatatatttaaaaccggaggtagtataataggagtatatagattctgttagcaaaatatatacaataatctaaaagatcaacatttcttatctcagctttactaaaaatggctgcaaaaggaacagaactatcttttgtacatgaaagtgtgtacagaaagagatgtattgtgtaatatgggttcgttgtatttagcctcccaggtcggtatatcaaggaatctcagagatgaaatggaaaccaatcctatcctaccgtaacaattgaatcctctagaatcctatcggtatactctaacagtacacaacaaaaaattgatgatttatgctttgaatttagcaaaaggacttcagaacatgtccggtttgtttctagtatattgatctcaaaaaattgaagatggtaaactaaaggaaggtaaaggtagaccagtttagctagcttaaatcattgaagggaagatctctttaaaatgtgttctattgttttacacacgagccaacattcaaacagctatttaccacaataagcctaaacacatttaacatgtcatttggagcatgcatgaaaaaaaagc

SEQ ID NO: 14296 - DNA, 637 bp, Oryza sativa
ttatagtataatatagagtaaatttcacaaagctacaggtattttgcataatttatcacagaactacagatttaagagcttgtttcacaaaactatatatttagtgtctccgtttatcacaaaactacagatttaataacttgtttcacaaaattatagatttagtgtattcgtttatcacataactacatatttagtgtcttcatttataaccaaactacaggtgtagtgtcctcattattacaaaactattggtttaacaatgctaaaacctatagttctgtgagaaatgaagatattaaatctgtagttttgttaaacaattttttaaatatatagttttgtgatatattctgcaaagtacatgtagttttgtgacaacgaagatattgaatctatagttttataaaataagttcttaaatctatagttttgtgatagatcgtgcaaagtatatgtagttttgtgaaatttactcaatagtataaaatttgcagttttttttactgtaaaaacacagctcggtacagtggtggatctattgttggggcttgttggtgcgcaagccccatctgcatgattcccttcctctaattagcgactaatgactctaattaattagcatttagcgtaaata

SEQ ID NO: 14297 - DNA, 1501 bp, Oryza sativa
gttgccaactgtgattcacggcaagcttcttctattgagcatctttcccatccttgagaaggtaccatgaggtacaaggtaccaatctaatttaaccgttgatttaacaggggtatgattgggggctaaaaaaaattaggtctctcttccacgtcgtcgtcgcccatcgagggtcgtcgggcatcgaggccggcgccgtcgtcgtcgcccattgagcccgccgccgccgtcgggcatcgaccgccgccgtcgtcgcccatcgaggctgctgccgccgtcggccatcgacccccgccgccatcgcgcatccagccgccaccgtctcgcatcgagccctccgtcgtcgtcgcccatcgaggttgccgttgccgtcacgcgtcacgcatccagccgctgtcatcgcccatcgaggttgccgccaccgtcacgcgtcacgcatccaaccgccaccgtcatgcatctagccctccgcggccgccactgctgtcgccgtcgcgcatcgtggccgccgccgccgccgcgcatcgaggctgccaccaccgccgctgccgctgccgccgccgtcgcgcatcgaggccgccgccgtcggccatcgagcccgccgcgcatcgagcccaccgagccgccatcacgcctttcgccggtctcgccgcaaatctggccgccgctgccgctgccaccgccgtcggccatcgagcccaccgagccgccgtcacgcctttcgccggtctcgccgcaaatccacaatcttcccgatttttcccctcgtgaaacagtaaaggacagaaatacccttccaccaatggtactgcttgaaagagaaggtgcagtaccatgaggtacggatgatttctgactgttggataatgctagatcaacggtcaggatttggtactgcacaacctcaaggacagtaaaaaaactcctaatagtatcatgatgctcaagtgcatcatattggtgataccatgatacttaggtattaggcctaacgtctagcgatatcacactaatacctacttagtaccatggcctggtctggtaccccaaatactcggtacttggaccctgataccaaggcttggtaccttggtacgagacactcggtaggtactggatctggtatctctatgtatcaagttcgataccctaggtacttggtaccaaatcgtggagagggggcatgtgccgttgcttctcccttcctctcctcgatgcctccctctttctttgctattgctatggctgagtgagggagctaagagggagcgcctctacttcattgtgttttgtacgtgggagctcgagtcggagaggaaaggaaacagttcatcacttctttctatatagttggtacccactacaagtattaacactataaagaagcatccaggttaagccacatcatcgataaccaatagccatccgatcgaatacatctttgtttgtttagctggcatgcacagccatgcaggccttaagtaagcaaactgccatgggt

SEQ ID NO: 14298 - DNA, 1501 bp, Oryza sativa
agaggcggcagcatcgacggcagctgcgacgcgggaggggaggccggcaccgacccagaatcggaagctaaaggcgacggcgtgggcgagcgtggaggcagaggggctcttcgctgttggacaccgcactggaagttgtcatcaccgaccggcgcccaccctggagggcctcaccactagagaccggtgctcgagcccgtcgaccggcgctcgagcccgtcgaccggcgcgctggccatcctccgcgactgcgagcctgatggctcgggctccgccccgcttcctccacgcgccggccaccaccgcgccgtgggcggcggccaacgtcgacctcgccacacataggtccctacaagccggcgcacgaggggctcgacgtggtcctcgcaacgtccaaggccgcctccggtggttcccagccatcccgcctccggcaacggcgccacaatttccgccgccgagggctacgacggcgaggaccgcgttagcacgttccccgacgacctcctcgtcgcccgcatccccgtcaaggacgggactcgcaccgccgcactcgccttccgctggcgacgcgtttggagctccacgccgctcatcctccgtggcgagccctttgtgcgtcggcgtggagggccataagggcggcgaggtcgacgatggctgccgtccacggcgcggtggtggccggcttgtggaggaagcgagcggcggcggcgctggtcgccgatctcctctctgccggcgggctgtcggtgtcgtagccgttggccgtgccctcgtcggtcacccggaccccttccacgtcgtgcaccggttcgagctcgccgagtcctcaaccatctgctcgcctgcaagcctcgccgctcgcgctcaattggcagagagagagaggaggaaccgaggaagagaagaggggggggagaggccgactgacgtggcatcctgacatgtggggcccacgtgggtcccacgctgactcagccgccacgtagactaaaaccatagtcaaaatcaccgaaggacctcgagtgactggttttgtatagttaagggacccatatatctggttttgcggttcgaggacgttttcgtatcccgataacaagttgagggaccttaggtgtactttttccttttttactcttctaataggaaagatgggtggatttgagcgagaagaaaaggcccacgttttcattccggcccagaaagcagctgctgagctgggtgggcatcacgaatcgatgggggaagctaagctagggcagtgtgggggtgggcccacctaatccgggtgagccaatgggctgcggccacgaggtcgataagatggcgcgcgacgacgctggccacccaacctctcaatcccaacccgagctcagatcattggattggtttatagcaaccactacaccggcgccgctgctgctgaaccataggagtactacgcagacgcagacgcagacgcagaccaagaagaaatacaatacactagctacca

SEQ ID NO: 14299 - DNA, 1501 bp, Oryza sativa
cctcggttcctcctctctctctctgccaattgagcgcgagcggcgaggcttgcaggcgagcagatggttgaggactcggcgagctcgaaccggtgcacgacgtggaaggggtccgggtgaccgacgagggcacggccaacggctacgacaccgacagcccgccggcagagaggagatcggcgaccagcgccgccgccgctcgcttcctccacaagccggccaccaccgcgccgtggacggcagccatcgtcgacctcgccgcccttatggccctccacgccgacgcacaaagggctcgccacggaggatgagcggcgtggagctccaaacgcgtcgccagcggaaggcgagtgcggcggtgcgagtcccgtccttgacggggatgcgggcgacgaggaggtcgtcggggaacgtgctaacgcggtcctcgccgtcgtagccctcggcggcggaaattgtggcgccgttgccggaggcgggatggctgggaaccaccggaggcggccttggacgttgcgaggaccacgtcgagcccctcgtgcgccggcttgtagggacctatgtgtggcgaggtcgacgttggccgccgcccacggcgcggtggtggccggcgcgtggaggaagcggggcggagcccgagccatcaggctcgcagtcgcggaggatggccagcgcgccggtcgacgggctcgagcgccggtcgacgggctcgagcaccggtctctagtggtgaggccctccagggtgggcgccggtcggtgatgacaacttccagtgcggtgtccaacagcgaagagcccctctgcctccacgctcgcccacgccgtcgcctttagcttccgattctgggtcggtgccggcctcccctcccgcgtcgcagctgccgtcgatgctgccgcctctctgtcaccgcactcgcccgccgacgccgcctcgccttgccgccgccctccccttctcccgtgtctctgccgccgcgtcaccgccgccgcatcgccggccagcctgcccagtccagagagaggagtgagagggagaagaaggaaaggagaggaagggagaggccggctgacgtggcatcatgacatgtgggcccacatgggtcccacgctgactcagccgccacgtagactaaaaccggggttaaaaccaccaaatgacctcgggtgaccggttttgtatagttaagggaccccatatatctggttttgctgttcgagaatgtttttgtatcccgatgacaagttgagggacctttggtgtactttttccgagtaaaaataacttcaatttacatagtttggctcgtatccttaaacacaataccaaatataaagcatttctcattttttaaaccaatgcaaacgaggttatggtttggatgattggttttggctgagtggtgcttacatgggtagtttgactagtcctcgtcccacatggcactagaagcaagattaaaaaaaataaaaatatgtgagctacatatgttagccaaata

SEQ ID NO: 14300 - DNA, 1501 bp, Oryza sativa
gagaataaccaatgggggtttatcctatacatatagagaaggcatatgtagtaatgatgtagaccaacataaaacatataccttcatgatctccatgttctcaatgtaaataagactaaataagataacattcgagtaaacattagtctcacacttatatatcaataacatggaaatcatatatatgaacctatcaaaaagtaggagataagaagtggtacatatcgttttatctccatgcatttcatccttgtcatgattaaggtccatcacaaaagaatgcatgtcttccacatctcattatcgggaaataacctagtaggcaacttatgcaaaagagaggttaatcccataaacatcggtttatcatctattaccaaagtaacaattacacaaattgtttaatccaagatctttcaatcttttctctctttggtgatggataataacccgatataaacaatatagagagatgagatgaaaaatgatttcaaatcaagatagaaatcttataataaacaaaatatagaataagctccccctcaagatatgcatacatatggatatgaaggaacgcatatgcacataatcaataaagattaaatagcaagctcacactatattttggatccacaagagagaccaagttagaatatgtgaagtttaatacatacctctcatcatttttactttcatatccaaatgagactagtcaaagaaaggctcataaaaatgattagtctcatatagttagatttgtcattaatcaccaaaatcaaattaaggcacttgaacttacaacccattacgcattctcaaaccaatgatgacaaggttgccctaccttgtcatcttcctcatcttcgacagctcctcgcatgctagatccatcaccatccgccgctgcctcctaatccatcgcccactttgcccccgccatcaacaccaagcccaacaacagatcctgatccagtggcttcattgacaccgtcgccacctcgccacccatccatttccattgcctcctatgactatccctgtaagcccgataatctccctattctttccattaccctctcctacccccacctcaaaatggaaccctaatccataggttctcgattggagtttgagatgatattgtcaatgccaaagaagaagaggaggtcgtcgaagttggaggagaatcaccgtgtgaattatgaagcatatctgatggcttaaaatctagcctatttaggatatattttttgtcgacagaaggttaacaattctattttgtttaccttaaaatctagcctatttaggatgtattttttgtcgacagaaggttgacaattctattttgtttaccttatgtgtttttctatttatctcgaattattgttgtagtttatttaagcctgattgaataatgtaacttgtaaaaaaggattgcttgagtacttgacggcttagtttttgaacagtgcaagcaattgctcgtccatgagagcaaaac

SEQ ID NO: 14301 - DNA, 1501 bp, Oryza sativa
ttgtcagccggctcaaaccatgtgccgggccaatgtgtgccatcagccatccatgtcgcattttcgccggcatgtttggcgttgtacacatctgatcgctggcgaatggtgctcgagagggagtcgatcctgaccttgaactcctcgtactctcgccgcacacgccggtgatcgctcatcagctcgccggggacgccgcctttgtacgcctgcgtcttcatcgcgaagtagttctccggcgacctcggctcgacgcagtgcttccggcagaagggcacccacagctcggcgaacttggcgacctccaccatggcctcgtagtggaccagcgtcccgccgtcgtcggacaggtagcaggcgtacctgtccaccgggtagtcggcggcgaggatggagaggatggtgttcacggtgtagagtatcggctcgtcgacggggtcgacggtggtgacgaagacgtcgacgccgggtaggtcgccggagtgccggtcggcgagggcggcgaggtccgggacgcgcttgatggggctcagcttcgggagctggttgagcacccacgagaagccgaaccagacgtcgccgaccatggacattgtccacagccacacgccgtcgcggttcttgtgacgtacgcgccacgcgaagaaggcgacgatggcgatcagtcgaagaaggatcaggaacctgtaaggatgaaggatgctgcccttgaccttgtacgtccggaacagcggcggccgggcggcgccatcgccgccgcgggccccgcacacgtccttttcgtcgacggccacccacacgtcatccttgccgccaccgccgtcgttcacccgcttggccacgggcgaccggcgcccgttctgcccgtcggcgccggccgcgacgtcaccgctggtggcgtccacgcggagggcagcgttgatccggcgagtcactgccgccgctgcggacatcgtggaagccgcggtggccgccatgcacggaacacacctatttcactagctagctcctccttgtccgtggctcctccttgtccgcggcgaactggtgcacgccgagctggcttcatatagcgcggcaaacgacatatgagtttcataatgtcgtctctgcctggtcaaagtactactgctgctagcctgctagtagtacacaacaagaaggcaagaagccgccacccctgcagtgcagtgcagatgagcattttcctttctgcatcgttctactcgtccttctaaacaaactactgctatgttcgtcccataaaaaaccaacataatattaaatgtgatacatcctattctgatttattgtattagaatatatcacatccagtcctaaattaattttcttttggacggagggagtaagcaacaattatagtgtttggtgggaagtctgttcctcatttttacatgtcatataaaaatgcttttaagaaaataatagtataaattaatttaatatatattactccataaacatgtatgtttaaatgtaa

SEQ ID NO: 14302 - DNA, 1501 bp, Oryza sativa
tggacgtcaggtagcatgaatggagtgagctcatgagcagctgtggtcaaagctgttcgtggttgtcaaattcatgacatcaaaatctctgtaaatacttgtgggggcagtagttacacatgttaggtcaggcgtgtgtctgcttgaattaaagggtgcaagcaaggcaaggtgaaaggagataattgcccagtggaaaattgttggaggctttattttatctgaaattcttaaatccatgtgagttgaataattttacctttcgtggtcaaaactacttgtcaacatgaatttttttcctcaacattttttttctttctggaagtaaatttgaaaattgaagtatatgtgcatgtaattttttgaatggcattggttctaaactcaaaatatttgtactactatgaattgctattaaggtactcgtgaactccacctagccaagacaccttcttgtgttaattccctccagcaaaaacaattaagggactcgtgatctcgtgtgtgaatggtaggtcagtggcgtggagaacattatgagttatgatttggtccctatgtttggtagagcacgcacacaagtacacacttgtactagttagtgatgcgcctacaaattggtctttcttgctgaaagagaaaaaaaaaaactatatgcatatacaatgcaaaccaaccaactttgctaattaaaccgcacgagtcacttcagttacccctggattttcgctcggttttgatttgaaactgtcaagtgttcagttgaaaattgcctcaagttctatttgaaaccttgtattccccccaatttctaagtgacaaaaaattagatgaaaatggctttgattttgaactgatcgagagtgatgaatctaaaacgtttaaaggtagtaagagatcaatttggcaagaaagatgctgcaatttgtggttaaaaccttggtgaggtactgaggtatctgcaggagagctaattacagcatgttatctagtgcttttatataggtgaaactgctccatatgcatgtaacgagtgaattaaattccgaaatgcaaatcatgaacgtctggttcaagctttgaaattaattcaacattgttacatgcatggggctaacagctactccgtcccatgcttctaaagaaagaagcccaggccagctagaactgacacgccaatcagtgcatgcacctaaaaatcatacggatttgccttttaggttcgatccaacacaaccgtagactgtttcggttttgaaagatggtgacactgacatcatatgcatggcacaccaaagggagggaaaaaaaagaaaaaatgcaagttaaaatatattcagtgcattgcatgcatgcatactacacatgtattactgcctctgacaggtcggtcactagcgtcatcagcaggccagaaatttgtaccgtttctaaacgacgcatgcatgtgcatacaaaataatttgcaaatgcaatgcagcggtggtacgcctcaatatac

SEQ ID NO: 14303 - DNA, 1116 bp, Oryza sativa
agcacagcatgcatgcgagccaacatggatacactatcgccgacggatgaatctttattgtacctgctctaagccaccaatggcactagtgggcaacactcggttggcctcctcctccctaagctaaggggcagctccattccattgtatcatcatcttctttgactcctcgtttgtcgaaaacttcactgacaccttccgcctcctgattgcacggcctccctcgtcgtcgatttgggccacttggcctactgttggcctccatcttgatgtatcttgacgttgcttaggaaggttctcaatcggaggcgatggctagtggtgacggatgcacaagatgaaagagagaatagatgagagggagaagtggggaggaggattaaatgggagatgcatttaggtcttttcatctagtccttaatgtcagatgggggaataagtaaaaatagcaccagtgaataataagggtgtgaccagtgatagccatacgaaccgaatggtctcatgaaaaagatgcactgctatagaaatccataatggtctcggtttgcaaccctctttaatccctggttgcaaaccgggatcacgagtccgggactaaagatcgccatctttagctggccgccgcccgctacgccggagagagagaggataaagagaagaggggagtagtgaggatgccattttttattatttgtgtgtaacttacatatgggtcccacgggttttattattttttcaatcgaattatcatgtaatcatcacatcaatgtcacgttgggacgaagacttagtcaaaggagcaccatgtaggcgccacatcagccaaaaccggggacaatactaccaaggtacctcgtttgcacgattttgtaagttgggggtgcgttatatccggttttgtggtacagggacatatttcgaactcggagacaaattgaggaacctaaagtgaacttatacctttgctattgagtaaagtccatcaccggtccctgaactagtaccgttgtgtcattccgatccctaaactcgtaaatcgatcgttcaggtcatcaaacttgttcgactgtgtcatcctagtccctaaacttgcagatcactcgtttaggtcct

SEQ ID NO: 14304 - DNA, 1501 bp, Oryza sativa
cagaaaaatgcacctgcttaatttatccaaaaatagagaatatagtcatctcaccaaaatcatgcatgggatgatatctgaagattgatctacccgtcctagatagtttgattcctcgatctaaacaacccataaagttacaaatcgtccatcttcagttactgaatatttttgttgctgtaagtgttgtaccatttattgtgttgctacaatgaaccacagcaggtagcatatcgcttaacttaaacaggaagagttgtccatgcatagagagatttggtgagaccactcatggtcatggataatatctaacagtgtgcatatcaatgtgatgagtgttacttgtggttcaagacatgttttgcccaatttaccaagaaaaatgaacacgtatatctaacaagcagacaggcaccaaccaaccagtgaccaaacatgaacaggaagctcatggtgtgatcatttcatgccatgatatgatcaatataatcaagttcggttctatatagatcaatcagatatgcatcatatccaagagtcccagaagcaaacatcaattgctaccggtttgcccatggcgcaatcgatggcaaaacagctaagaaaccatgagaccacaccaccggctggtgcccacaaggctgtaatggtctgaaactctgaatttcttataacaattgcagtcagatgggtctcagcaataagaatttcttgcaatcatgtccgtccatttttatatccaaccgtgtacaaaccctttcgcatctttgcgtacatcagatcaaaaatagacggctcggattgaaatccaccggatagatttgaggaaagagggtgcaccacatgccatttttcaggccatgccatgttgccatgcacatgcgccccacagtgccacacaaaacaccccaaggaaatgtgctgatgccaccaccctcaaggatcatcaaagagcatccccattggcaaatgcatgattgcagcggattgttcacaagggccccactcgggagagggaaacgtcagaggggaagtgtaggaaaccgggaaagaaattgaaggcattaatcgaacaaccaccaactatttcaggcttgccaatgagcgagcagtggacgtgccctacaccatgtttgcctctgaattttgcgtgtgaaggaactccagctccataacagcaacttcattcagtgtctgagcttgtgtacgtgctctttcagaaagagaaagaagatgggttacttgacgttttgtagctagcgacagggcgtcaatcagctcagctaccctgttgctgcacctgatccatcctgaagctcacccatttctagtactccatgagttagcacagtgtctacatggctcaggattagcaaaaaagtactccagaaaccattgaaacctacaatcacggaattgggtcacggctaagtgtaaaggaaaacacatgcttcacttcatgtttattactcaaatggaatggtgtacaccagtgtgaaag

SEQ ID NO: 14305 - DNA, 1482 bp, Oryza sativa
atgtgtattactcttgtttgagacatgttgtacctctctatggtttaggcttccttgtgatttaatttacttgttgtgaggtgcttgaaatagcaattcacaactgctaggaagttcctaggaagaacctcggaagttccgggtagctttctctgcttgtgagaaaaagctgccaggaagttccggaccttttgccatgaagttctgggccctgattttaaccgctgtgatttgaattaaattttaggagcgcctattcacccccctctaggcgacatcaaggccgtttcaattggtatcagagcctaatctccggattggcttaaccgcttggagagaagatgttgggggatggcgagaaaagtgtgaagggtaacatggttgatagtcaagatgctacaatgtcaacacgaggtgaaactttccttgaacttctcatgctagatggttcaaattacatgtcttggagtactcgcatgctttatgtgtttagggtcatgggacctcaaatatagcgagttgtagatgtgagcatttctcctcctagtgatcaaatgatatcatttgaagcataatagaaatgcatacatctcaatgctcaagctactaatattttgtttagtgctttgagtgaagatgtgttctaatccatcatgccacttgaggatgctcatctcatttggaacacactcgaggagagatatgacaagtccgagtgtgatgaggcaaagctcgctatagaagaaccacttgtggagtgctcaaattcatcgacaatttgtaaagagcctcaagtgattctatccaatgagcaagatagtcttgccacattcacctcctcaccaacacatgtctccattaaaggtaatgaaatggtgagtagcgtcaatgtggatacttctacttcctatagtgcttgtcgaactaatcttttgaaggtagaagtatgtgggaaaaaatggccaagtgaagaatttacatctccaagatgctcatcttcacacttggatgaatattcttgcatcatggagaaatcatatttggagaaagaaaatctagagcttaaagctcaacttgtggagctcactagcaagcatgtggacctacaagaaaaatatgatgagcttttgtgctctcatggaaatcttgtggattcacatgccatgctagaagtaactcatgaggtgatcataataacggtaaaatcctatgtgcctcatgttcaagttgactttacatgtgctaactcttgttgctctcaagcaaatatttttctgcgcactacatgtgacttggattatgtagggaaaaaggataaatacatcgatcatggatttgtttgcaatgctcaaccttctcaagataaccgtgaaagcatgctgaagaagcttgagaagggatcaaccgtagcttgcaccaagttctatcaagaagataacaagtccaacaacaagagcaaggggcaagatcaaagcaagaaca

SEQ ID NO: 14306 - DNA, 1501 bp, Oryza sativa
ccgccgccgtcgccacgccaccgtcgccacgccgtcaccacgccgccgccgtcgccacgccgccgtcgccacgccgtcgccacgccgccgccgtcgccacgccgtcgccacgccgccgccgtcgccacggcgccaaccgccgccccgatgccgccacaccgccattaacgaacgagaacgagaacgatcgaacgaacgagaagcgagaacgaacacgtcaacgtacgttgccgtgagaacgtgaacgagaacgagaacgatcgaacgaacgagagcgagaacgaacacgtcaatgtatgttgccgcgagaacgtgaacgagaacgagaacgatcgaacgaacgagagcgataacgagaacgatcgaacgaagacaagtgagaacgagggaacgaacgtgaacgagctagggaacgtgaacgagcgaacgaacgaggacgaacgttaacgtgaaatgcaatatatatatatatgtatatatatatatgtatatatatatatatgtatatatatatatatgtatatgttacttcgcatttgactatatgcatctttttgtatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattactttatttgtaattagacttagtatgtaattattgactacggaagtggtgcgacaagtagcaattgactattgtagtcttaattagacttagcatatacgcacgaaacacttagcatacatgactattttagtcttagcatgtaatattatttgagttttaatataagattactttatttgtaattagacttagtatgtaattattgactacggaagtggtgcgacaagtagcaattgactattgtagtcttaattagacttagcatatacgcacgaaacacttagcatacatgactattttagtcttagcatgtaatattatttgagttttaatataagattactttatttgtaattagacttagtatgtaattattgactacggaagtggtgcgacaagtagcaattgactattgtagtcttaattagacttagcatatacgcacgaaacacttagcatacatgactattttagtcttagcatgtaatattatttgagttttaatataagattactttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacaga

SEQ ID NO: 14307 - DNA, 1501 bp, Oryza sativa
tatacttatggaaactcttttttcttcaaaggagatcgctaccggaaacttgattagatcccattggcgaaaagtttctgaacatttactcccatttattacgtatcatttaaatagttataaaaaacttttagaagacttacatggtagatcaatttgttatatatcatttcaaaaacatgcaagttcaaatttaacatacatttattaaaaactaataaatatgaatgtgaataatacaagtactagttactccctccgcccccaaaatataagaacctaggatcggatgggacatttcctagcactacgaatctggacaagctgcatgctgcctgtagcggtggtgacttgatcttcattccaagtgacattgacgtggcgtttatatggtattagaattaaaaaatattgtgacccatttgtagttcacacaatttttgtgagcccacatgtgaccctctttcttctccttcttcctcatccctccctctctcttatctcttgctttctctccccctttgtaaggatgtcgccatgtgtaaggacgtcgccttttcaagcagtcggatgtatcggcggtgtccacgctctaggtgaagatagcgcgccctcgactcgcgtggggtggaagcggggtgggttggcaccgacgatggcactggaggccacagagggaggtgggccattgagctggggtggatcgattgccgccgccggccacaggaaggaaaggaaagtagagctacaacatcaggggagagtggcgccgacttctgcctcacggctgcctccgacgacgccattgccccgtgccgcaggagctccatcccggacgatgacgacattgagctcatcggcgctcctcctcacatcctcctcggtgcagctgcggagctcaccagtgctcctcctccagccaccgtccatgggtccgctcatcctccggcctcgtcggtgccgacgatgacaatggaggaggcgcaagctcgaaggggagagaaagagagagatatgggagagggaaggaggaaggaaaggaaagacgatgacatatgggcctcacatttttttgtatgaactacaaatgggttccacatatttttttaattataataccacataaactaacaagatcaggtcaacaccgccacgtagatgccacgtcagcgaaaccgccctccaaaactaacaaggaagtgaaattgcaccggctttagtagtcagggggtcgagacatcaggtattatggtttagtgatacgaatcagattcagttactagtcgagggagtcaaagtgaacttattccaccttagtatccctctagaaagcggatacgtgggcctcttagcttatgggcccacatgtaaggctgtaaatagcccgatcaatcggccacgtccgcttcttctctctccctagcacgcaaccgagtcgagactagacaaggggagcagccgccgcgatccaagtcctcctccgccgccgccgacgccgcca

SEQ ID NO: 14308 - DNA, 1501 bp, Oryza sativa
gcagcggcaaggtcgccctcgccctcgccctcgcccccccttcacccgaacgccgccggtgtccgtcgtcgtcttcaccgttcattctcgccggctcgtcgtctcgcggtgccgcctccgtcgtcggcatcgcagcggcgaggtccgcgccgtcctcgtctccgtgcagccgctgccggctgccctcgtcacctcctcgccggtcccggtcgtcgtcgtcgtcgtcgtcctctcgtcgttcccggtcgttgtggcgttcgtccctccgtcaagccgttcttgtccgtcgtccgcgtccatcaagtgtgccgctgcagccccgtcgtcgtcttcgtcctcgcctccgcgtcgccaagcgttgcgccggccacgtctcgccttcgtccaaggatcgccgccgaagtcgtcccctcgccgttcgtctccgtagttcccggccgcctccgccgtgctcgttgtgcggttgtcggccccggtacccgtgtaccggtgtcggtagtcgttcgcttgtgcgtgtggtgaccgtgttaatgtgcccgctcggtagcagcgtggtttctacgggtgcagcccgtgtggtgtctagtggagtccgtttgttggccactcgcctcggttgacacacgggatctgcttccgtcgacccgtggaccgtctctgtgtactcggtctaccgcggtcctttaggttgacatgtggggtccgcatgtcaacggcgcagccctcctgtcttttccaggctagcgcttacacatgttttataattacaaagcttaattataataatccgcaaatctccatataacagcattaaacttcagatgatcatatcttggtcatacgagctccgaatcgacccgttcaagtctcttaatgtttgttataacctaaagaactgtgtgctttctttttatgtgttgttattacttctttataggcttgtagctttgcttgtgtgcttcgcgtagctttcatcgttccggaggttcccgaagcgtggttcgtggtcgtcgccgaaggttcggaaggccgttctctctgagcaaggcaagtcacatcatccttgagcatattgaatcccagtttataaaattattttaatttaaattaatgcattaccgctttatttaaattcccgcgttatcactgttttatttagccatgcctatttacctttgttaagacattattattgctattgttattattaccttgttcaccctaggataaacaaaaccccaactagtgggtactctattcatggttccactagtatgaatttaggtagatgcttcgctgattaattaggcaacattaggtggttttataactttagactttgggaattctcatatcatttggacactatggaatggttggcttatgttggaattgggcacaaacctccccctctattcaaaacccccaaaatggttttaggctgggctcgaggtgcgtggttgggttttgttagtcgtacctcgggtactataaggattaa

SEQ ID NO: 14309 - DNA, 1501 bp, Oryza sativa
aggcgtggctggctggcggcggcgtgcgtgcgtcacgtcgctattcttttgcagccactaacccacgttcccacgactctcttcacaacagcgcgtccacgttcccacgactgcctctctctcctgatagataaggaggccgcgagtccgatctattctgatcgcttgcttctttcccggtgttagttcctcctcctccgcgcctgtactgttctcgcttcctcgcttctgatctcttgcacgcacgagagattggaagtagcagtgcctccgaaaccacaccttcgcctgagatctacaccgggtaagcgggtgatcaggtttttggggagtacctcccgcacgactgctcgccatgtctggagttgccgccaccgctgctggaggagatggcggaggtggtgcgccgccgggagctggagccggaggtggtgcgctaggagctggagccgatggcgcgaacaacaacatcaatggaggcaattctgcctcacagtctagcggaggtccattctcggggtatatccttctcctgttcctgtttccactgttagcgctttactgctatgtgcgctatgttcctgttcctgatattcatgatgcctctagcatgttattgcgttattgtaatgttcctgttcttgacattcatgatgcgtatagtatgctactggttatattaagatcaccatacactgcttatgtcatgattattgctttaaagttttggattaaaatatgccgattcatgaccatatttccaacaattacaaccaccttccagccagaattcatttagaacctcagaccaggctttattggctaagctatgactaacctggttctgagcgtgatggatcttcctgacagagatttccctgtccccgtcaatgagcctccttatctccctgactaggtgcgcagaggccgacaggtctttttctcttgattgcagcatctgtgtcagcgttaaccaatctgtttccacttcaaaagggagcatagtccagtgaagcgctaatgcaattccttccacgcaggcaaggatctctgcctcaagcgccccattacagcgctccataaatctgcaggcagaaaagaccatggccccattgtcatctctcaggatcataccgattccccccgctcttccactggatcaaaagagccatcgatatttagcttcatctcgatctcctttttggtttctcccagtgtggtgcaggggccttcggagcttggtgacaaaccgaattactctctccgtcccaaaatatatatagcaaactttgtagtggatgggacacatcctagtacaacgaatctgaacaggggtacgtaatctctatgtaatccatccttagcttgatcgtcaagttctccattaattaacatctaagatgtccactttaaatgtgaacacaaatacgatcaaattcccagatttaagtaattatatatatatatatatataattctcaccgatatcaaaatatgtttt

SEQ ID NO: 14310 - DNA, 489 bp, Oryza sativa
ctcaacaaccaggagtaaagatatccttactctcggttgttctcatcaaccgggactaaagatattttcccgttatttccaaattctttttaaacccggttagggttaagaaccgggactactgataagcgcactgaatattaatttccattacatatgtgtttctaaaatagaaaataatgcattaaaattatttaaagtacaaaaattaatgacaattacttcgaaaatttattgttgtctgtaataaattaagtggatgaaacgtaataagcaaacatatgatttaaaattaataaaaattctaataatcatatatacttagcatatgaatgatattaaattgttaaaaactctaattaacatatgtatatacatacggcatgatttaaaattaataaaaattgtaataatcatatataattagcatatacatgatttaaaattgtaaaaacctctaataatcgtgcgtaattaacatatgccata

SEQ ID NO: 14311 - DNA, 1501 bp, Oryza sativa
gttttacggttgggggacgattttgtaactcgatgtcaagttgagggaacttcggtgtactttttcctttgcatatatgtgtttcgggctcttgttaatattttgggcttatttatatggaccttgtgcaataaaatgggccactgtgtggatcttttgactgtgaaaaaaaaaaaagcccccgtgtgatccttttgactggtttgcttatgctttatcctatcttactataaaattatcccccactaactctttaagcttaacatgtaaatattccatatcattatccactaacaagatgccacatcatcatccactaattaacaagatgccacatcatcatccactaacaatcatcacatttaaacatcatgcaaatatgctatatctttatagtttttataatttaagcgcttttcaaatacaaacatgttaaattatcatccaacataattcacataatgtttcaatgtatatctttataatgttttatgatatcctacatacttatatagttcatcctcacttagttagtgcttaaatgattaatctatggtccaaattatctttcttcttttttcctctaattaagtcatatcacatcaattgtttttagcctttagatgattaatctatggtccaaactatctccctacttttcttcttccataaagacataccaccttactttttacatttgaatcaccattctacatactatttaaatttaaattatcataaaccacattaatttacttaatctgatattatctagctatcttacacgttattttttttattgttatcatactaaagtcccgcagcaatgcacggggtttcacctagttttaagaaaaagtatacccaagattccttatcttgtcaccgagttacaaaatcgtccctgaaaaaaaaacaggtataacgcatccttcaatttttaaaaccggtacaaatgaggtccctgtgtggttttgttcctggttttggctggcgtggcgtctacgtggctcctttgactaggtctttgtcctatgtgtcattgatgtggcacgtacgtggcatttgctaaaaaaaaaacatgaggcccacttgtcagtcacactagaaaataattaaaaaaattgatggcccatgtgggcccacatgccatcctcgtctacttcctcctttctccttctcctttttcctccccacactgcgtcaggcagagtgggcgagctcgctggccctgcctcctccctctccgtcttcattccccctctcttatcttcccgccgatgaactccgacgagctgcaccaagatgccgtcgtcaggggagctggaggggagcagcggttgcggactccaccacgagcagcagccgcgcggcattggagccgagcgccgatgatgaacgccatgccgtggttgctcatttcctcgaacatgatgacgaaggccttggagaaggactgcattccccgtgctattgggcatcttgtggaactgaagtggca

SEQ ID NO: 14312 - DNA, 1501 bp, Oryza sativa
cgagttacaaaatcgtctcccaaccataaaaccagatataaaacatccctcaacttacaaaaccgttcactttagatccttcggtagttttgaccccggttttacctgacgtggttagcgtgggacccacatgtcatgatgccacgtcatcaccctcatccttcctcctttctctctctctctcacatttctcctctgggcaagccgaccggcggatgggaggagatcgccggaggtgagtcaggagaggaggaggttcggcggccagcgacgaggtggaggtagcggcggtggctgcgacgcagaagctggccaccgcgcccgtgtcggacgtccggggtgaagacggcggcggaggcggccggaggagagccctctcctctagtcctcttgaggagcacagccggcaggggaggagtgttgacgcggtgggtgcaccggtggctagtgggggaggagggttgacaaaccaagccatggcgatttgacggtgaggtgccggatagcttaagttgtttgttcagacttcagagcgccttgagcatctcctcgatgctgctggtggtgaaggcgacgccttccttgaggttgagcaccttgaccacgccgtcctctaccaggaacgcgtagcagcgagaccggacgtcgtgcccagcaggcttgtcggggaggtcgagctcgacgcccaaggcgtgggcgagctccccgttgctgtgagagaggaggagcaccctcatcacggcggcgaagaaggcgagccacttgaggaaggtggtgccgaatccgacttggggcggtgaggtcggaggcaagagacgaagaggcgttgagttgcgatccaagttcatttgcacttaataaagtccagcttctgccggagcgaagtggagaccctgccggacatatatatatctcttataagccgccgtgcggcgttgtaacctcaactcaatatagtgaagatattttgctggctggcacccgtggttttttctttcttactttgaaagggttttccacattaaatctcgtgtcttatgtgattgatctattgttatttatcatttgtttgcctatcgtttgctaacaagagggaggactttgttggcaactttttgtgacaagtcgacaagcacgatcgcaacacctaaacgccttgcggtgatatggagtcgccaaccaccttgatctagccaaagggccaaatcaagatgggttttgtgaaaacagctaaaccggctagcgaagccgatttagagatcaaaatcagcctctaggccgatttagatcgatatgaggataactacccgtctcgtgggcaaaacggaaggttttcaggacaaacctacaaagaggtgtcgcactctcgcagcggcggtggacggtttacggtgcaaaccgacaaagatggactaaactagggtaaaatagaaaaacatggtaaaagaacgattcaagtagattgtatgcagggggtttacaatataatgaaccggccttg

SEQ ID NO: 14313 - DNA, 818 bp, Oryza sativa
acctatgtgaaaacgacaagagagcccaaatcaaacctgaatcgagtacagcatgctaccaattatgtttgtgcagaccgtgctgacctgatagcaccatatatgaatgcctataactatggcaacattgaatacagtggaccttggttgatcagggggagcattcgttaagtaggcccaaacacgtcttgtcttcgtcttcgtctccggggaaggaggctcgccagtcaccactaacaacagccgggatgatcgagtcaaacgatagaaaatttattaggcaatggatataatttctgttttgtttgtgcccatttgtttgcatcttgtccaaaccatacgacgatcatcgatccctgtgggccttacaacatacagaatgtagatcgatggtcactaatcactcgacatgctaaaagcaaggaaaagctacatcacaactaaccgaaaataactcctcgtgctactgggagccctcatgcttgaaaatgtagttgcgtttcttttcagccacagtgaatatcagttcactgaaaagtttttgtaactaatcctagaaactactgtttgaccaggtttaattctgacaaagaattcgagaacacaaaaccatatgcttcgcatttggtttactgttgttaaaaaaacatgttgtattcgaaagaaactcctctgatgtaatgccctctgacatgtgggtccacgagttatgggctccatatgtcagtcccttaaagtcggaggacagtaagttagaaggtttttttccgttgtattcttgtttctgatggaggattttttttttctgaaatttcagg

SEQ ID NO: 14314 - DNA, 1501 bp, Oryza sativa
gtcgcttcgaatgatcttgatcttgaggtcgaactcgttttgtactattcttgcaaacttcttgaagatggcttgtgtctcactcttgtcatgcaaaaagaacacccatgtgaagcgtgaaaagtcatcaacaataacaagaccatatttgttacctccaatgcttagataagcaattggcctgaagaggtccatgtggagaagctccaatggtcttgtagtggtcatcacattcttgacggggtgatgtgctccaatttgtttgccggcttgacacgcgctacacaccctatctttctcgaattaaacatttgttagtccaaggatgtgatcgtactttagaatcttgtgaagattcctcataccaacatgggctagcctccgatgcgaaagccaccccgtgttggacttagccactaagcatgtctcatgtttggctttacttgaggaaaaatccacaaggtaaagctttcccttgagaacacccttaaagactaccgatgaatcattccttctatagacggtcacatcaacatcggtaaaaggacaattgtaacccatagaacataattcagaaatagacaagagattgtagtttagagatttaacaagagaacgttggcaatggaaagatcattagagattgcaatcttacccaatcccataacctttccctttccatcgtccccgaagaccatgttatcttgtgaagtgccatttggatcatgtcatgcccggaatttctatccaaaattccaaacgcttacatgtgtgttaaaccctcgtccaggaatcaaccgaggcacacaataacaaattgataatagagtacaaataaatatctatttgatattcgcaaataaataattactacagaggtagatagttcctctcaaagaaaaaccttctacgcagcggaaaaaaaaactataacaaactacggaacagctatggcgactccactccacaggcatcttaaccaggaacaagcctaatcctccagatcatcaccttcactgagatactcctcttctgatgaatgattattgcaaaaatgagcatatgacatactcaacaagtcacacagcaaatatgcaagtgcacaggataacaaaggatggcataatatagctcatttgcagaaacaacatttaataaatatttaagggaatggtaaaaacagttgaataattaatcaatattaaataacaccatacaacacacccatgttgcataggcccaacctcatatgaacaaccaaccccggttgtacaaatctaacctccataccaggaacgtaccattccaaaccaggagtcaaattaattatcacaattaccattaatgaataatatgggactaatcacgaaaaacattgctcaactcacccataaccgcgggtacggctattcgaatagattaaactctgatcagaggtgtaccactgtacccacaagtcacaatcccacaacatgttaccatgcgccttagtaccaccacg

SEQ ID NO: 14315 - DNA, 1501 bp, Oryza sativa
gtttaattgctttagtttccgacgttccggaggagagcgtttccgttgaggaagattccgaagcgtttgcggaagcccaaggcaagtcacacagatcccaaacaaacctttgagtatgttgaacccatttaaagctattattttatttcaactatgcattgttttcgaatgtcatcgggtggtgaacctttcccaattaattaatggccgaagatgatcttattttcctatgggttataaatttgattagcatgaaccttatatgttggattggttcagctaaatgctatatgtaagtctgcttagccatgcttagaaacattagctaactaaagggattaattataaactatgttacattattattttatttatggttacattaaatggtagctcacgatggttaatcgtgtgatgttaattaattgataattaaaacctggttaaggtgggttgtgagcatatggttttgatggttgtgctcatgacaattaaggaccgttcgcgagctactgtgtgaaacatttatcgtgccaaccacaagccagcgtgggcaacggctttatcttttgacagcatgattcattatagtgcgccagactgtgaagtggcgagaagtccacgggggtcgctggggagtccatgccttgttataagggggtgattatgatccaggaaaggtgcgctgtaaaggattatgttgtgcaaggggtattgtcacaactcctttccgaggtatcgtggtggtactaaggcgcatggtaacatgttgtgggattgtgacttgtgggtacagtggtacacctctgatcagagtttaatctattcgaatagccgtacccgcggttatgggtgagttgagcaatgtttttcgtgattagtcccatattattcattaatggtaattgtgataattaatttgactcctggtttggaatggtacgttcctggtatggaggttagatttgtacaaccggggttggttgttcatatgaggttgggcctatgcaacatgggtgtgttgtatggtgttatttaatattgattaattattcaactgtttttaccattcccttaaatatttattaaatgttgtttctgcaaatgagctatattatgccatcctttgttatcctgtgcacttgcatatttgctgtgtgacttgttgagtatgtcatatgctcatttttgcaataatcattcatcagaagaggagtatctcagtgaaggtgatgatctggaggattaggcttgttcctggttaagatgcctgtggagtggagtcgccatagctgttccgtagtttgttatagtttttttttccgctgcgtagaaggtttttctttgagaggaactatctacctctgtagtaattatttatttgcgaatatcaaatagatatttatttgtactctattatcaatttgttattgtgtgcctcggttgattcctggacgagggtttaacacacatgtaagcgtttggaattttggatagaaat

SEQ ID NO: 14316 - DNA, 1408 bp, Oryza sativa
cctagaagtgtttgtaggatgttcaatggacttttatcatgtgattacatattacagtcagtttgaagctttgctactgctgtgctgtgcatgagtgcacagattgatctagctttcttttgttgtttgacttgaacatatatactgtagtttgattgacttgtaagcatgaaataaattaaaatgacagcggaaacattaggatcatattagcacaacttaatttaaatgacagtcatatcccataatagatttatttttatatcggtttatttttatggaacggaattagttgctcgcaagtgcattaaattggaccaccgaatcaacgtggccattttcggaaaaaaaaaatcaacgtggcccagatatgcgtagtccactgttgggagaataaaaaaaaagaagtggaataaaggaacaatttagctgcaagttcaagctatctttttatgcattgtttggataaggtgcccactacactagccatgatatttattcgccactttccatatataaaccatatagcaaaatcattcatgaggtctatccactgggcattttaatttttgtttttcatatttgtatcaatgaactgcacaaacaaatttatattccctccaatataacgataattgtcctttttaatcattttccatggtattaatggtcatactttgacaataactttataacaaataagtttgagacgattgtaacaaacttcatacttgttaattatcattccagggtggttgtttggcaaaatttggtaccgcacattgaaaatttgtggtttttgcatgtagacataacaaaaatatagaacggtctgagtacatcctaaaaaaaatatggtaatctgctgaaggatgctctgtcaattattttattatttttagcctatacaagaagagaaatgttttgaaaagacaagatttccctgccacccgtgaagaccacccggtctggtctgtttcaaccattcaaccgattcccatctcctaacctctctctgggcctcacaccccaagtccccaatcctaggcagtggtaagggcttcaacaatggcgagctgatggtatccaagagctaactcttcacacacattaaaataaatgcactaaatgtatatgcatgagaaagagagaggagaagaaaaataaatacaaagttagagcccatctactatacatactaactctaatatgatcttatagctaatatttggctctactgttaaacttgctctaattgcttgggagggcatgtcatcacctattgcacgcaatggcttgtcgagacccctcatctattaataatgtgtgcacaatgcatgactagcgacaacataatagtggcccgctgttggtatttgctacagtcataaataaatccgcaagaaca

SEQ ID NO: 14317 - DNA, 1501 bp, Oryza sativa
  unsure (1)..(1501): unsure at all n locations
tgtcatttcttgcctttgtataaaataagaatgaatttgctttttcttttttatcatgagaatgaaacacctttggttgagttgattcaacaggtcaggtcttctcactcttacaatatccgtcactaaccaatggcatcaaccatcgtgctccacctccacccactcaaaatccattgtcaccatcctcccggggaaacctagcttgatcctacatattctctagactacctccttgatattctttatttgtcgtctaacagctgtcaaatactataacttttgataaggggggtgtgtcgctgatgcttgcgctcggaactcacataacaatacatagtcttagccaaaacaaaacagccaaatacttgggtgctaattataccactcgagccattggtttcggcaacaattttcatttcccacttcctattcttagctatcacaataaacaaatagtgtatatatggcagccgtatagctagggatgtttctattgtaccttgatactcatactactttatattttcatagttgaaatcaattttgattattagctgagacttatttgacttgggctcaatccattgcaagaaattacagtgatctccactttccctttgccgttgtgacttgttagcatagagttggcctaaatatatatcgtattatcatgacaccaaatcatcatccatccaacttatgagaggaaagagtatagggcctattcggctgccagcgcttgtgttgtgcggctgcaactagctgccgtgtagctaaagaaaatacaagccgaatatattgatcatctttttggtgaagactggacttaaaaacttttgacttgtgattattatttattattgtatttaaaattacaaagctctagaacattgtagaactaatacgttctctaatgtaacctgaacggaatcattggcttaagaaaatgacgatgccagttgacgcttgagcccaaagtgagctctcttccacagcacaaaagtgcacacctcagacgagactggtggtggggtcaggtgggttactcgtcgccttcagcccctggcatgtggatccgtacgtgagggtgggccccacacgtcagcgaggcagacaaaagacaagggacgaagtcaacgaatcccatttctcgagtcgttggccggcttcttggcacgccgccctggcccgttcacaggcacagcccatacgatttcccttctgaatccgactgatcgcctcctcccgcaccgacgtgttcgattcgtcttcccgcggcggcggcggcggcggcggcggcgaggaagatgggggtggaggtgccnnncgangagtccaaccggtgcgtgcgcgggtgcttgccgaacgcccgcatcccgctccacctcccgccctcctccttctccctcctctcccccatcgccaaaggtaactaaatcctctctctctctctctacgctctactagttctgacgaggaaaatggaatgtgccgcgcg

SEQ ID NO: 14318 - DNA, 1501 bp, Oryza sativa
gccgacggcaatggcgacaaaacgacgcgcggtggcggtggcaaagcgaggcgacgacgacgcggcgcggtgatggcgacacgacagcgacggcgccgatgcagtcggggctcaaggccggctagggcggcgcagcagtggggagaaagagagctgggatggctaaaaaccaaatcgaacacctaggggctaatgaacagtgctagccaataatttttgattttagagggtactttacaattaggaaaaatatactgttgctactaattttgtcacaatgtaaaaatacaccacgtctaagttatttcatcgaaatttatattcaaattaatattgtccaaatttaagttttattaaagattctataatttcctaatgagaccgttattaacacattagcacattagctcaatttatttatatgttagtttattttatatggaggggtttaatatattaaatttcaatccctaaatgcaattaggaacttggtgcaatatcgatctacatatcgaattaaatactcccataattctattatatatacagagagctcagtttatttgaatgatcatcattccatgtgtactcatattatggcacccacctttattattcaaatattttaatatttgataaaataggttaataataacttttcttttatttgattttaatatcttgtgcataattatttgtaggattaaatatattctcgtaaattatatctattgcttaaatttagatcttttctttactttctttgtgatcttttacggtttggcaagcaatagcaatcataacaaccagcatgatgcaaaagttttaaaaagttcaaaattttagtgatttttattgtcaggaattttcaggatgttacactgtaggattcaaaaataaatccctaagatttgttaatgtcatcatgagtaaaatttttactcccactacaacttttacttatggttaaatctgggtaaaattagttcccatggtcatgcaaacaaatctcaaacgtccactgtagttttttgtttgcactatatatatttttttagtgtgcaaagctttggtaagaaccaactagaagtacaaactttctacgtgcaaagtttcgacaaaaatcacaagaatttgaatgacaactaaaaaaccaaaaccccatgtgtgtgcaaagttttgtcaatattcactaggaacttgaatgaaaacttaaggaataagatcactttgactccctcaattgaccaccgaatctaaatcgtatccctcaactgcaataccagaaatcttgaccccgaactgtcaaaacaggtacaatttgactcccttagtggttttagagggcggttttgctgacgtggtgcacatgtggcagtgttgacttggtcttcgttccacgtggcattgacgtggcgcttatgtggcattaaaataaaaaaatatatgcgggacccatttgtcattcacacaaaaaaaaattgtgggtcccactgacatg

SEQ ID NO: 14319 - DNA, 1501 bp, Oryza sativa
agaggagctccttgaagatgaaggctttggtgtctagctcgtgcctgccgtcaagcgcctgtggtcgtcgccctagtcttccgctgtttttcgtttgtctctgtgtgtgctgggccttcgctgcccatgtaataagttaactatttacgcttccgcttgttaaactctgatttgtatcaacttttggtgtaccttgcctcctgggacaaggattaatgcacgcacgtcaggaaagcccgttgggttatttccggtcatgacaagttggtatcagagcatcctttgaccctaggacgagccgtagatcccaagccttagcaatattttcaaaaataaaaatcctttgttatttgtgaaaactgtctagtctctctctgtcttgctgcttcatttatcgccaaaaatctgacctttgaaaatgttgcttttcttttctttgtttttagatggccggcagcgtcacccgtcgtggtttggacatgactggcttcgtcttggagctgcgcggcatgtgcgttgtcttagggtatccacatggagtgggctaccaggccaggccgctcccggagcaggagggtgaggacgcggagccccacgctggttgggaggtcactgcagtgatcctcgctggctcttctgagcggacttcgctgacagtcaccgcgggtggcgactccttccccgccgcttgccagaacgccgctctcctcgccatcggcactcttcaccagcgctacccggacgagttgcagcactcgccctaccgctaccaccctcgtcgcggaggagcccgcgactacgccaccttccgggatgctagctcggaggatgacgctaccgtcgtgcatctggcacgcatggtggaggcatacgacgcggctcgtatcgacttccatcagatggtgcgtcgtgggatggtcgagaacaacctgaagatcctggagctgcgtcaagagaacctgcagctcaggaaggacctcgacgcagtggaggcgcaactgcatcagctcaagatcgcccagggagagatctgccgccccaagcgtcgccgcgtctgccgcagccagaagatcaccgcccgcaagagcacctccaggcctgagctagtccgtcagtccctggcgtggacctgcttcgtcgagacccctcgtgccgagcctgcgcccgtggttccctaggagggggaagcctccggcgttggtagcacggaggatgcgctgttgctcaccttccgtcctggcccgtcgcagcagtagacgagcagttagtaggcttgcgcgtgtgttctttctcgtttgtctttttggagtcgtgtggggcatggttatgccggtgtgtggcataactatgtcggagcctgtctttatttgtttgcctaagcaacttgaactttaatgaaccaatttaatagcagtgataaatttaagaataatggtagtcgtgggtggttagttttaattgttagctctttccctgtttgctggttctgtgtggggtttcc

SEQ ID NO: 14320 - DNA, 1501 bp, Oryza sativa
agtcgcagactcgcagtctcactctcatatataatatactacacaaaacacatggctcaaagcctcaaactatagtattggtacaacatttttgatttatttgcctcattctttctgtaattgaatcattgacagtttgacactgacacacacacacacacgctactccactgaccacaacaatctacagctacatgcctacatgtacatgcatcacaaaaatgagaaaatacatcacgaacctcttcatcctaggctcgtcgttgcggtgtgatgcatgaactgtcgtcgatcggttggcgacatggcgtctcggcgaggtcatgatggacggcgtcgagtcagggacgccggcgatgcagggggcgtcgagctcggctcgagcggcactggggacggtggacggaggccggaggtggtgcagggaactagggaagggaggcggcgccgcggtgggccgacggcacagggggcgtcgccggggagggaggacggagccgacgcagccacagtaggggaggtaggcggcgcaaggagcgaggcggcacgcccgcggcgcagccgcgcagggaagggaggtggcgggccggcggcggcggcacagagggggcttcgaagttcgaacggcgctgccggcctgccgctggcggtctggcgctggggaggggatggatgcggcggccggcaactcctcttgccagtcaccgccagcgccactgcgctagtggctgaggaacggaggaaggggattaggggagggatcggatctggggcgtcaggtgctcacggctcgcgctcggctcagctcaggacttagggtttctctctttcatgggccagacaattgttaatgggcttgggctcgcttagggaactcagttttccataggcttgacaagcctaccgagcagcttgcgagctagctcgggctcggctcggtttggaaacgagctgtggagggagctcgggcttggctcgtttagtcttcgagccgagccgagcttcgcgagctcaagccaagcccgagccgagctcgcgagcccgagctttttgtccacccctacgcttgagtcactagaaagaaaaacaaaaagacgacagctgtttcaaactacagtagaaaacacatagtctttcgatcacgctacatgtgctccacgacgagaaaaacaaaaccaaaaaaaaaaaacgaaatgatccttgcccgccacggtacacgagtcctactatccatacacacccgtcctatgccggttcattttttttttattttctccttttttttttcccttgatacgctaatgtcggttcatttcatccatgccaacttgccgagcactaccgacctagaccgccttggctgccacgaaacccctccctatataagccacgcgtcctcctccaccaacacatccacatcaacccagcgggctcaactccaaagcccatccactacccagcccaaacccagccctctctctctctctctctccatggccgc

SEQ ID NO: 14321 - DNA, 1501 bp, Oryza sativa
catgttagcatgtatcaccaaacatcatatctatcccagttcacaattgtatcaaacactttaagccaaacaaacccctcttcaacatcaatttgatttaaccaatctacgccctgtttttgttttctctaacaaaaattggataagcttttagatactcgtgacacgtttttcaaactgttaaacggtgtgtttcatacgaaaactttctatataaaagttgttttaaaatataagattaatccatttttaagtctgtaacgattaaaactcaattaatcacacgttattatcacctcgttttacgtgaaacacttaatttttatcttcatctttatcatcaggagattcaaacatcttagtacgtatcagcgctctttccaagtattgccattccacacaggaaaatataggttgtgtttagatccaaagtttggatccaaactttggtcattttccatcacatcaacctgtcatacacataactttttagtcacatcatctccaatttcaaccaaaatccaaactttgcgctgaactaaacacagccataagctcaaaagcacaaagcaccgctcacaaagaaaaaaaaaatatcgtaacgattatcctagaccatctgatccacaatccgacggctgagctgtcaggtgcttctccgcaagaagaaaatagaaagagaacatttaagaaatgtcattgataaaaacccaaatccgagaaatactattgacgagtacaggtttcataaaaataccatcgtacaagtgatttttgtcccagaaatacaatcgccgttatgattttatccattccgtgtcattaaatgcaccgttcattctaacggaaccctaacggagatagcatttttaagaacaaaaacacttgtataatgcaatttcatagaactctacttacgccgtgtttagttccaaaataattcttcaaacttctaacttctctatcacatcaaaacttttctacacacacaaaattttaacttttccatcatatcgtttcaattttaatcaaacttctaattttggtgtgaactaaacacagccttatcgataatatttcttgtaattggatcgattacatttgttgaattttctcagataaaaaataggctgtgcaagtgcaacggaacaggtgaagagttgcccacccatcccatccctcccatgtgccctgccgcccgctcgtgttcgtccgcgtcctcgtcctcgcctcgtcgcccgtgtcgcccgcgcgcccgccgcgcgcgcgctccccgccaagatttcgccacgccacgccaccacctccggcttcggctataacctcgccgcacgcgtgacgggagcgcatcgcccccttcccttcccttccctccccatccaggcacgcaggcgcgcgcgagagagagcgatgggagcggtggtggccgcggcagcggcggagatgaggcgcactggccgctgcggcggcggcggaggcgggggcggggagaagaaggggg

SEQ ID NO: 14322 - DNA, 1501 bp, Oryza sativa
tgtatggatagtaggactcgtgtaccgtggcgggcaaggatcatttcgttttttttttttggttttgtttttctcgtcgtggagcacatgtagcgtgatcgaaagactatgtgttttctactgtagtttgaaacagctgtcgtctttttgtttttctttctagtgactcaagcgtaggggtggacaaaaagctcgggctcgcgagctcggctcgggcttggcttgagctcgcgaagctcggctcggctcgaagactaaacgagccaagcccgagctccctccacagctcgtttccaaaccgagccgagcccgagctagctcgcaagctgctcggtaggcttgtcaagcctatggaaaactgagttccctaagcgagcccaagcccattaacaattgtctggcccatgaaagagagaaaccctaagtcctgagctgagccgagcgcgagccgtgagcacctgacgccccagatccgatccctcccctaatccccttcctccgttcctcagccactagcgcagtggcgctggcggtgactggcaagaggagttgccggccgccgcatccatcccctccccagcgccagaccgccagcggcaggccggcagcgccgttcgaacttcgaagccccctctgtgccgccgccgccggcccgccacctcccttccctgcgcggctgcgccgcgggcgtgccgcctcgctccttgcgccgcctacctcccctactgtggctgcgtcggctccgtcctccctccccggcgacgccccctgtgccgtcggcccaccgcggcgccgcctcccttccctagttccctgcaccacctccggcctccgtccaccgtccccagtgccgctcgagccgagctcgacgccccctgcatcgccggcgtccctgactcgacgccgtccatcatgacctcgccgagacgccatgtcgccaaccgatcgacgacagttcatgcatcacaccgcaacgacgagcctaggatgaagaggttcgtgatgtattttctcatttttgtgatgcatgtacatgtaggcatgtagctgtagattgttgtggtcagtggagtagcgtgtgtgtgtgtgtgtcagtgtcaaactgtcaatgattcaattacagaaagaatgaggcaaataaatcaaaaatgttgtaccaatactatagtttgaggctttgagccatgtgttttgtgtagtatattatatatgagagtgagactgcgagtctgcgactctttgttagttgttatactgcactgcatatacttcacactcttgtttttccattgtttataattttgactcatctttaaatatgttgatagatccaaatccaaatcaattggtgcttcagatggtaacgtcgtcggtgcttctgcattctctactactggtgcctcctcccaagcagttgtagggtctacgacaagtgatatggcatacaaagattgtgatgtaccattatctccaataatagccttggtacagtacttgccct

SEQ ID NO: 14323 - DNA, 1501 bp, Oryza sativa
acgccgcgccacgacgacgccgcgccacgacgacgccgcgccacgccgccgccggcacgccacgccgccgccttcgccgccgcgcaacgacgtcaccgccacgccgctgtgccaagcgtcggcccgatgccgccacaccgccgttaacgaacacgtgaacaagaacgaacacgtcaacgtacgttggcgcgagaacgtgaacgagaacgagaacgatcgaacgaacgagagcgagaacgagaacgatcgaacgaattaacgtgaacgagaacgacaacgaacgtgaacgagaacgaatgtgaatgagaacgagcgaacgaacgtgaacgtgaaatgcaatatatatatatgttacttcgcatttatcctaatacatatttttttgtatcttgcagaaaagacgtgttgtcggagtcgttcctcaagccggagtggaagagctagccctagaaggaattcgtgcaggcaaatgacgtaataatataaatgattgttatatttgtaatgcaattaagaatattagacttgtaattagacttagcatataagaatgtgtagtgttctaatattatttgagttttaatataagattattttattgcaaattagacttagtatgtaattattgactacggaattggtgcgactcctagcaattgactattatagtcttaattagacttagcatatatgcacgaaacacttagcatacatgactattttagtcttagcatgtaatattatttgagttttaatataagattactttatttgtaattagaattagtatgtaattattgactacggaattggtgcaactcctagcaattgactattgtagtcttaattagacttagcatatacgcacgaaacacttagcatatacatgactattttagtcttagcatgtaatattatttgagttttaatataagattattttatttgtaattagacttagtatataattatttactacggaattggtgcgactcctagcaattgacaattttagtcttaattagacttagcatatacgacagttacacttagcatacatgactctttcagtcttagcatgtaatattatttgagttttaatataagattactttatttgtaattagaattagtatgcaattattgactacggaattggtgcgactcctagcaattgactattgtagtcttaattagacttagcatatacgcacgaaacacttagcatatacatgactattttagtcttagcatgtaatattatttgagctttaatataagattattttatttgtaattagacttagtatataattatttactagctagggttgtataatatacgtcacctagacttagcttatgtcatgatttgtaattagacttagcacgtaaggttgtgtagggttctaatgtacgacatttacacttagcatacatgacttagattgttaaaacataaatgtctcgtgacttagcagatgtttcttgtatcaacaga

SEQ ID NO: 14324 - DNA, 1501 bp, Oryza sativa
cgtctatcacgatttttatggagtcattctcgttcagagttaaataagtttaatttaaaaaaagagtcaaataaaaagttataatatgaatcaagctttgagggagtattatgtaagtatgaaatcaaacgtaatcctctttttagataatggaatagagcattccggcctttgctcaaagagttatagccaattattacaatctcacactaaaataagtgaagttgaaagaaacttaggccagttctttgctgggagttctcaactcctcacccttgtttccgcgcgcatgcttttcaaactattaaacggcgtgttttttaaaaaaaaatctatatacgaaagttgcttaaaaaatcataatgatccattttaggggggaaaaaatctaatatttaattaattacgtgttaatacaaatattgttttgtgtgccggaatcctaaacacagccttaaaagatgaaaccaaccatcaaccagaaataaactaatgactgctaacccaagataaaaagtacacaaataaaacataatcctatggcaccaatgtcctatggcaccaatggcaagaaggaagttcccaagttttaacagccgtgctgtgcatgcacagactgatactagtagctaggactcgttcaacccaagtataaataaggccctatacgtgttccacgccggcacgcgggtgtgcgtgcgggtcaattccatggacggacggtgggcgtcgtacatactccatcgtagtactagtagtgtgatggatgatcgatggtggtgacccattaccaagaaacacacaccgtcgtccagtatccttccttccttgtggacggtcgcccggtcagcgcgcacacacacgtcttacgtcttaaccccacacggtcacaaccacaacaaacacgagccagacccaacccaacacacggtatttatcacctcggtgatcccccggcatatcctcctccatctccaattctccattgtcttcttcttctccatcagatcaaatccatcggaatcgatcggtggctgggagcctccttatcccccacgcagacgcttctccaccgcacattactcgcctccgccgttttggattcttccctgattttttcccctcctctcgatcgcttggtgtttgtgcttgttgttgcgttgcgtttgcttatagtggtccagtgagctccagcgagcaaaaacagacgccatgagcgccagagagagattttggtgccaatagacacacactgatttcatcatcatctaggcccaaaaacctctactcttccgcgtcttggaaaattcttctcagattgcatcaccagtaggaggattgtcagattgctgctgctgctcttgtactagttgtattcaggattcagaatttgggcggacgacgacgaggataaatcggatcttttcttcctccttgattaattcctgaggcgtgtgtgtgattagttcaaaaaagaaaaatagaagcgagatgtcggcgt

SEQ ID NO: 14325 - DNA, 380 bp, Oryza sativa
agaggaagagtgagaaaaaggaatagtggaattgaatatgacaggggggtctaactttttttttataattagaatgctgactggactgcaggtatatgccacgtagaccaaaaccaccgtggattggatcgagagggtaattcatcctgtttgtatagttgggggtgaagaatgtccggttttatggtttaggggggtaattcggacgaccgcgatagttgggcggtaattcgtacttttttccaaaattaaatgcagtttgagatgtgatactcatacaaaccagcgttccttcagtcttaggagatgatgggcatgattagcttgaaacagattgcactagcgaaattcttttctttcccttccaattctagtttaga

SEQ ID NO: 14326 - DNA, 1501 bp, Oryza sativa
ggcagctgcggagctcgacgaggatatgcgccatgaagcacttgacctgcggctccatgaagtgcagccccggtgtggcggcgaggtcatggtccatgtactcgaagacgaggtagaagggtgagaatgacatgtgggactcaccatttttattaatttgtgtgaaactgatatgtgagttccacgggttttattatcacgccaatgccacgttagatgaagaccgagtcaaattagccatgtaagcgccacgtcagccaaaaccgccctcaaaaccgccgagggacctaatctacatcggttttgatagttgagggacccgttgtgtctggtttttgggttgagggacgcaaatcgaattcgacttgctgagtcgtggtaattaaagttgtcatcaattgctcctgattctcgtgtgtaaaatgcatgatatccacgtctaattaatttctccatggccatccccagagagagagagagagagagagagagagagagagagagagagagagagacagtactggatgccctggggaaaaatggtgaatataattgctagcgcgagccaaattggccggggacaaaacagaagtggcatgttgttggttgctgacgatggtaattaaacgaaagcgaattgcagtcccatgtgctacgtgttgggtaatagcacagggatcaatttctttttcttctaggaatcaactctttgtcactttagattgtacggaggatgaattaagcatgacttaacggagacttactaatgcatggaaacgcacactttgttactcatgcaagcagaacgcatgcacttactcatgcatccataacacacttactcattgattaatgtgcatgcaaaaacccactcatcgatcactaatacatgcatgcagaaaccgaatactaccatcaagccgttatctagctactaccaccaattgaatgtcatatggccacaaccaagcaacactacggacaggtgctatatactccctccgttttgaaatgtttgacaccattgactttttaacacatgtttgaccattcatcttagcttattgaaaaacttttgtaaaatatgtaaaattatatgcctacaaaaaaaatatatttaacaatgaatcaaatgataggaaaagaattaataattacttaaatttttttaaacaagatgaacggtcaaacatgtgcttaaaaagtcaacggcgacaaacaattcgaaacggagggagtataaattctgagcccaacagccggtagagaagcaacagtaaaacagcaaccaattgagttgcaatattattgagagcagaagacaacaaggttagagatgaggaagcaacacacttcttctgctgctgctgttgtgtctctttgcaaggtgctcctgatgatcctcgccctcatctgcaccctgcacactgtccccgtagacggagcaggtaattactagtaccctataattaatttaaccattggagttgagccatgttca

SEQ ID NO: 14327 - DNA, 1440 bp, Oryza sativa
ttttcacacaaaataacaaaaaaaccggtggggcccgtggaccccacgtgtcattctcacccctcttcttcttcctcctcctctctccccattttccctctcttcatctctctctcctctctccagacacgatcgagagtcagcggtgcgcggcggccggcgggaaaggagggagtggcgtgcagccgcggaggcacgtctccagcggctgtgggcggaagaggaaggggcggcgaaaggtggcggaaagcggcgggaggcggctttgtcctgaagaactaagcagcagcagaggaccccatgcgagcgaggaggagaggagagggaggggagaaggtgtgcatgcttacgtcgctgtccacggctacggcggcggtggcgcggtgccccggtcggacggctcgatgttgagcagcgtgtcgaggaggtcgagcgccggtggcgagaagtccctgaacatctcggcgatcttccgccggtaggccgctgcggcttgaacagcgtcacgtccggcagcttcgccttcgcccaatactattccgacggcgacccgcacagcttgaagatcttgtgcagctgctcgatctgcgtcgatcagcaatgacaaatcagatgccgatccatttcatccacgcatagatgatatcatgatatatagatggagagttgaggttataatatttatttatttgccttggtttggctgggcaagatgggcttgccggcgagaagctcggcgaggatgcaggcatgcagccggtgctccagaggtcgacggcgacgccgtactcggtggcgtcgaggaggagctccggtgggcggtaccagagcgtgatgatgcggctggagcggctgcggcctggcggcgtgaagaaggtggcgaggccgaagtcggcgatcttgagcacgcccgtcgccgtcgatgagcaggttggcgcccttgatgtctcgatgcagcacgcaccgttcatggcagctgcggagctcgacgaggatatgcgccatgaagcacttgacctgcggctccatgaagtgcagccccggtgtggcggcgaggtcatggtccatgtactcgaagacgaggtagaagggtgagaatgacatgtgggactcaccatttttattaatttgtgtgaaactgatatgtgagttccacgggttttattatcacgccaatgccacgttagatgaagaccgagtcaaattagccatgtaagcgccacgtcagccaaaaccgccctcaaaaccgccgagggacctaatctacatcggttttgatagttgagggacccgttgtgtctggtttttgggttgagggacgcaaatcgaattcgacttgctgagtcgtggtaattaaagttgtcatcaattgctcctgattctcgtgtgtaaaatgcatgatatccacgtctaattaatttctccatggccatccccaga

SEQ ID NO: 14328 - DNA, 467 bp, Oryza sativa
tgtttctgcgtgtttattaggcccgattggtgggaggagccgaacccattacgggcggcccatcacgcccatgcctctgtttatctggcccaactgggggtcggagatctattctccgaacctccctatcctgcaaagtggaataagttcatctgaggtcccttaattttacgccaaatccgattttcatgcttgaacccaaaaccagatataactggtccctaaactatcaaaacaggtacaaatgagatccctcggcggttttgaaggtggttttggctgacgtggcgtctacgtggctagtttgactaggtctccgtcccacatggcattgacgtggcgcttacgtggcaattacgtctcaaaaaaataataaaaccatgggcccacctgtcagctaaaaataataattttaaaatggcgtggcccacatggaccccatatgtcattccctctcccctctcagc

SEQ ID NO: 14329 - DNA, 1501 bp, Oryza sativa
gacaatggaatctgtttggaatgtggagtgtgattatctaagagcatgcatgtatgataagatcatgtaaacgggctatagaagacgtcacatcggatttgtactgaattgaaattaagagagaagaggacagaaaaaaaaagcaagctacatatatgtaaccagttgtaacacgaacttcaaaaaactatgagttttttttaacgaaccggcacttagaatgtgccaatttcattgaatatggcaaaaaaaaaaagctgtacaagagtagctctatacaggtttaaaagaaaaaagaagactctaaggcactatgttacatagtccattcggtgctgccatggcccaaatctgtgcctcctctttgatctttgcaaccaagtatgttgccgatagtttttttttgtcttaactgatttcgctccttccaaatctcccatgacgctaggagaataaggctacgcaacactttctttggcacccctggggtagaggcaagatccgtccgttactcatatcatggaccatcgtaggattgttccaattagatagctgaatttgcttgtgggagatctttgtgaggttaaggataataatagaataagcatcttactattagtatcttccacgtcatctctacaggagaaggcttaaaagacaaaatttacagtaaaatataccgtaaagttgttctttttttttgagaactctataagagcgggtacaatagcagactattaaccagctacaaacatattttaatgagataaaagatgagagagaagagcagcgggctatagatttgtagccagctgcagcgcggactccaagacgcaatgtgtatatgacaggtgggaccatatattatagtatagtaagcaaatattgtataaattagctattagattggctataaatgaattggagctagtagtgggctatactattaaccttgctctaagttgtctgaatgccatctcctcctaagcataatgcatttaacgcttaaaagtatatgtgaatttatgctggaccacatgtaaatattatttttttaactatatggagagatccaagtattaataatggattataaatatatagttaactattgtataggtgcaccactggtatattgactgtagtattagggctgctctaataccatatatctatggttgattactcgacagtatggctagttcccaacacgtacgcttgcaagagctagttcccaacattcccctctcattttccacacgtatacttttcaaattgctaaacggtgcgtttttttacaaaaaatttctatacaaaaattattaaaaaaaatcatattgatctatttttgaaaaaaatggctaatacttaattaatctcacgctaatagaccgctccgttttccgtgcataggagatggtttctatcagagcaggtataatagcaggctattagctagctgtaaacatattttaatgagataaaagatgagagagaagag

SEQ ID NO: 14330 - DNA, 1501 bp, Oryza sativa
ttttttttgcacatagtgtgtttgtgatgttgcactccgtcttttctagatgtttcttaaatcagtactagatgttgcatttggtttctttgaatgttgcacgtattgggtttttgttgttgcagtcaacattcttgagtattacattcgattgaaacatcttcgataaagcgatgaaatattcttcagtgaaagatgaaacattaagaaaaaattcgtgttgaaacttttttttagcaatgaaaaattgcaacatttcttcatcaacatatagtgcaacatcgtcgagagatttgcaatctctggacatccgatgcgtaggcctctccaaaaaaaatcgagaacttagcaacatattgtgtttttatagtagtagagaaatgggtatgcaaaaatcacaaatgtagaaatggccgaacgaaattaggacccgtttttatttttatttttttgacatgtagaaggaccagttttgctgatgaagaagctggtaggctaatgcttccgtgaattgaccagataaaaatgggcccacatcaaactaaccaaaagggcccttagttttcggcccacatccgagcagcagcccagcattctaagggatcccgtgggccaaatcgtgtgggccgtggctgttggggtcggagatttcttccccgacccttcctttttctcagggcgagatgccggcgtgatcaatccgtcagatccgcacatgaatctggtagtggttgcagagacaccgacggcacggagatgtttgcagttgattatttcgtagagattggaacgatttcaagcatcgagatgcatgatttctacgtgtttttactgaattactccccccgttttaaaatgtttgataccgttgactttctaattacgtatttgatcattcgtcttattcaaaaactttaagtaattattaatttttttcatatcatttgatttattgttaaatatgctttcatgtacacgtatagttttatatatttcacaaattatttttaataagacgaacggtcaaacatatgctaaaaagtcaacggtgtcaaatattttgaaacggagggagtattatgatagtaagctacgttaccccgatacgctgatacggatacggatacgcgatacggcgataccgggatacaccatcttcccaaaaacatggatacggggatacacgaatatatatatatatatatatatatatatatatatatatatatatatatatatatatatatatatataatttaaaaaaattgagtgtggaatatggactgaaaaaataggaagcaaacagcatcaatccaccaatgcatatatgatatctcagtacgacagattcacaggctcacagcatctcaccaagtcaccatttattgaagaggcatacataaataagtgcaagacttacacagtagatgaaatcatgaaaataacatagttcttcaaatagatggtagacattagacaacattgttcacatagtagatga

SEQ ID NO: 14331 - DNA, 1501 bp, Oryza sativa
acgagatcagtcgagcggccgacgggaagcccgtcccgccccgatccttgtcccgcgccagtcgacggcgacggcggtcgtacaaggctaagagatcctggccaagacgtcgttgttcatcaacgtgtgggcaatggggagataccccgcggcatggaactcgtcggaggagttctggccggagcagttcttggccagcagagaggcggtggactttcagggaaacaactaccagctcatcctgttcatcaccgaccgacggatcttccccgacatcaacttcgccgtgccggtgctggagacggcactggtcggactccttcacccgacgaacgagctgctgggcggcggcggcggcctgatgtggttgcagcggagctgctcccgcgcccgtcgcccgaggtccaccgcccaccggcgccaccgctccggcacccacccgggcgccatcgccgctgctgccgccacctagcccccgcttgccgccggctcatatgaaggggagagagagagagagagaaataagggagaggaggaagaagggtagtgagagagaagatggcatgtggatcccacatttttttgtgtgaatgacaaatgggtcccacatatatatttttattttaatgacacaagcaccacgtcaataccacgtgggacaaataccaagtcaacactgccacgtgtgcgccacgtcagcgaaactgtcctccaaaaccaccaagggagtcaaattgcaccggttttgtaagttcgggggtcaagatttttggtattgtggttgagggatacgatttagattcggtgctcagttgagggagtcaaagtgatcttattccaacctacaatggcctaaattaatcccaatttcatttcctaagtgggcctcaatgtttccggtccatttttcatgggccatagcccaacggcatacaacgaaggaatatgcgcgtgcgcgcatcatccggggcccaccattccagagaatttgaaatccgggcgaggaattttgaaagacatttgaaccaaccattctgtcctgtccattctggcccacctcccttatccaccctctgattcccaaactgccccttactccaaaccttgtctgctgcaagttgctgaaataatttgcttgcatttgctttggatctcttacgaaattcaagagtaaaaaggtatactgaaaatccttttgaaatttcaattcatccgaaaagtaaaacgaatatttgaatttcgaatttcggggaacttgttcccgccgggccacttggaaattggaatttgccgcaaggggcaaaaccgtaaaatgggagcagttgcacgctttcgtccctatccgatgccgtcgcgacagtgacgcctctctgctcccttcgcttcgcccacagagacacagtgctttctccctctcgaaccttccgcctccttctagaaccttccactcccgctcctcgtccgggcaaggaggtgccgcctccctccgcctcgccggaga

SEQ ID NO: 14332 - DNA, 1501 bp, Oryza sativa
cgaactcggcgatgcgtatcatgaggtcgcggccgtcgtcgaacgccgggaagacgtagaaggcgtggatggcgttggggtactcgaacaccctcacgtccttgcccttgccccgcagcatctcggcgtaccgcctctgccagtcctggagcgggtcgtagccgccgatggcgaggagcaccggcgggaacgccggggagtcgacgccgggggcggcggacggggcggcgaagttggccgcctcgtgggtgcggtcgcagccgtcggggaggaacgcgcgccacatccagtcggtgcgggagacggtcacgatgggcgcgccgtcgaggcggagctccgagtccgtcctctcctcgccgccgaagaagggctggatggcgacgaggccggcgacgcggacgttctcgaaggcggcggcgtcgcaggcgtagcggcgggcgacgtggtgcgcgatgttcccccccgcgctgtcgccgccgaggtagcatcgggcggcgtcgagcggcgggacgcctccgccgccgccgccgtggtgattcttggggtcgtcgaggtagcgcagcgcggcgatcccgtcgtcgtacgccgccgggcagcggtgctccggcgcgcggcggtagtcgacggacagcaccgcggcggacgcgtaccgcgcgatacgcctgcacgcggcgtcgtacgccgcggacgccgcggagaggaacgcgaacccgccgccgtggaagaagacgatgacggggagagggcgaggaggaggaggccgctcgtccttgccggcggcggcggaggggtagaagaggcgcgcgcggaggcgggtgggcgggtggacgaggacgtcgcgggaggcgacgccgcggcacggggaggagaaggccgggacgcgcgggtcgaggacggacagcgcgaggcggttgagcgtgccgtcggcgcggcgcgtggcgtcggtggcccagtcgacggccttgagggacagccgcatcaggcgggacatcggcggcttcggcttcgtcctccgccccagcggcgtcggcgtcgtgtcgtccgacgacatggccgccgctgccgtcgccgtcgtacgtgtcgcgggcgcgatcggtggagagaccgagtcggggcacacacgtatttatgggggattggacgtaggagatgggggtgagtgtggtgtcgcgtcggttgatagctacggatggttttcgtgtgccgtattgccaattgggtctattggctattgggtttcgtgttgaatttttgggtaggcacaaaggcagctcgcaacaaccgtggatggctattaataaaaaagtatacggaactgctaaaattgtggaattaaattttaaaatatacattatttttctcgattttgtatatatatacatgtgtttgaaaattgtgaatatggtttagtccaattgtgaatatggtttagatttagagacgaggaaaattacaatgtaaattttaaaatttacatgtaagatttgaaaattacaatgta

SEQ ID NO: 14333 - DNA, 978 bp, Oryza sativa
atatgtctattttagtccctatactttatgtgccgggcctagcctgccggcccatcgtgccgggccggccggtcgggccagcgtgccggtggggaggcccaaacacggcccggcagtcgggccatgccgtgccgtgcttgggccgggccaaaaagccgtgccatgggccgggccttcggcctcgggccttatggccatctataattgagagcgattttttttttctgtggaaatctaccaatccagaagcttatccacaaatcatcaatttaacatgcatcatatatggttcggcaccattcagattcgccagtggaaactgattctatgtacgcctactaacttcaaaatcttcttattttcataggcaacctgtccagctgttttcgataacagaggtacatggcgatgtggttatgtttgtagctttcttgggagttctgaacaaaccatttgtaacacattagcaggtgattacatggcttgttttcccacagaaattacagttttgttgttaaggggcaatacccgaattcttggaggatcattgtttccatttcatttcgttcaaaagaaatttgtttccatttcatcatctggtagactggtatgttcatagtgttagttagcatgaaaggttcggatcatgtgatcacgacctgacagcttgcatgcatgtagttgttgaggttagtttggattaggttagtctatccatgcggatcaggttagcctttcctccacatgcgataacagatgtttgttagagtttgttttctgttttctgttactgcatgcagtcgtttcatcaatctcggcttcggttgttctcagctgcgccgaactctgtatcgccacgatgggggctgttcccatcacatatatattaacacgaaggcgacgcacaggattagtgcgatcgtttccacccaaactaattcacatggtatcagagcgttgatcaattccctaatagat

SEQ ID NO: 14334 - DNA, 1089 bp, Oryza sativa
gaaaaaaaaatgatgacctaagatccccttttgttctaattaagatatagattttaccttgattttcattagcacacatttcaaactgtatttcatacatatagaagttactaaccccatcctgaaataaattcatttgtcagccatctcacaatatcacacatgccaataaacacaaaatgaattagaatacctcagttatatcatatcccaatacaactatttttatattttatatactcccaatataattattctatatttttataaactccaatacagtaattacaataaaaataaacttgttttaaaataaatggtactccctacgtcctaaaatataagcaatttttagtacagtagcaagtcaaatatttttaactttgaccattaataaaaaaataaaaagatcaatcatataaaattaatgttactatgtttatcattaaacaaattattataatatatataactttttttcatttaaaacatcttacttttatagatattgacatattattggtcaaagtagcatctagtagaccgtgtcaggtctaaaaagaattatattttgaaacggatggagtagaaaataaaacaattctaaatgaacttgagggaggaggaagtagcatctttggggagcgagctcctctaacgtaaagttagtgtggattccttagagcaagtttaatggtatagccaactactagcttcaattcatttatagccaatctaatagctcgtccatacaataattacacagtaatacactattaatatctggtcccacctgtcatatatacactgcgtcttgtagtctgtgctacagctagctacaaatctgtagcacgctgctcttctctcttcttatttatcttcttaaaatatatttgcaactggcttatagtctgctattgtagatttgtagccagctgtagcacggattccaagacgcactgtgtgtatgataagtgggaccgggtattaatagtgcagtatgtaactattatatgaatgagctattagattgactataaatgaattagaactattaattggctatactattgcccttgctcttatagg

SEQ ID NO: 14335 - DNA, 1501 bp, Oryza sativa
gtcgcaacttcaggcatcgccgggcaccaatccagttctccataacagcttgctataccttctagctcaagatggaaggttagcagtttatgatccttgcaggcaccatgaaggatttaagattcttgacaagcctaatagcttcggtttcaaatgtgaagacagctacttgctcgagtccaaccaaggtgaattaatggttgtagcgattgaacgacgtgggaagaaggtccatctcgtcaagcttaacgagcaaagcatggagtgggagaaggtagatagcttgcatagccagacagtgttcaccgggtctctaacaacgatgatgaagaagaccaagtttaactggatgcagaatatgatattccttccaagattctaccagtggcctgagaccgtccacgttgaccttgttgctcgcgatggcgaattggcatttgtaccaaagttaccgttctgcgcagatacgtaccttgatacatgtggtacaaacatctggtcttatgaattagcacacggagcagcaacaaaagaattttgggggacagagagggcagattacagtatatgggttgactttggtgataattgatttatacattgttttctatagtatatgtaaatttgtttatatactcccttcgtttctaaatatttaacaccgataaccttttaatatgtttgattgttcgtcttatttaaaaaatttaagtaattattaattttttcctatcatttgatttactgttaaatatacttatatgtatacatatagttttaaatatttcataaaagtttttaataaacgaacggtcaaatatatacttataaagtcaacggcgtccagaaacggaggaagtatgttgtatagagggttctagtatattttaattagttagccgggtaaagttatttttaatcagtataacatgcatacttaacatacagtagtttattaggaggcgaggcctaaccactaattaatccgagctttagggggaatagccttgtggagattatggatatcccatatctacacggcgatagtatttggactgggtacaggatacctaatgtagatagaatatcttatttgtatctcgggtttgtttcttaacttgtgtatcaaggaaacaccctgagacttagtcggtcacgactgtgttttatctgtatcttcctattccgttagggatatagattatcttttgtaatacggactccttcccatatataaggggggtccgggtgcctctaggggcagaggttggattttctccaaatcatacaatcaataacacactcggcggattcatccccggacaggagtagggtattacttcttttataagaaggcctgaacctgtataaatccttttgtcttcaaacccatacactttcctagcttgatagccacccccttttattattgctgaaatctagtttcgacagttggcgcgccaggtaggggttgcgtcaagcttttcgccgatcagtgcaa

SEQ ID NO: 14336 - DNA, 1501 bp, Oryza sativa
cgcgcgagaggagggagtagtgagtttttctcgtttcttttcggtttggtttttctttttttttccggtttctcttctgttcggttcttttccctgttttttcaaagatgcatgaatataaagtttgtattcgtatgtatgcaaagtttgtattcgtacatatgcaaagtttgtatacgcgtatgcgaagtttgtataagtgatgtattttctagtttttattgtatttttttaatacatacgtatataaagtttgtatacatcgtatacaaagtttgtacacatcgtatacaaagtttgtatatgtatatatttttttatacataaaaaatatatacatataaatatatatatattatagtagtaatactagtggtagtataatgacaatagtagtagtaatagtagtgtagtagtactactagtagttctgttgtagtactagtactgaactatactagtagtactgatcggctgatcgcgcgtctggagggccgcgcgactagtcgcgtattagggcccctcgggcgcgcacgagtatcagatctattaaatatctcctagaaaatagcatatacagggagagggagagatatatagagttgtggataagggtggaaccaattttgtttggctttttggtctgttcggtcgagtcatccataccgtgactgagttcctctagcacctctctccgtattttcctcaatcaagtattgttacactgaaattcctttagccaatttgagatatttttataaaaacggaacctacatgatatgagcaatccatttttgaggtgacccaattttagttttgcactttgcatttgagtccctataatattcatatttacatttgagtccttgtttgaagtcagtggttcagttcttgttaaaaaaaagtaaaaaaaataaaaaaagaaagaaaaggcagaaaggtgcaaagaaaaggcagaaagccgcacaaaaaaaagggcagaaaggtgcttaaaaaagccgtacctagaaagaaaaaaaaaaatcatcctttgagtatgttttcagagtgcagagttgtgcattgattcatatctagtcattagttttgtcgggtgcttgcttgagctagagttgagtctagactaggccagcacattgactagtactttgaactattattcaactttgcattttctgattagtacaattgcgttcctttgctactatatattgtgcctcccaagctacacatatatacttctggtcagcaccgctgatccttgcaatcgccacatcacgtccttcaaggtgtcacgaactagccaccggttgtaccgtccttagcattgctggtaagacacttgtaagagcttggtaaggtgctccgtttggctgagttgttaaggggcaccactacaccgcgtagcagattattagggataaccttcattgtttgttgttgtttttgtattcttaatgacaggtatgagtcgcgctcaaaatcagcgataccaacaagg

SEQ ID NO: 14337 - DNA, 1501 bp, Oryza sativa
catctaatgtgatatagactaaaattttagtccctgatccaaacagcccttaattttttaagaggagatggaaacttgaaaagcaaacaagtttctggccgagttcgggagcctccctgcacggaaaatagcgttacctattaatacgtgattaattaaatattagtctaaaagttttaaaaataaattattatgattttctaaaacaacttttctatagaaaactttttttttgtaaaaaacaaattgtttaacagcgtgaaaagcatacacgtaagaaaagatgaagatgagttagaaaagaaagggaataacacaaccttgctccctccgtcctacaaaaatctgaatctggattggatatgatttgttgtactatgatatgtcgcatttaattttaagtttgttttttcgatggaggtagtatgcatgaacatgactttccaacaccaattttatttgccttttttatatatcagagaggattttcagttccaaagttgttggatcatttttttcgacagatgcgtacttccttcctctcattctctgtttcaaaaattgattttactggtgggtcactcttacttacttacagtggcgaacacgacaatactccctccatccaaaaaaacgaatgtgtcacatccagtactagaatgtgtcacattcagtactaggttggtttttttatgggacggatggagtatttattaggtgggtatagaggtatctggtacactagtgttaggagatttgagacagttggttactagaagtgcaggagtgaatttgttgaggaaaaagaagtattaggcacattcgaatataaatatatacagtataatatacttacatatattatgttttttcatgaaaattttggggaatatccacgggttcccccattgcttacttagcacgtgcctgttgcatacttgtgcactgtatatttttctatcgcagtcatgtgatatacccttccgtaaaaaaaaaatcaatcctaactacgaatctggacatatatatatatatatatgtatatatatatatatatatatatgtatatatatatatatatatgtatgtatatatatatatatatatatgtatgtatgtatgtatgtatgtatgtatatatatatatatatatatgtctagattaatagctaggaattgttttttataaagtaataactgattaaaaaaatcagcagagatgcatgatcccaatgctaatgtacatgatactgtagatcaagaagttgtaaaatgataatgaaagtaaatatgtttctaattaatcggatttcaaatatagctaactgaaattttcaaaactgcagaaaaagacgcaaccaaagttatccaagtcataccagtggccagcaaggctgcgaagccctatataaaacccagagatccatccaagcttcctgcccccactgtccactctcacaccaaaaccagtaaaaaaatatcgtcaccttcgccggcgaga

SEQ ID NO: 14338 - DNA, 1501 bp, Oryza sativa
tctataaatttgattaaatttaaagtagtttgattttgagtaaagtcaaaacgatttataacctacaacggagggagtatattttaaaacgaaaatactacatatcttttgtgtctgattaattaaccggtgtgtgtatgcttgcatctgcaggagctggagctggaggagttcatcacgcacgagatggggttcgaggagatcaacagggcgttcgagctgctcacgcaggggaagagcatccgctgcatcatctggatggacggcgccaaggtgatcgacaacggcgagtgatcgcggcatcgtcgtcctgtcgctaataaccgattaaccgctgataccctgggaaacagttgagcctcgctgttaactcaaactgtccgtcgtgtctttctgaaggctttgtctgttctctgttctgcataaaaaatgcggttgacagcgagttagcgacggtgtatgtccttgattaaataattctgatttttttttcacttagaccgtatacgaaaataattcagccctgctgatttttcttctatagaagcaaaaaccctggtgcagatataccatagcgacacatctatcacactaaattattttcattaaattcaaaattactacgtttatctataaatttatcataattaaataaattaaggaacgaaactccagggttttcgactctgcgctcgcttcggttgcagtggttctagagtccatccgctcggagggccagctgtggtctttagccggtgttactttttttgggatttcttgggagtgtagcgtggctctgccccctcccgctgtttggagttgcgtttttaaccgtcgtagtagttcatagcttcaagtcccccctttagacataagccagtctggctgattgctttgtgtaacaaaaactcttttcctgttaatatattgacgtgtaatccttttacgtgttcgcaaaataattaaataaattaacttaaaaaagatcaaaacatcttataatatgaaaacggtgaaaactagaacattcatgattgatttagatttctatgtataagtgctaaaaagagactttgggcggaagcaatcagacttggaataagttcatctaaggtcccttaacttgtcaacgaatccgattttcgtccttcaaccacaaaaccagatacaacgaatcctcaactataaaaacgggtacagattaggtccctcggcggttttgacagcggttttggctgacgtagcgcctacgtggctaatttgacttagtctcaatctgacgtggcactgacgtggcgcttacgtggcaattcatctgaaaaataataaacctcatgggacccacatgtcagtttcacacagaaattaataaaaaatggtggggcccacatgtcagcctccctctcccttctctcttcttcatcctcactcctattcttcctttcccctctcccctctctcttctttccgggcggcggacggcacgggtgggcggcgaagc

SEQ ID NO: 14339 - DNA, 1501 bp, Oryza sativa
accgcgggagatggcggcggcgtgcctcatttcgtcgggaccatgagagaagaacgaagaaaagagaagaatgaggagatgtgggtccctttttttctcacttacatgtgggtcccgcagttttttaattttttgttttgctgattaggatgccacgttagcgaaaccgtccatctatactgctatagaaccttgtgtgcttagtttgtgtgagtttaggggtacacatttctggtttgtggttaacataccttaaaaaatctcgctgttaagttaaggacctcccgtgaatttattcctacggtgaaaatttttcaccaagcttaatgggcctaattgtaactcatgtactcaacttatgatgatttgtttagaaagacacatccaatcatttcaaggagtgaacagatagagtgaacctcaaggggaagacaaaagacaagacaaggtgacaacgactgatggacggccggcctgaagacgccaacacctgaacaccagaagaaaggcacgctactactcctactatatgataaaaaaacactacaagagaagatacctcaagactgctacaggtgacgatcagtcgacacatcatgccttatcgctgctaagccttgtctaaggccattccccaaaatatacacatagtttctataaactccacattactaaaaaaaactagtactagacactactattcctatacaaacatcaatattctatacttaaatttaatgctacttatttcacacgatgtcttggatattgtgtagaaaccatgtctcatgcaagacatggtctccttctctttcctcatttattcacttgccacatcatttttcattctaggtgacagcttatttaatactatagacactattatagtcattgggttgggaatggcctaattggctgacgccacaactcccacttcgccaccctcacaagtcacaaccttccctcaacatcaacattaccaaatgttcttgttcacaaaatctgaaggaaacatttcttggattccactccctgatggctagcctccagcccagttaatttctgtagtaccagacgggccatgcgtttggatgatgtaatgcgtgaacacgatgagtcacatgagtgcatatgtacatgagcggtgacgaacagggaggcacgtagccgatcaccgtacgtacccaacacacaacaaagtccaaaaaacgacgacgataaaacctgatcccctttcacctgctcccctttcacgaccactcgctttcagaagatatacgagtatatcatagcgtgatatacagctgaagctgcctgcctttcgttttccagcttccaacgcgatctttaaataagacaaccacgaagttggagtagcagccaaacaccaacaaggatagaggggagaggctagcttcctggaaatggagcagatgaacactgctgctgcaaagtccatcaggtgcagaggtgagctagcatctgagatcgagttttgcaa

SEQ ID NO: 14340 - DNA, 1501 bp, Oryza sativa
cagagaatcagccaacgacgccattgcaaaactcgatctcagatgctagctcacctctgcacctgatggactttgcagcagcagtgttcatctgctccatttccaggaagctagcctctcccctctatccttgttggtgtttggctgctactccaacttcgtggttgtcttatttaaagatcgcgttggaagctggaaaacgaaaggcaggcagcttcagctgtatatcacgctatgatatactcgtatatcttctgaaagcgagtggtcgtgaaaggggagcaggtgaaaggggatcaggttttatcgtcgtcgttttttggactttgttgtgtgttgggtacgtacggtgatcggctacgtgcctccctgttcgtcaccgctcatgtacatatgcactcatgtgactcatcgtgttcacgcattacatcatccaaacgcatggcccgtctggtactacagaaattaactgggctggaggctagccatcagggagtggaatccaagaaatgtttccttcagattttgtgaacaagaacatttggtaatgttgatgttgagggaaggttgtgacttgtgagggtggcgaagtgggagttgtggcgtcagccaattaggccattcccaacccaatgactataatagtgtctatagtattaaataagctgtcacctagaatgaaaaatgatgtggcaagtgaataaatgaggaaagagaaggagaccatgtcttgcatgagacatggtttctacacaatatccaagacatcgtgtgaaataagtagcattaaatttaagtatagaatattgatgtttgtataggaatagtagtgtctagtactagttttttttagtaatgtggagtttatagaaactatgtgtatattttggggaatggccttagacaaggcttagcagcgataaggcatgatgtgtcgactgatcgtcacctgtagcagtcttgaggtatcttctcttgtagtgtttttttatcatatagtaggagtagtagcgtgcctttcttctggtgttcaggtgttggcgtcttcaggccggccgtccatcagtcgttgtcaccttgtcttgtcttttgtcttccccttgaggttcactctatctgttcactccttgaaatgattggatgtgtctttctaaacaaatcatcataagttgagtacatgagttacaattaggcccattaagcttggtgaaaaattttcaccgtaggaataaattcacgggaggtccttaacttaacagcgagattttttaaggtatgttaaccacaaaccagaaatgtgtacccctaaactcacacaaactaagcacacaaggttctatagcagtatagatggacggtttcgctaacgtggcatcctaatcagcaaaacaaaaaattaaaaaactgcgggacccacatgtaagtgagaaaaaaagggacccacatctcctcattcttctcttttcttcgttcttctctcatggtcccgacgaaatgaggc

SEQ ID NO: 14341 - DNA, 1501 bp, Oryza sativa
cggcggcaggggaggaggggaaggaaaagtagttagggtttgatggggtttgcacgaatctcaaattaattcaatggtcaaaattttgtagtatattaaaagggattttctttaaaatgaggagtaaacagtcccttagaattatccatcacgacacgcgcaaaaagcacaacacaccgcaagcgcacgaacacgtcacacaaaccaagtaaccaacacaaacacgtcacaccactgctttcgccatctcagaatatatatgatactacgattttacgatttatattgtccatgagtacaagtacaagtcgagccccaccaggcaacaactacacagacgcagctcttcccatgaaaccgaaacggcaaatgtcccattttgcgatgtgaatatctagagatgaaaacagtcagaaactaacggaaaacaatatcaacaatttggtccatttctataattaaaattttttgaaaataaaatcgaaaacaataatgtcggaaacgaaaacgatatcggaaatatcggaacaccggaaacggaataatacggacggaaacattaaactataaaaacatatatttagctttacataagtatattatatgtacaaataaatttaagctgtagtatgtaaattatatattaactccattttagccatgcacttaagttagggatttgattgcaaaagggtttgtagtctagtggttacaagagtctcagcagtaccttagttcctgggtttgactccccatgagagcgaatttttcagaatttaacggttttgtgctttcagtggtaggcaacgtacccgtcgacagcgaagcgcctgtacggaattttccaagatttaacggctctgtgctttcggtggtaggcaacgtacccgtcgacagcgaggcgactgtagtgactttgtctatctccaggatagatttgtcctctctaaacaattaccatattataagaaacataattttcacaagaatacgaaaacggtaaaaccattttcgttttctatttccatatttgttacctttaccattttttcggtcaattaccattttcatatggcttagtcggtagaaagttaaaaacaaacgccggttggcagaaattaccgttaccatttttaacccctacaatatcacagtttccccggataaactggcacaacccgatctattgccacacggaaacagatcatcaaacccatacgtcagtgatccaagtaaaaggggagtacggcagagaaagattcatccgtcgcgacacacgcaaaaagccacaaaacacaccacaagcgcacgacacacgtcacacacaaaccaacacaaaacacattgcgttgcgcttcctcaaactggatttattaccggttggacgccgcccgcgatctccgcgaagaggctctcgaggttccgccgcgacgacccgccgggcgccaccgccgccgccgccttcctcctcatcgccgccgccttctcccctccccccatc

SEQ ID NO: 14342 - DNA, 1501 bp, Oryza sativa
tgccaatacgaaacgtctaatggggattggggaacagtccccatcacaggttgatgtctgtaactaatggaggtttgtaatgggcaaatgccactctcagctcagctcagctcaatattcctagccctattttcttcttcgtttttctcctctcctccccttgatctcagtagcgcgtcttgttttgatacagagagcactatgaaaatgttctttgcacagaatgaatggtttatctgatacagtagtctcatgttttatcagacactcttgttattcaccagtatatcgcccatcactgtgcgttactacttagttactacttacaactaacaacggcccctttggttggataaacaagtgcgtgttgatcccttgctactcgtggttcgcatgatcagggttgaacggcttgttcaacgtgatgccaggcttatttctggtgtgattgtactttccctccagctgatatgagcgtgaagtttgatcttctgatagtttctagcggtctagcaggtgtcaagcctgggcagccagatagggaactttttaacttacgtaacttgtgtcactaacatataaattcttttatctaacaaatccatatattagcgaggaaagtaaatgagaagatcctcttcccagggaagttcctctggcggtctggcctcaggctcagggtagccctgtcatttagacgaacagccccatcgtttatatatatatctaataagagaaaaaacgaaatgggtatttttgcaaatgaaagataatttgtgaataaaatttttatatacatgttcttaatggtctaagatttatatacatgttcttaatggtctaagacgaatagccccatcgtttagcgaataagagaaaaaaacaaaatgggtatatttgcaaatgaaaaaaaaatgtgaatacaacttttatatacatgtatttaatgatctaaaaataaaggatgaaaaataaactacgattaataaaatcctaaaatcaactttaaatttaaaattaaaattcaaaaattttggctgagaaaggatgaggcctgaagtccaccgagagaaacaagcagcttaccgcttgcggctccgtcgacggccgccggcgcctctgcgtagagggggaaaaatgatgaaacgaaatggcgtctcaaagattcaagaaccgcgacacgcgtggcggcacgtggcgcgcgcgcgctgcccgcacaaccccacgagtacgagtgggcgtcttctccgcggctccgcatcgaggagcagtgggttcctttggattcgacgattcgagtgggccgccggcttttgtagcactagtttctgtctgcccaaaaaaaaaaaaaaaacgccacgtcccgacgcgccgacctccatcctgtgaccatcccacgttatacacacggtgattggctctgttaaaaccgtaataaagcagcttaaccacccagacaatgacgagcactaatctcattctcatctaagcaagtgccatt

SEQ ID NO: 14343 - DNA, 1501 bp, Oryza sativa
cctcccgatggccgcggccggcggaggtgggggtggcattgctcgccgccgaccgccggagagagttgcgcggctaaatttggccgcccaagcgtggtggtggtggtggtgcagcgcgagtgcgagaagagaagagaatggcacttgcttagatgagaatgagattagtgctcgtcattgtctgggtggttaagctgctttattacggttttaacagagccaatcaccgtgtgtataacgtgggatggtcacaggatggaggtcggcgcgtcgggacgtggcgttttttttttttttttgggcagacagaaactagtgctacaaaagccggcggcccactcgaatcgtcgaatccaaaggaacccactgctcctcgatgcggagccgcggagaagacgcccactcgtactcgtggggttgtgcgggcagcgcgcgcgcgccacgtgccgccacgcgtgtcgcggttcttgaatctttgagacgccatttcgtttcatcatttttccccctctacgcagaggcgccggcggccgtcgacggagccgcaagcggtaagctgcttgtttctctcggtggacttcaggcctcatcctttctcagccaaaatttttgaattttaattttaaatttaaagttgattttaggattttattaatcgtagtttatttttcatcctttatttttagatcattaaatacatgtatataaaagttgtattcacatttttttttcatttgcaaatatacccattttgtttttttctcttattcgctaaacgatggggctattcgtcttagaccattaagaacatgtatataaatcttagaccattaagaacatgtatataaaaattttattcacaaattatctttcatttgcaaaaatacccatttcgttttttctcttattagatatatatataaacgatggggctgttcgtctaaatgacagggctaccctgagcctgaggccagaccgccagaggaacttccctgggaagaggatcttctcatttactttcctcgctaatatatggatttgttagataaaagaatttatatgttagtgacacaagttacgtaagttaaaaagttccctatctggctgcccaggcttgacacctgctagaccgctagaaactatcagaagatcaaacttcacgctcatatcagctggagggaaagtacaatcacaccagaaataagcctggcatcacgttgaacaagccgttcaaccctgatcatgcgaaccacgagtagcaagggatcaacacgcacttgtttatccaaccaaaggggccgttgttagttgtaagtagtaactaagtagtaacgcacagtgatgggcgatatactggtgaataacaagagtgtctgataaaacatgagactactgtatcagataaaccattcattctgtgcaaagaacattttcatagtgctctctgtatcaaaacaagacgcgctactgagatcaaggggaggagaggagaaaaacgaag

SEQ ID NO: 14344 - DNA, 1501 bp, Oryza sativa
ataacttttaattaaaaataatactaatatatactaaatattatgcatgttatatcactatatttatattttaaagtactttcatgtaatgctaatttcatattcgttaaaatatagatattataattcaagatggaggagtacaaccaaacagtagaggatccacttcctctttatttatgccaagttattttagaaccatgctccacacaagacacgcacacatgcattgacatgtgctaattttgtttcgtgtggaaaggcatggaggccggttccccacaatgtccaatcgctgccaactctgcgagagagaagggggaggaatggaagcttgtgcatggcctaaacacacactttgacacttgactttgtgttggaatccattgattagccgctcaatgcagcatccccaatgcagaggtctcccctctactcctagctctttgcaaaacccaatgtccaccatttacttcaatttctcagtcttccttgctcatgtctcccttgcccttctctcaacttgggtcaacttcattaaatttctcctttggtatgtgcaaaggctttgaaggtgtaggcctggtgcaaacattgcaaagtcaaaatgtacggtacgatgcatcgagttactgacatggtaaatcttcccgattcccgtgtaaataaactactatttcattcgtttcatttataagatgttttaattttgttatgggtcaaacttgcttaactttgacatagtttattgaaaaaaataggttagaaaacttaaattcaggaaaaaaaaataggtgagatatcctagtataaccatcttggtttggttaagacatgccttagaatagacgagtcggtcgaaacggtcagaatcggtagcatctctttagaaacgacgctcaatcgacctgtaattgaccgtatttatcatttaaactattcattgtcaacattaatacaatgcaaaaagaaattagatttttttttataaatagtcaaaaatggtacgccagtctatcgggaatttatgtgaccgttttcacccctattcaagtgcatgggcacttgagttgtaaaattgacttgatcgagataccaacgtatatacaatttacacatcgaattgccgggaaattggactttgagatcattttagctccccaaggcgatccacacgtactctaccacaaaactttggttgtttttgctatcatctcaaggccactgcagcatgcgcattgcgcacgtacgagatgctactctttccaaggaaccgatgtctctctctctctccagcctccattgcttataaatatgttcctccttcctatactggtaatggcagcaaagcaaagaaacaaagaagaagaagaaagaagaagcagcagcaaaaaagttgatcagttaattagcaagtgtgttcttctttcttttggtgagagagagagagagagagagagagagagagagagagagagagagagagagagagatctcagaa

SEQ ID NO: 14345 - DNA, 444 bp, Oryza sativa
ccaaatcgccctttccctttgtattgcgtcgcgtcccgtcgggtcgggttgggtcgccactgccacttccactttcacttctcccccctttacccacgggcgcgcgcgcctctcctttatctggtggtggtggtggtgatgtttgggttgtttaccttggtttggattggattttttttttgtttgcagagttgggtggtggagcgagcgtggccgcgaggggacgcggaggggcggcggcggcggcgattgttcgcgggatgagcagcttcggcggcaccagctccgtcgcctccggtggtacgtttcgttccattgatcggtgttgaatgcgttgaggagggggggattgattcgtgaaatgggatgggattgatgctgtgatttgattgcgttcgtgatgctcctgattttgattcgaatgcgttgggggatttgggatcg

SEQ ID NO: 14346 - DNA, 1501 bp, Oryza sativa
ggagggtttgaataagactttgagaaatttgaatgaaggtggttacagaaaaaagtagtactctaaaattatatttttaagtataaatttatttctagaagagtaaagtgcatgggcggtccttaaatttgtagcggtgtgttatctaggtccttaaactctcaaaatacatattcaagtcccaacacttgtcatagtgtgtcatctagataccaaatcgccacagctccttcaggatcctacgtgccgctgatgtggcatgtcacacgaacatgacatggcataattttgactgacaaatgggactcatttaaaaattttcttttttctttttttttcttctgttgtattttcctttcttctcttttctctgtgacccgagtaggagagaggaaaaaaataatgagaagaaaacggaaaagaaaaaaaagaagaaaaaaaaggacacgtcacgtccatgtggcaggtcacatcagcgccacgtaggatccaagaggggatgtgtcgatttgggatctagatgatacactttgacaagttctaggatctgtatatgcattttgagagtttggagactgtcgacgggtgatacccgtagaccggatatagagggtattggggtacgttggtacaaggatctacgtagtacgacatcgaacaatcaaaagacaagaattatactggttcaggccccttggtaggtaatagccctaatccagtagatatgggattatatggtggaaaacacagattacaaagggaacgatggaacttgtcggatccggcgagatcgtagtcgagtggattcgactagctctcgatgacttggctccttgtagacttcggctttgtaggctgtgtggattgtgttggctctgagattcgatgatctatgccctccccgggggggtccctcttatatcacagatctggaggtctctaagtaggactcggagatatcagacccaatacgatacatcgacgacccagttctgtccgagaatgactcttcccatctgtagatttcgtgaaaggtttccttaggatatgtagaaaacatctgcgtgcgcgtgggtatgccatgtcgatatgtaacgtatatcgaagggtagagggtatgcctgacccgtaaccctgacagtagcccccgacttctgcttaaaatgaactcgtgcaaccatttacgacttcgggtgtcgagaacgttgtcattcctggtgcgaggaccgcggagatagaacatagtcgagcatgccgtttgaagcacaacggtcacgagtgaattttgaactgaagtctagaaaactgccgcgcgtaacgggcccagagatttccggcggggatctctcttcgttccttggaatttgcaccgtcggtagtgcgcttatttaaaggaattttgggagctcattttgaagtctaccaaccttgttgaacacacaccgcctgccagcgctccttgccttctccgccgccgcaagaaaccctagttcgccaactc

SEQ ID NO: 14347 - DNA, 802 bp, Oryza sativa
tgcagccctatttattagcaaatgattaattaagttttagttatttaaaatttaatttttttgattatttaatatttcaaagtaatttttatatacaaaatttttacataaaacatattgtttaacagttaaaaggtcgtggtaacaagaaccgaattatgtatgttaataagaaaaaaaaaggccctcagagacgtccatgcaccacgtacggtaccagtaattaacgaaaactaagtagcaggtttaacatttctaacagccaacaaattacatcaccagtctagctaatatgataggtttaaattaagaagcacacgacaaactacatcactgagtctagctaattaagcggcagacgtagccacgtggcagcatctcaagccaagacgagcagcgcggcggcggcaaccccggcgacgcggtggtagccgccgccaccaccaccaccacgcgacggcgagacgacggcggcggcgctggtattcccgtgcggcggcgtcggcggcgaccccgacgagtaaccgtaccccggcgtgcggtacgacccgccgctgtcgtcctcgtcgtcgccgtcgccgtcgggcgacggcgcaccggccggggagtcgccgccgccggcgcccttggcggcgtggtccgccatgacgcggaccgtcatcctctggccggccttgcagtggcccggcgcgccgctgatgaagtagaagttgccgttcctgtcgaggcggaacctgacgtcggcgccgtcgtcgaaccgctgcaccggcttgtcggcgctgcagagcttgtagtcggcgcg

SEQ ID NO: 14348 - DNA, 1501 bp, Oryza sativa
atataaaccagaccatagtacaatcgaaaaataggtgttgtattgtctcattagagttacaaaatccaactgtagaccataaatataaaccatgcattttcgttactaaaagaatatctccaaatggaaaattctttttgtgactttgtacacattttcttgacgtgaagaggcacatgcaagcccacaatgttggaagaaacgggcgccctcgacacgccaccaactaacttcatgtttatttgaggcatccatgcgcaaagtgtgcaatgtttttaggagatgactagagcctgctcataatttgaagcggtttttgaaattttaaatttgaagcatattttaaggtctctcctttataattaatgcagggatttcatagaatataaactaattcttcgcgcatgtgatttttgggtgtgtgtttagttcatgctaaaaatggaagtttggttgaaattggaacgatgtgacggaaaagttggaagtttgtgtgtgtaggaaagtttgatgtgatggaaaagttgcaagtttaaaaaaaagtttggaactaaactcggcctttatgtaaaatcctgcgttccaaattgtaatccgaagcagatttaatgagagatgcatccaatgatcaatacatactactagaccaacagggccttcttggtgcaatttttaaaagaagagcctagctcctttgaaacggatgaatttcatagtgggtatttggaggaaacgaacagtttccctgtaaatttgccgtgcacgattagcacagtaactgcaatttccattctttcgtttctggaaatgactcgatcgatcagaaagtacgctgctaaccggcgacgacacacatgtcatcccaagctagctaggtcaccatcaccaccgtcccaggagtcctctcatgcaaaaaggcattacccaccattaccagcaggaggtagtatggcagaaatgctggaaggaaggcccagactttgttcagtcttccaagcagggtagtagccgaagctgaaactgaagctcagctccagtgtcctttgcacccttccggcatcagcgacacggccaaggcaaccaccccatcgcttccctcccggtgcaactgcatcatctccctcgcacgcatctccaagcagataaagagatggtcgctactccgtagaagtagtcggcatttattgggcggcgacactttgcaccaccaagggtaggtgctcgccattataagaggcagcaatgtgcaagaaaccattccatccatccatccacctatcctagctagggagataagaggaacactcctagctcgtctactcctagctctctcgtccaatccggccggtccctgtcgcctcaaggagaatcatctgtggctagctatagatctttctctcatcgacgagcgcgagctgctagtataattaggcttgtgttgttgcagaggggagctgagagttcatcgggttgaatcgatcgatcggcaggtttgcgggca

SEQ ID NO: 14349 - DNA, 267 bp, Oryza sativa
attaccacctctaggatgatgccacgacataaatcttactccctctgtttttatctataagcatttgtacgtcatttaggagaattaaggttcacgaaaaaattatagatttatagcgtgtcattaagtgtgagttgatcgaaaatgggagaattaatgcttggtgtaagataaggaacaatttgaatactcatatagtatttgggacaagagggagagagagtagaccggaagggatagagattcgaatggaacacggactcccaa

SEQ ID NO: 14350 - DNA, 1501 bp, Oryza sativa
aaatactacaaacatatgctactttgccgccaaagggtgcccctccattccctacaaatcctcaaggagccagtcaaccagtcacttcccattccattgatcagcttgcaaagcaactccatgcccacaaatcacaatggctatagatttaaacatactagcagatgaagagggagatggaggggctttacctgacctcaatgaagcacaagtcaatctggaggaagaaggagaaggaaggcatgctattgaagcagaaggtggaggggttgtacatccttttgatctcaacttgagggcttttgatcttaacatggaagttgcaggagaacaagaacaagtgcatccaggtatttgacatcatgtaatctttctcaatgcataaatgaaatctttctcagtcaatgcttcaatgcattagtaaatatagttcaaattatactccctcatcagcacgcacccatagaatatgtgaacaaaacaaggactgctactgtacaaagattaccagttatagttgcattctttcaaatgatgccaaatgtgtaggatttcatattcaccaaaagaaaggcacatgtttacatgccaaatatttattgatggttagatggtcacttacttgtgaaattggatttgtgaaagcatatgcagcataactccacctcccaaccccagacaccatatttttgcacttgtttctgaaaataagcagtcactgaattaagtagctgaggaaaaataagaacttttaaaccactaaagatagagcaaaacaaggacacaaaatacattattgcataagcattccagacaccatatttttgcacttgttgtaaataagtaatcactgaattaagtagctgagaaaaaaaaagaacttttagagcactaaagctagagcaagtatgtaattaaacaaggacacaaaaatacattgttgtataagcattccagcaaatcatacctgccatactagcaagatgtatgaataagtcatggttcttgacatggaagagatagtactattgtgacctacagtcatgtatcatgactttgcaaatcctaaacttattcaatgttctttgtgtctacataaagggcactgaccaacaagtaattttttttttgtagataatgatcagcaaggcatgcagtatgacatggatgttaatgcaaatggaaatgaggaacaagaaattgaactaggtaaagttcatgactttatgatcagtgccgaacattttctatccttggttttaggattcaataaatctgcataatctgattagcacatattaacttaccaagtaaataattttgtagacgacgacgatgctttgcaacatgagctagaagccttggaggatgacattcaggattatagtgtgtacgctgatgctatcaatgttgtgctcgaagaaagaggagttgcccgactcagatgaagaagaaaatgatgcaaatgcaaatgagccaatcaatgccagagaattgacaa

SEQ ID NO: 14351 - DNA, 1501 bp, Oryza sativa
ccccgccccgatcgaagggccgggaacggcggcggcggctgcagaggcagagcaaagcagcgcggcggagcggagcggggaggaagcttcaccgcgcccccgccgccgcggcgggggggagatgtagggggagttgggcgtgggctgggccccgtcgcgtcgcgttcggtcgtggcggcggccagagagagagagaaagagagaggcttagtggcttcgccccggggtggtggtgtggcggtggttcccccgcgtcggtgatcgcagcagttcgcccccggtgtgatctgagccgccggcccgcgcgggcgcagcagtgggtggatctcggcctaaagtcgccgtggatggtgcgggtgcgcctccccgtcgcgcaagtgcggcgacggcccatgtagtggaagtgggtttgggccttgggcttctggcattaggcccattttgatgagaggctgcgaggtaggggtgttcttgggccaggcccgaatagcagtatttgggctgctgatattttcggttgagaagacagggacgatctttgatgcgacgtatggtacagtacgctgaaatatactgacgccgtaggggacagcgtccaggacgataataaaaaaattctacgagatctggatcgccgtatgttgtctctctacgatacaggggagtactgttggattgatgacggtgagtacatccccaagcattgatcagatcattggcatcactagtgatggtcggtgatagatgctcaacccaaattacaccatgatataatttttcatgcatctccacacaaaatttctacactttttgaagtgtgtgcgacctaaccggttaggttcttgtagtgaaacttgccaaccatcattaaaaaaaatttctacgcttttcgaagtgcgcctaacttaattggatagataaatttaagttatatttaatatggatgctcgtatttatgactaattatttttttaatggtagtgcaggcgatgcaaggtgtccgtggtagctttgtctcgacataaaccggcctagtcattctgaaatgctcgtagagataaggtgcacacgtatgtgttttacaaagatgagtgtgcagatatatgggtgttttgccgagttttcaaaaagaactctcacgctctttttttgtgtaaaaaagaagaagacaagattcatctgcattcgatgcgactcaatgtgtgtgttttgtgcgatctattcagtataggcatgctgtgccacgtaggcgcgccatgtcagcgagctccaaatccaggagaaccaagataaggctatccggaagaggccacgcggcgagctccctatggggcgtcggccatcgcgggagccacgcggactacgcgttccaaatccttaacagcatccgccgaattaagtctgtgtgcacgtacgtgtagccgccgccgcagatagtacaccggctatctatccatctatctactcagctttgcgtcctcccgcgaattcaccgcagcaa

SEQ ID NO: 14352 - DNA, 1501 bp, Oryza sativa
agaaatcgtcgtcaatatttctgattgggcatttgatgacccatgttgacgcctgacggtggcttattcaaataagagaattattctctacttatctctactattgtaaaaagtgaaggtgtttccaccagtactttggtacgtcatctgtgactgaattgatggtgcgtttgttttcttgggtcatatacgtccgtctctaactcaattggtttttgcgcttgccgccgcaacccacgaatacacactatgagtccatcagcaagactgcaagagcacgtagtcctaggattaattacaacaccgtttatctgtccagttttaaaccagtgatttctgtttattctgtaccggtacttatccaggagctaggaggagaacgttatcggtatatttgtgcttgtgcttgatcaacaggggatcggtgtaggattaattgtataatcaaatttttaattcaaaaaatattattaataattattgaaactatatcaaattatgaaagatagtctaggaagatcgcaaagtatttaaaggaaaatcttagcgttctcatttaccattcaatttttttttcgttcatcatcaatcaaaacatgggactataaggattttttttatctttggatggattttgatgtataagaacccgaataaatttagaacaaggggaggcagataaagaaataaataattcaaaaggaaaaatcatattcactttcaaaatttcgaattgagtttgaggaatttctggaaaagttcaaagtacggatctattgtttatcaaaattttagtttgttctgttgcaacgcacatgcattttttctagttagtatttaaaacgtagcaatttcgagaatcaatccacacctattaagtaagtactccctccattcctaaatatttacgacgttgacttttttaaaaatgtttgaccattcgttttatttaaaaaattaagtaagtattaattcttttcctatcatttgattcattgttaaatatatttttatgtatacatatagttttacatatttcataaaagtttttgaacaagacaaacggtcaaacatgtttaaaaaagtcaataacgttaaatatttagggacggagggagtataaagttgaagctatatgagactgcgtttaggagtagctcaatgactcgatccaactctgtaaaccgttgagagtccgtaccggtccatgtacgaagatgaaaccgagtcggcaccgatacgctacgcgcgcacggccaccggcacactgtcattaacacgtctcacactctaccctgaccgtccgatcagatcaaccaacggcccagatcacgccgctgacgtgtactccctccgattggtcggcagcggcacacatcagatcggagtcgggctcggcctcggccgccgcacgctgtatatatatcgcgacgctcgtatcgacacaaaaccaaaagcgaagacgacgatcatggcgcggccgcggcgcgcgtcgacgatg

SEQ ID NO: 14353 - DNA, 1501 bp, Oryza sativa
ctccggttccgttcacctgcatgcacaggtgtacatgcttccaaaactccgtccgcttgagaacctgcacgggtaggcgggcgatcaagtttttggggagcgctacgcgcgcgactgctcctactgttcgttcttgttcgtcttcgcctgctcttgttcttcctctgcatcaacatgttgaacaccggagacaacaacaacactagagataaggagaaggaggttcccgtcaataccaacggagacaatactgccacaatcctttactgttactgttcattcttcgtttcctgttactgtcaggcgcaatgttattgcgttctcatatctatgttgatgcttattttatattaagcatgctcaagttatttacatccaccactgtcactagatatactcaaattgcaaatgccatgtttattttcttaatattttggataaaaatatgccgaattatgaccaaatttccaacagagaccccactgaaccctatatccctcactattaaattgggctgcgatggaatgagatgggcttcccgtggtcgaagctatacatgggtctcacatggtggctgtgtgtgagatgggttgggttgtgtttaatctgatcatatgctgcggttttccatccaacggtttagagccgatctaatctacttatccaacggctgagaattgacgatgatgtggagcattgatatttgagctttaggatcataattacagttagtgggtgataactttatgtagtatgaagggatatataagatccctatagccataaggggtaatatcacaactgtgtttttgctacaccgtactctcttgttgctataattttgatgtaggacgtacacaggactattttgttggtacgttctgtactgttgccattttttgagatgccaacatgataagattattcctggtgccacccattctctgccaagcaaaaagctaagaaattaattctcctaaattcactcataaaaaataaaaaatctaaaaaaggagaacagcacaaatatgtccattaattaacttgtgtgcggtcacgactcacgagtatgcagtaatattggctaagctttggcccagctttagctttctttcttctgtgttccctttaggagtagccaaagacagcacataaagaaatactgatagtataccttacatatagcagctggctattcattttgtgtacatatataatttataattaacgtgtggggaaaaagttaaatatgtaagtcgcaaatatataatttggtgtggtactaaataaaggttttattttttttgcaaccccgccgctctgtttgacagtatttgggtatagctcattgtgcacatagattgatcaaactcggcaaagaagcataaagtcgaagaaaatattaatgagaaaagacggtaaataatcctattgggcatatgttcggtgcagcttgctacagcgtcggtacttcatgcaagcaaaaagtgagggctgcccc

SEQ ID NO: 14354 - DNA, 1501 bp, Oryza sativa
tgcaccgaacatatgcccaataggattatttaccgtcttttctcattaatattttcttcgactttatgcttctttgccgagtttgatcaatctatgtgcacaatgagctatacccaaatactgtcaaacagagcggcggggttgcaaaaaaaataaaacctttatttagtaccacaccaaattatatatttgcgacttacatatttaactttttccccacacgttaattataaattatatatgtacacaaaatgaatagccagctgctatatgtaaggtatactatcagtatttctttatgtgctgtctttggctactcctaaagggaacacagaagaaagaaagctaaagctgggccaaagcttagccaatattactgcatactcgtgagtcgtgaccgcacacaagttaattaatggacatatttgtgctgttctccttttttagattttttattttttatgagtgaatttaggagaattaatttcttagctttttgcttggcagagaatgggtggcaccaggaataatcttatcatgttggcatctcaaaaaatggcaacagtacagaacgtaccaacaaaatagtcctgtgtacgtcctacatcaaaattatagcaacaagagagtacggtgtagcaaaaacacagttgtgatattaccccttatggctatagggatcttatatatcccttcatactacataaagttatcacccactaactgtaattatgatcctaaagctcaaatatcaatgctccacatcatcgtcaattctcagccgttggataagtagattagatcggctctaaaccgttggatggaaaaccgcagcatatgatcagattaaacacaacccaacccatctcacacacagccaccatgtgagacccatgtatagcttcgaccacgggaagcccatctcattccatcgcagcccaatttaatagtgagggatatagggttcagtggggtctctgttggaaatttggtcataattcggcatatttttatccaaaatattaagaaaataaacatggcatttgcaatttgagtatatctagtgacagtggtggatgtaaataacttgagcatgcttaatataaaataagcatcaacatagatatgagaacgcaataacattgcgcctgacagtaacaggaaacgaagaatgaacagtaacagtaaaggattgtggcagtattgtctccgttggtattgacgggaacctccttctccttatctctagtgttgttgttgtctccggtgttcaacatgttgatgcagaggaagaacaagagcaggcgaagacgaacaagaacgaacagtaggagcagtcgcgcgcgtagcgctccccaaaaacttgatcgcccgcctacccgtgcaggttctcaagcggacggagttttggaagcatgtacacctgtgcatgcaggtgaacggaaccggagaagcagtagcagcacaagaacaaaggagtaggaggaacctgaagtgcaag

SEQ ID NO: 14355 - DNA, 1501 bp, Oryza sativa
cctccctccggctgacgctcgtgtgctgcttctttcccagcggctgccggcaataggcccgagggggcggaagtggaggaggctgcgcctctccaagccgtcgttatctccgccggccggcgagactgcgagaggagggaggagaggggagagagatggagaaatgaggaagaagaggagggctgggagtatgacaggtgggcctcacgtgggtcccaccattttttaatgtgaaactaacatgtgggtcccacgggttttattattttttccgatagaattgccacgtaagcgccacgtcaaacgaagaccgagtcaaattggccatgtaggcgccacgtcagccaaaaccaccctcaaaaccgccgagggacctaatttgcgccggttttgagagttgagggactcgttatgtctgattttccgtttgagggacgaaaatcggattcattgacaagtcaacggacctcaaatgaacttattcctttcggatatgccatggtcgtcggccttcgaatcctgggcggcccactttgcatggtggatgggccattatgtttagctaaggaaacagacctgattcggctggattcaagtccaattttagccaagtttgattcgtatcctttgaactacaaaaccatgtaaaaagatagagagaatctattatatgccactcgaaattacccggcttccatatatgctaccgaaaaagttacatttccttctatgccgttgggtttcaatttttatctctttagtgccactactgttagactactgttaagttggtgttaagtaggccatgaaaagacactagtgcccttgttccctctgttttttctcaggttcctctcactctcgtttctgttcttttcaccatcgtgcatattccatcaccgagacactaactgagctagctcctgtagtcccacactcccactattgtgtgacatcgtctgctcctctccatgcataccagagaggttgctaatatcggtgaaccacctccacaggctctgctgaacaagcttccgtaattaactgtaggcacacatttaattatccttgattgcaagcttgcagtcatttgatgtaaccattggcacacatttaatttgcatcaagggcacatatatactagaccatgaattaactatcggcacacatttaattattcttgattttagcttgcattcatttaactaatcatcttgattcgctgggagtccaaggatgaagagagtgctaggcgcatttcagatcgttaattagtgatagcatggacagaagagtgagggtaaaacagatataggaagaaaaatctaacatgttaactcacttaacgggagctagggtcaactgacttgacggtggtggtatcaaagggatgaaaactaaaactcagtgggcataaaaggaaacgtagaattttcaatggcttttaaaggaaatgagtaattttgagtggcatgtaagaaattttctcaaaaagatatcc

SEQ ID NO: 14356 - DNA, 1501 bp, Oryza sativa
ctcgcgacgcgagggaccccgccggcggcggcgcgaggaggagaaggagaaggagagagagagagagaggatgatcctggtggcgatcgtggcggagctgctggaggagtacacggcggcggtggcgcgcgccatggagctcctgctgtcgcgggcgccgccccgcatcttcccgcgccgcgtccgctttctcgtcctccggagcctccccttcgcctcgccgccgccgtccccgctctttcccccgccacccttcaccgtcgccgccggcacccgctgatcgatcgatcgatcggtccatgacggctccacgtacgtacggcaaccagcaaagacagtacgctggctgctgaagtagtctcgccttcgaatcatgaattaacctgctcgcgcgtgtgcatagttcaactcgtgatgtttgtagcagcgtgctagattactagctagttgttgtgttcttgcagcttagtaattaattaatcatttgcttagcttctgatcctgaaaaagcttgcatgtagttgtagcccagcgactgagttacggtcacgggctcacggccagttgactcggagcgagaagatgtgtgtaatctgtgtgaggttttgaattacttgaagaaaatttggagatcttgtttgtttttggctgctgatgtgttaaattggatcaaattcgtttgaaatttggacctttttctatataaccgcgcttccgcaggctggcgattcgcaatttttttctcggatcatttcatttcccagcacacaatcttctgtgctagtactaccgtttgcagaattgtgatcagtgtgggcccaccctctctgaactctgattcactagtatatttttgggtcgacacgttgaaccgccgattggacttacatgtgtgtctgtctggtgtggtggcggtttaactttaatcaaatactccctccgtaccaaaataaactaactcctatgatttaaaatttattctaaaataaaccaactcctactccctccgtcccattttaagtgcagtcatggttttccgtgcccaactttgactatccgtcttatttaaattttttctgaaaaaaattaaaaacataagtcacgaataaaatactatttatattttatcatctcataacaacaaaaatactaattataaatttttttcaaatatgacggacgatcaaaattgggcgcgaaaacttatggttgcacttaaaatgggatgaagggagtaccttcttacctaccatcaatccgcaaatcgagaaattttattacttcaatacccctcacctactcatcgagcaatacaaattttacattaattaagggtaatttgtttttttgtttcttttcttaatagttttgtgagattctaggattttattttattagggacagagagtttgattttattaagcccagagggagagaccccgatggtgatttatgcgatgaagttgagaatggacactaaccttttctttttcccgccagg

SEQ ID NO: 14357 - DNA, 1501 bp, Oryza sativa
  unsure (1)..(1501): unsure at all n locations
gacatacctagacaaggtagtagaagatgacgaggtccttgaggttcttgatggggaagacgcagtggccggatggtggagaccgaacggagaaggccgcaccgatgttgagctccgtcagatctgacgagaggcggcatctacggtgagaggaggcggcgtcatttgtggcgagaggaggaggctgaagcgacgtgaggcgccggcgcgagcagatgcggtgtgccgcgccggcgggcgacgggacgagcagcggcggcttgggcgccgctccagtcgagaagaggcagcggtgtgttgctcagggtggtggaccaatatccctagggtttgggggtattgggccgggatatccaccttcccgggccaagccgaatgcattttttgacaacccaggaattctttcccctcgtggtgggctttcccgaaagggccggggaaaaggccggtttacacccaaaccgaacgaagccgtaaggtggcgggaaaagtacacgcaaggtccctcaacttgttagccagatacaaaatcgtccctcaaccgcaaaaccggacatccggcgtcccccaacttacaaaaccggtcacaataggtccctcgcggtttttcaccctgattttgtcccacgtggcagctgactcagcgtgggacccacgtggaccccacatgtcagtaagccacgtcagcaccctatctctctttctctatttctctccttcctctcgctctctgctctcgcacaggcggcggtgcgcgcggccgaaaggtggtgcagccggcaacggcggctcccgggtgggggcgcgcgggctcaggcaggtgcgagttcgccggcctccccgtccccctcgtgcggtcggcgatggcggcgcgcggctgtggccatcataactgacgcgaagaggagggcctatcgtgtgtcggcggcggcggcgtcaccnacgcggtggagaagagggtcggcgcgaccgacggggaagaagcggcggagaggaggagcagcagtggaggccggcggaggcgcggggaggccggtgtgctcctcccaagtccaaatccggcggcgaggcgggaggaacacggtgacgacagcggggaggcacggggaggccagcgtcggagtcgagacgggacgaatgcgtcggcgttggctcaggggagcaaggcggcggtggcggcggtgagaggagcaaggcggcggtgtcagcttcctatccgtgctcgccgacgaggaggagcggcgggcaaccgcggcagccgagctggagccacacgcggggcagcggaagcgcggggaggccggcgagcggagaggtgatgacatggcttactgacatgtggggctcacgtgggtcccacgctgagtcagccaccacgtgggacaaaatcggggtcaaaaccgccgagggaccttttgtgaccagttttgtaagttgggggacgccggatgtccggttctacggttgagggacaattttgtatgtggctaacaagttgagg

SEQ ID NO: 14358 - DNA, 1501 bp, Oryza sativa
cgcggcgccgacatgcgggccccacatggcagtgactcggggggcggtccgcggtggactgggtccacggaccgggtaagggacggcgcaccatgtggtgcacacgtggcgccgacgcggcgcacacgtggcggccacatggcagccacgcgggcggcgggattggatggccccgatctaccctcgcgacgggagcgcgtggccggcgcgcacgggcggctcatgccggcttggtggccatggcgcacggcggctcgactcgacatagcggcggtgcaaagcggcgaccggctggcggcggagggcggcggcgtctcggctacgcggatggtgatagcgcggcctaagccgctaggcggcggcgcggcggctaaccggcgcgggagagagggagaaaggggaggaggtgcctcaccgacggcgattgacgacggcgagcgacggaggacgatgacgacagcgggacgagctccggaaccacctagcgaacccgatgaaaggggttagagagagagaggaagatggaagagagcgagaacgccggccgaaggcggcggccatggtggtgctcaccggcgcacggtgcggagtgggttccggcggtggattccgacggaggaggggtggacgggatgatccacacgacggcgaacgcgacggcgtcgacggcgcgactcggcatagcggctagcggcgaccggagcagcggcggcagcggcggcggggaggagggcgacggcgctagggtggtggagtgcacgggagcgggcgattgcaaaacgaaaaagagagaggagggaacgggggtgctttatatagactcacgagggttgatcgtggccggggagaccgcgatttcgccagcgtagtggggagaggtggggaggagagagaggcgggattcaaaaattgaatctcggccgtctcgagcacgagagcaggcaggagagagagggagtgggcgcggggaaggcgggcgcgggcggcgacgtgggcgatgtggcccgggagatgcaggagcgagcggggcggcggttgcgggatgcggcggcgccagctggaggtgggagacgggcccgacaggtgggccccacctgtcggcgacccaaagggggagggaggcgaccggctgagctgagcctcggcctttggccggcctagtggggagggggagaggaagagaatgggccggcggcccattcgaaaaggaaagaaaaagagggaaaaagaaagaaaaggaaggaaatgaatttccagggaattaaatattgcttgtgctcatttttaattggttaaaattatttctagagctctgaaaattccactaaaaatcttcttaacgtatttcgacatgtagaactgaagaaaaatcccacatgccagttccgattattatttgcattaattcctttagggtttctctcttgcttttacaccgatattttcttgagaccatttataaattcaatttaggcttgggaaaagaacttcagggagtgac

SEQ ID NO: 14359 - DNA, 1501 bp, Oryza sativa
tgaaaagaataaataattacttaaaatttttgaataagacgaatggtcaaacacgtacttaaaaagtcaactgtgtcaaacattttgaaacggagggagtatatgttttgtacttttgtaagtaagagtacttttgatttgttaatgcaactagcattagaggggtgatgcatccagatcaacaaagtgacaccaaactattgttgtataggagtaagagtttgactaggtacacttgaatttgacagaaccctggccggcaaaaactatggaagcatatgcgaattgcgcaattggataactccagataagaaagcgaccataataagtttaacaacgccactgttgaattagtttttgtcaaaaagcacatcactgctcacttgtcaagtcgacaagtcatcacttcatttctaatttttcctttttctttttgtttcttttctagtattttgaaatgaattgtggatggtgacgtggaacagaaaagtcacgcgctgaaaccgacgtgtaccaacgggaggagctcgacgtgtaggccatctggaatgatggaagaagaagaagtgacttctggttgggtaggcaaaggagttgctgctaagtaatggaaggggtgtttttgtaattttacaaggcggttaggacaagcaagatttggacacctgtcgtgtcctatgctcatatggtattaaaatatgttagttgaaaatcataatctaatgaagaaaggattagtttatggagtactagggctcttggttgccatgtggagtatttcagtgagtagcaagtgtccagtttccagtgagatggcacccatggatttctgtctcataaaaatgcaattaaaatttttgtactgcctcattcaatacttttatcctttttagctaatctaaacacaaactaaagcgtgacaaaagtagaattctctcttattgaaaaatgtgagtaaactttgtgattggaaagaagtcgtacaaaattggactgaattcatatgccatctgtatcaatacataaaccggttatcaagacacatttgtaacgataaaaacaatgtacagtacgtactagaaacatttcttggatcccatttcaataatcattctgacaaggaaaacaaccaaatgggcacaaacagtttcgctttcttgatagccatgtcgcagccacagctttgtttgctagaatgagacacccctgattcctcagccacatacttagattaagaaactaatcaccttcctcaatcttggttcctaatccgctataaaaagcagaggaaagcagaggagacaggcagagcagaggagagaaccccaccttggcaaaaagaaaagaaaaataatatcatcgcactttttgctgcccttttcatcccctcggatattcacgaagcaaatctctctgcaattcttttcttttttttttttgatcttgcggatcttctccattgaggaaaggcgagagctttgggatcgattccgggccatgg

SEQ ID NO: 14360 - DNA, 1501 bp, Oryza sativa
ggatacaagaaaagttgtacatgtccgcatgactgtatgtcccatgttatcaaatatatacatgaaaatctattatgagtgctaaaagattttaccagctcgcaagtattattacataattttttttcatgatgtatatctttttagcacaccaagtgtctccctagattaatatccatgatcaagagatacaaatctctactattataaaaattgaatgtttttgccggtactttggtacgtcgtctgtgtatgagtcgatttttaagtttgtttatttttggaaatacatatacgtatttgagttaatttttaagttcgttcgcttttgaaaatacaagttgtcgtataagaaatctcattaaaacaactcacatgctaacttaagacgatcagacttctaactgcagctcatgattttctaaaaaagatatatatttccaagcgaatttttacatgattttctaaaaaaaagatatatatttccaagcgaatttctacagtaaatttcaccttaagtaaaccgtataacaataataagattaaaataatcttcacccgttgcaactacgatttgaaggaaaaatatatggtatatagctaaaagatgagtgatatgttatctggtaatatactgtatccggttttaattttgaagaaaaatatatgttaggatacgtaccgtgatgtgactgtacccacctgattttcaccctaatagccatctcgtttggtatctaactagcaagagtcacgagctacgccacgtgcgtgggaattaatgtttgaagctgggatatcataatcaaaatagcacaagatatagtgtaacttttaagcattatatccaaacattatctaaaaaaaatcattatatcagaagcatactcacatatgcaaacacattacaactatacatcacaagattaaaggcgaatataatccatttgctcatataattatttttacaatcatgcacatttacagaaaagcaacaaccatagaggacaatggtgcttacgtgatgtgggagtatagattagaaaagtagcagtgttcaatcattaagtgatcaaagaattgcaacattttctcagacatcttcatcatgaactaattgaatatattcacatatagaactgcgccgcaaagaaaatttagtgctttagctcccaataaaaacaacaccacatcacattatgtacttgcaacagtttagtagatgaactggtacctcctttgcatagcgccactgagtactgaggtatcccatacataattatgtctaagggcatgtttggatatcattcatatattgccatgtgatgagtatatatgacaggtaggacaaaactcttttcaaataaactgtgttgaaacatctatgtcttccaagaaggggcaaacagaacaataataaattaaacagaaaacaaattaataaaatcatatcttgaagttggttgataatgaaaactctgtaagcatatttacaaagcaa

SEQ ID NO: 14361 - DNA, 1501 bp, Oryza sativa
aagttttttttgtgtggaccccactcaaggctacatagcactgtgaaatttgtggcaaatattattcttaggtgttcttggggctacgtggcagatgaggttcggcaaaatgtgttgccgcattgctaatgccctcaccatttttgagcttgaatgatgggagcttgaataaagtagacacacctgggagtatgtcacgtctgctagtgttttcaggagaagtacatctaccctaaaaaaaacgagaagtactcctacatctacacggctgacgtggtacaaagtggtgccgatctgacagtaatattgtaacgaggccgaaacagaaaacacctgctataaaagggacttctatgtgacttctggcctggtgtattggctttactgggctgtaatgccgtttgctgggtttctaattcatacaagtacttaagtccaagagggcatggtctgtatatgggctgagcaattcctttccaaaggaataagttcactatagatgtctcaatttgtcacctagcgtgaggctagcatgaaattcgttcgtaaaccaaaatacaagatataacgagttcctcaatttacaaaactgtagcatccgaggtcctagataatattatgcctagttttaactgacatggtatgctaagccagcgtgggatccacgtgggcagcgtgggatccacgtgggccacacatgtcagtgcctagcactttctttctcctcctctcccctccttggagcaagaacatgcccaacccaagacccagaactcatctcctgcctatgcccatgcccactattctcattggatataaaaaaaaaacatacccgttgagtatcggatacccatagattttaaaccacataatgtaatatattaatttatatatatggataatcggaaaaagatcctctgacttaattgtttttttagagaatctgacttaattgttgtacagttgagccactgacatgtgaaccataataaagtgggacccatatgtcagtgactcaactgtatgtgtagttaagtcagaggatctgcttccatttacaatcacatttagatatgtatgtttagccaataagtataaaaccacaaacaatcaataccacaagtcataatcattcacatagtattaaatgcgggtaaaaatccgtaaattccacaattacaaattatttcatcacatagaaagaaagcagttgattaagccattaatagtattggtcatgtcttgatatataagaagtacatcatttgacacaaactcctacaaataacaaaaattaataacatatactatcatgtcatcacaaataatttcacgtattccctcactttggcctccttattttctagctagcaaacaataaatatccattaaacatagtgtatattagtatattatgcattaaacattttttaccgtgctcctaacccaccgcatgatacatctaataaacttgaaaattgtaccaggaatctatctatct

SEQ ID NO: 14362 - DNA, 1501 bp, Oryza sativa
gtgcatgtgctcgccccagatgctctcccacacgccggacgactcgtcgtagagccccgcgatgccctccttcagccccgggggagctgccgccgccgtcgacgacgaggacaacgtcggtgccatcgcgcgcacggcgagtttcgtcctccggctgctgcggcggcggcggcggtggtggtggaggcagaggccggcgcgaggggaagccgaggcgcagagatgacggctcgtgcagcggagcagtggatgcagcggtgccagtgcgcccgtggccgcggcggcgtgggccattttgtagcgctctggcgtctgaggccttgacgttttcttttctttttattcgctcgcagccaagccccggcacgagcgcgcgacggcgcaaggatggtagaggccagactgccaagtgcggggtaagtcgactgagagcggattggaacataagtagtaattgtattactagtatatttttctgtttattttgagatggagatattaatatttaataaattagatatttttattggtacgtgaaataggtaaaagataggattattttgagacgaatgaggcactgcactgcacagtgctatagcactctgtgtttagggaggattgtagagggctgtaagtacggggtaaatctactgagagcggattagaagagaaataattgtattactagtatattcttctgttcactttgagacgaagagattagcatttaataaattagagatttttattggtacgtgtgaaataggtaaaagataagattattttaagatggatgaagcacgacacagtgcgtttagagaacacgcgacaccacaccaaaataaaccaacatcatactagaatgtgatgatgatagtataagtctataccattttaaaagagagcaatggtaggggcattgaatttgccagcactacccccttcgtgacgtatgggttcataggtttgacaccccttaaataagctcttttagttgactcgaagtttatgcctatcaatacattgatcgtattgtgtcattaaatcttaacaccaggtaggcattatatgccaaatggatttattgtgctaaaaacttgtaaattttaccttttttcttttataatatccattacaacgcattgatattgtgctagttatcttaaaataagttcacttatatccctttaactagtatttgctatgtaaatcgagaagttttatccattcagtactttttactaaccttctcgtactattttcttattattaaaactagcatgatggcccgtgcagattgcgcggctagcatcattatattttctctcatataatagcatatatgttttctcattatattattcaaatatattaaaatgacattgtcgaggagtaatcctctctatcgggagatcgtgagatccccttttgtgagttcggctagggaaaagggctcgcctctagagatcgcgtatccgccctaagtcttgctagtcgcgta

SEQ ID NO: 14363 - DNA, 1501 bp, Oryza sativa
tagggtgggtccccaccctgtagaagagtaggtagaggcggtgcatgtggtttccccttgagctataaaaggaggaccttacccaccgagaaagacgacgactctcaggaagcctgagctctaggagaagagaagcgagaacgctctccggagtttaggaacccttgtaactctcaaccttaaatcccacacacagaagtagggtattacgctccatcgcggcccgaacctgtataattctcttgcccatacgcgactagcaagacttagggcggatacgcgatctctagaggcgagcccttttccctagccgaactcacaaaaggggatctcacgatctcccgatagagaggattactcctcgacaatgtcattttaatatatttgaataatataatgagaaaacatatatgctattatatgagagaaaatataatgatgctagccgcgcaatctgcacgggccatcatgctagttttaataataagaaaatagtacgagaaggttagtaaaaagtactgaatggataaaacttctcgatttacatagcaaatactagttaaagggatataagtgaacttattttaagataactagcacaatatcaatgcgttgtaatggatattataaaagaaaaaaggtaaaatttacaagtttttagcacaataaatccatttggcatataatgcctacctggtgttaagatttaatgacacaatacgatcaatgtattgataggcataaacttcgagtcaactaaaagagcttatttaaggggtgtcaaacctatgaacccatacgtcacgaagggggtagtgctggcaaattcaatgcccctaccattgctctcttttaaaatggtatagacttatactatcatcatcacattctagtatgatgttggtttattttggtgtggtgtcgcgtgttctctaaacgcactgtgtcgtgcttcatccatcttaaaataatcttatcttttacctatttcacacgtaccaataaaaatctctaatttattaaatgctaatctcttcgtctcaaagtgaacagaagaatatactagtaatacaattatttctcttctaatccgctctcagtagatttaccccgtacttacagccctctacaatcctccctaaacacagagtgctatagcactgtgcagtgcagtgcctcattcgtctcaaaataatcctatcttttacctatttcacgtaccaataaaaatatctaatttattaaatattaatatctccatctcaaaataaacagaaaaatatactagtaatacaattactacttatgttccaatccgctctcagtcgacttaccccgcacttggcagtctggcctctaccatccttgcgccgtcgcgcgctcgtgccggggcttggctgcgagcgaataaaaagaaaagaaaacgtcaaggcctcagacgccagagcgctacaaaatggcccacgccgccgcggccacgggcgcactggcaccgctgcat

SEQ ID NO: 14364 - DNA, 1501 bp, Oryza sativa
tggacactctactcatggtaccactagtatgattttaggtagatgcttcgctggttaattaggcaacattaggtggttttacaactctagactttgggaatattctcatcacctggacactatggaatggttggattattgtggaattggattcacacctccctctctattcaaaatcctcaaaatggttttaggctgggctcggggtgcatggttttgatagtagcacctcggccatataaggaccggtcttcaggcctctgttgcaaagcactatcgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctaggggctcagtcctgcctacctgtcccgggggttccggccgtaggtggagttgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgtttttaattcttaaaacctgcctaacaactaaaatgtggaatggttggcctgggttggcttgggatgagctgggacccagggttgggttgccagttcggtctgaatcatagtaggccttgggttaaggcaggttcgtgtgggttcacggccttgattaataatcttgtatagctctaggatcgtatttacaaaatagctttgagcaactaagtgtcttttaatgctgtttactgcaaaccctaacaccctatattatggctcccttgtactcccttgcatttattctgcacttgtgggtgtgtcttattgagtacggtggttgtactcagtcttgctcaatttttcccaaacccataagaggagttcctggaagatgaaggctttggtgtctagctcgtgcctaccgtcaagcgcctgtggtcgtcgccctagtcttccgctgtttttcgtttgtcttcttgtgtactgggccttcgccgcccatgtaataaattaattaattacgcttccgcttgttaaactctgaattgtatcaacttttggtgtaccttgcctcctgggacaaggagtaatacacgcacgtaaggaacgcccgttgggttattgccagtcgtgacgttctatcgctttaaataccaaccgttgccctcgagaaacctcacaccgtgacttctattttcaccgctcaagcgaaactttgtcctttctctctccggcgattcctccgacgcaaaagcgatccccaggcgatttcgcttttgatcagatctccgcgtgcggcga

SEQ ID NO: 14365 - DNA, 1392 bp, Oryza sativa
agtagtcgtaactcgaccactagaagcaaatgtacgagagattactacgatcaactggttgagaaccggtgagtaggtgtccctcgatcatttggagtcgtggtacgaggaccactacgctgccggtcgaagaccagtcgtagctgttcctcaaccatctgaagtcatggtgcgaggaccgctacgatgccgtagtcatacctcgaccatctgaagttaaggtgcgaaagattgctacgtattggtgcgagaaccagcgtgcgagcagaattatctctcgaacaccaatggaagttgcggtgtgagagattgctacgtactggtgcgataaccagtgagcgagtaaaattatctctcgaacaccaatggaagctgcggtgtgagagattgctacgtactggtgcgagaaccagtgagcgagcagaattatctctcgaacaccagtggaagtgctagagttggtttattgcaagtgtatctcatgtggccagcatgactcacgtacccaacttatagcatatccggatgtccgttcgcaatcatgtcgggtgatcaagccgacgacgttcgcaaggaattatccgttaacaaccttttctcaagtagtccagccatggccggtgctatgagataggtcgtcggtctttgttggtaggttgggtgcgataactccgcatttgtcgagaatgttctcgataatggagtatattcgaccataacctactcgagtgctcaattgttcttgaaaaatattttctagaaggcaagatatatagcagataatatcgagtatgtactcaaagaactgcatggatcttctagtattatcaggatacaataagcagatgtaaatatcagggcattatgtaaaccgtaaacaagcatgatttatacataagagaacggagtgagcccccagcgttagaccgtagttggtctatcgtcggaagtactcgcacaacggatgttgtataagaaacatgctctaggtaaacataataaattgctgatatgataatgttgtatcatctgaataggtacgataaattgcatataaaatattacgtacctttgtagatacatgccggatgtatctacgaaattagtagatcaatttgaaaaaccaatctaccaattaccttattgcgtactcgttcgacatcatatgatctgacatcttttggtacggcgcggagcttgaggcttgggtgatctcgatagaccaagttgtcgatgacgatgatggttctgatcttgtcggaagacatgttccggtcgggttagatctccacagccgaagtcgtcgagtagtttgctattggagaatccatctcttaaacccatctcgtcgaaatcctgaagcaccaaaatccctctacctggcgcgccact

SEQ ID NO: 14366 - DNA, 1501 bp, Oryza sativa
ccggtcggccacggcaggggagcgcgcgggataccacgggcggcggcgaaaatcgaatcgcggcagccggaagatcaaagagagggagagagaacaaagagagagagggagggagggagctctcccgagcggctcacgtgcggcgcacgtgggaaggggagggggaaacgggctgagagaggagatgggccgagggagggaattcggcccacaaaagtagagggacggattttgaacttctgctgtgagaactggtttggaaggaaaagaagtttggaattggatttaactttgatatttggtctaggaacacaaggtggagtcaaggagatgtcaagagagagattcaaaatgagaatttgatatttgcgaaaacagggacaagtatttggtgaggattcaaaggatgcgattgaattcggtatttgacttcggaagttgaatcggaattgaaatcttggggtggaggattttgatgtcgacgagagggaacaagggatatgaattgagatccatggcacgacttagactctcactcaaagaacggaattttcgcaattaggattttattaaactagtttttaacgtctcgctgaaagcggggcattacatcaaggcacgcccagtcgacatgccatatggtgctttgtgcagccactgcgcctacggcccagacatgactcaataagactcgggtcatgccgtgtcgatccgaaggcacgatcattgcatcgtgctcgtccttggaataagtttattttgagtccctcaactctttgggccatgtcttatatggttagaaataagtctattttgctctctcatctctttgggccggacgccaatgagctacggcctgcgggagcatatggacggcgacgacagtgaggcatcaagcattgggagatgagagggcagagagagtgaagagaaaagagagggagatcgggataaaggaggaagagggggctgagaatgacatgtggggccatgtgggccccaccatttttgattagtttatgtgtgaaactaacatgtgggtcccatgaggttttattttttcgggtcacattgccacataagcgtcacgtccatgccatatcagatgaagactaagtcaaattaataacataggtgccacatcagccaaaactgccgagggacctcatgtgcattagttttgacagctgagggacccgttgtatctggtttttcggttgaaggacgaaaatcggttcgttgataagttaagggacctcggatgaacttattcctctttcaaaccaagcccagttaccctgctgtacaaatgtcagcctgggcctcttctcctcaacccgcccagcccaatttccgccacacacgtccaacattacgaatacaaaattttgaaagatggcgggaaatgaaaacacgtcgatctccgactccgactgcgcctgtgaacgcgtcgatctccgactccgactgcgcgtgtagactccgtttcatattcaacaac

SEQ ID NO: 14367 - DNA, 1501 bp, Oryza sativa
ttcctctggtaggatccctttctagcacttgctgatctggaaatctttcgctctccctcggtgccgctactttctttggttggtcgctcaccgaccttgctggatgaccgaccatctggagaagcgtgacctcccgcacccaacccattgtgtcttttgcgactagagggattataaaagaacgaagggattaccttgattcacggtcttagctttagagtaaaataggtgagcagtgcctccgggctccagcgtcggtggcagcgaatgccgccgccacgttcaggactccacctcaacatcaagcacaccatatcaacctatgcctccgccagcatcagcttgccgccgatgcacgccgtcgtaacgacatcatcccagggacccttgagcgtcatcgctagggttccacatttcggactgaaatttttgaaattttggtaatttgggacccctctgatacgatattatttcagccggaattttcaattttttaattttttcgtgaattttggtaatatttgttcacatttgactaaattttgttccaaatttcaggatcgaaattttcaagattttaccatatcggagccgcccaatctctagaaccgatttcaaggaccaaactctagcttcctattgggccacgtggagccctctaaatttggcaataccccctccaggaatccgccacgtgtccatttggaggaaagagcctggacgtttcatcgtgaaatgaaaaaaaataataaacgaaagaaaaggtgcattggcgtgtacagccgagtcacccgtgcatgccatggggcatggtggtccagtgcggttgctacagcagcacttgcattgttgccttctcaagctaatggtgcacacaaagccaagcataaataggataaaggaaagtaaagaaataacaaagagaaaagtataaataattttgcaaaatttatctgaataaataaaatacattatggttaaaaccgaaaattgagtcatattgatatcctatatttctacaaaataaatattaagaaaactatatacagaaatatggtgaaagtttggatgaaaaatttgcaatactaagaaataatatttcttcgaatgtgcattttattattgataccatatgcacgattttttggttaataaaattgccacaattttgaggaaacgttacgttttttttctaatagcatctctaatcatttgtccaattattggcaaacactaattacatcatactttggtttttctcatttatctgggacaaacattaaattaaattccattcttctgggacaaacacaaaattagtttccattcttttgaaagattttttttatgggttaaactaacttgtgtaaacatatattacttcatcagttccaaagttccaaattactggtcattctcatatttcaatttttagatcatgatcccatatctccacctttcatcaatgccacatatatccagtaatcaaagttaacattac

SEQ ID NO: 14368 - DNA, 1501 bp, Oryza sativa
aaatttgtcttgtgaattagcttttatttatgtaattagttttgtaagtagtctatatttaatactctaaattagtgtctaaagacagggactaaagttaagtcgctggatctaaacaccaccttaggccctgtttagatgggactaaaacttttaagtccctatcacatcggatgtttgaaaattaattataaatattaaacgtagactattaataaaacccatccataatcttggactaatttgcgagacgaatctaatgagcctaattaatccatgattagcctatgtgatgctacagtaaacattctctaattatagattaattaggcttaaaaaatttgtctcgtgaattagcttttatttatgtaattagttttgtaagtagtctatatttaatactctaaattagtgtctaaagacagggactaaagttaagtccctggatctaaacaccacctaaaacttttaagtccctatcacatcggatgtttgaaaattaattataaatattaaacgtagactattaataaaactcatccataatcttggactaatttgcgagacgaatctaatgagcctaattaatccatgattagcctatgtaatgctacagtaaacattctctaattatagattaattaggcttaaaaaatttgtctcgtgaattagcttttatttatgtaattagttttgtaagtagtctatatttaatactctaaattagtgtctaaagacagggactaaagtcgttggatgtaaacaccacttagtcgctcgctacctctctctctccactcgtttctctgtcacctcaccacatttactaccgtggacacactatcgctagctaattttgtctattgtaccgttactctaacaagaggcatatatatcctctttcctcaaaagaggcctactccttatttgaaaagtttcaacgcactttctttctttctctctctaacaaatcaacgcataatcttaaatttcccctacctatcctgtgaggcatctaaatggctactttgcacaatttctatgatttttcctatagaattaaaaagccattacattttaatcctgcgtttttagaatctaacgtttcaaaggagtattacatgtaacttgaactatagatttaatcaattccactcatagttcaagtacaatgatgtgattgcttggtttgtatccttattttatcaaacttacaccctctgttctattaaaacaaaatagtaacttctagctataaatctggaaatacgttatatacagattcatagtcagaagttggctttttcttggaatggacggagtatgtgttaagacttgaaggactgctttgattcaacaacatcaataggaattgtagaggagttgaaagttttaaatttacatacatagtctgttgtcgatttaaatttaaaactttcaaatcaattttcaaaagatctccctattttaaaactttcactccaaattttgaaactaacaa

SEQ ID NO: 14369 - DNA, 1025 bp, Oryza sativa
aaaaacgaatttatatatcttttttcatttcttctgaggttaccatagccatttttcaactccatgaacaaccattgctaacatgtcataggagtttgccactgcaattacatttttttcatttattctattggggtgctcgtcatgtagtgggagagttcatcaaattgggatagccactgcaacttaaactgtcatataggcaccggtggattggaaagtaacggccaagattttccttggaacttttttgacaaatactgtagctggatgtttcctgtagcgcgaacactgtagcaaaaactttttagaaccgatgtggcacagattttaaccgttggtcgtatcaaggtgaaaaatgattccgactgcttaagttggagtccctactatagctgcagtcgatccttattcgagttcatcacggtttcgagagacaaacaaattagttattacaaagttaacaaattgattaatagctcaactggttaagtttttttttaaggaaccaactcaccaggttcaagttttagatttgacacgagtactcatatttatggcaattattttttttaggtgatgtatccgtcgatagtgatacacctataattacttcgtcaatctcaagatataccggtgtagtctttcggaggtgcacacatgagaatgatgtgtggatgtgtgcatttatagggtgagtatgcgcgcgttgtgagtatttgtgtttgtactatgttaaaaaaatagtttaacaagttgatttaataatgttttttaagaaaatactgtcgaacaaagttttaggagaaggcacatcatttagtagcatgttaaatgctgtgactataataattcctaattaaagtgaacgcgcctggaggttgcaatcaaccaagttccgacggcaatatctgtatgtacgtctaagctatagccttgactataacagaactgctggtcatgtcaaagaattagttaataataatggaaagctgagagatacgaaacataatttgccgggtcca

SEQ ID NO: 14370 - DNA, 1501 bp, Oryza sativa
gaatctttctttaccatgctattgctcacacaccacaatcttcttggtacttcacttccaccactgctcctttcttcctccaatctacgctcttcggcagaatatcatcactgctctctccaggcattgctctgaggaattgcgacatgaggtctgaaccccatcttcttggctctgaactcctcgttcgtcaggtcggcgaacgtacttcttgtcagccagcttgtagccattgcacatggagttgaacttctcaacaagctcaacgttgctcctgtacacctcgaacctcctctgcttctcgtcggcagtcgtgcagctcccggcactgcgctcgcacgagctctagctcgtcggagacgggcggcgcgccgcggccccgatctcctccacgagcccccgcgcggggtccgcgccgacgccgtgagcgaagacccagcgctcccgccgcgacgccctgcccactgcccttctcccacgtcgccggccgccgccgccggacctccccgtggccccgtggcgcctggagggaggagaggggagagatggtgagagaggaggaagaagaggaggggtgacaatgatatgtggggccatgtgggccccaccattttttaattcattcttttgttgaaactgacatgtgggtcccatgagatttattatttttcggatcgaattgccacgtaagcgctacgtcaatgctacgtcagatgaagaccgagtcaaattagccacgtaagcgccacgtcagccaaaaccaccatccaaaccgccgagggacctcatctgcactggttttgatagttgagggacccgttgtatctggtttttcgattgaaggacgaaaatcaaatttgttgacaagttaagggaccttaaatgaacttattccatttcaaaatattctgtgagccatatataccgtgggcttccaatcctcctcaaattaaagggcctttttaaaatagataattgccttctttcagtcacccataaaagtacaaaactactaccaacaagcaacatgcgcagttacacacattttctgcacatttccaccacgtcacaaagagctaagagttatccctaggacaatctcattagtgtagatacatccattaatcttttatcagaggcaaacgtaaagccgctctttatgacaaaaataggtgacacaaaagtgttatctgccacatacataacttcagaaattacccaacaccaagagaaaaataaaaaaaaatctttttgcaagctccaaatcttggaaacctttttcactctttgcagcattgctctcttgctcttttccaaccgatccatgtcaccctcaagcttctacttgatctacacgaagctcaccgtgcacacaaccatggccacaaaaaccctataaaaccccatccgatcgccatcatctcatcatcagttcatcaccaacaaacaaaagaggaaaaaaaacatatacacttctagtgattgtctgattgatcatcaa

SEQ ID NO: 14371 - DNA, 1501 bp, Oryza sativa
aagtttacacctgaaagctatagctagctaggttgaatcaagcgagacgaccagtcaccaacaaaaaggagaaacgaacaaactgaaaactcaaagcagctgacgatgcattttgagtcgtcagagccggaatgcacatgtgcaactaacaggaaagagagctctgatcagcgatcaccacgaatacacgatgatatgagaagcgatcgatcgaacatccggcggcggagtcggcgtcgccgcgctggaattgatcaatcatccgcacgcacgagagacgccgggtcgccggctaagcctgcaacaactcgtagatggatggaccagtggacacactgttaggtagttgaagtggtatcattttgttcagaaaaggcatagcaggtaggcagaagcagaaacaaacaccagctttcatcggggggctcatctctcatggccacatgggcaactagtagacactagacagttcagaaacagcagcaatggcgactcatcatctcagtgaactgaactgttttagttagctagctagcttacttgctccgtttcttttttccagtttctggaagctaattaacctgtgctatctaactccgattcttttgtccccagtacactctgctaactgcaggctgcttggagagatgctaagaattaaagaaactggatggtgcatcagtgcatgtggccggtggccttctgctagctgcctgcacacacgagtagaatgattgatcacttaaatcacttttgtcatttgacaacgagatttcaccttcggagttgccaatgattagcacagccaaagtatgaactggtaatacttcacgaggctgggacgagtcactttttttttagttgacgaggatttttttttttttaaaaaaatggaagttaaaccggttaaccaggccgattgctagcagtctgaaggcagatgtgaccattaaaccggcccaacatggacgttgctcttgggcggttgggcctgaatattagacccaattgggcccaaacagtaggcccatccgtggcccatagcggtaatgttggggctaccaggaagtctacattttgatccagatttcaaaaggaataagttcatctgaggtcccttaacttgtcaacgaatccgattttcgtccttcaaccgaaaaccagatacaacgggtccctcaactatcaaaaccagtgcagatgaggtccctcgacggtttggatggcggttttggctgacgtggcgcttacgtggctaatttgactcggtcttcatctgacgtagcattgacgtggcaattcgatccgaaaaataataaatctcatgggacccacatgtcagtttgaatgaattaaaaaatggtgggtagcattctcacacctcctctttccccatctctcccctctcctctctccagcgccacggggtcacggggaggtctggcggcggcggccgacgacgcgggggaagggcgggccgtcagtggcgggagtgttgggg

SEQ ID NO: 14372 - DNA, 1501 bp, Oryza sativa
ttcagtcactttttttctccatgtgattgctcggtctcttatatgtatatgtatgttttcatctctcctattttctatttcaagtagataataaattacttgaatcctaattctctcgtacattgtgcattagaaaaattacaatcataatgtcgacgtttgatgtcgcgatttcggtatttgcatattatggggatcgttggaactaggatatacgcgagactgagataaaagatatggggacagagatttttatacaagttcgggccccttaattgtcaggtaataaccctacattctgttggccgaagccggtattactcttattcaccataatcacaccagtacaatatttggagtagcctatttaactgttgtcgacatggcggtctgaaggtctgactcgtagtcgataacagggtcctcctcgagttcgtgcccggcgagatcaaagatagcgctttcgtctctcctgacagtatccggagacaccataggggactagccgtgcctatcttcgaagtcgatatccagcgtcttgtcttggcgtatgttgatattgtgtcttgatttattgtttcgtgtcttctatggtggttgtgtgttgatcgtctgtgtcccctctcctcctaaggggccttgtatttatacccataggtgtccccttgtccaaatagaaccagagaaaccaatatggatacaatccgagtagtccttgtcgtttccatgtagaaatttggttatccttccttatgcggaactcctcctatatccgaaggttgtttccgtataagacatagtatgtggtgggtcctgccgagatttagtcaattattattaggtatgtggtatccataacactgacacataatattgaaacttaccatgtaattatagcgtgagttttgatactttcagttacaaatataagtatatgtaattcatagttgtaaatatagctagtttcgagggaggtcaagcagactacacgcagcaagtcaacactgaaaaggagagtggcgatgagtcatgggcaaggccaatgtttgtgactcaattgacaataagagtaggaaccgctgaagatagcaataactatggcaatgtctgcaatggttaagctcatggaaaaacacaaggtggtcctaccgaagaaaaaaaattacttcccaaccatgcccaacaggcaaagagcaatgaaaatattgtattatattccttgtggtagcaccttaagcttaagatcattttttgttgcactaaacttatcatgtgctcacacaatggctaaggtgttatactattgcagtatttaatgcttaaggttaactttttggatacattgtggttgcctgaggccgcaagcatcagccgcgccaccgcccgtcctcagacctcaggtgcggcgagcggcgagcctgtgacttgcaacaagttcccgtttttatttaagaagaaagcagttctcattttttttaagaagaagagagttggtctaaac

SEQ ID NO: 14373 - DNA, 571 bp, Oryza sativa
atcaaatatttggacacatgcatagtgcattagatgtggagaaaaaaaaccaatggcacagtttacatgtaaatcgcgagatgaatcttttaaacctaattacgccatgatttgataatgtgctgctgcattaaatatttgctaatgatggattaattgggcttaatagatttgtctcgcagtttacaggcggaatctataatttgttttgttattagtctatgtttaataattcaaatgtatatccgtatacttaaaaaataaatttggcacacgaactaaacacaacctcggtttatataagcagttgagccaccaccttataacttagtagttgtctgtggaacatatcaaatactcccttcgtccaaaaaaaaataatcaagggtttgaacttggacacacactgtaaatcagatcaaacaacacacaaaaattacatgtctctatcacaatgttccatagcaacacacatttccaccacaaattcacagaaaattatctatttaataaaattggcagcttaccggttcgttaaaaaaaacaaattcacggaaaaaggtgaagaaga

SEQ ID NO: 14374 - DNA, 1501 bp, Oryza sativa
tttctaagccgtggatgtctcaccaacttgatcggaagttcagttcccagcagttgacgtttcttggctaacacagttcgttgtgttcttctcatgtactccagctaattaattaaatcgtcttgtcaagaacaaaaatgtgcctgcatgcaggcctaattaagaaattcgattgagcagaactgtactgggttagtttgtagtatactacttgaagagaaattagggatgacaattgatgtttaagaaatgtcctattggtccatcaaggactgcatcttgcttttgcttggcactccagctaagaattttcgtgtgccggcagagtaccacaagctttgattgatgcctgatgccttaaaagtcattagcaaaatcaatgtctgcatgccctgagtactatctgttggcaaaaccaaggaggctaattacgccctttataatttgcacacgctgaaactctcttaatcacagcaaattattcgcttccggcgtattatgcaccctaccttgcattgcatctacagcttacctaacaattaaaatggagcaaagcaattctgcaactaactcatttgtctgaaataaaagaacaaatcaacatcaaccatccatgtatagctaagctagcccatggatgcagagatatatatttatgaccaaaatgaatactcctactacacaagatctaatccacatgcatggcatatcaattcaaaatttgaaatttatgcatcataaatttttatattataatttgtgtacttggtcggcatcattgaagggcatcagctcaacctcaagcaacaaccatcacccatccatccatccaagccgaccaccaaccagagcaaacaaacaaatggtagtacaccaccagtggcagtccacgtaaataacatccaaatcgaggccccatctcgccgccgctctctataactaaaagaggagaggacacctcacccctttcctctccctggctcgctgacaggagcaaggtgggagccagccaagctgccaaggtctcctcctcctcctcgctcgtcgattctcctcccatcagcggcgggggataattgatagcgcagacccgtcgatcgatcgacatttcggaatttttgatcaaaatttagaagttttcgttcaaggctatttcgattattacgataaaattatataatattaacggaggctaaccgaacggcgatggtatattatactgtgagttaagcaaaatgaaatgatatattagaacttgacaaactcagtgacatattgtaaaatatggataaaattatggttgttcacttaactacctatttactactccctccgtcccaaaaaaagaatctaagaccatatgtgacatattctaatgcaataaatctggacaaaggtatgtccagatttatagtactatgatgtgttacatgcagactacgttattttttaggatggagggagtatggtgcaacatttttagagaaaaaaaccaaatatt

SEQ ID NO: 14375 - DNA, 1501 bp, Oryza sativa
gttttattattttttcggattgaattgccgccacgtcagatgaagaccgagtcaaattagccacgtagacgctatgtcagccaaaaccgctatcaaaactgtcaagagatctcgtttgccccgtaagttgggggacgggtcgtatctggttttgcggtcaagggacgaaaatcggactggttgacaaatagagggaccagagtgaacttattcctttttctagtgattaaaaaaaagtaaagccttcatacattttagcccatttatctgccacacgaggaagctacggagtactcttggggcccgagagagtggaccttttaaatgaagcccagtcggatcgcacggtagcccacccacttcttccatgtcctcctgtgccgagaagcagaggaaccaatcccggcgagggcgcgcacacagcggaatagcgcatcgcctcctcgccttgccaccggcaagccgcgcctccgcctctccaatggacgacgcgccatggcgcgacctcgacgccgacgtcctccgcctcgtcgaccgcagccgcatggcacgagtctgccacaactggcgcctcgccgtcgcgccgcaacagccgctgccggagacgaggccgctcccatcgatcctcgtcccgcgcgccgacggcccttccttcgcgtcttgatttgatatggtggttgttgatttgcccagttagggcagttgatgatgcgttctcgagatccatgtgtgcttgcaattgcttgatccataataacatctcttcagtactctctgctatttttcaccatgttagactaatgcagaaattgttggtgttcatgactcagattgcagggaagacgaaactgcttctgcagcagtgcagcttgctttcggtttgcttcaaatctcttctgaggatctaatcagaaattcagaaattctgcattcattgtttacttttctcaactttgtggcatcctgtccaatggtgcagttaaaaccagttcattgcttaattacttactgggaacgccaagccgtgattttgaggaaaatgcattcatattcaagcatgcggattcactaggttgattcatatggacacatgggagcatgtagagttggacagatggttattggtcctcccggccaaaaataaaaaagagaggaaaaagaaaaggagagatttattggtccaatgtgatcatcatctttagtaacacagatatgatggtaaaactacccgtacagattaacagatatgatgcctaccaacctaccatcagccatcaggctgtgttaccgaagaaatgctgatagtataacatcatctgatcagtactagtgatcatattaacacgctgcctatcatctgtgttactgaagaaatgctgataacttaggatctgaagaaatacctcttgactgaagaaatatactccacattttacattatgcacataacataggaacagatcctctgaagagaaaaaaaaaactagaatattagggaagg

SEQ ID NO: 14376 - DNA, 1501 bp, Oryza sativa
tattggatgtggctgcggcggaggcggagctctgattgctcgcctacgaccaagaagtcccaagattggcggcgcagggacttgaccacggtggccggagcatggcggctgccccgtcgctggtgaagtgttgctgcaggcggtgtgaggctgctgcttggctgcagatgacgaggctgaagctagcactagtagtggtagcagtaggatgagctgagcttgagctttcgagcagaagcagcgaaatcccattgctgatgctttgcttccaggtccaatgattggatgggcctttgggggtaggaatttatgcagtttgtatcaatggcgatgcattattggtagtaagttgggtttttctttagtctgaagtgaagtttgagttttttttaagtaaagtgtacgggcggttcttaaacttgtaggggtatgtcatctagatccctaaactctcaaaataaatatccaagtcttagaacttgtcatagtgtgtcatctagatcccaaatcgccaaaacccctttagaatcctacgtggcgttgatgtggcatgccacacggatatgatatggcattattttgattgataaatgggacccatttaattattttcatttttccttctcttttttccctttcttctcgtgacctgtgcagaaaaaaaggaaaaaaaagaataagaagaaaacgaaaaagaaaaagaaaagaagaaaaaaaaagtaaaggacacgtcacgtccatgtggcattgccacatcagtgccacgtaggatcctagaggggatgtgtcaatttgagatatagatgatacactttgacaagttctgagacctaaatatgtattttaagagtttagggacctatatgacacaaccctacaaatttaaggaccgccaatacactttactttttttttatcccctgaaaatgatgagctgttttcactgtaacatactccctccaactccaactacttttgatagtaatattttattttggcacaatgaccaaggataagtaattctacttatcattcatttaaacaaactactagttattcctcgtaaacaagcgattcattaatatttacatttctcgatacccatgtagctaatcttgtgaagaagaatagagagtcactattaaatccgagaaattcattaagagaatagatggttggattgaaatatgtctatcaaaagtaaatttttcagatttgaaaatatgactatcaaaaatagatgtagagagtatgatgtaccggacacaaacttcattttttccacagaaattcagcagtatggaggaattggaggtgatgccaagattttgagttttgtggtggcctccatatcctaagtattttttttacattaaagagagagctttattaatgactgaataaatggttacaatcttggtttaacaagtctaggatttgtgctggggcgcatagcctccactcagcattagacctagtactcattgctattctagcaaga

SEQ ID NO: 14377 - DNA, 1501 bp, Oryza sativa
gaggatccccttgaagatgaaggctttggtgtctagctcgtgcctgccgtcaagcgcctgtggtggtcgccctagtcttccgttgcttctcgtttgtctttgtgtgtgttgggccttcgtcgcccatgtaatgaattaactatttacgcttccgcttgttaaactctgaattgtatcaacctttggtgtaccttgcctcctgggacaaggattaatgcacgcacgtcaggaacgcccgttgggttatttccggtcgtgacaagttggtatcagagccacccttgaccctaggacgagccgtagatcccaagccttagcaatatcttcaaaaataaaaatcctttgtatttgtgaaaatcctctagtctctctctgtcttgctgcttcatttatcgccaaaatctgacctttaaaatgttgtttttctttttgtttttgtttgtagatggccggcagcgtcagccgtcgtggtttggacatgactggcttcgtcttggagctgcggggcatgtgcgttgtcctggggtatccgcatggagtggactaccaggccaggccgcttccggagcaggagggtgacgatgcagagccccacgctgcttgggaggttactgcagtgatcctcactggctctcccgagcggacttcgttggcagtcaccgcgggtggagattccttccccgccgcttgccagagcgccgctctcctcgccatcggcactcttcaccagcgctacccggacgagttgcagcactcgccctaccgctaccaccctcgtcgcggaggagcccgcgactacgccaccttccgggatgctagctcggaggatgacgctaccatcgtgcacctagcgtgcatggtggaggcgtacgacgcggctcgtatcgacttccatcagatggtgcgccgtgggatggtcgagaacaacatgaagatcctggagctgcgtcaggagaatctgcagctgaagaaggacctagacgcggtggaggcgcagctgcatcagctcaagatcgcccagggagaggtctgtcgccccaagcgccgccgcgtctgccgcagccagaagatcaccgcccgcaagagcacctccaggcccgagcttgttcgtcagtccctggcgtggacctgcttcatggagacccctcgtgccgagcccgcgcccatggttccccaggagggggaagcctccggcgttggtagcacggaggatgcgctgttgctcaccttccgccctggcccgtcgcagcggtagacgagctgttagtaggcttgcgcgtgtgttctttctcgtttgtcttcttgttggagtcgtgtggggcatggttatgccggtgtgtggtataattgtgtcggagcctgtctttatttaatttgcctaagcaatttgaactttaatgaaccaatttaatagcagtaataaatttaagaattatggtagtcggggtggttagctttaattgtcagctctctctgtttgctggttatgtgtggggttttc

SEQ ID NO: 14378 - DNA, 1501 bp, Oryza sativa
ctaaggcttgggatctacggctcgtcctagggtcaagggtggctctgataccaacttgtcacgaccggaaataacccaacgggcgttcctgacgtgcgtgcattaatccttgtcccaggaggcaaggtacaccaaaggttgatacaattcagagtttaacaagcggaagcgtaaatagttaattcattacatgggcgacgaaggcccaacacacacaaagacaaacgagaagcaacggaagactagggcgaccaccacaggcgcttgacggcaggcacgagctagacaccaaagccttcatcttcaaggggatcctcttctgggttgggaaaaattgagcaagactgagtacaaccaccgtactcaacaagacacacccacaagtgcataataaatgcaagggagaacaaaggagttacaatataaagggttagggttgtggtaaacagcatttaaagatatttagttgctcaaagctatttggtaaacacgattctagaactatacaatattatttatcaaggccgtgaacccacacaaacctgccttaacccaaggcctacgatgattcagaccgaactggcaacccgacccagggtcccagctcgtcccaagccaacccaggccaaccattccacattttagttgttaagcaggtttttagaattaaaacactaacttgggtacattgctcggcttgtccataaccgagggcgcggctattcgaatagattatactctgatcagaggtgtatatctttacccacaagacacatcttcctcacgtgtagccacgtgccacataccaccacggtatacagacggaagacgtgacatagtttccaacccatcctagctatagacaagagtaccgacccaatcccacctacggccgtaacccccgggacaggcaggcaggactgagcccctagcagcaggacaccggccctgtgccatgacatctcgactaccgagccgcagctcgtgtagccttcatttgccctggagatgtccatcgacccccgacttcttccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccctgagcccagcctaaaatcattttggggattttgaatagagggggcggtgtgaagccagttccacaataaaccaacaattccaaagtgtccaggtgttatgaacattcccaaagtctagagttgtaaaaccgcctaatgttacctaattaaattgcgaagcatctacctaaaattatactagtggtactatgagtagagtgtccactagttggggttttgtttaatctagggtgaacaaggtaataataacaataacaataataaggtcataacaaaggtaaatgggcatggctagataaaacagtgataacgcgag

SEQ ID NO: 14379 - DNA, 875 bp, Oryza sativa
cccactattagctccaattcatccatagccaattctaatagctaattcatataatagttgccttactatactattaatatatggtcccacctgtcatacacatagtgtgtcttggagtccgtgctgcagctggctgtagatctatagtccgctgctcttctctcttatcgtttatcatattttcattaaaatatgtttatagctggctaatagtctgctattgtacctgctccaaaccagtacgagtagtttaattatagtgctccgcgccgtggcccagttaatcagagggtcgtagcatatatagcagcgcagtaaatgaacgatcgagccgtcgtccaccgccgacaacgtggtcgctcgcaaggccgtgaaggggacggcggcgaggcctcgcgccacggcgcccagccacacatacccccgtgcgcccacgtgcccccgtctccaaccgcaagtccacactcccctccctagctagctcgctcgctcgctagctacacgtacaccacgccgcccgtgctacttagctagccagccagccagcccgtcctcctcctcctcctcctcctatattacggcgccgtgcaggccgtcgtgggcgtggcgcagcctctccatactggagtactactagccaacgactgcgcgcttggacgcacgtacataggcacgcgtgcgcgaggagctagccagtgcatgcgtagccggacactacagggcgcacttcgaacgcgccggctgggagctgatcgatcgagtgagctgagtggccaacgcagctagctagctaggcacgtatacgccgtcgtccactcgggcccggcgccgcgcgcgcgcgagagcgagaacgagggtatagatatcgagaggga

SEQ ID NO: 14380 - DNA, 1501 bp, Oryza sativa
ttggacaactaagaattaaaatgtaaaaatataaccttaattatttttgctactttgataatctattttcgatttatagactgtagcaaaaagaaaaaagcttttcaagcagtgatctgggttcaccagctgtactcaccactaaggctatgttcttctcctagttttccctcttttattttccgcgcgcacactttgttttttttaccagggcgcacacgctttgtagaaaaattctatatgaaagttgtttttaaaaaatcatattaatttattttttaggaaaaaatagttattaattaattaattatgtaataatatatatttcgttttgcgtgtcgggaggagggcagcacctaactcatgctcctactagtttttgttatatttcttgttcattgaattttctcatagaaagggacattatgcttgatctggtggtgtttggatcagggacttaactttagtctctatatttagacactaatttagagtattaaatatagactacttacaaaactaattatataaatgaaagctaatttgtgagacaaattttttaagcctaattaatccataattagagaatgtttactgtagcatcacataggctaatcctggattaattaggctcaaacaccacctagcatgcataggacgaggcatttaattttacttataacgagacgtgccaaaaaatgatatccacataacggcataaaactaaacagctgcatatgaatgtaaagactaaataaaataattgcaccaaatcttaagtttttaaatgcatttttggaaaagcttactactggtactactattcttgtactcatatgtggagttgtggacttgcaagcaatagcacatgggtccataacacctgacaccaaaaccacctgtggtcagtcaaacatatccattttagcagctggcaaccatacattcaaacatgcttaaaaaatcttaaaaacattactagtagtcctcagaaccggacaacctgcggctaaatccacaatatgaacacacttttctttaatccaactcagatttcttaatccaaaagttgctaaccactatcgaccagctggcctcgctgctgctgcaagcttgcagaaatgcaggcatttggcaagcacatttgcaccgaggccccctatttcacctacgaattacaaaaagatcccacctcttctactatcgtcagctaattaaatcgttgttcctcagttcggtacttcttcttccttcactctccccaccaaattcccccaaatcgcagctgttcgccacccgcattgcgccgccattgcctccaaatccgagtactccttgagtaatctcagatccatctcgggttcctcccgccgttggcagcagccggagcttttttccgcggaagaaatggcgccgtttcggtgagttcttggcagtttgggatgatgcttggtgggtaggaggactaggagtgcggcggctcggggagaggctgcgatgg

SEQ ID NO: 14381 - DNA, 1161 bp, Oryza sativa
tcaatgttagtaatgtggtaattaattggactcctggtttggaatggttaattcctggtttggaggtttagtttgttcaactggggttggttgttcaaatatggttgggcctatgcaacatgggtgtgttgtatggtgttatttaatattgattaattattcaactgttttcactattctcttaaatatttattaaatgttgtttctgcaaatgagctatgttatgccatcctttgttatcctgtgcacttgcatatttgctgtgtgacttgttgagtatgtcatatgctcattcttgcaatattcattcatcagaagaggagtatctcagtgaaggtgatgatctggaggattaggcttgttcttggttaagatgcctgtggagtggagtcaccatagctgttccgtagtttgttatagtttttctttccgctgcgtagaatgttattctttgagaggaactatctacctctgtaataatttttatttgcgaatattaaatagtcatttatttgtactctattattaatttgtcattgtgtgcctcggttgattcctggacgagggtttaacacacatgtaagcgtttggaattttggatagaaattccgggcgtgacaagttggtatcagagccaccttgaccttaggataagccaaatggtaaaccttaagtagccttcaaaatattttgaaaaaaatagaactgctcttctctattctcttacaaattaattaagttggcagcacatgcaaggttatgcacaaaatttatttaactcaatttcttttcctttaaaagcaaaagttgctcttctcaaaacgtttcattttctttttaccaaatcttattgattagtcggcactgtacatctattatggtatcgatttaatcatgctggcactagtactactcatcccctttaatggtgacattgtaccgtgcttatagtaggtcttaagtattctggttttattttattcacttgtccaaactgatttgtctatgttcaaaagttaaaattctaaaaacatatttatataatagcttggtatgtgtcttttcttttattgtcttcctttttggtcaaaatcagttaagtctagatggtgcagctaacttaaaatatgcattaattcttctcttctatgtttctttaga

SEQ ID NO: 14382 - DNA, 1501 bp, Oryza sativa
tagattacgtctgatcaaataagctagataagtccatagatgtatgctaatatgatcctaatgagctataaccctggcttagcaaacttgtttgcaagctcgagcgagttcatttagcttgtgagccacggggcaagagatgaggagcgcaagatcgccgacacttaaagctagacaatgcaagagatgagctcgagctcgctggaacttggagcatggggaggagctcaacaatggaggtgtcagtctcaaggataagacatatctcctatacatgggtttgtggaataggcaataccatatatccaataatatatgagaaggtatcctttagttaaggaaatacgatgaataaggaaggaaattatcttcctagaatagaaggcctgtatcatgttctatttctccgagttctacttggagagaaagatgatgttcgctattaatacaagatcttctaggaggagaggggacacgcctacggaatacatgccaacacaaaatacaagcctagacaaactaaatccggaaccacaaaggccggcatgagggatctagagctatctacaatctctccgagttcatatttgacaaagaagattacactagccgtcgatgacgtgtggaagctccatgccaccaagctgatagagactagattaggtcaatcccaaatattatattcaggtgatactgatacataaaggcattatcggctctggccaacaggagtagagttattacctgttagttaagggccccgaaactatataaaaatccatgtctcctatatgttttacctcaatctctcatataccctggttctaacgatccccatattctacaaataccatctacgggtatagccggtgataggaagagaaaagctcaagcttgccaacacttgagtcttggtccacaggaaggctcgtgctcattgtggttcgctgcgctggggccgggcggtggcgcaggtgggtggcagcatcgggtgctgggggcgtgcgatggcgttgggccgagcgatgacgcaggtgggtggtggcattgggcgttgggggtgagcagtggtgcctagctctagggacgagcatcagtagctggagacgcagggcgacggcaccatacgctccttttggtgatgacgacaggttgagcgacgggcctataactgttggtgaagagcgacggacggcgtatggcgcaagcggtgagcggccttggcgggctagcgacttggcgagtggtgatggcgagtgggtgggtggcggcgaagttgtgcgcagaggggagacaaacacggcgcacgctcgtgcatgaagaaaggaggctatgactgctgtgaagagtgaagctagggtttttaatgctcttggccctgaaagtatgggcccgtgggttgtgggctgacttgctgagagcaagtttaatagtatagccaactactaactccaaatcttctatagccaatgtaatagtcaattcatacaatagttactta

SEQ ID NO: 14383 - DNA, 1501 bp, Oryza sativa
gttaaggtttaaatgttataggatgaacaacgtatttaacaggacaggctggacaaaaccctaacaacgataacatttatgaaacaaattagtttgtacgatgatattttacagaatttacacccattgatgacagtttttaggctcgtacatttgtcaattacattatttggattttctctagtttttttttcctttgcacctaaagtttacacggaatatttttgagctactagtaacaaatgggcccttggacaccatgtgcttagcccacaggccgtgccacggtggacaaagacatctggtggggcccccctaattctgttgacaaggcgccccttcgttgcgtcatccgccatccgcgctttccctttcgcttttccgtccacacgaggtcggcctcgcgcaggcccatgggctggcccacccgtcagtgtcccctcccaggccctatatgtacagccagcacgggagacaaggccacccaagcccatccatccctgcaagcgacgaacacatctcatcacacccgtcacctctcctctcccccaaatctcgcgctccgctcctgctcctgctcctgccatggaggaggctcagggtacgctatgacgtcaatgatacgggcacaccagtggttgcttgctgcggcgcttggggggcgggaactgttggattttgtttcctgctttgtgtcttgatgatttggtctagaaaaggggggcgtgagtgagatgagatccaacaagtttggagttctttgaggatttggggccgagagatttgctatctacctgttaggagtattgttaggagtaggatggattttcgattctgtgtttggtgaattaaccgactgctgcaattgggataggaagagattgctcatttctgcctcatgggtaggctgcgatggactttcttaggcttagttttatgtgtgattgcggtaagaggggtaggatttaagagttttgagttgctctgggtgattgcaagacaaacggagtgttccatgttggctgatgctgatggtgacttggtgttgaaccatgctatttatttcctttctcatgcacaggagtatagatcatgcacttcatgtcttccaaatttgtcatactatagttgttatgccgcttctggcatgctacttactttgcttccttcctggaactcattcagaagaaatccatggtttcaattaaaccaaaacaggattctgcatttgtcagaattaggaactgtggtggtttctgcgacatgatgcaatttggggactatagatatgtggctttggtcatcatagataggtcttacatgggggcatgggactatggccatggaagtaaatcttgttctgttgtcagctatttaccatagttgtgaatggcctgcatgttgatttcttcagtcctccagcctaaaattctttaatataatcacttcttgttgggaggagctgaaacaatcatttccaagcagtcaaatgaattatttt

SEQ ID NO: 14384 - DNA, 1501 bp, Oryza sativa
ctccctctcccgctggccgccgtcggctgcgcacctctccctccattcgtcgccatcaagtccccgcccacggcgctcggccatcgccggcctccctgcgtcctccctccctgcccgcctcgccggtctttgcgcgttgctccctcctctcctgccgccggccgcgcgtcgccgcgcgccgccacgcgccgttgtcttccgtggcgcctggagagagcagagatagggagatgaagagagggagatggggagagaggaggaagaagagcgggtgagttggactgacatgtgggtcccacgatttttttattattttctatgtgagactgacatgtgggtcccatgggtcgaattgccacgtaagcgctacgtcaatgccacatcggacgaagaccgagtcaaattagccatataggcgccacgtcagccaaaaccgctctcaaaaccgccgagggacctaatctgcacgagttttaatagttgaggaacccgttgtgtctggttttccgatcgagggacaaaaatcgaattcagtgtaaagttaagggacctcagatgaacttattccttagactttcagcttttacaccacatcaaaactttcctacacacacaaatttccaacttttccgtcacatcgtttcaatttcaactaaactttcaattttgacgtgaactaaacacaccatcatcaccatctagccgaatgagggtcaatcgtcccaccaataagtttcaactcaattacaaaaactttaaacttaaattttaaaaaaactttcaactcaagatttgaaactttcaactcaaatattaaataaaaatcaagccaacatttaaaactttcaactatttttaaaaacttttaactaaattgttgatgtatattgtttttaaaacaacattaaatattaccattaacactaatcagtgtcattagcagcgagagagaggagcgcacacgagttacgcggctagcacgcgtgccccaattagcagcccccaagtaaacacatacaatctgatttgagaaaattcccgaaacattaatagacctacactagggatctcgtccataacttcccaaataaatacctgaccaatacaaggtgaaaaagaaaccacctaaaaaggaaatcgggaaagagagtgaaaattattcacatgggacttttcgtccttttaacatttcgtcggcccaacgaggcaagcccatcaactagcccccatccacgcgaaggaggcctgcttcgtcacgaccaaaaaagcccaccgacttccttcctcactcctccaccggcgaccagccccggctgcccttcaccctgcgccgccccagtccaccgccgcgttcgccggagcgacgatctcgcgccgccgcctcctcctcctcccctagattcctgacccggccacgccggcggcgctccccctccgccggaggctggcatggcgtccggccgcggcgggatccccgggccctctcgcgccctcctcgtcc

SEQ ID NO: 14385 - DNA, 1501 bp, Oryza sativa
gctgtcttttgattatgtttgcggttgcgatgtgatattccagtcatgataaaatgtgcctatatcttcaggcctcattatgaaatactccctccattcctaaatatacttttatgtgtatatatatatatatagttttacatatttcacaaaagtttttgaataaaacgaatggtcaaatatgtttaaaaaaatctacggtgtcaaacatttagggaagaagtgagtacaacaattttgcaggaattacattatttatttttgttgcagggaagtgtcatgaagatcggctagtcgtgttctcgtaacattgggcatttgggggtcgtcaaatgccaggtgctagtccatttaacatactgttcgcgctggtttactgactggttatgcgcataatctacattatctggttgaattgtagggaggttagcggttgtctcatgccatgtagcttgcatctcacatcagtctcgtgtgcaaatgtttgggtttgttgaccaaccagaataaagcccggcccagggaactagcgaaaggaaaagttgacgatgactccctgcttgcgttgtcagttggtttggaaaagctgactgagattaaaattcatcaaacacgcttgcattgtttggtccccattgttttttcgaacggccaccctcttacttgaacaggtttggtccccattgttaaactttgccttctttgctgcagcaagaatgctctgttgaggtaacgaggatctattttagaagcttgtggagttacactactgttataaacaacttttataatatctgatccccaaataatctaaattctcatctaatttatgagaataaatagcggtttcttagaatctcttgctaaagcagaaatcacaaccttcttcatctcatctcacagtaagttcatttttagcttcttctatttgtcctaaaataaatccatttttaagtaatcattatatcaaaatttataaaagtactagtataaaataattacattgagaattgataaagtgaaaaacaattacattaagatttatgaaataggggtatttcggtaatactaatcgtttaactcgacacgtccatctcctgcagaacaacatgaatacgtcgaccatatcaccactgcaaacaccgtatcgagatcacctacgacaacgaagcgagacgcgacagggagagcctacccgcacgtttcttcagccatccaaaccgtagctgaaaaaaccagacgcggtaggcgacccggaccagtcagcccagtcggacggaccccctctcgccttgccgcgacgcgaccgagccgacccgaaccgaaaccgaaaaaaaaaaagggcaaacccaacccaacataaaatcgcccacctccacctctcgcattccccttccttccttctcttcctcctcctcctccacccccaaatcgcctcgacgagcggcgcggcggcgagggcaggagagaggcggcggcggcggcggcggcgggggcgaga

SEQ ID NO: 14386 - DNA, 1501 bp, Oryza sativa
caattcaatatccatttcagttgctccaaacgagatgctcgttgggcgtacataataaaaaaaccctatgaatcatgcaacgatagttggttgcttggtgttatgttattcaagtaagagcaagtatatcatgctttccatgagggcatggactagcataatgccctacaatattcgatttcgagccatatcctcaagggccaaatcggcaagaggcccaaagatcctctcaagtctcaaatatagacccgtgttacccaaagagctcagaacaacataggtgcaaacgtgcaagggcaaaaattgaccagcaacaaaatgccacaaattatgctcagtgaggccacatttttttagaaaacagaaacacgattcaagtgcctaattctcatagtgggaacagaacaatatactgctagtacacaatttacttcacttgatttcttttcatgcttctcagctagtttttcaattaatacatccaagggtagttgcaaacataagctagccaaacccgagaaaacaaaactacgagaaagctacaaggtggcatttgaccaaacaatataacatatgtaaacaacaaaggaggccatggtagccatctaaattaaacacaaaattaaattatgtacctgcgtaatgcataactagagattaatgccgagttgctgactcaaataccagcttgctcccgagaagaacatcagcatttcatgtgtatagaaacaagtgacacacacatgtccaggctacttggggaaaaaaacagaagttagcacttaaacaaataaaattgcccaataatagcaccaccacgtacagtatggaagtaaatacttacagtgagtgttacacctatgcgataaaagagaaattagtcaccggcgtttctctttagacttaacagtggcccactgaaagtgaccacaatttgcttcttggtttgatgcaggtccctgtcatagacaatacatggtggttacagcacaatgccaatgcttttcatcctctgtcaatatgaactacctttatgattgttcctcggatgtgaattgagcagttgattctgaagttaaatacctgagcacgggcacagacatagaataggcgaccaatattagagcctttcttcacagaccttggaatgcaaggttcatggtgtcctttgcaaagtggtagggtcatcttcattctctgctgtattctttgccactccagtgttgcttcattgcatttatctgttgaaagcgagcagggtacatctgagttaccctgatcttcggttgctggagttgtacactggatgctttctggcagacagtcattctttggatcatgtaattcatccataccatgcaaagtatctggtggagtaactatgctattggtactgctatctcctggctttgactttggttgttgaaaaaatgacttgatcgtaggttgggaagacaagttatgtttgtttttcttgttggacacagccttgctgcaagaa

SEQ ID NO: 14387 - DNA, 1501 bp, Oryza sativa
cagttcctggggaaaaaccagattcgcagataccgatggccgctcgagcgacgaggagggcttgaacaggatgcgggactgttgttgcttgctccgtcgcttgggcgtccacgacggcattgcgcgccgccgctacttgccattgcggacctcgcgcgcgcggacgcctccgcgccggtgacaaggaggagcaggagaaggcgccggtgccgcccgtcgccgtcgccaagctatccagccgcggaagcgcccgccacctccagccaaggcgccggaagccccaccggaaaccaagcccaagatttctccggcgccgagctccctcgccgtcgccgccaccaagctccttcgtcgccgccgccaagctcccggatgaggatgaaaatggagacgctgtgagagatgagatggaaaaagtgacgggagtgccatggttctgatttttgaaattttcaagggttaattagatccatgccattaaaattttgcctgttttgaaatataccattaatatttgcgtatttgtaatgatgctattgctacttgtttctaatcttagtggtgccactgagatacgtattttgcatgtattggacaaaaatgccctcatcttctacctctctccctcttccccatcttctaccctctctatcttctcactgcgccgccatcccgccgccgcgtgctgcagcagcggggcgcgcgctgcagcttgctccaccgctgtgtcgctgctgctgccaccgcagctgctgcgccgccgcgcgccgccgctgcagctgctgccgtcgagccacatcgcgccgccgccgctgccgccaccgagccgcgtcgctccgccaccgctgcaactactgccgccgagccacgtcgcgccgccgccgctgctgtgccgccgcgccgccgtcgccgcgtcgcgtcgctccagccgccgccgtcgagccgtgtcgcccctgagaaggaagagaggagggaagagaaaggggaagaaggaagaagggggaaaggggtagtttggtccaattttatctgaaaatacatccaaggggtaagtggtatcttttggatatgtgtgaaattataatgacatatttccaaatacatgaataccttttaataacatgtatctaattaacccaatttccaacggcacccagctgatatgacgaatagtagtggtatttttttaatttgtcgaagttgcagtagtatgatccaattaaaccaaattataatggcatagatctgtgcacaaatgaaggagtgacagatcttagccttggtttttccatcggacggtgggcgtgaggcgtgagtggtggtgcgcctgtccgccccgggcagtcgcctctcgccggcggcgggcttggacggccggagataggccgcaaactcgcgaaggcgcctccgtcgcggcggcagaagcgggtggcgtcctgtcggtggtcggcgtccgggtggggggttgggggaaccctcgcggtcgcggcggcggggatgg

SEQ ID NO: 14388 - DNA, 1501 bp, Oryza sativa
cttcactccaaatcagtttgacgtgtttttttgggggtaaattaatatggttatagaagggataatcgtgatagcgttttcgatcaattcgtaggatttttgacatttgatttggcaagcaggcaaatcaaaatcgccattcaagataaggtgcatagtacaagtggtgaccaagaagaacaggtgggcttgtcatgcctatgcgtcgttcttatcctctaaaactcgagcttaaatttggtcaggcatggtttgaaacgaagctcgttatgtactccacgctctcttcgtgttaaaaaaaaaacttttatctatgaagctagagagactcttgtccaagtctatggcagattttggcagtttgtgaaatcttgtcatataccatgagcatttagtcgttgtttgagtaataacatcatctctagtttaaattgtgtagattcgtttacagcacgtgagtaaactcacgatcgaggtaatcgattcgagtttgttaagagaagctgagaacgctggtcaaatttgagcttgttaagagcacctgagaatcgactgcgtgtgaattttgagtttgtctacgggcaaatatatttgcgccttcgccgttagtttgcttatttaccttatcctcgctggccgctgcgacacggtttgacgacgtcacatcagcaccgtgctccacgtcggcctcgcgatttactgggtcccactttcagtgtctcgtctggccaccttcctcctctccgagactccgatcacacgtgaagcgagagggatgccgcggcgacggcggcgatggacgcagcggccaccggtgggaacgagagcccttgccgctgcttaattattcgggggatcatgtggtcggcgagcccttctgcattaacttggatctatagtagaacatattgtccatcgatcgtcatagctaattttagtttttttcccgaggagataaaaattaaggaattgctatatatcattcgtcagaaatttgggaatgaaatcttatatattttggaccattggatctgtgcctagattcgtgcatcgacttcttgtccaactttgacgaactccccttctcatgtgtcggtgacaccccaatcgagaaagagataaatcgataaagctgacggttggtttgaggtgggtggctcaccaaggaacacagtcagttatatttcacaattagatgatcggcatcctatttatacctgcaatatgtttttttatttattattattaagtaatttttagaaagccctatattttattatgattaaagttgtacaaaatcacaagtattatgacttgtgacacataaaccatgtattatggatttaaaagtttcacaaacttcacatttgtgcatgtttagtacaaatttacctgaattctaaaacatagagtgtatgcaatatttttaattaatcaagattttattaaaggtggtgttttagaaacatactagtaatcgtgcacgtgcaatgcacgtttc

SEQ ID NO: 14389 - DNA, 1501 bp, Oryza sativa
taactggcaggatcatcgaggagcgacgacgacgtctaggtcttgacatggtgcaagctttggcattgatcaaggactgggagcaggcagacaagaagttgcagcacactgctgagaatgtagagcttataaaatcatttgagaatttgtttcttgatgatgtaaccagaggcaatgccactggaactggatgattgtactggacttggactttaatatgatagttagatgaaagctgtgggctgcactcttttttcctttctagagttttctcacgaggtgtgagtttttacctagaaaggtttttaatgaggcagccattgcactacacagctactattatttttgaaagtgtttgtgacttgatcacttaagtttgaattgtgatttgtgaactgttagacttagtatttgaaaatgtttcgtggatttgtgacttgagttgtgaattgtgagacttagtagttgagttagtgaattgaattgtgatattgcacatactataacttgtgaattgtgatattgtaatctaagacttgtgatattgtgatctgttaacttgtgaattggatggttttgtgctgttttttgtgatggacattgcattttttatatgtatgtgcaaaactgaagtgaacaagtggcagttagtgtttggcgtgtctgggctggcccgggcacgatgggctcatcgtgccgtcgggccagcacggtccggcacgactgctatcgggccttgcctgggcctgaggtacagcccgtgggcaggcatggcacgacacgaagtgccaggcatgccgtgctggcccgatcgcctcgggccgtgcctaggccgggccgtgccgggtgggtcatatggccatctttacacctcgtagtgtcatagtttgctcaatagtttatcagccattaaaaaacttaattttagaattaattttaagatttatttattgtagcttattttttacatttactttataaacaataaacaataaaaaacatataaaaatgttacacacaaattagtttttttcacttcgtttacttttccaggcgtaaggcaaacgatagtacgacataaaaatgccagtagaagttttggttattttttcttaaaaaaagacatactagtaatttttgttattgactttgcatcacgtgagcaccgcatcgagcttgtcttcttctccggatcgccacgtcagctttccgcttatcgcgctaaagctttccgatcttgccgcagcttcaactgccacgtggggtcaccgcctcgggcccgcattgccagtgacacgaggtagatgcataaaagtccaacacagtcgcatccacacgcggggccacggccgtgcgccacttctcttcctcgctcactcttccccccctctcgcttccttcccttctgctctgcttcctccgcctctgcttcgtgtcgccgtcgccgccgcagcagccgccgccggcgagcaccgggtgcggatactgggagcgatggcgt

SEQ ID NO: 14390 - DNA, 1501 bp, Oryza sativa
actgtcgtacgccatgctagtgtgctttcttcctgtacgccggtgtggccgtggctgcgtgggcgtgggtgctcctcgtgtgcatgtgtacgcccgtctgcgggagacgagggtttctgaaccaggagacgcacgacgcggaggtgctccggcgaggccttgatgaggcggtgaaaggggttcggcgaacaaaactcctaacgcccttggatctacgccaccagtgatgagctgagcacaaaatgcgaggggaaaccggctcatgttgaaccgtcgcagggcgaggccacgatggagacggtggcacgggcagaggcatggctgtggtgttcttactgagtaaaacgtacgggcagaggcattgacgccatcgttctcgtttgtgtgggtcgagaagagcgttgttctggacgccagtaccgcggcgtgcgtcgtcgtcgtcggcgcgtggcggttcgtcgtagcgttccttgtcagggtgtgcgatcttgcacgttgcgcggctgcgtgctcatgggatcatggcgcgagcctgcctgagcatggtcgcgaatccggctgtcatgggcgtgcgcggcttgacgtggcgtggcgagaatcaggttcacatcactcgctgacaggatcaccatgacggcagcagccagcagggttggtgcttcttcctgtatgccggcgcgtgtcggtggccgcgcgcgtgggtggctcctcgcgtaccagcgcccgccggagatgagggttccgatcgaagcagggaacgcacgatgcgtctctcggaacccactgcgtccattgatctgccacggcccagatgagcacagtgtgcgattgcagaaaccggctcatacttatattgtatgagtgctatcaatttttttttagaatttttcatagtaattgtttggatggctttaaacaaacgagcgacattctctcgagggatcaaaattgtttcctccatttgcagcttcttcttttaatcatgtatattccctaaatagaggaacggccaatatactaatcggcagtgagaaggatgaaatgagcagaggcaaatcttgggtcgcatatagtcatccatgtgaatgttgttactaccagttagctgcaattcttgattggttgctactatgcttactgtggcgttcgtccgtcgtcgcggcgtgcgttcctcgtcgatctggccgtctggtttatttgggcggttgggctgtgccacggcgagctgcaccacggcgatcatgccgctgcgacgtactgcgtgcgcgctcagggcgcgaaccgggctgtcgcgcgcgcgcgcgcgtggcgccgcggcgtgtatcgctcgctgacgggattgccatgctagagtgcctctttcggtacgccggcttgggtttcctgctcgatcctcgtgttaaatcattgtcataattaatatttatgatgaacaattggctgtgcaaatgattttatcaaagaattggtttgagagatgtgtggatgttggtgtgagtgc

SEQ ID NO: 14391 - DNA, 1501 bp, Oryza sativa
agaagtcgtgcataaaaaatacttcataaagcctttgttggaaacacacttctcaatgtgtttgaatgaccccgcaaaagcagtcgcaataagaacattggtcaacatatgcctcttaagagctacaataagataataagcgagttatatatgttatcatattatatttatacttatgtggaagaaagataagaaatgatggctacagatttgtaaccatctgcagcaaagtctccaacaaactactccctccgtcgaaaaaagaaaaatcaaccttaggttgaggtttttttttaagacgcaggagtgtatgaaagagatgggtggattagatattaatgatgtaatatatatatctataattaactattgtatgagtggactattaggttgattatagatgatgttttaatttttgaagccaaaagttggctatattattaaacttcgatgcaacttctatattattaaacaaagccatgggttaatatagtagtaatttttaaagcaacttctatgcggttcgagaaatgtgcatatagaaaactatgcacatttctcctatacaatgttttttttcctgaggaaacatgcagggagttcctacaattctttatagaagaagaaaattgatccagtactcctatacaatgttcaaaacattgcctcctttgaaatggagtactattttcaatgaaatatcaaaagattaagggtgtgtttaggcttcgttcgttcctgggcaatctgggggattgagagaaaaaagcatctcgttttccgcgcgcacgcttcccaaactgctaaacggtgcgttttttacaaaaaaatttctataggaaagttgctttaaaaaatcatattaatccatttttgaagtttaaaatagttaatactcaattaatcatgtgctaatggctcatctcgttttgcgtatcttcccaatctccccaatccccttctccttaaacatgcccttagttcacgtcaaaattaaaagtttggttgaaattagaacgatgtgacagaaaagttgaaagtttgtgtgtgtagaaaagttggaagtttgaagaaaaagttgggaactaaggccctgtttagatgggactaaaacttttaagtccctatcacatcggatgtttgaatattaattataaatattaaacgtagactattaataaaacccatctataatcctggactaattcgcgagacgaatctattgagcctaactaatccatgattagcctatgtgatgctacagtaaacattctctaattatggattaattaggcttaaaaaatttgtctcgtgaattagctttcatttatgtaattagttttgtaagtagtctatatttaatactctaaattagtgtctaaagatagagactaaagttaagtccatgatcaaacaccacctaaaccagcgtaaaagagaagaaaatgggcgtaaagccctgttccactagagtctgccatccatttgacctcaacacagt

SEQ ID NO: 14392 - DNA, 1501 bp, Oryza sativa
ccgccgccaaccagatcctcaccagctgcaactaccaatccgactcaagaatatggtatatatgccaagtgtgatgaccacaaacatacgaaaaaacaatgaattcaggcgactgataaacttcaaaactataattattctacgtgcaggtatgactactgcttcatgcggttcgagaacgagaacttcatcgggcagacggacacagatgccggggtgattcttgtgaacgtgcaggcgatggataacggcaaggcgttccagaaggcggtagggaaggttatgggcaaggcaacgtcgcaggcatcacaggctgggagtggtgggctgggtaggacgaaggatcagtacacgccgttcatcaacatctacgggctggcacagtgcacacaggacttgtcaccgctggcttgcgcacagtgtctgtcaacggcggtgtcaaggttcggtcaatactgcggcgcacaacagggatgtcagattaactacagtagctgcagggtgcgctacgagatctatcccttctacttcccgctcgccaccagcgcacgcagcgccaccactgacatgaccaagtacaccaagatcgttgtgcaccgctaagcatccatggttagttgcacgtacatggtgatgtgcgcatgcaaaagttgcaaacacatcacgtacgtacgtattaatgttcaacgtattatgtgtctgtggatgtttcagcgtgcagtggatgaataatcaaggctataaaatgtagccttagcatgttataactgggaataaagatgtgagtactagctaagcaatgtacgcgcacattcgtgtggagtaataatattagagtttttaaccattgcattatgtgtgacgtataaagtacagacaattaattatataccacgttataaaatataagagattttacccatttaatcttacttatatagataaaatcttctatattttataacggagataatatccgtgatcttccacttataaggacaagcttggaaggcatttttatagcttcgacttataagtcgcatgatcatgatatagcgcacaaaattaggttatcatttattttaattacgtgcatgggtgggaagagtaataatgtcccccggcgatactatggtgtatgatctgctatacatgatggccaagccaccaaggactcaacagcttataattgtgacgataaaatgaacgaccagatattctttctctaacgcaaagggacatttttttgaaggatttcaatgagaatatagaacctaaaccggatgaaaattctatgctgtcacgttaatatatcgtttacacatgcctccctatcatgccctatcttcactttagttcttttttaaaaaagatattcagaagacactctctacatttcttctctccctagtcttaatattttctttagaaaaaaaatacatgagagatgcacgcacaccctaaactataaatcgaactgtcgctaatccctgatctcata

SEQ ID NO: 14393 - DNA, 1501 bp, Oryza sativa
cccctacctacatcctcagtagaattagtataccaacaactattggtttgtcacggactcaattttgcgggctatccatgtagagattattcatatccatgtttgcccctaccttttgtgttgttaaatagtacatgaacatatttatcaattattattatattgtaggttacataaactttatttttgtttgtggcaacgaaacgcaccaaaaacagaagttaaaaccactagattatagaaatgcattaccaaaggtggaatttattacatatttattggtgttatttctacctgtggttggccctccttttatgttattgcacatgcaattgaatatcttgtcagtttaccatgtgcatttacaattggtgactatgagcagaggacatgacaggaaagcaaggccactagaactctccacttgaaaaactagaataaaacaaaacaatgtaaccttctgatcatcgaaggtaaatctatttgaattgtgcaccctagtgttgaaaatcatgcttgataatgcatcctaggcaatgggtcattcagcaagccggctgcagcggctgcgctctgtgcgttcagcactgttggtgctgagtgcggcacagccgtgaaactagcaactgaacatgtccaatactatagagaccatttaattgtagcaatggaatgtatttataagtatatatggatgtaacattattccctactatctccaataccacgtggccatggtactagtagaagtgatattggataaatctatcacaaccacatagcttttcctgttcaacatggtgttatctctactgagacaacgccatcccaatactagtctaacgtcatatgatattgagtctagtgatagacacggaccctgataccagcgctacgtcaccgttcagctagcaaagaattccattttgtttagaatactcacctaacataagtttcacctatagcctttaatcctcattactaatttacaattatgttattgaaagtaggttcacctatagttacaccaaatggaatcggcaaaaactaaaaaatgtcgcatcattttctcctcctttttctccatgtgaccaaagaagaaacacctttaagttgtataggctacctagccatcgataatgaggcattcatgctgacttcatcgatctatacgtgtgtgcgcataaggatgagtgtacgtgtgttataagcgtctgcgtttatattgtatttttaaatagacaaaatcgaaaaggaagacctttgaaatacaaaatacatgaactcgaaggggtgtaatgctaaaaagtatagaaccctccaccacgaagcggccacgctcgagacgagacgaggtgaccccttcccttctcttccgtgcgtccggaaagcttcggtaggacgcttagcttggccgtcatcattaaccttcccaacctcccccacgcggccgccatcaccaccaccacctcctcccccccacctcccctcctccgatccc

SEQ ID NO: 14394 - DNA, 1501 bp, Oryza sativa
tgcgccctcgtcgaaaattcactccgtgactagcgtggtgaacttttgtcaattaatgtcgatattggcacacgtgggtgtgatgtttttaacaagaacgaaagattcaaaaagaactaaaacatgagttttggacatattggagtgtatttggtgcgtccgaatcgaaaaatcactctgtgattcgcgcgacgaactttcaattaatgctaattttggcacacgtgggtagcggaaccaaaattttcaaaatacacgaaagcatgagttttggacatattggaattgattgggtgcgtccgtgtagaaaaatcactccgtgactcgcgcggtgaacttctgtcaattaatgccgatattggtacacgtgggtgagatgtttttaaccagaaaaaaaaagttcaaaaaacagtaaaacatgaattttggacttattggacgtacgtccgtgtcgaaaaatcactccgtgactcatgcggcgaacttttatcaattaatgccaatactgcactatattggcacacgtgggtgagatgtttttaaccagaaccaaaaagatcaaaaagcagcaaaatatgagttttggacatctcgtagtggattgtgtgcgtccgtgtcaaaaaatctctccataactcgcgcaacgaacttttgtcaattaataccgatattggcacaatggcacacgtgggtgctatatttttaaccggaacaaaaaagttcaaaaagcaccaaaacataagttttggtcaaattggagtggattgggtgcgtccgtatccaaaaatcactccgtgactcacacggcaaacttttgtcaattaatattaatactggactacattggcacatatgggtgagatgttttttaccggaacgaaaaagatcaaaaagcagcaaatcatgagttttggacatcttgtagtggattgggtgcgtccgtgtcgaaaaatcactacgtgactcgcgcggcgaacttttttcaactaatgccaatattggcctatattggcacacgtgggtagcggaacgaaaaaattgaaaggtacaaaaacataaattttggacatattggatttgattgggtgcgtccgtgtcgaaaaatcactccgtgactcgcacggcgaacttttgtcaattaatgccaatattagcacacgtggtgcgatgttttctcaccggaacgaaaagttcaaaaatcaccaaaaacatgagttttggacatatttaagtgtattgggtgcgtccgtgtagaaaaatcattctgcggctcgcacggcgaactttcatcgattaatgtcaatattggattatgtctacataactatctcgtagcaaagtgcgggctatcaactaattaaaccttccctccggcgtcaacatcgtcacaacgtcattcttattcgtgccaaatttaggtggctttcccagtttatccgcatgtccacaaattaatccctcatgctcttggcatttacccaccagacgatcacatcacccg

SEQ ID NO: 14395 - DNA, 520 bp, Oryza sativa
tgaagtacaattgtgatgaaagaatgagatactaacgttctgaatccactagaattattatttacactttctggtatccatgcctacttactggttcttcttcttcttttttctgcataattaataaaacaattaatcaatcagtttatgctgcttgtaaggcagcatttgtacagccttgtagtgccatattgtaattttaggcactgttgattttgtgttcaaaagttaaaaatttattccaaattatctgttatttcttcctcagtttttatctctgatgtgatgtatttgtttatgaatgacataccatataaaatgttcaaaacaaaatctggctatcaaatttttagaaatattaaaatctggatttgatggctgatattttgtatgccaaagagaaaactaagtgacaactctttattttgaatttgtcataaacctgtgtatgctgccttcttttttcttatgaacagcatagtatcacaatgctagaccatctttttaattaaaaaaagtg

SEQ ID NO: 14396 - DNA, 1202 bp, Oryza sativa
ataaaagcgagagggagagggattccttaatggataagaataaccgatgacacggcattgtttcgatcgctcccaggtttggttccatgcactggcgcggcatgattgcctagatgatagggttccaggagagggttcattagctggggagggaacaccctaatatccagcggtctcggttatgtgcgacggcatggcgacacgatggtgactcgattggcggcgatgtgcagtggtagcggccttgataggggaggcgcagggctatgccctagggtgacgcgcggtcgtcgtggcgaccgttatccctcaatcccgaaggcgacgcgcgaggggacgggatgacgcgggctctcgtggcggcgcagctttggcgcgggtcttcggcgcctcggtcggcggcgggcccacgcggcgtggcgtgacgcggtgcggcgcacgggcacgaccagtgcggcgcacgagtcggaaaggcagccgcgcggcacggcagtgattggagagggcggcgtcgggtgttcggtcgggttaggcacagatcgaacacctagcgcgtaatgaacagtagcaacccgggaaaaatcacaattagggcttttcctagactttttgtgtgaataagttttagatgttttaatctccttatttcttttagatacttacctatatttcaacacttccaatcttgtgatttattgcaccatatattaataattattttttctaattccaacatatgtttctattttccccatatttaaggttttagtatttgtcttgtcataccaatatatttgtcttctcacattatttaatttaaacaatacattttgcaacagagaaacgaataacaccagcatgatgcaaaagtttttaaaagttcgaaattttagtgatttttattgtcaggaattttcaggatgttacaagaacagagtatgcatcggctgcgaaggcatcggctggagtctgcataggctgagaaggatcggacagaggacagctgacacagctgatagaggtggtgcagccgattgcgatgaagatggtttcagggctgtttcagggattgatcaaagtgcttcacggggattgccacgatggagataaagctctcagataggcaattgtatttattaattaggatatttcatgtaaattccttagagatatgtttgggcaaaagtctgccacgaagactt

SEQ ID NO: 14397 - DNA, 1501 bp, Oryza sativa
ctcgacctctagaggattctggatcagggggccgccaatgacgcgcgcaagggcgtgatgaaagaagtcggtgacttgggggagtccattctccccctttttgaagagtagggttgtatttcccttgtactccttaatcaattatgcttgtaaaactttcgtcggttcaaactgcctttgtgtatgcagttgtttccttcgttttctttagcatgttgattccgagtactttgctgtcattgtagagatgttgatatcgaggatgtccagcagcgtgggcagcctgagtcgccggtagtcgttccggcacttgcgcttgagccgtacgtgccgcgggacgatgtcgatcaaagcctgtctgtgaaggcggacgtggcgacgacttccttaggttggtactttggttttcatctcctttattcttttgttcggatcgacttaatttgctgtgttctcgaaagaggagaacgacctgacttagtcatttccgtattgagcagacctcgagagtacgttggccgaccgagatcgtcgaatccaatattggaggacgaagttcgaggtggccgaactcgagaggactatggtggaagtgaagaaggaccaagccgtggaagcactccgaggtcgcgaggtgtggttcaactcgtacctcaggagttgttatacagcgatggctggagtctgtagagagctccaagtaccccgcgggaatctcgaggagtcagcggctgggtatatctcgtggttgaacggggcctgcactctgcttgaaggcatcgggaagcgtatcgacgaggccttgaaacaggagtgtcgtcggtcgagccgatatgtcggagggcatgtgctggcctgtatccgagatcaccgcccacagctgcacctcgagttcctccacgaagggtttgcacgttctcggagggctccacgtgtactctcctgattacttcctgatgacggttgaagggtagttaggacatttaccatggccataaccgtcatatggtagctataaaaggaggactccatcacacttcgaaacacacaactttgagctgaattataagaggctctattgtatcttttgtacattagaaaataggtagagagtgaggagaagctctggaggagtgcccggaagtttggcactctctctgacttcttcctcggcgagtgtagctttctaggaggaatttgggaggagtactagagctgccggtacactctgctccgggttcggagaaacttcttctattaagttagcattcgggatactttgttatgttatttaattatttagtataagtaagtgtcacgccctgaagtttagccatgctctaatatgctaacatgatttttagtggaattttcagagccttttaaataatttttaaccaattaaaatcaattatatgcaatataagtccctggaaaatcccccctttttttctttttcccttctttttctttctttttctccctctccctacctcatggg

SEQ ID NO: 14398 - DNA, 1501 bp, Oryza sativa
tgatgtacttggctagcgcaacgaggactgacatctcatttgctgtaagcaagctgagccggtttgtctcaaatccgggagatgatcattggcaggctctggaaagagtaatgcactatctaaagggcactatgagctatggaattcactataccgggtatccaaaagtactagaagggtatagtgactcaaactggatatctgatgctgatgagataaaagccacaagtgaatatgtgttcacacttggaggtggcgctgtttcctggaagtcttgcaagcagaccatcttaacgaggtcaacaatggaagcagaacttacagcactagatactgcgacagttgaggccgaatggcttcgtgagttcctgatggacttgccggtggttgaaaaaccagtaccagcaatcctgatgaactgtgataatcaaacagtgattattaaagtgaacagttcgaaggacaacatgaagtcatccaggcatgttaaaagaagactgaagtctgtcagaaaacagaaaaactccggagtgatagcattggactatgtccaaacggctagaaatctggcagatcagtttaccaaggggctaccacgtaatgtgatagacagtgcatcgagggaaatgggcttgatacccattgtgatcggagatcccgtgaatttggatggcgaaacaaactattgtgtgactgagagaagagacccttgaaaagggctcattttcatgatgtgcttctcttctttcctgcatggtaggatggctcatgccttaatgtgatccgagtggcttttccaagcagagatgttgacctgcagaacatcttagaaggaacacacctatatgagttcgactgctagtcacagtctatgaggtttgggcgatctctagatactcatgaaaggcctggagtttgacttatatgctccaaacagaggggatgcgaacggcagcccagtaccagtcaaggttctgagtgaaacctgatcacacaaaactgacaattcaaggcatagtccattgttcagttgtggtctgatgtagctcatttcctaggtggaagttcaacttaatagtctccaccaaaaccctggtatatcaaacaggcacaacattgagaacatttcttatgagccttgaaatttggtggggattgttagaataattgggctatgcccaacttatcctattaaatctcaaaggcccataataagtgttaaggataataataccacctcaggatttaagcgaggaatatctcaacctaaatagggagttattggagactccttgttgaccagttgaggtgggggtcggattgccacacgcgcgcgcgcgcgcgccgggccaggccgggccgggccgggccgagggcgagggcgaggcgtggcgtggctggctggcggcgtgcgtcacgtcacgtcacgtcactatccttttgcagccactaacccacgttcccacgattccctccgcaacagcgcgtccacgttctttct

SEQ ID NO: 14399 - DNA, 1501 bp, Oryza sativa
tagagataaggggtagtgaagatgacaggcggggtccacgtgggccccaccaattttctattattgtgggtgtgaaactgacatgtgggtcccataggatttattattttttgattgaattgccacgtaatcaccacgtcaatgccacgtcagataaagaccgagtcaaattagccacgtaggcgccacctcagctaaaaccggggtcaaatactgccgagagaccttatttaaacggtttcgtaagttggaggacctgtcgtacccggttttgcgatcaagggacgaaaatcggactgggcgacaaatagagggacccaaagtgaacttattccggtggcatttgtgatagcccaggtttgggcttatgtggcccatttgttctttcacggattaaaccacatctaattttccaaaaaaagaaaaggaaaaaatataatcaccgtcaaatttgaagattgttgaaaaaaatcacgttgtttttaaatgcaatagataacatcccggcctttactcaaaggagctacaactttaaaaaaaatagctatatttatggcgccatatttttcactaaaaattagtcaacatgtatttacattgtaaatctctaaattacatatgtaattttagtgtgtttatagtgtaaatatcaaaattacatatgtaaatatcaaaattacatatgtaattagtatgtaattaccgtgtaaatatgatgtaactaacatgtatgctaatcaccgatactcaaatttgtttatatttactcctactagtaacatgcccgtgctaatgctacgctactattaaataggtcgttcctgtttacgctaatcaccgacagcctacgcacgtactactgctacacgaatctcaatggcatcaatggtctagaatccgactgagatgaggaacaaaatatggcgcaacatgtttagcaaatccgtaaaaaaaatcacgtggatgacttcctaattcctacccaccgaacttcgattacgttatatgtttcgtaaaaacaaattagcgttgtagtactatttgaatttatttaattttttatctcgaggcatgtacttcatttgtagtcacacgtaaagcgtgcaggcgtcctctcccgccgccgcatatgccggcgccgcgtgttacgcgtgacggcgcggccgccggcgcacggtaaaaccggtgatcaaaccagtggaatcgtggacgcgcgcgccagctgcacgcacgcacgccagcgagctagcgctcgccgccgaaatgcacgcgccctcgaacaccaacggcgccgtcgtcttcctcgccgccgccgtctcattcctcctcctgctgctgctcggctcgatccggcatgctcgagcgcagcaagaaaccgggtagctttcactctccatcgatcgatcgcttttatattacatgttgcagcagctaagtactagctaattggtgattgaatttgaatactgctcgatcgattgatcgttgcgggcagacgacg

SEQ ID NO: 14400 - DNA, 359 bp, Oryza sativa
ggagtaatcaataatattgtactctctccgtctcaaaatataagagattttaggtggacgtgacatatctagattcatagtcataggatatgtcacatccacacaaattaatttcttactttctccgctctaaaatattgctatctagctagaatgggatatttgacttatcctatgacaacgaatctggacaacaacttagctagcaacattttagaaaagaggaagtatattttaggtcgggggagtacatgtttaaaccatggacgatgctaccagcctacggtaccatattagaaatttgtccacgtacgtacgtgtgcatttactgatcacatgtggtattttgactccccaga

SEQ ID NO: 14401 - DNA, 1501 bp, Oryza sativa
caccaatagattcatccatgattagaaatcaatctaataaacaatgataaattggaagggaaaaaaacgcagcgacatcggagatttaatcatcaaactcgccaaggttgatctccctgacgagattgagcctgtgtcggagagaacaagcttggaacaggccttcgcggtgtttgggagaccaaatgagatcaaagtggtctgagccttccagactggtttgaatccgagtcggagaggagtgatttccaaagtcatcgttaaagaagacgaaacttccaaagcgaaggtttgccttggggcgaagatgaatccaacgattcctaagattgattcaatcgcacttctcgacgggaaactcagcgtcacccctacctgctgcaccagctatcgatgtatttatcaacgataataaagggggtagcatatgagacctaaagtggatggatgcaagtagacaagagtttagacatgtttcaagcctccttgatgagagataacatcaaactcttgtttggtggattggatcagctatattgattgatcatggtgatcttggttgtgttgtcctcatggatcttttgtctggtcaatctggttcccttgagggggcttcatgctcaccttatataggttgggaagcaggattgcgagaagagaaacctaaccagatacggcttctgtttcctaatctatataaagtagtattcagccgagactctataccctgcctcgcaacataagacaacatggcaactgagtgctactctatgttttattacatggatgtagcccccatggcctatctgtagttggatatgtaggctgtatcagtaccccggtacccatgtatcagtaccccggtacccatatctttcacagatgtgtgctaatttgttcctatgatcaactagctagcatatgcatcatagtctcgtgggtcttgtttaattagtactccatttgtcccaaaatataagcattttagacttcgacatggtctttgagatactattttgaccaacaaaatctatgaaagtaagatgttttaaataaaaaagagttgtatattatgatagtttgtttaatgataaatctagtaacattaattttacattattgttctttttaattttttttctactaatagttaatgttaaaaatgtttgatttcacactatgctaaaaatgcttatattttgggacgggacggagggagtaacatttacactagataataatttaacctggttatatagttaatacaatgtgagttatttgatatgactcatggataattctttcatgggcatcccttagggcttgttcagtaaattcctacaggaaggaatttatttttaggggaagggacgtttgatttcacgtctctccgcatagacttccattcctatgaggaggaattaaccaaacaaatccttaggaaaataatttcctaggctaaaatagtatcctgagctctgaaataagtaattagacaaga

SEQ ID NO: 14402 - DNA, 824 bp, Oryza sativa
atgcatatccaagtctcagaacttgtcatagtgtgtcacaacccctttaggatcctacgtgacgttgatgtggcatgccacacgaaatgacgtgtcatcattttgactaacaaatgggtctcgtttaagatttttcctttttctttttttcttatctttttttccctttctactgctttctctgtgacccgagcagaagaaagggaaaaaaaagaagaatgagaagaaaacgaagaagaaaaaaaaatggcacgtcacatccatgtggcatgccacatcatcgccacgtaggatactagaggtgatgtgtcaatttgggacctagatgatacactttgacaagttctgggacctgtatatatattttgagagtttagtgacctatacgacacaaccctacaagtttaaggaccgccaatgcactttactcttttatctataatataaaaaattataaaaatcaaataataaatagtacccgtacaatgcagataaaatttattattattgtttcttcatgtgtagatcgaatttagacttgcatatttgtatagcgtcttatattattatagtctatattatcaaattttatgatttttttatataactgtctaaagtaggtgtcatacatagcagtatggcaggtaagtgtagaaaataatttctaaccgtccgtccgttctcttcgtctccgatcgatcggccagagatctctataaattggcgccgagagtgagagctagccatgacaaacaaacacacactcagtagctcgtagtgttcgtacgtggtgagctactagctagctaagctccggttcacca

SEQ ID NO: 14403 - DNA, 1501 bp, Oryza sativa
gttgccctcctcgggaatcttgacgtcgaggagcgtgtccacgtacgagtgctggaacgtcgtctccctcgccggcgggaggccctggctggcgagcctcttgtactcccggcgagcctcgatcagcggcacgaagagctccttctggcgccggcgcagcgcgtgcgcggcctcgaggcggccgcggaagaggtgcttggtgatccacgggaagaagaagaagacgctcatcctcctcgagatgtagagcagccacgcgcgctcggcctcctcgacgtcgcgcacggcgggctcgtcgaggcgctcgccgaagcacatgagcacgaggaggcagaacatggtgtactggaacgcctccatgacgttgggcgcctcctcgccggagccccgcagcttctccatcagcacgcggcgcacccagacgcgcgccggcgcgaactggtcgacgcgcgactgctgcagcgtctgcgacacgaggttgcggcggagcagccgccacatggcgccgtagttggcgcgggtgatgatgttgtcgctgacgccgaggagcgtgctggtggcggcctgcggccggtcggccagcttcgcgccggcggcgatgagcgccgcgtgcgccaggtgccgatccgccacgaagatggacagcctcgacccgatccggagcgtcacgacggggccgtacttcttgaacagcgtcagcaggaggggctcgacgtcggcggccgagtgccgcagccagagcaggttgccgaacagcggcaccgccggcgggccgggcgggaggcggcgccgcctcgacgacgccgcattgcggagcaggaagaggagcgggaggaggaggacgccggcgaggatgaccaggttatccatctgcgtcgtcgtcgattggtgtcgttgttgtacgtcgggtgagacaaaacggctttacatttatagggagacgcatcaagtcaacgctgaatacgattgagtttggataattttatgagtttaagagtctgaacaaactacgggttgttcggatgtaattttcaaatcttaattcaaaattattatgtgttagagtcctgaagtctgaacaaactatgacttgttggattggatgcaattttctcgagagagaaatcgtattcagaattggttttcttttatctgctcttttcttgaacatgtcgttagaccttggatcatacgagtcatgtggaaacaaggtgtcgcataagaaaatattctagaattttttttcttcgtatttattcctgttcatcatcatccctgacgtcagcggaggtggacccttccgttcacttcgtccgcaagtcgaatcgagatcgcgacggtggcataaagcataataaaccgataaatacaaccgaatttacttaaacacaagcagttaaaaacctcctaataacgtgctaattacgacacgtgttaaccatataaaatgagtcccactgaagtagccacacggtacgcggtgctcgcgctcactcgaaga

SEQ ID NO: 14404 - DNA, 1501 bp, Oryza sativa
cggatcgggtcgaggctgtccatcttcgtggcggatcggcacctggcgcacgcggcgctcatcgccgccggcgcgaagctggccgaccggccgcaggccgccaccagcacgctcctcggcgtcagcgacaacatcatcacccgcgccaactacggcgccatgtggcggctgctccgccgcaacctcgtgtcgcagacgctgcagcagtcgcgcgtcgaccagttcgcgccggcgcgcgtctgggtgcgccgcgtgctgatggagaagctgcggggctccggcgaggaggcgcccaacgtcatggaggcgttccagtacaccatgttctgcctcctcgtgctcatgtgcttcggcgagcgcctcgacgagcccgccgtgcgcgacgtcgaggaggccgagcgcgcgtggctgctctacatctcgaggaggatgagcgtcttcttcttcttcccgtggatcaccaagcacctcttccgcggccgcctcgaggccgcgcacgcgctgcgccggcgccagaaggagctcttcgtgccgctgatcgaggctcgccgggagtacaagaggctcgccagccagggcctcccgccggcgagggagacgacgttccagcactcgtacgtggacacgctcctcgacgtcaagattcccgaggagggcaaccgcgccctcaccgacgacgagatcgtcacgctctgctccgagttcctcaacgccggcaccgacaccacctccaccgggctacaatggatcatggccgagctggtcaagaacccggccgtgcaggagaagctctacgccgagatcaacgccacctgcggcggcgacgacgagctcctggagcggaacgtgagggacaaggacaacaagatgccgtacctcaacgccgtggtcaaggaaggcctgcgcaagcacccgccgggccacttcgtgctgccgcacaaggcggcggaggacatggacgtcggcgggtacctcatccccaagggcgccacggtgaacttcatggtggccgagatcgggagggacgagagagaatgggagaacccaatgcagttcatgccggagaggttcttggacggcggccatggcgccggcgtcgacatgcacgggaccaagggcatcaagatgatgccgttcggcgtcgggcggaggatctgcgccgggctcaacatcgccatgctccacctcgagtacttcgtgggatccatggtgatggagttcgagtggaaggaggtggaggggcacgaggtggagttcgccgagaagcgggagttcaccaccgtcatggcgaagccgctgcgcccgcgcctcgtgcccaggaggagttagacagtgagacagagtccagaattggtttagttttgtgttcattagttagtgttagcgtatatttactcgtgattaagttatgatccaaatgtccatagtgactagaagtatataattaggtttgaattaagtgccaaaagtgtgttttgttttagcaaattttgagcagtgc

SEQ ID NO: 14405 - DNA, 1501 bp, Oryza sativa
tgccatttgatatcagcattcacctcatgacacgtaaaaaacctgacactgatactccaaattactccctccgtttcaagatgtttgacaccgttgactttttaatacgtgtttggccattcatcttatttaaaaaatttaagtaattatttattcttttcatattatttgattcattgttaaatatactttcatgtacacatataattttacatatttcacaaacttttttaaataagacgaacggtcaaacaagtaagtcaacggtgtcaaatattttgaaacggagggagcaaatgagcagtgagactctgattagtgcctgactcctcctgggcacaaggcgcggacgcagcggcttcgccatggcggtggtgaactcgagcttctcggcgaactccacctcgtcgccggccacctccttccactcgaactccatcaccatggatcccacgaagtactcgaggtgcatcacgccgacgttgagcccggcgcagatcctccgcccggcgccgaacggcatcatccggatctccctgctgcccgtcacgtcgaccccgtcgccgtcgccgccggcgaggaagcgctccgggatgaactccattggcttctcccattctctctcgtctcttccgatctctgccaccatgaagttcaccgtggcgcccttggggatgaggtacccgccgacgtctatgtcctccgccgccttgtgcggcagcagggtgtggctcggtgggtgcttgcgcaggccttccatgaccacggggttgaggtacggcatcttgttgtccttgtccctcacgctccgctccaggagctcgccgtcgtcgccgcaggtggcattgatctcggcgtggagcttctcctgcacggccgggttcttgactagctcgcccatgatccattgtagcccggtggaggtggtgtctgtgccggcgtggaggaactcggagcagagcgtgacgatctcgccgtcggtgagcgagcggttgccctcctcggggatcttgacgtcgaggagcgtgtcgacgtacgagtgctggaacgtcgtctccctcgccggcgggaggccctggctggcgagcttcttgtactcccggcgagcctcgatcagcggcacgaagagctccttctgccgccgcagaagggcgtgcccggcctcgaggcggccgcggaagaggtgcttggtgatccacgggaggaagaagaagacgctcgtcttcttcgagatgtagagcagccacgcgcgctcggcgtcctcgatgtcgcgcacggcgtgctcgtggagccgctcgccgaagcacatgagcaggaggaggcagaacacggcgtgctggaacgcctccgttacgttgggcggcgcgtcgccgccgccgccgctgacgccggacgtcgtctcacgcagcttctccatgaggacgcggcgcgcccagacgcgcgccggcgtgaactggtcgacgcgcgactgctgcagcgtctgcgacacgaggttgcggcg

SEQ ID NO: 14406 - DNA, 1501 bp, Oryza sativa
gcttgaactgcatataaaagatcgggtcacaaacatttagactacaaaacagaatagagaatttacattcacgtgtgcatgagtgaaaagaagcaatgctaaccttggcatcctcatccttgacggactgaaggcggaagcgacccttggtgtcatagagaagcctgtagttctcaccagtctttggaatggaaatcacatctgccaaacagagggcattaccatgtaaggtatgctagaaatgaaccacttgcataccagaccatacaagataacgacgggtcagaaaagaaacatgcgtgcatacccatgaaaccagcagggtaggtcttgtcagtcctgaccttcccatcaaccaagacatgccgctgcatcaggatagagataacctcacggtatgtcagcgcatacttcaacctgttcctgatgatgaggatcaggggcaggcattccctggacttgtgaggtccagacgatggcttgggggcctggaaggcacacaaagcagttcggcgaattacattactgaacaacagaaaatagtcgcaaatggcagaggccatttcaagcacatcacaggaaatcagtaaactcacaaaagctccgccgagcttgtcgagcatccagtgcttgggcgcattgagcctcttgagatgcttcttcaatcccctcgcctgttcagaaaataacaggttgacaacgttaagtatgttattaaccacatactcacagaattgtgatgcttcttaaaagccagtacaacaatataattctagatagcaataggctcgatactgtatatccacaatataattctagatcccaacaggatccatactgtttaactacatatcttggaatctaattcctatataaaattagtaagaatatatcaaacagcacacaacttaaatcagttactacatcaaaaggtaatcatcatacatatgctgccatcaagaaacaggaaataggaaacataacacgaaaaaaagattgcatagccctcatcacacctgcccgccaatctacaacaatgcacaccgcatcaattcccaagaaccaaaccaaatcctcccccaatctctcaattctccctcttaacattaccaccacacaagctaaacacaagcccatcctgctaccactcgacccgaaactaaagaacagaagaagaagacaccggtgctacacaagtacagagactatgaaactgagacgtaacgggagaaacggcgcggcgctcaccatggttgcgagctcgagctacgtcgccggagggggagaccaccacgccgtccgtctgcgtcgctctcttccgccgccgccgccaaagaggagagagggatggcggagggcgagaggtgggagaggttatatgctgcggaggcgcagcgcaagtagggtttccgtggtgggccggtttgggcttttcttttttacacgtgatgagtaaatgggctgggttttgcatcttcttcggcccaactcgttcctcctc

SEQ ID NO: 14407 - DNA, 1501 bp, Oryza sativa
cattcccttgaaggtcgttacgaagaatttactattttactcagcaagcaaaagatggtaaacccagttcaaacactcaaatgtggcgtaaacatacctatatcagccaaagatgaaccaaaatggagataaatgcaatgattaaattctgggaaaaggctgccgaatactgacattcctcagctaactagagctgcttgcgcactaaaactggggcatctctatcaacatattactcctaccgataaaattactcgttaatatgatctgatccttcacgacgattgagaagcactcgaaatgtggaataggcggaacgggaatcgacttcgctcaccctgcccttggagaagagctcgagtcccaggttgacgcacgactccgccgtcgggacagccaccgcctccttccccggcgatggcgggggagacggagacgaagaggccttggagcggagcacgcagcggcgtcgtcggccgcaatgagggaggaggggcgagacgaaggatagcgcttggagggcatagctacgggttccgccgcctccgcctccaccgccgccggcggggagaagggcgaggtgtggccggagagccgatgctccggcggccgccattgccggtttcgtgaggtgaggtggtcgtttttctcgttatccaaactagtatttgtggtcgaggaggaacgagttgggccgaagaagatgcaaaacccagcccatttactcatcacgtgtaaaaaagaaaagcccaaaccggcccaccacggaaaccctacttgcgctgcgcctccgcagcatataacctctcccacctctcgccctccgccatccctctctcctctttggcggcggcggcggaagagagcgacgcagacggacggcgtggtggtctccccctccggcgacgtagctcgagctcgcaaccatggtgagcgccgcgccgtttctcccgttacgtctcagtttcatagtctctgtacttgtgtagcaccggtgtcttcttcttctgttctttagtttcgggtcgagtggtagcaggatgggcttgtgtttagcttgtgtggtggtaatgttaagagggagaattgagagattgggggaggatttggtttggttcttgggaattgatgcggtgtgcattgttgtagattggcgggcaggtgtgatgagggctatgcaatctttttttcgtgttatgtttcctatttcctgtttcttgatggcagcatatgtatgatgattaccttttgatgtagtaactgatttaagttgtgtgctgtttgatatattcttactaattttatataggaattagattccaagatatgtagttaaacagtatggatcctgttgggatctagaattatattgtggatatacagtatcgagcctattgctatctagaattatattgttgtactggcttttaagaagcatcacaattctgtgagtatgtggttaataacatacttaacgttgtcaacctgttattttctgaac

SEQ ID NO: 14408 - DNA, 1501 bp, Oryza sativa
ggtatccaacttagtggtagggtttattactaatcattttcactagtgttggtgaaatatgtgtatgcaggtattttaaagagaaaacacacccgtcatacgacaaaatacacctccagacaaccaagatgtgtttacatggattggagggcccatatgtcaatcaaaaccacttagaattgggccaaatcatagtacatgatgttgggggcccattaagcgacctcccggccgaaggagatgccgggaggagggtttctgggttcggccgaatccgttctaaggtcattgatcaccatcttccatgtgtacattcctgatttcttcccaatgacggttgaagggtgttttggacaattccgatagctgtaaccgtcatatggaggctataaaaggaggagctcacttcacttcacaatacacaactttgagctgaattacaagagcctctattgtatctttgtacattagaaaataggtagagagtgagaggaagctcttgagaagtgcctggaagtttggcgctctctccgacttctacctcgacgagtgtagctttcgaggagtaccggagctgtcggtacactctgttccgggttcggagaaacttcttctataaagtatggattcaagatcatttcttatgttatttaattacttagactaagtaagatatatttccatctttgcgggttcattatttagtattcgtactaaggggtctagtactaggactctgggtaaagaaggaagttcctgcgcaagtattagagtacttcctccgtttcatattataagactttctagcattgcccacattcatatagatgttaatgaatctaaacacatatatatgtctagattcattaacatgtatatgaatatgggcaatgctagaaagtcttataataggaaacggagggattagtaattaataacttaggcgtggtgtctaagttagaaattacctttgtttgttgtgtatcccacggatttgttagaggtagatggcaagtggtgacaaccctaaatcccgtcgtagtaatcctccacgttcgggtacatcataaagctatagcaggaaccacgctggcataccagcaggggttggtgcccaatgcaacagataggaaatttcctttacttagcttagataactaaaacacatagaaagtcctctctagcctagctagcctaccatcagttattgtccttggatagtcttagccttaggtagattttttagccttaggtagattacaaacgttccctgagttcaatatatccctttggggtcacccgaaggtaaagtgctacagtggtattctgtgcgcttgcggatttatctgtggtcgtaagaaataccaacagggtacatcactgccacgtcagatgaagaccgagtcaatttagccacgtaggcgccatgtcagctaaaaccgtcgtccaaaccgtcatgggacctatattgcaccagttttgacagttgagggacccgtta

SEQ ID NO: 14409 - DNA, 1501 bp, Oryza sativa
agacttgatcagttagagctctataataaacatattctagtagtatgagcgactctaggtgttcgttacgcgtggtatcatcggtatttgtgtgtaaaccggccggtgttatctggagcgttgagatacgtacggtgacgcgacaccgcgacagtatagtgatgctagtttttggccgtgtgtgcactacgtctacgtacacgcgaaggcaattcgccagtgacctgaatttgctcgatctcttgtgatcttaatttacggcgtttcgtccacgcggaggagttcgtaatactgatccttgggacgtacgggccgccgtgctcatcagcctcagccagcacgacgtgcgcgagtttctcagtttcttttgtttgctgcttctgctgctgctgctagagacacgtcgtgtgtgacagcataatatttggggcttattcgttttaaaaaagaagaatttctaaggattaatttctattaatatctgtttgtaggaatgagatataggaaaaccaaattaaggaaattttattttcctacaagttatagggagagaacgcaaaaaaaagtaattaaattatccatttaaaccttaaagaaaaattcctatggattgatatgtgcatttctttctatttctttaattttttatttttatgggttgaaattcctccaaacccaataaacaatcgacgtttgggacagcaaaatactgctacgtgtaagtcatttttgatgtttcaagcatcaaataattctgtctaagagataataatactactagtcgtaatagctaactgatataacaaaagagacaaatatgtataacaatatactactgatatctacataatggatgtatatatatagtcaaacgtactgtggagataggagatattatgtcatgcatgcatacacctgttgatagggacatgatggcgctgtaaaaacacgtagcataaggtcgcggttgcgctacacatcaggcaatgcgtgtctccacaaacccgccagctacgttgcttaattaagggaaaaacggcgagtgagtcttcgagtatgcgctgccgcatagaatttttttccgtgtgggtgtcccggactccaggtgatgtttgctgtttttgtcattagtgtagtattatatatttatatgtgcgcaaagtacacttgcaattgcatgattgcatctgttaattgttatcttcagtactggtaagattgcgtttgactactctgaggtcgtgttttattacgtacgggttgccgcctctcagattttcaatttggagcagtaggggcgttctttctgaagaatgaaactattccatttatcaacattgtgattctttttcaaaaaaatgcatacatattatttttatagaactgttttaaatcaaggtgaactaaactccatgatactccctttatgtcaaaatacaactatatttttttttataaaatagctatattttgaattgagcgagtagttttaaaaagagtg

SEQ ID NO: 14410 - DNA, 904 bp, Oryza sativa
ctgttttaaaatatgaaacggacgaatttagtagttagttccactgttaattcacttactccctctgtctcataacatagcaacctatgaccggatgtgatatttcatagtacaacgaatctggacatgtatctgtccagattcgttgtcctataaaatatctcgtccgattcttgattgctatattatgagacggagggagtaacatgcatcttactatcttagggcatgttcactttgataccattttcaaccatactaataaatcctggtaaaattttggcaatattgacatgttgccaaaattttggtattgccaggtttattttggctacagtctgaatatgcccttgattatgcaataatgctgtacacgtacgctagttagtactttagtagtgctggaaccagcacgtacgtgcgctcccgtggcccgtcgacgtccctcccagcaaagcatgggaaaacgatcgagctagcatagatcaatgcatcaactatcgatcagcaagtatacatgaacacatgacattatgttgcaagttgcaaccacctaaatagaccaaattaaatggaaaatttaatttccttgtgctctttaattacagttgcattgcgcagcatcaacgatcgatcgatgcctagacggattggctgttgtattttttttagataatggaatataacatctcggtctttactcaagagagttacagccaattattatagagaagcacctaaacaagaatgtagttcaacaaatcattgaaaacacccaatgaacaaaataagtaacgaatctaaaataaggagaacacattattgaagtctatttgtgaatctccaaccataattgataaaaagttgcataattatcgtctcaagtttgcaacatgcaacttgt

SEQ ID NO: 14411 - DNA, 1501 bp, Oryza sativa
cctgcaaggacgcccccatcagcgagatcaagaacgccgtcgtcaccaagagcctcgagttcgagaagctcctccgcgtcacgctcgacctcatcaccgaggcctccggctccatgtccgccgacgtcgccctcccgcccgccaccggcggcggcggcggcggctatggctatgaatccagcagcgccgccgccgcgccggcgccttccgagtccgactccgacgtcggctccggctcaggctccgccgccagcgcgccgggcccgagcccatccgacgacaccggctacggcggctcctccggcagcccatccagcagcccatccagcagcccctccagcagcccctccggcagcccctccagcagcccctccggcagcccctccggcagccccgccggcagccccgccggcggccccaccgccggcggccctgcatctggaccgtcgtcgtacggcgccgcctctggccccgccgaagggccgtcgtcgtccggcgccgcctctggccccgccgaagggccgtcgccgtccggcgccgccggccccgccgaagggccctcgtcgtacggctccaccgaagggccgtctccatcgccgtcgtcgtccggctccgccgacgcgccgggacccggcgccagcgcaccggattccgaggagtactgagcgacgtacggcgcatgcatggctacacagatttttccttcttcatatcaccatttctttttctccagtcttctttgaataatccgttgacactagcgaagattatgatgggttgatcattaagcctacgtagaaaatccattgacataattattacaatggtgtatggggaaaaggggaaaaatattagtatggtttatgaggattatttcggatcaagaaatgaggcccatataggagagatggcatgtggccccaaatgggagatttttattttattttatttttttgggaaaaggagattttttttattattattgtaatattgttatatgttgtattggttttctttgatgaaattatatctgttctaagtgctagctccatgactccttttttttttcatctgatttttctcggtgttcaaacttggctcaaacatagggtgattctaattatgacatcggcgttggcatggtagtgttgcattatgctaaaaatagttttgaattttgaaaattagtaaattaccccagcaagctcataaacaaataaacttttatgaaaacaagtacttgtattctgattgagacaaaatttatctaggttataatcctataatgtgcatatttttttgaaacttttttcattcctaaatctgaatattcaactgcatatatgtatttgactttgttaagttgctaaattactttaaacaatttggaaaaagttgcaattgcacactccctctgtcccataaaatattccattcgtcccaaaatataagcatttttagacttcgatacagtcttcgagatgctaatttgaccaataat

SEQ ID NO: 14412 - DNA, 1501 bp, Oryza sativa
ctggtgcacgagcgagttcgctgacatgtgtgctctacgctgcgtgttcaggcctgctgccgaatggcaatttcgaggaggcgccggacaagtcgcagctgaacggcacgagggtgatcgggcgctacgcgataccgcagtgggagatctccgggttcgtggagtacatcgggtcgggccagatgcagggtgacatgctcctgccggtgccggagggcgcgtacgccgtgcggctgggcaacgaggcctccatccagcagcggctcaccctgacgcggggaatgcactactccgtcaccttcagcgcggcgcgcacctgcgcccagtccgagctcctcaacatcacggtcaccccggagatcggcgaggtccccatccagaccgtgtacaccagcagcggctgggactcctactcctgggcgttcaaggcgagacgcagcgacgtgtcgctcatcgttcacaaccctggcgtcaccgatgacgcggcctgcggccccctcatcgactcgttcgccatcaagactctgcaatctcctccaagcaccaaaggtaactaaagatcgatgtcactattgaagtttgctctaatgctgtaattgcatccttacgtagtttaatacgttctccgtgaaacaaatcccgtcagataacttgctgaagaatgggggcttcgaggaaggcccgtacatcttccccaacacgtcgtggggcgtgcttgtgccgccgatggacgaggacgactactcgccactgtcgccatggacgatcatgggatacaccaagtccgtcaagtacgtggacgcggcgcactacgccgttccaggcggcgcacgcgcggtggagctggtggccggcatggaggcggcgctggtgcaggaggtgtgcaccgtgcccgggcggtcgtaccggctggagttctccgtcggggacgccggcgacgggtgcgtggggtccatgtccgtgcaggcgtacgtgtcgcacggcagcgtgaaggtgccgtacgagtcgcagggcaggggtgggtacaagcgcggggtgctcgagttcacggcgacggacaagcggacgcgggtggtgttcgtcagcatggcctacaccatgaagcccgacggcacgctctgtgggcccgtcgtcgacgacgcgtcggtcgtcggcgtccacagccatcgccggcttcttctgtaacataggctaacgtcaacgtggcattcattttgtactgcgcctctccggttcgtcggaaattatgtatagttcgatgatacacatatcattgaattgagtttcctgcaccggattttctcagtaggaagacgaacggatttgagattcagatgtagtccttcgcctgtcgagggttaactcagacatctgagcaccagaaaatgttttcgcctgtgctagatttcattacaaattagaagctggatgaatgcattagttttagtagagtgctactgaaaatacactatgttacaccaagatgcattgttttaacatt

SEQ ID NO: 14413 - DNA, 1501 bp, Oryza sativa
aattctaggtaaaagtgataataaaactattaattaggtgaatatcggtttaggctcacttctaaccgaagtttggatcctctttaccatatatctttactccatatttaccatatttctttactctagcctagacaccactttgtagacccttttcccttaacatcgttcgctgttcataaattttattttcaacccatttttttcccttttcaaataagccttcttgtctatgtttttaaatctgaaagatttgaacatattaatacacggtaaaaaaaacatacgataaaataggggttaacacagtcaggccgatgtcagtttttgatatttttagcaataagatgaacccgtctaacggcaataacatgtaaacaaggggttggtaacacaatccggtgtggctacttgctccgttgaaataaaattttgtgaacatatgcccatatcatgctccttctcaacgaaggtttgaccggcggcgaggacccatacttgccatggcaactcgctcccactagcgaggatttcaaggactgtgtggttacaagtatgccacgtatagtggcgaagcgagaccaacgtcgtttctatgcatgagtaatcatgcatagtctcgtggttaatttggcagaaacgcaatgccaatatctccaatccaacgctcaaatggtggaggagctgatcaatgtcatcacgaatgaatggcaaaaaaaaactcgatcatggtggatttgttcaattttgacactggttcacctatatattgtcgtagccgaggtcctcaggaccaggataatgcaatgaagagcgggaagccatataaatcattgtaatttgaatattttctttccaacatttgttgatagtaataaaatgtttccctcaatcttaatagaactctaaccatatagcttgagaaaaatatatagaaatctagatacactatagtccttgatatgataatcaatctttcctctatatttttacgagatcctttttgctactttcaggggttaatgtgtaatactatttctttgtaggaacctctgtgcaacttcgaaggtgtaactgaattatagaatctatctagatcgtaggtctgtggtgccttgccttaaaaaaaaaaagctctacacggtcacactagtatcaaccgtcataggaagtgacattcgaagtttattttcaagatagatattatggtttgttgtttagataatatgaaaagaaggttaaaaataaaacacaaattaagcatccacagggagaaaaaaaaaggtcaattcagagcaaactaataaaaatcccctaaagagagagagagagaaacccgcctcggcttgcgaacaagtgtaacaaaaatccccaaatcgatcgaaaagatccccaaaaagaaaaagaaaaaaaacttcttttttattccccatccactcgtagcgggaaagagaagagaggggctctcccggcgctcggagcgcagaagcagcgagccgct

SEQ ID NO: 14414 - DNA, 1501 bp, Oryza sativa
aagtgtaaaattattaagaattaattaattatttattaatgatctatctcgttttatgtgcaaccaagttaattggccgagctaaatgggcagttcaaacgcacgatagagacagacaaaatgctggaaagtttacataagtccatgggaattgtaaaatgcgtacgcgaatgtttatatcgaaagcccactgctttgaaattttcgtaactcggcctccagggaaagcccagtgtgatggatgggccgagaaatttaagcctgtcaatgaggccttaaagtggggtggtacgcatctttggtgatatttggtccatattagctgcagtacaaacaaattaatctagtttgtatagattgatatcattttaaaccatattattttttggtaaaataatccatttagtttttattaaactttgataaatacataaaaaattatgctaaaaattgacaatattgctaaaatctttaaaatttgataaatgtttatttttgctacaatctaaacaacccctaagactcagcgaatttatactccagagcaagatagccaacaagaacattaacaagtgcaaccaccaacatgtccatttaatactgttttgaattggggagactgaaggagagggagatgattgtccttttacaaatgattacataaatccatgattttttatgagtaaaatagattgcttgcccttaattaaacttatcctaagatgtcatctagtttcataaacttagataacatacatcttagatacataatctttgtttaatataccacgtcaagtccaaagtgctgcttgcgggactagagtactgaccagggttccccttattctttttgcgcggttaccgcacccccacgataaggtgattactacggtaaccgcgcgattaccgagaaaccacgagacgtaccgtggtttaaaaactgaaaaagttaccgtgcatggtaaccgctataactgcatagtaaccgcatggttttgtaaactatgtactgacgtggccatctaccgtgggtgaagtttcttatgcagcccctttcgttacaataatatcaaaatcggctctcataattcagcatgccaccacttgaataggagagcaggcgaagaagtagctatatattagggcgacattgatcatccacaatcaaattaaaggtccccatagcgagatatatgacgcgatagggagacgttaagtttgtgcacatacgaatgacccggcctatactcttccttcccttttgagccgagcaattaatttagaggttactgtagtggaaattaaggggttaaatgaaaaggtcccatcattatggatggtcatgttagctctatggcccatctaattaaccgatctcacgtggtacattaagccaaaattataggctctaaatgagcattttgttaagttatgggtctagatgacattctatgataagtttaaggattggcattgtattttgcctttctttaattaatgt

SEQ ID NO: 14415 - DNA, 1501 bp, Oryza sativa
atattgatttgccggtggggtctgaaatttccaaaatttcgaaccaaaattgcaatcactgggtccaccgaccccatctcaacgcggacattgtgatgataatgaggcgctgtgaccgcggccatgctgttgtgcgccgctcgttcgtagcgacactgcccttctcccctctgattccgcacgctggagacttgaacagagatgaggaagagaggggacatgaggagagagagaggaggaagatgtttcactgacatgtgaggcccacaaggtttttcatcatttatttttgcttcccgtgctacgtcagtcaaaatagcctacaatactgccttggaactatatttgtaccagttttaaaagaaaagggacacgttatatctggcattgcggttgaagaatgtaattcaaactcaacgtgaattatcagggacctaagtgaacttattccaattgtaaaccagtttcatttttattttttctagatgggccttcacggctacttactcgccggttacttgcagcggcccatcatggcatcatggcccagagcagccaagcccagaagcagcccagagccgcagatgcagcaagtccctactccctagtcgccggctgctcgcggccattgacggcgattggcgaagtagtcgtcgtcgccggtggcggtggcggccggccgggtctctggcggacggcgcagcgacgtcatccggccgggtttgaccacgacgccgcgtctcgatcgagaaaacaacggaggtggggatgagggaatccgaccgggatccccgagcatattccgctcccggtccacgccccgcctgcaatcatctccatttcgttactagtttactaatactatacgtgtgtatttatacgcttgattcttttatttatttttctttgcctcacctgccatgatctgcatgatgtcatactggtataatattctgaatataccatacgtgttccagtgtcagaaattaagcttaatttgatttagctgttccctttgctggtaactaattagccgctgtgtgaatgattagtaggattcggatacagcgagcatgtataatgtatatgttgtctgaactttgctgtcacagtgcgttggtgtcttcctgaagagatcatatatacatatatgtatatgtatgttgattctgctgtgtgtgaatgatgtggcctactggcgtgttctgttccctgacaggttaaatctcatatccatatatatacatatactctctccgtttcaaaatgtttgacaccgttgactttttaaatacgtgtttgaccattcgtcttattcaaaaaatttaagtaattatttattctttttatatcatttgattcattgttaaatatactttcatgtacacatatagttttacatatttcacaacttttttttaataagacgaacagtcaaacatatgctaaaaagtcaacggtgtcgaatattttgaaaggagggagtatgtaataatgtaaa

SEQ ID NO: 14416 - DNA, 1501 bp, Oryza sativa
gtttgaccattttcatctaattcaaaagaagatggtttttcatccctagatatacccttttaattgcaaaaaaaggttgatatacattaataagagatattgacttaaaaaatatataatgaaactacaaattgtaacaaggtacttttataacagatatatcgcataaaaaatatagaagttaaatttgacttatttgtaacaataaaaaaaataaattaaactaaaacttgctaaaacatacatctagaactatatttgttccttttggttataacttagtagaagttttcgcaaacccgcattacacgtcaatatatattagaaggaacttatataagtcaaattaagttttcgcaaacgtgcaaaaggattacacgtcaatatatattagaaggaacttatatataagtcaaattttacttatataatgttcgtggaatggtatatcatatattaataatggatcatctactacaggaagcctgtaacattgttcgaagggagggtggcaaattgcacgacgaggaagcaacagacgaatgccaagaagaagaagaaaaagaagctgagcacgaggagtaagacggcatccgctccgtgatgggacccgtacgtggtggaagtgcagtggatggcgtagcagaccacaatgcatgtattgaacactcacggatcgatcgagtatactgatcatgtttgaattcggaaaagaaactttcgtcaaaattttctaactagcaacacgattgcaagaatcgatatgataaaaaaaaagacgtgtattttaaatttaaagttttaatttgtgatcatacgtgacaaacagcgccctgttttcatcactgacgtagctagcaactagcttccatccaaagaagaattaagagctagcccatagattgattaatttgtttacattgcatatgtacgtacattcatgtagtgctgaattgaaggtacgttaatcattctcgatcccctcaactccgtgcggactactaatcaacatgcatggaagttgatatatgaaaaattaatcctaaagagagaaatttgaccttgcctagctagcttgtcaagtcaaatgatcattcgtttgcgaaggaggcaacgtaacgactaacgactagctaggtagcatctgcaacgtttgtacgtactacgtagtacatcggatcgtacgtactggccggccggtttgggtgatcgatgaactcgatcgctcgatcacacgcaactgataaaatagaacaatcgatggaagctactagctcacattattgagacaaaacgcaacacaggtagcaatttttgccaaccttcatacagctgcgcgaaatggatgattttgtaggtagtcgattgcgttgacattttgacatcattttgtatatgcgaaaatgattttgtaggtgcgaacgagcaaacgcctataaattgatgaagacactcgcatgcaagctcattcaccccaactccaagacacaaaattaagccg

SEQ ID NO: 14417 - DNA, 1501 bp, Oryza sativa
gccttgggacagctcctctggtagaaaccgtacgacaagcccttcgccgtcggcgggtaatcgccggcggaggccgccggagcacacagaagcagcaagctgcagcaggaaacgaccaaaacctgcaacgtgctgctcatttttctcgccatctcgatcggcttaattttgtgtcttggagttggggtgaatgagcttgcatgcgagtgtcttcatcaatttataggcgtttgctcgttcgcacctacaaaatcattttcgcatatacaaaatgatgtcaaaatgtcaacgcaatcgactacctacaaaatcatccatttcgcgcagctgtatgaaggttggcaaaaattgctacctgtgttgcgttttgtctcaataatgtgagctagtagcttccatcgattgttctattttatcagttgcgtgtgatcgagcgatcgagttcatcgatcacccaaaccggccggccagtacgtacgatccgatgtactacgtagtacgtacaaacgttgcagatgctacctagctagtcgttagtcgttacgttgcctccttcgcaaacgaatgatcatttgacttgacaagctagctaggcaaggtcaaatttctctctttaggattaatttttcatatatcaacttccatgcatgttgattagtagtccgcacggagttgaggggatcgagaatgattaacgtaccttcaattcagcactacatgaatgtacgtacatatgcaatgtaaacaaattaatcaatctatgggctagctcttaattcttctttggatggaagctagttgctagctacgtcagtgatgaaaacagggcgctgtttgtcacgtatgatcacaaattaaaactttaaatttaaaatacacgtctttttttttatcatatcgattcttgcaatcgtgttgctagttagaaaattttgacgaaagtttcttttccgaattcaaacatgatcagtatactcgatcgatccgtgagtgttcaatacatgcattgtggtctgctacgccatccactgcacttccaccacgtacgggtcccatcacggagcggatgccgtcttactcctcgtgctcagcttctttttcttcttcttcttggcattcgtctgttgcttcctcgtcgtgcaatttgccaccctcccttcgaacaatgttacaggcttcctgtagtagatgatccattattaatatatgatataccattccacgaacattatataagtaaaatttgacttatatataagttccttctaatatatattgacgtgtaatccttttgcacgtttgcgaaaacttaatttgacttatataagttccttctaatatatattgacgtgtaatgcgggtttgcgaaaacttctactaagttataaccaaaaggaacaaatatagttctagatgtatgttttagcaagttttagtttaatttattttttttattgttacaaataagtcaaatttaacttctatattttttatgcgatat

SEQ ID NO: 14418 - DNA, 1501 bp, Oryza sativa
gagggaggcgccggccgggctcggctcggcctcaaagccgaccggcggccatggcgaccggcggcggcacgcgcggtcaccggcggtgaccggcagcgcgggagacggcggcggccggtacgaaggcggcggcggcggccgaagacgacggcgcacgcgcggaggacggcggcgcccatgggagagagaggaaaggaaggaggagaggggattcctcaccggcgaacacggcggccggcgcgaagggagaaaacggcggtgacgaccggtgatgccgaggcgcgaacgggcggcggcggcaccctaggagagagcatagaggggttagggaagggaaggcgaccctggcggcttgaattgccggccggagacggaggggagagagggtctcaccggcgcgcgaggagaaaaaaggctccggcggtgattcgcggcaatgaagcggcggccgaggtgcgggcgggctcggtgagcgcgacggcggcgatggtgcggcgcggcggcgcgacgcggccgactgaaggcggtgtgtggcggtagtggctcggcctcgcgatgggaaggtggttccggcggtggaggagggagatggagtgggggccggggtagagcaaggcatggcgatgctagcggcggcggcggcgcgacgcggcggtggctagggcagagaggagcgacggccggagctcgccggaaagcggcggcgcccgggctcgcggtgcgagcgcgatttgtggcacgggagagctcggggaaattggggaaaagagagaagggagcccgtggatgctttttatgggctcgggaaggcgggatcgaggccggacgtggcggaatcggccggcgaagtggggaggtgaagtggagctcgtggggaggtcaaaccggcgccgtttcttgcggggtgagtgggggaaatggtggaggacgtggagggggtcgtgtccacgtcgttggatgcgagctcgggtgcgggagggcgccggattttgcggcgacgtggggaggctcgggcggccatggcggcggttggagccggaggaaggggatgacaggtggggtccacgggtcccacctgtcggcgaagggagagaagaagggacgcaaaacagacttttgtgagcgggccaagagagaggggagccggcccgagagagggagaaggcgcgcgggccgcgggagaggaaagaagacttgggccgaaaaggggcccaaagagaggaagggggaaattttatttgttttctttttattttaattggttaaatgatcttcgtgactttaaaactatttctcgagctccgaaaattcacggaaaattccggagagtacattagggcacaaagaatattacaaaatattcccggccaatgatttttaagggaaaattttaattctcccattatttcacttgattaaattgcttaactttttattcaatttctaggaaatgcattattaaatgatttttaatcccgaacgaaaatcggggcgttacagt

SEQ ID NO: 14419 - DNA, 1251 bp, Oryza sativa
aaatagacttttgcggaggaattcgatttgggaaggaattggattcgggatttgaattcgacgatggatcggggattcgagatccggaatggcacagagactgactgcaagcgaagaaacaattttcgcaattagggtttttagaatttaaattttcccgctaggcgccacgacggaacgggcgctacacaacgtcttagcggcggaggaggagcgaggtagcggtggtgctcgaggcccctcactccacttgcggcagcaactgaggagaggagaacggggagacgtcgcccaaagcaggaggcgcaccggcggcgagggacgatagtgctacgtggcagcgggaggaggaaaactcgttgccgaggtcattgcatgtgcccacgtccatggccaccgccttgtctgctgtgcgcgggggctggcccttccccggtgtagtctcactcaccggcagctgtcacgcacccctccgcaacaccgacgtccacgccatttccaccgtccgctgcccgcgtccatggccgccgccttgtccgccgcgcgccaggaggcggtggccccttcctcggggcagcctagcttgtcggcggctgctgcccgtacctccgcaacaccgactttcgcgccgtttccacaacgacatcaatgccgctatcttcccctacttcgcgcggtggcgccaagcgtttggcaagagaggaatagaggtggtaactagtgaggagaggggaagtagtcattgacgcgtgaacatgctgactcagctgccacatcaactaaaaccagagacaataccaccgaaaatgctgcacgccgggcgcctgagcgtccgaacaaaaaatcggacactcggaccacatactaagtattttaaatagctttaaaatgatttttctcctaaattaattatccaatctatgatccgatcacgccgttgtattcgttgcaattaaatctttataacaagaccacacatgattatatttcgacaaaaaaatattttagcttttttattgatatttttttagaatgctgcatatggttcttttgatgtttcaatcaatagttttacgatgttttagctagtgtactcactatgtacggatcaaatgttgcagtggattttgatattatggaacgcgtcattgcaacaaatcacccatatattttgaaaactctctattaagggaatttgttttctttttttggttccacaaaaaatgtttcacctagtgtactcacaatgtt

SEQ ID NO: 14420 - DNA, 1501 bp, Oryza sativa
gccgttgccggagaaggactgcgccgccaactcacgggcgggcgggcgcgggcgactcgcgaaggaacgacgacgcagcgagaaacgaaggggcggcgggcgtcggcggcatcatgtgaggcccgcgaccccggcggcgtctggcgattcattgggcggcgacggcgtcgtcttgaatcgcgggaggcggagtcgaaacgaagcgacgcggacaacgcgtccagggcaccgggaaaaatttgataatttgacatttttttcgttgcctaattgctttaattgacacttgtgaagatgacatgtgggaccatccgagtgaataaaagtgggccaggatgtcaaataatcgaaacccatttaaaggagtgttaaattatcaaatctctcggggttgatctgcaaaaaatgaggttaagcataccacttcggaaaagtagaaaggcacggtgttaaaccacaggcctttaatggaactcgatcactccatctctttggacatgcatgtgttaaggacatagcaaggctaattgcgggcagttatttgcaaaattgtcccacttccacccctacccatcggatgccgagctctgctatacatacgataaacatcgtacgattagtgtacgatgccttctaacctctaatgcatgcagcaaatatagggtccacaatgtttccatggcccaatcatttattatgcatgactggatcgtaacaagtttatcgtatatacagcaatttccatcggatgcccatccagagatcttgattggagttttcaaagtttgcacaggatgtctggtttccataggatacgctgcctacatagttatagggtaaggaagacgacgtcatgacgctaactgtgagatatggtcaacgtgcaaacatgctagcctcgtctttccgcttatacttatgtttatcagccaaaatttaaattttcaaccttaaatttgaagttgatttttgaggtttttttcaatcgaagtttatttttcagccttagatatggtcaacgtgcaaacatgctagcctcgtctttccgcttatacttatgtttatcagccaaaatttaaattttcaaccttaaatttgaagttgatttttgaggtttttttcaatcgaagtttatttttcagcctttaattttagatcgttaagaacacgtatataaaatttttatttacagattaattttcgtttgtaaatatatcgtttggctttttcagttttgtgttttacctgtggtgaaaagaatagtataaacatcatgcacatattctgttagtctggttagccttgtgttctgtttgttctgcctttctggtttttaagagaagttgctcagtaaaatcatgactaacagactagtgctgcaatcaacatatataccatcaagtagaacaaagatgcgggaaggcacttgatttacactgatggatagagcactggcatgaatagatgaatgaaatgtttgcaagtcgagttcaattacgta

SEQ ID NO: 14421 - DNA, 1501 bp, Oryza sativa
acaacatgcatgtcaaatggtagtatgtcattgtcaaaagaacaggaagaggaaactgcagagtttggcattgagtagcacaagaacgatgtctgtcttacttggattcatggtgagagggagtccgaactcgttggtgaagaagttttgcgtcggaattttgcacatgttgacgcacattccgacgcagccgctgttctccaggtacctgaaacggagatgaatgttttctgaattttttactgaatctcgcttgaaatccaagacgaacacagttgaatcgtccgtcttacctgcatttctttatcagcactccactcttctgcttcaccccattgacctcaacctccacaacctgaaagatcaaggaattgatgcaatgagttcatgacgatgaactagctgtgtctctgaattatactcctacctctgatgggccgacgagccagtggaagaaggggacggtgagggcagcgttgaactcgcaggcccacctcgtcggcgggaagagcttcttgaactgctcgggggcgccgggggggagcatggagaggagcacctcgcggacggcctcctgctgctgcgcccgcgtccgccccaccatcacccgccgcgacacgtccacgaagctctcgtagtcccactcccacaccgacctcgagctcttctccttcttcttctccttccccttcccgccggagctggagacgacggcgtacttctccatcttgcgcgcgaacagccccatgaaggcgcgctccaccggcccgtcccggtactccgtcttctcccccatcggcgccggcgcagtcgccgcgcaccgaaccctcctccctgcagacggtacacgcgaccatggcgccgccactggcgccaacagcaacgccgccgccgccatagtcgtcgtcgtcgtacgtcgtcctggctcagctcagcctctgcgtactcttggcgcgtctccaggtttcatgggcggtggtggtggttcttggcattggcgttgcgtcgtcaggcgaacctgaggctgccggcgtgacacggtggcggcgagcggggggccatcgccgtggatgcttggcactgggtgcacgacggccacaataatttggtggattatatggtgatggtgatgatgtttgtggcgattcgattggctcgtggcgcccacgattttttgtgtggaggcccaaaggatggcaagtccaatgggctaaaattttcaccttggaataagttcactttgggtccctctatttgtcactcagtccgattttcgtccctcgaccgcaaaaccgggtacgacccgtcccccaacttacgaaaaccgggcaaacgaggtccctcagcggttttgaaggcggttttggatgacgtggcatctacgtggcttgtttgactaggtctccgtcccacgtggaattaacgtagcgcttacgtggcaattttcaacccgaaaaataaataaacctcgcgggacccacatgtcagtttcacatagaaa

SEQ ID NO: 14422 - DNA, 1501 bp, Oryza sativa; identical to SEQ ID NO: 12526

SEQ ID NO: 14423 - DNA, 1501 bp, Oryza sativa
atgacagtcatacaataattataagatatctttattcatacaaaaatcataaaatattacaccaaataattcttaaaaactatttgtaaagttttaaactaattttaatgtgttttacttcttttatttttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaaaagtgtgcaaaacataggtgcaaatgtagtatgacaaaaaaaaacattggaggataaagttgcaaaccttttaggcacctccgatttgtatgtaatcaccaaaataaattcaatagaaattttggcatgacctcccctcttttttgaagtaattttgaagcttgctcgggcagctggaggaggaagaagacatatatataggggtgggactttagtcccggttggtagcaccaaccggggctaaagatcaccgggatcattagtcccggttggtattaccaaccgggactaaagttaagatctttagtcccggttggtaacaccaaccggggctaaagatcaccgggatctttagtcccggttggtaaagttaagatctttagtcccggttggtgttaccaaccgggactaaagatcccgggggggcctgacaggtcctgacagcattcgaaccgggactaaagatgatctttagtcccggttgataacacaaaccgggactaaagatcaaatatgcccgtttcccttttgaaccgggactaaagatcatctttagccccggtttttattgcatccgggactattgtggaaatcggccgaccgacgaaagatggtttctccaccagtgttacttcctctaattaacgtgtcagcggtctaggtcacgtaagagatttctaatataatgtatgcgtttgttcggagaacaaagggagtttgtttgtttcgttttccacacgcacgtttcccaaactactaaacgatgcgtttttttaaaaaaaatatatatgaaagttgctttaaaaaatcatattaatctatttttaaagtctaaaataattaatactcaattaataatacgctaatagcccacctcgttttgcgtatctttccaatcttctctatctccttctcctcaaagtctcaaacacagctacacaagatttctctggtatactgtactctaacatacgtgtgtacaaacatgtcagcttcacaaaatcggagagagagagagagatcgacgtcgacgtcgctgcgaggctagtgcgtgctgtgccccgcaagctccggtacgtacttcggtacttactctatatctacacacgtacgtgtgctatagctagcagctgagcttgcgcgagctgcagggaattggttaatggcgtcgccgccgcgggaggaggccatggatcagaagg

SEQ ID NO: 14424 - DNA, 1501 bp, Oryza sativa
ctcagaaatggcacggaggaacggacagaagaagcgacgttgatgtgcggctgtttctctctgtccggggactacaagtgataattgggggcgaggttataatgcattgctcgactgacattgacaagtcccgaaaaagaaacggttacatgttcgttattgcgcacgtccacattcgggaactgatcgatcgatttattatacgtatgtagccacaaatacctcacgactccactcccttccttccttttaacaccatctatcggataaacagggaagagcaagctagaagctaatgatagattttttctttctttcttttcctcccatttggagcggcggccaagagaatacacatactgtaacaacatctttttcgtcgaatactacatatgtagtgtatagagcatcaacgtgggtacaaaaaggaaaggaagcggtgcggcattggaagcaagcaaggatcggaagcatcccgtgatcatgccatcttcctaacctatatattcgctattatatactccctccgttttaaaatgtttgacactgttgactttttagcacatgtttaaccgttcgtcttattcaaacaaaattgtgaaatatgtaaaactatacgtgtacataaaaatatatttaacaatgaatcaaatgatatgaaaagaataaataattatttaaattttttaaataagatgaatggtcaaacacgtacttaaaagtcaattgtgtcaaatattttgaaacggagggagtatattttttattcctaatgagtggatcgctgattaatctataatcgtggctcaattagcctccatgagagatgacagcgtcacggtcgatcgatctccgtatcattcaagcaggcatcgcacgtggaggagtggaagctagtgtggaaccttccctcccctgccgcctgcctgtacacgccggcgcttacagtacaccctacaagcgaaagaaacccaaacaaaccaaaaaaaaaaaaagttgcaggcagcgaatgcccctcagcacccgtgcgcgatcctgccggtgggtctcgcgcccgtgccgtccctgcagccgcgcgtacgtacgcacgccgcgatcgacgaaacacgggcgcagtcgtcgtcgtcgtcgtcgtcccggtggtgtttcaagcgcgtgctgtgcgtgcggcggcggtgacaccgtgcgcccgcgtacgtatccgcgcgggacaagcagcggacgggccgagcaaaatccggtgttgtacgcgggccgggcgcggtgaggccgtccgctcgatgtaggccgttccgttgcggaataagttcaccggaggtccctcaatttaacagcaagattttttgaggtccctcaaggcctcaaccacaaaaccagaaatgttcgcccctaaaatttcacaaaccgttcaccagaggtcccttggcagtataggtgggtggttttgcttacgtggcatcctagtcaacaaaaaaaataaaaaaatttcgtgggacccaca

SEQ ID NO: 14425 - DNA, 1501 bp, Oryza sativa
ttccctgcagctcgcgcaagctcagctgctagctatagcacacgtacgtgtgtagatatagagtaagtaccgaagtacgtaccggagcttgcggggcacagcacgcactagcctcgcagcgacgtcgacgtcgatctctctctctctctccgattttgtgaagctgacatgtttgtacacacgtatgttagagtacagtataccagagaaatcttgtgtagctgtgtttgagactttgaggagaaggagatagagaagattggaaagatacgcaaaacgaggtgggctattagcgtattattaattgagtattaattattttagactttaaaaatagattaatatgattttttaaagcaactttcatatatattttttttaaaaaaacgcatcgtttagtagtttgggaaacgtgcgtgtggaaaacgaaacaaacaaactccctttgttctccgaacaaacgcatacattatattagaaatctcttacgtgacctagaccgctgacacgttaattagaggaagtaacactggtggagaaaccatctttcgtcggtcggccgatttccacaatagtcccggatgcaataaaaaccggggctaaagatgatctttagtcccggttcaaaagggaaacgggcatatttgatctttagtcccggtttgtgttatcaaccgggactaaagatcatctttagtcccggttcgaatgctgtcaggacctgtcaggcccccccgggatctttagtcccggttggtaacaccaaccgggactaaagatcttaactttaccaaccgggactaaagatcccggtgatctttagccccggttggtgttaccaaccgggactaaagatcttaactttagtcccggttggtaataccaaccgggactaatgatcccggtgatctttagccccggttggtgctaccaaccgggactaaagtcccacccctatatatatgtcttcttcctcctccagctgcccgagcaagcttcaaaattacttcaaaaaagaggggaggtcatgccaaaatttctattgaatttattttggtgattacatacaaatcggaggtgcctaaaaggtttgcaactttatcctccaatgtttttttttgtcatactacatttgcacctatgttttgcacacttttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaaataaaagaagtaaaacacattaaaattagtttaaaactttacaaatagtttttaagaattatttggtgtaatattttatgatttttgtatgaataaagatatcttataattattgtatgactgtcattattgtaagaataattatttgtgtgcggtttttttgactcatgtaga

SEQ ID NO: 14426 - DNA, 1501 bp, Oryza sativa
atccgtccgatttccttcccgcattcatcgccggcgcatctatggcggccgaaatctccgcgaccgattcctccctctccggccgctctttccttcccccggcactatttaaacgttgcccgagctccgctcttccgtttccaccgctcgccgctcgctctcgccgtcggattcgtgctcgcgccgtgctccgctctctccgccatcgccgccgagctccgtttcgccgccgtcgtcgctccggtcctcctcccgactcggcgtcacctccatcgtcttcgccgagtggttgccgaccccgtccgccgctccgcttcgcccgccgaccgccggagcaccgtcgtcatcgtcatcccgagccgcgccgccgtcttcttccgctccgtccgccgtttccaccgccttcgccgtctcggggtgagccgaagaccgccgttcgctttcccccttccctcctctctctcgggtgccgctccgccgcgccggtggtcgccggcggtgaccatcggggcgcgggcgcgccgctcccgtcggccgcgccggcgaggccgccctcgggcgcgccctcgcggctgccaagtgggcccggccgtcagccgcccgcgcccgcgggtgcggctgacgcgcgggacccacggcgccgaccgccgccagccgcgtgcgcccggtccaccgtggaccgtggggctgacgcgtgggccccacttcccgtggacccggtccgcgcgcccgctccctcggctgacgcaataaatgagatttttaattaaaatttaaatgaagaaattcgcaaatatccatttaaagagcatataaacttcaaatggccatatcttggccatttgaactcggaattggaccgttcaagtctctaatttttccttaagatgtaaagaacccatttttgtgctttgtttctgctgttatgtggagttatttagtgttaaagcctttttcttttccgttggtcgtgtagacgctgcagcttcggaagatccgctcttcgtggaagtcgaagccgtcgattgggaaaacgagcaaggcaagacacatcatcttgatcatattgaatcccagtttataaaattatgttgatttaaattattgcattatcgctttatttaaattcccgcgttatcactgttttatttagccatgcctatttacctttgttatgaccatattattattgtattgttattattattcccttgttcaccctagagcaaacaaaacctcaactagtggacactctactcatggcaccactagtttaattttaggtagatgcttcgcaatttaattaggtaacattaggcggttttacaactctagactttgggatattctcatatcatttggacactatggaattgttggtttatgttggaattggacacacacctctcttcctctttcaaaacccctaaaacctgttttcggtggggtttgggtgcatgccagttgtgggaagtagcaccccggccactataaggattaa

SEQ ID NO: 14427 - DNA, 1501 bp, Oryza sativa
aataccaatatttgcacacatgggtgcgatgttttcaactggaacgaaaaagttcaaaaagcagcaaaacatgagttttggacatcatggagcggattgggtgcgtccgtgttgaaaaattactccgttactcgcgtgaccaacttttgtcaattaatgctgatattggcacacgtgggtgcgatgtttttaaccggaatgaaatgttcaaagagctagcaaatattggcctatgttggcacacgtgggtccgttgtttttgccaattaatgtaggtattggcctacgatggcacgcgtgggtgcattggttttaacctgaacaagaaaaaacagttaaaaaaccagaaaaacatgagattttgacttattggaatggattgggtgcgtccttgttaaaaattcactccgtgactcgcgtggcgaactttgtcaattaatgccaatattggcacacgtgcgtgcaatgtttttaatcggaacgaaaaagtttagaaagcaccaaaacatgtgttttggacataatggagtggattgggtgcgtccatattgaaaaatcactccgaaactcgcgcggcgaaagtttgtcaattaatgccaatattggcctacattggcacacgtgggtgcgatgtttttagccggaaaataaaagttcaaaaccacaaaaacatgagttttggacatattgcagtagattgggtgcgccctcgtcgaaaattcactccgtgactagcgtggtgaacttttgtcaattaatgtcgatattggcacacgtgggtgtgatgtttttaacaagaacgaaagattcaaaaagaactaaaacatgagttttggacatattggagtggatttggtgcgtccgaatcgaaaaatcactctgtgattcgcgcgatgaactttttcaattaatgctaattttggcacacgtgggtagcggatccaaaattttcaaaatacacgaaagcatgagttttggacatattggaattgattgggtgcgtccgtgtagaaaaatcactccgtgactcgcgcggtgaacttctgtcaattaatgccgatattggtacacgtgggtgagatgtttttaaccggaaaaaaaaagttcaaaaaacagtaaaacatgaattttggacttattggacttgatttggtacgtccgtgtcgaaaaatcactccgtgactcgcgcggcgaacttttatcaattaatgccaatactgcactatattggtacacgtgggtgagatttttttaaccagaagcaaaaagatcaaaaagcaacaaaatatgagttttggacatctcgtagtggattgtgtgcgtccgtgtcaaaaaatctctccataactcgcgcaacgaacttttgtcaattaataccgatattggcacaatggtgatgaaccctgagttcctgacgacactcaaggctgttgttggcccgatctttcggtgagttgtgataactacgatttgggagaaacgttgacgatccgactacaac

SEQ ID NO: 14428 - DNA, 1501 bp, Oryza sativa
ttagtagaaacaccgttcatgcaaatgaagtgcttggaaccgactgaaccggttttgccataaaccggggttaatccaaagatggttggactggcggcgtgcgaagggatgggctccatgtttagtaatgggctaaagaaggccctgtaaagtttctgaggttcggaagcgttcaacccattagaggccgcatctttgttaatatatagttggtgaaaacagccatcaccgggtttacaatcctgcgcatgtgatggccggatagatgtaacaaacatactccctccggacactaatacatgacgtttcggatagctaatttacatagaaatcaagcaaaaaaaattgtcgaaaacaacatctatagaaatatggagggagtacaataaactcctatagtgaagctagaagatctaatccatccgggccaagtctcatatgcacacacatatactccctccttccacaaatacttaacgtttttgagctaaccaacgtcaagtaaataaaaccggagggagtacatatataagatcacaaactatattctaacaggcccaacatggcctaaaatagtcccacaaaggcacttttaaggcaaaaatctcccgaaatgcaacaacctatatagtttcattgaagtaaaaatatgcatatgttttgtatggtgtggttcaacatttgaactatataggcgacccggcgaaccaaccagagtgaactggttttagtccaacaacccagctgggtcaaccttcggtctagatttttccactatgcatggtaagcgctacaccggctggctccttgggtggtcggatgggcaagcctgaggatcaacatatttcttttatttgaaatttgataaaattcaatccaaatttgaaactttctgactagagattgtatgccccatgcaatatttatgagtggataagggaccggaagttgtatgccccatgcattcgcgcagagaaatgtactataattaaccacacgagggtcgcgcgcgtacgtagaaaaatacatatgtgccggagtgcgtgcgccagatccgcttctcacgcgcacgtagctagagtcgtcgcctgggagtagcaaaacatgcatatataagcataaattataagcaaaagatgattcgctatttaaacgagtgagagtgtagtaagcatgaactaactatatccggaaacattatgcactaccctcgtgacactgacatacataatctaatcaaattatgtactaccctctcgatcgatactatgcaatacataaacttatcaaattatgtaactattctcgcgacacgtacacaccaacacataaacaaatcaaagtaccaaaccatgtagcccatgccactatatatatgcatgcacatcatcgatcagattgcaaaacgaagaataacacactaacttcaccatgcaaggttcagtaggagtccatggcatcctcctcctcgccgccgccgccgtgttgacgcagtgtctcc

SEQ ID NO: 14429 - DNA, 1501 bp, Oryza sativa
cgacctcgccgaacgcgccgtggcgttcgccggcgagcacgagttcggcgacgtcgtctggtacccagcccgcggcgaggccgtgttccggatcgacgaccgcgtcgccaccaccaaaaccaacacgatctcctccggcgatttccagaacgtcatccagtcgtcacggtcaacggagcagcagcagcacggagacgtgttgccgttccaggccggcatcagcgtgccgctgtcgagggcatcggcgttcatccgcgacgcgcagcggctgctcgacatgaaccccggcgcgctctgcggcggcgagaacggcggcatcctgatccgctacgtcaaggcgtcgacggcctacctcggcaagacggaggacagcgtcgagttcgacacgaccagctgccgccatgacggcgacgcggcgatgccggaggagatggagcagatggcgctgcgcaagtacggcggcgtgccgcactgggggaagaaccggaacgtggcgttcgacggcgccattgccaaattccccaaagccggcgagtttatgaaggtgaaggacgcgtacgatcccgatgggctcttctccagtgagtggagtgaccaggtgctcggcgtctccggcgccggtggtgtgaacgtggcgaggaacgggtgtggaatggaggggctgtgtgtttgttcggaggacgagcattgctcgccggagaagggatacctctgccgtccgggaatggtgtaccgtgacgcccgtgtgtgcacgccgtgtcgccggcgacgcctacgccgatgcatgatcgaactcgatcgtcagaacatgacacgtacgacggcttgtatgtacgtgtagtgtgtgtggccatgctatgcaggccgcgtgaataatgtagtagtactggcagttaaatctgcacgaatgtactgctacatgactgcaatttctagttttcaaataaaacatgtttgctcagatcagatcaatggcgtcgattttctgaacatatgtttcattttcgattcaatggaaaaaaagtagtaaaacatttcaaggctcaactcgatcgatttggttttaaaataattgtggacactgcccaaatcaactcgatatggcccgggccaaaaacaacaccatcatcatagtatgagctgctgaagtaggtatggcaagtcatttcaaaagagtagggatcgatggcaatggttcagatgggacgtagagcaagaacatgtccgagccatgctcgcgagaactagcccggtgttaacagaattgatatattcggttttatctatgccgaacagcttctagatattaggagatagttatcacatgtgctgttatctcctgtaatctagctctatagttgaaaccttgtacgccacggcttggggctattccagccatcgctatttaacacgcaaggcagcgcagcacgcgattgtgcggttgctttcaccgaaactttacatggtatcagagctgtaatccaatctatctctacctctc

SEQ ID NO: 14430 - DNA, 1501 bp, Oryza sativa
attatgcagaatttgatccaccccaagatgcaaacagattctccacgtatgctttgcttgtctggttgcttgatctgcaaacacttgactcatgggatgtgtacatcatctcttaactgaataatgctacccaagcacagagtcccagatggttttggttttcttgtacaaatcgttgtgcccttctgtttgagcttcagttcagaactgacaagaagattaactgaagaaaaagggattagcaatatggtttcctccctatcaccaaaaaaaaaaacatgcctaaattactaagttttgctaggtaggctgaagagataagactcatgaagaactatgctgaaaaagaagtacaactttaaaacttggaaagtgaagaagtacctttgcaaactgcaactaaaacaaacatgaagcttgaagaactaatttgagggcaaatattgtcaatttcgaattattgtttaaaacaaacagaaatggaattgcaactaaaagtaacatcaagtctgaagaacttttttcaggacaataatggtcaatttcaaattcttctttaaaacaaaaagaaagactgctctccctgaaaggaattgcagctaaaagaaatatcaaatctgaagaactaatttcaaaacaaacattctcaattcaaaattcttcgttaaaaagaaaataaaaaggctgctgtccctggaagtccaatgcccaacagaacaggcccaattctgattttggtattacccaaatccaagccacatggacatagacaaacaccttacacagatgcttattactaatactacatgataataaaatcagcactaacatattttttttctccctaagaactccaaatgaagtattgccaattcaaaattgtttctttttttaaaaaaaacaaataggctgaaattcctgaaaagcatataggcggcccaattggcccaactatgatgaacttttggtattacccaagatccaatacaccaggtgtagcaaaaaaaaaaaaaaatctgccatgaaggaagcaaacaggggcggatccaggaaaaaaaaaattgggggggggctcaattacacagtttcttcaatatccagctatttagggacctttagtttatcatttatggtgaaaaaatcgaaggggtgctccggggtatccatgagtcccccctacattcacgttggatccgcccctggaagcaaagaagcatatgtccttgccccaaggaaggaggtcacccatggcgtcaagctcactccatctccatccatggctaccttaattagcttagctaacctaacccaggttgcattgcatatgctcctgccatctccatcaaccaatccaagctatctatctaattccattctcacaacacatttgcatgcatctatataaagtgtaatataatgtttattacaacacgtcgctgtcacaaaagcaagcttagttgacgtgtacacatcgaactccggcgagcggcggcggcggcga

SEQ ID NO: 14431 - DNA, 1501 bp, Oryza sativa
aaattgggcgctgacatcagcgttctatttttctccaaattgattggatgcccgagccgtacagtcgtctaattaatgtgaatagccgctgctacccaagcctaattcaccttatcattatcattcctggcccctcgccgcaccaccatcgctggaaaacggaagccacacaccacctctatctccacataggggcatcatcttccttcagctgaccgacgagcacgcagcggtgtgtcgatgttgtcggtggggtatacggagcttgtggtgagaaggtagtggctgatggtggcaaacctgacaaggcgggctgcgtatgtacatgtcagtatgttgccgcaacgaaatattagtactaattagtaatactttctccgcctcaaaatataaaggatttgcgttcagatttataaggtataggatagtatgtcacatcacccaaaattccttctattttaggaggaagggagtaccgttcaacgtgtttaagtccctatcacatcggatgtttggacactaattataaatattaaacgtagactattaataaaacccatccattatcttagactaattcacgagacgaatctattgagcctaattaatccatgattagcctatgtgatactacagtaaacattctctaattatggattaattaggcttaaaaacttgtctcgcaaattagctttcatttatgtaattagttttgtaagtagtctatatttaatactctaaattagtgtctaaatacagagactaaaattaagtcgctggatccaaacaccacctaagggcttgtttagttggggaaaatttttgggtttggttgttagatcggatatacggacacatatttaaaatattaaatgtagcctaataacaaaataaattatagattccgtcaggaaactgcaaaacaatttattaagcctaattaatccgtcattagcaaatatttactgtagcaccatattgtcaaatcatgatacaattaggcttaaaatatccgtcccgcaatttatatgcaatatgtgtaatgattttttctttttgcctacattaaatactctatgcatgtatcaaacattcgatgttatagcatagaaatttttgtttttggaaccgcctaaattcagtaggtttgtggcacctttggccgtgatactgatatctgaaggaatttttcaccgcaagaaaatagaaggaatttactgttttattactcccatcgtcacaaaaaaaaacagagagagagaaaaggaaagaaaaagaaaaagtgaaaaacccacaaggccccatccggaccgggtagacaaaacgaaaggacagctcagcaagtagccaatagcccaacgaactcgaaatttccgctccctcccgctcgtctcccctcccctttcgcctctcgcctcctcccgctcgcttctcgcagttcgcccccaattcgccaagcgccgcggctaggtcatgccgccgctgatgggaccccgctacg

SEQ ID NO: 14432 - DNA, 1501 bp, Oryza sativa
tctcttccttctggcgggcaccaacatggcgctggttcatcctctcaacacggagcttaattagcgtaggccttgaacgccttcatctcatcggtgaccttcacagcctcaaccgagcgcttctcaccgcgagcaataggcatgtaattaatcaccctggacctgggtggcagtggcaagctcctcggcagtggaatcaccagcctgacacaagagctagcacaatcaagctcaaaaccagatctagaagacaataccttcgataaacatatacaaggagtcagggacaacaaactgcagccataccttgcccttgtttagtccccagaaatttttacatcatattgaatctctggacaatggagtattaaatatagataaaaataaaaactaattgtacatttagggagaaatcgtgagacgaatattttaagtctaattagtccatgattagccataaatgctacagtaacctacatgcgctaatgacgaattagtttaggctcaaaagattcatctcacggttttcatgcaagttattaaattatttttttcattcgtatccgaaaacccattccgatatccgttaaacattgacactcaaaaattttcttttcgtgaactaaacaaggcctatgtcttaaacctctagacattagcctggagccctcaagtgagcggttcttgcggcggtggtccacggaaattccaatggtcggagtatacttcttcgggatgttcgcagcctatgattataggagaacaccatcaacacaaatataaatttacatatgcaaatgtattttttttctacagataagagcaagtttaatagtatagtcaactactagctccaaattatctatagccaatataatagccaattcatacaatagttgcttactatactattaatacatagtcctacttgtcatacacacattaagtcttagagtccgtgctgcagctggctatagatccgtagtccgctgctcttctctctcttcctttatctctttaaaatatgtttataactcgcttatagcatgctattgtacctgctctaatcatggccggaacacactcaaagcattagacaatgaaactagaatcttaatccaaatttaaatggcattcaacacttagagaaggggaagggggtttctaatctactgacaagacaaagttacttatctattatctacaagcaaacagttcagatttaaccaaacagaggccctgatcagatcacacatcaaaatttttcaccctatcatatcgagcgtttaaacaccttcatgaagtattaaatataggctataaaaataactaattgcacatattgtgactaatttgcgagacgttttaagccaattgctccatgatttgacaatgtgttgctacagtaaatatttgctaataacggattaattaggcttaataaattcgtctcgtagagtcgcagtttactgacggattctgtaattagttttttttacac

SEQ ID NO: 14433 - DNA, 1172 bp, Oryza sativa
cacccctccccccacgtgcgtgcatgcaggccctggtcccaccgcgttgtctgctcccacctaccattgaaaaaaacccacatattttagaaactccctattaaaggaattcgttttattttttttcataaaaaatgtttcacctagtgtgctcacaatgtttcactatgtatatatctaatgttgcagtgaacgaaacattccattaaaaaaaacccacatattttagaaactcctattaagggaatttggtttatttttttctaccgaaaaaatgtttcacctagtgtactcataatgtttcactatatatagatctaatattgcagtgaactgaaacattctttcactatttgctgaaatattgtttttatataatgtgaaataacatccgatttaaacgagggaaacatttttgatctacttaatgaaacatttccgatatatctggtggaacatcgtacaacatttaaaaataattcaataataagattttttttcgtcggaatatatccatgtgtggtcttgtttcgaacatttaattgcaatgaaattaatggtgcaatcagatcatgatttggataaataatttaggagaaaattcagtttagagcagttttacacgtaaatcgggtgctgacgtcatgctgacatcagcgcccgattttaaccttctcccatcggatgcccgatcgtcacgtcctttaaatagggatagatattgcggtacggataagggtgtgttcggcacctcctttcccaacccctctttctcgttttccgtgcgcacgtttttcaaactgctaaacggtgtgttttttaaaaaagtttttatacgaaagttgtttaaaaaaatcaaattaatctattttttaaaaaaataatacttaattaatcacacgctaatacctctgtttaccatgcataccatgcagactgttccacgctggcaacttagcgaacacaccctgtcggtacaatgctacggtattttccaagaaaaaaaataagggtacggggaaccagcccatcgaatcccacggaagcccagcgagtggaagccaagcgacacgtgcctgcctgcctgcctgcctgccgccgccgcctacgccggggagtggcccggagctgatcgatccatgtcacgtgtcactggacgagacggcgacgat

SEQ ID NO: 14434 - DNA, 1501 bp, Oryza sativa
ctcatccccagttacaagtgccaccaataaacaaccaagcaaccaagcatctgaactaggccctaacaagccactgaaatcatgatcctttatctgcaacttgtcatgcaccacctctgccacctcaggagccatgaaggccttagacttggatgagcaaacccctacccgaaccccgtggcacaaggccaaaacctgattcaggtcgagcaggcagtgtccaaagcgatcgaggcagaagcatcctagccctatgcaccccagtaccagcccctctccgtgcaatcccatgaacgcttcacagacctccattccgacatttctgatcagagccaccgtctcctctcgtcggctcctctcctccaacaagcaggagactccgcgggaatgccgctcggagagcagccacagcggagccgcctcggggcccatccagaagccgtaaaccctgcaaacccgccgcgccaaccgcgacgagacggccaccaaatcgatcacttcatccctcgccgcggcgctcagcgcatcgatcgcggcggccacccgcgccgcgtggctgggccggtagtacaacggggactcctgcttggcggcggcggcgggggtttcgatcgggaggaggcttacggggtggccacgcgggcagaaccacggggcgccgaggtcggaagcgaaggacccgatggcgaggcccgcggcgggagcgggcgagtggagcggcgaagcggactccgggaggacggcgtggcggaagcgggagaggagacgcgagtggtccgcgtggagcgggacatgaggaggcggcggcgccgcggcggcggtgcgagaacgagaggggtttgggggcgaggggaggagggagatgagggcgaggtttttggggagggaggagggcccgagagcgcgggagaaagggacgcactgggagcagagagggcagcggagcgaggcggcggaggcggaggcggaggcggaggccggcgggagggaggcgatgcaggggccgcagagggagtggccgcacgggaggacccgcggcgcggcggaggcggcgtcgaagggggagaggcacaccgggcactcgggaggctccgcgtccggcggtggcgatgcggtgcccgccgccatggccgcctcttatgctcggccggggagctcgccggcgtcggggactcgttggttttgactatacggccggcggagcacgggaaggagcaactcgccaagtgggccgaggaagggaggttgacttgtgatgtgtgggccaacatggtagcgagaggagagaacaccaagcgcagcaaaaaaaaaaataagttcacaagctgtccctcgactctacgtcgagtctctttgaggtccctaatctctaactaggtccataaatcttcacccctaaattatacaaaatcgtgtaatttaggtccatagcagtatagatctctggtttcgctgacgtggcatccaagtcagcaaaataaaaaataaaaaatatatatga

SEQ ID NO: 14435 - DNA, 1501 bp, Oryza sativa
agatgtttcctttgtccgttaaaataaaaaaagtagcgaaaaaaacccaaaataaaaaaagttcgatccccctgtaattttcgttcgtttttttccctttttcccgttttattttcttttcgcgtttcttatttttttcagcgtttttccctttttttttcttttccttttttcgttttattttctttttgccgttttttcccttactttttttctttgactgtttttccggttcctttcttttatcgcttttttttgcggtttttccatcgggccaaactctaccgccgccgccacgttgatttgcctccctatatatttcatcctccaattcattgcaaaaaaaaaaccaattccccgctactctcacatcattttccccttgaattcctctttcaattcggctttaattcaccggattgaatctccatttaatcctcgtcattttttatcccgagttttacagattgcttcgattttgattaaaaaaacagaaaaaggaggttgagtggatcaaaatccctcaacaatttttggagatggagaaacattcgaccaaatttgatggagaggatcggctccgttattgtacgggcactagactatgcaagaacaattttggagatggagtaagattcgaccggatttgatggagaggatcggctccgtcatcgtacggacacgggactatgcgagctcgagcggattaccggatatgggaggagctcgagcggattaccggatttgatggcaggatcggcttcgtaatggtacaggcatgagactgtttgagctaggcctacagctccactcgtgggctgagccgaagagaggtagatcgagcagagagaggtagcggactgtgctaggactggagctgaaaaggaaggaaggaataagcatctggtctaaaaccaagaaagtatcgggtccaaaactaagggagaataatgtataggataaaaaacgtttttacctgttgcaacgcacgggtattttttctagttcaaaatataatacataagtagcttttaactgtatttttttactccatcacactttaaatacacaacctgctttgtgcagatcgttcagaaaaaagaaaaacacgacctaacgatcctagggctgccccttgccccctgctcccagcaatatgggtcttatgggccgaaccgtgcgtcggcaacgaagctagcgcgtctgtgtgaaataggaataagttcatccgaggtcccttaacttgtcaacgaatccgattttcgtccttcaaccggaaaaccagatacaacgggtccctcaactatcaaaaccagtgcagatgagatccctcggtggttttgagggtggttttggctgacgtggcgcctacgtggcaaatttgacttggtcttcatctgatatggcattgacgtggcgcatacgtgtcaatttgatccggaaaaaataataaacttcgtgggacccacatgtcagtctcatacataaatcaataaaagaa

SEQ ID NO: 14436 - DNA, 1501 bp, Oryza sativa
tatatgatacttggaacatggacattaatccaaatacataagctaaactcttacgtatgtatctgcatcaatagtatcatatggatcatacttcaaagtatcatacggatcatattaatttcaaagaagcttaggatattacgtacgtataattgatccaaatacgcacgccaaatacggatcatgtacagatgtgggctagtaagcaccacgcaggcccaaacaaagtcgtgacgatgggccgatcgaatcaatctgggccgcaaaggccacatcgaacggcgctcagaggcccaagggggttcggcgttgaaaactccgaacgccttcagttgtatgttctgcaaactgatggaattcagcagagtatcgagaaaaagtgatagtattacaattaaacaaaacgaatggtaagaaaagtagtaagtagtcttgtgttgtttggttgttaattagtctgtttggtgacaatatgcaagtatgcaacggtggtttcagtactaagatttgctgatctgcatgttttgatatgcagacaaagtactgaactgaaccacacaggaaacatatgagcaaaaaatgcagagctccagtgcatgagcgcatcagtgacagtgaatgactgaagtaggggggtgaaatcggtctacttcagcaacaacaggaggcccaatagaagtcgctgacacttgcaacaatgggccgatagaatgaaccggaggcccaagggggagtcggggtttaaaggaataagttcatatgaggtcccttaactttacaccgagttcgattttcgtccgtgaatcacaataccagatacaatagatccctcaactgtcaaaaccggtgtagatgaggtccctcagcggtttagatggcggctttgactgatgtggcgctgacgtggctagtttgacttagtcctcatcgtatgtggcggtgacgtggcacttggaagcaaaataaaaggtcggacccacgtgtcagtcattaaaaatagtgggacccaccctgctctctatctcccctgcgccgtcgtccttgtcccttctccctcccggccattcttcatccttcctcgagctccctagccggccggcgagcgcgcgcggagagggagaagggcgccagccatcgggtggggaggccggcgagcgtgcgtagagagggagtaggcggggaggccaacgagcggaacgggtaggccggcgagcgcgcggcggcaggcgagagagcggcggccggagctgcacgacctcgccccccctcctccggcgccgccgcatcgatctgcacgagttacggcgacggcgagctcacagccgcgggacacggtcagcgtggcgctgacgaggcccggaactcgagctcgcagtcgcagccgccgctgcccacttccccaatcccctccatatgcgtcaaagtttttgatattcatggcgttctgctcttgttctggtggattgattgattggtgtgcttgtgcggatgatttgtgcga

SEQ ID NO: 14437 - DNA, 1501 bp, Oryza sativa
gctactagtactatattactactactagctgattaataatcatcatcatgtgtgattagtttaggtggtaattattaaccaaattttggtgataattatagtattaaccacgccggataaggccactactcgccggcgattgcggtggctatgtgtcacggggtcctattgactggagctttggattgcatcaaggcttggcacttgtggtattttagccctgtttgtttaagatggatatgtttagttaatcacctaggttactagttttagatgtcatgtgaggtaactaactttcacatgaagaaatcaattgaactctggacaacaacatgcagctataacacgtaaatatctccccgcaaaaaaaaacacgtaaatatctatctatgcaaaaaaagcccttaatttctagctgttaaagtttatcttaatgttttttaccctcttatttctacaaaccgaggtgttgtatctcaataatcttacattttttcacctgacattgacaatactactttcttattagcgaaagttactttatttgttttctttcattactaaatgttctcaaagaaattaaggttatttttattggatagttgagtagtaaagacggcggcggcaatctttaacacactatatagttgatctatttttatattttagtggtatggagtttaattaggatgaacttccgtgataccagcgtaagtgcattgacgaggcatatgattagagtgaaggaggtccaattagcagatggattagtaggcaagaaaggaagagcttttgccgcttaaaacgaaggaaaagtatggatggagagacgagaggagaggaaattatgccgttgcccccaaaagctgcaacggcatcctttgcttcccgcttttcctgtagctttatttattagcgtagggtgccacccaacacaaatttgctctgctcacccccaccatcttctccactattggttagtatttgtgtatcatcattatatgagttctaattttgtttagagaagggttttttttacccggcctttacatccaaccggatatatgcagccattttatattaggaacttagcctattaaacaaggaacttagctctcaaataacccaatctgaaattagatttgaacttaagaccttagagtgctactcaggtcactacaacaactaggttattgccatttcactaaagctgagttcgttgcttaaggttaccaacttcgcgcgcacactttttaaattactaaatattgttcttttaaaaaaattctatagaaaaattgttttttttaaaaaatcatattaatctatttttttaaaaaataactaatacttaataattcataggctaacgggtcgctctattttgcgtgcatgagagatagtttccaactccagcaaacgaacttagcctaaaattcgtttgaatttctcgtaaggtccgctatccgtatcttatctttgtttcattcatattttgcag

SEQ ID NO: 14438 - DNA, 1501 bp, Oryza sativa
gatctaggacataaatttaatgttatagaggcattagaccaggattggacagagccatgggttcatattgtgcagtaaaacaaatttaatatccaaacctgaagactatcagagactattccatcttttccgtagtcaatgataagtgcaccccctccatccgagctaattctatctgcaatctgttcagtgatctccattgctttcgggcagacttcaatatgctcaactttctcaagttcctcagaactagcccaaccgcaccgcttggaaaggaaaagtaaagaggctgtaggctgtggagatagaacaaagcgaaacctgctacaaagttagaattacacatctccataaggttaaccacttaaaaataaaatttgtaaatcctacgatgagtcttctgcaagatccaccatcttctcgcaccagccacgtgatgctttctgaagagaagaaaaaggacggttcagtggaatgcatgaacaatattcaatctgtttgtgtcacaaaacattaagaggtggaattgctggtgtaaccagacctgaaattgatgaattggcaaggcatcatagaattcatgtgcaataattatagttggcactgcagagaatacatatacaaacagaacaagcataagaaatctgatcaagatgtcaaaaagaaaatagcttgacgaaaaagagaactagataaaggcggcaaccagtttcaaagtcaaccatgacacttacgagaaaatatttacaatctaatactaaaaatgagcatatatcacgagaacactatacactttacacatgcaaaaacaactaaattaccaaatatgaaatggtaacatatgtgcaaggagatgatacaactaattagaaaaattacagtccattggcacattcaattcttttggctcctcgccacaagagttgaaccgcagattaactaaacccaatctgttacttcctccgtttcatattataagactttctagcattgtccatattcatatatatgttaatgaatctagacatatatgtgtgcttagattcattaacatctatatgaatgtgagcaatgctagaaagtcttataaactgaaacggaggtagtactcaattatacacgatggcacattcggtaccataataaaataaaaaacataatgtttccccttatcttatatagctaatgtccttaaagctttccctactgtacttaacaatgcatgccaaatcagtgctgccaaactgatgaatggtaactgcagcggcaaaaacaaaatggacctttgaatagaaaggacaaaacaaaatgccattctttgggtatcaaaactgaaattgcacttattttcagtacaaaaacaaattttaccaagtgtgaaagttgataatacaagtgcttatgagccttcaacaatagttaatgttcattagaagcaaagttatcaatgaaagaactccatacatcctgaaggaacctgttcaagggaagcatgccagtg

SEQ ID NO: 14439 - DNA, 1501 bp, Oryza sativa
aaaatgatgggaacaattcatgctctctctgtccctctctctcccggtctgcagcggcagccagccagggtttcattacgacagaaacctgaaaaagaagaaaaacgtcagcacttgagagagcatggggttgggtgacactgccacgtgaatgcggttgcatttgggccggaattacctgtgcttgggttttgcctgccatgtgacccgcctcgtttcgtttcacccttgctcggcccgatcgatttgcagctctgcacatgctcttgtccggccaccatggtagtaagctatgctatgttagtataggaacccttttggagctgttccaacgcagatggtgccactccagttttgggccaaaataatggagcctgacattggttctaaatgaaactatggtatgtttgagagagcttttggcagctgcaacctctttcaaaatcaaaagctctccaaacaatacaacttttcattaagattttgtgaatgatttttcttgagtaaaatacaccaacagtccttaaacttgtcgggaggtttcacctaggtccacgaacttacaaagcacatatcgagatccctaaatttggtttattgtatcatccaggtccaaagccacttttgaccgtggtcttacctacgtgacacgctacgtggacgatgacatgattttttttatttttttctctcttatcccttcttttttctctttctatgaaaagacgatgacatggacgatgatgtgtacgaggcattttcgtcttttcgacaaggaagaaagagaaaaaaaaggaagaagggagaaaaaacaaaaaaaaaatccatgtcatcgtccacgtggcgtgccacgtaggtaagaccacggtcaaacgcagctttggaccgggatgatacaataaatcaagtttagggacctcgatgtgcgctttacaagttcgtggacctaagtgaaatcttctgacaagtttaagaaccgctggtgcattttactcatttttcttcttagcagctgcaacctccctcagaatcataaactctccaaatagtacatcttatcatttagattctgtgttaatggttttccttacggcttatcgaaatatatttgaatgaaattttcggcagatgaagacattcctatgcttgcatcatcaatgcaactggaccaaaaaaactaaaaagagggagaatgacgtcaaaattggaccccggaagaaaaaaaactcacagaaatgtagaatgtgacacattacgacatattctgtcacgacccattttctggccgcataggacagtcatgcacaacgcaaacggcgacacgtaagttttgcaggcgcgacgcgcatctggcaaagccaatttcgcccttaaaaaccaagggcgcgcaacggctcgtcgcgtggagagcaacgctcgctgcgacctgcgacgccgccccgcgccaacttctctccctcccacctccaccacctcctcctcctcctcctcctctcctaca

SEQ ID NO: 14440 - DNA, 1501 bp, Oryza sativa
tatgacagtacctgtctataagttcaaaaaccttgtcaaacatagactcttttttatccattgagtcatatacgttgacggtgcaggcctccaggtcgaagagtaaaaggacccagtggaatctgcaatgtgcgtgggatgcattacatatgaaacacttagcatgttcgtacgggaatgaaatttgttatagcaagacagtaaaaactaactctgtgttgtacggcaatagtatgaatgtcttgtaatgctgcgccttcaggagatggacgagattgtcctctgtggcttgcggatactggtcgagtattgcgacgtttactttccgagggtcgatgaatctagtatcgaaaacccctcgctgtcgggccctttgaatctccattctacaacgataaaaggaagtatatattatatatagtctacttatatacaaggacctaattaattaaaggaaacgtaataagaaatctaactgaacgatacttacaaaatccagcaactcataatagagacgtcgagggcgtccagctggtatagttcgtagatacccttgaaattgatctagagaatgtcatctccttgcaagaagtccgtgtccctgatcctcgctccgatcatccctctaccggtggcgctcatctccatgtacagttgatggaacttgtacatttgtgtgggtagggactgcagctgctcaggcttgacaaacggtttaccgaattcgtacatgtatttcacttccgccttttcgattggtgcgcctcgtagcaattgatccgtattagaactatgctaactcaaacaatcttatatgctaagttttattacaaatctaataatcttatactatgctaagtctaagtgtcgtataaccctaggtaatcatatatgctaagtcgtctaagtgtcgtacattacaaacctagataatcatatatgctaagtctaagtgtcgtatattaaatctaatagtcttaattgcattaaaaatctaataatcatatatttacatcacttgcctgcgcgaattccttcgagggctatctaccactccggcttgagggacgatgacgacaacgtcttttctgcaacatacaaaaagatgtattaggataaacgcaaagtaacatatattgtatttcacgttcgcgttcttgttaagttcacatttcgttcacgatcattcacgttcgcgttctcgttaagttcatgtttcgttcacctacgttcgttcgttcacgtgcattcacgttaacgtacgttaagttcatgttcgcgttcttgttaacttcacttttcgttcacgcacgttcgttcgtttacgtacgttcacatacaacgttaagttcacgttcgttcacgttcacgttaggttcacattcgttcacgttcacgtacgttcattcgttcacgttctcattcacgtacgtttcgttcgttcacgttcgttcacgttcgttcgttcgtttacgttcgttcgttcgttcacgttcacgta

SEQ ID NO: 14441 - DNA, 791 bp, Oryza sativa
caccaccattggggtcttttagaggagtatagatttagtttgtttatgttgctttttattattctaagctgtttgtgaacgttttgtggcatacatctgaaatcttcatagatttaattttttgctggattgctatacatcccttacaaattttcttcaacaaaagaccacgtggtatgataatggcaagtgaggctagggccatttgacacaacaaagtgttgttttctgagacttgcactctttatatgaatacaaactcccctttcttctttacactaatttctgttgatatacatatccagtatgggcactgatcatagggtatcagcataccacaactttatttcatctcgtatatagcacttttattcgtttaagggctagttttgagctcgacaacagatgtctgttttttttttaattctattaaaatttttctgtttgtttgttgcaatttcttcaagtctagcaatcttgttactcctaacagtgtatatgttctgttactctgtggatgacccctgaggattcagaaaaatactgagtgcttattagttgttcgtgaagtcctattatcagggtttatttggccattaagtttttactagctgtttcttttggatgatcttatggttctgatagaaaaacgaggctatctcttttctctctttccctcctcacatttactagtacattaagtcaacaaaccgacttccccaacaagcaacactactataatttctaaatgctgttagctcattcatcatgtgattctgtcttgttgtaga

SEQ ID NO: 14442 - DNA, 1501 bp, Oryza sativa
aacgccaaccaagatgatgggacaagggaccctcacccaacaagatgaagggaagcataagatggcttgccggagaggtggctagagcgaagggatagtgaacgaccttgctagaggcggagggtttggtatggtgacagcggcggtgtctaagaggggaggaatggagaagggactagggttcgaaaggggggggggtccaatttataaggaatagagccattggtttagattgatagaactggatccaatggacatcaaaattagctataagagtttagaaaagaaaaaagaaaaaaaagtcgtatatggcctcacttattttttttatatggccaatacatttattaggctggccctaataaactcggcccaggaggttttaaggcccgccttagggattttccatcaaactatattgacttagaccaaaacatatatttcttttgaaaaattgcattgtaaattcgacaaagcatgctacttaaaaaaaaacgattttcaaacactccctatatcagtgtaactggctgtcagaaaaatgattcgcctgtgcaataaatcaatgtgatcatggtcacaaatcacctctgggaaatgtttagatgcaggcgtctaagacaatcgcctgttagaaatggcaatacatcggcttattacaactgcctcatgaaacaataatccattattccatagtatgtttggaggaatggagggtgcatggggtaagcactgataacacaagtccacaacataacatcacaccagcacccaacatcacggatatgatgcggatgtcgacataacacgcatgtcactggtcatacacggccaggcagtcaggcacaagcacagcacagcgcttagatacacgtacgtaattaggtacgtgctccatcaatcgatgggtataatttgcccattggtcgcgaccggccggcaaggatgacgcgacgggatcgttgggtgcaccctgcgtccgtccgtcctcctgctcgtaagagagaagtcgtcagcgcgcacgatcgatgatctctcgatcatttcacttctccaaaacaaacagaaaaaaaatctctcaatcgatatagagatcgatgtgtactgactgtgtacgtacgtgcgccttccgtcctcccagatgatggagagaccaatcgggatgtcatccagattcgtaccccacaagtacgcgtactccatcggtccatccatgatgggaaggggtactagctagggacatgataatctccagcgtgaaaaagaaaagaaaaaaaaccgtgcatgcttagctttccgtgaaggcgccatgtttgccacggtgccccgtactccctccatccgtctcaaaaaatggtaaactatgggtttccgtatccaactttgactgtccgttttatatgaaatttttttataattcgtattttcattgttgttagatgataaaatatgattaatattttatgcgcgacttgtctttttaattttttttataaatttt

SEQ ID NO: 14443 - DNA, 1501 bp, Oryza sativa
ggctccttgttccatcttcttcctcatcttgaaaatattttgggatccaacaccgccgacttttcgttttgttgttatcctcgttaattctatcctcaattgctcgctttctgatatttttaatagatccaatagccccaactcaccgttccacgcctattggcacccgtaacttggtaacgcctctggttacatcgtatatcttattttagcaacatcgttagatccaacaccacttgttctcgttgtcctcgctaatcatgtcatctatagcttgcctttttttttctatccaatagttcctaccttaccgctcgacagctcgacagacatcgtcgctcatagctagattgctattctgtgatgccccacacttttaccgctatagataaaagtgcaagattgtgaactattaataaagtattgttttatccaataataacccaccatgagatatcgcaatggagaaacaggtagaactacttttaatccatccctacaagtctgaaggccatctctattccatcttatccttgcaaagacatatacaagaggaattatataacaacggtgagcgcatccgtactcagcaagtcattagtaacaaaatataaatgcataaacaataatttatttatcaatttatattctataccatacctttcgtaccatcatcaccttcacttttcatcaaaagtctatatctatcttgtacaagggttttcaaaaagaagatttttgaaaaaactaaaatacactcgtaacattgagtaaagtttacatcaacttcccgtagcctccaatctaggacgtgagtcacaatttaatagagcattgcgcatgcttgtatcattgtactcatatacactctagatattactgtacatattccctcaatcttcctatgaatcaaggggtcattgatgaaatctacgtgaccatgaatcgtgatatctgatttaaggcttattttggggagtttaagattttgagaagcaactggttggtagccagcttttgagaatctggaaaagctgggttttccagcttttggtttttagttctttttttggattctacaactacagtttgatataatcttaaccaaaagctaaactgtttgggggagttttgattctgggagaagctgtagcagcttcttagtggccaccgcttcctcccaatcgcagctaaagagaaaagggggacaatgttgcccgaggacgaacatgttttttaattgactagtaataaaatatctatttttttaactagtctctattcgcacatgtgagaaattcacctcttattcctactcaaggatttcactaaacagtttttgcaacgcttgcagtataaaactttcctccatcgcaagctttttgccaaggtgatcaccagctgagcctgtaagcgcacgcccacacaaacactctggtctgtgtctctgccgcgcaccagagcgtggtgggtgtgtctcttgtctcccgcgcccccagcc

SEQ ID NO: 14444 - DNA, 1501 bp, Oryza sativa
ataattgaactatgaacattgataaaaataaactagactctgttgcctttacctatcctctataacttctcaagttcctccctaaaaaataaccaggtaatatgtgcacaaatgtgtgagtacataaagtcttgtttgcaaagatgcttgtggtgtttttcattgaacataatgcttgtcatgattttggttaataaattgtaatgctattaaaaataagaggtggttgctgcattgctgatgcagaatacattgtttggggtcaatattttgactgctttatactgttcagttttctgaaatctagtattaatggtatattttgatttctctttttcagaatacaaaggataaccctccctgtaatacccttttcattggtaatcttggagaaactgttattgaagaggaattgcggagcctcttcagcgtgtaagaatcgacgccaatatcgttgtctattgtgtgcagtggtgttgcatggtatggttctagaaagtagatacaacagttctaactgattattattcattttcctttcaggcaacctggttataaacaaatgaaggtgttgcgccaagacaggaacactgtttgtttcattgagtttgaggtaggtacttacaatattgtaattttatcttaaccttatcctacattcttatgcatctcactgtttgttaaattttaggatgtgaatgctgcatcagctgtacaccataatctacagggtgctgttattcctagctctggtcgtggtggaatgcgaattcaatatcctttatttgctcaatgaaataaaataatcacttacattaacattagatatttatgtttcctttgctaattttatatggtttgtaagtccttaacgtcttgaacattttcgaaaaatccctatggccgaaggaaggattctgttggtggaattgggggctctctaaatggagctccttcaaactgagaggggatgtaacttgaactttagcatcctactaaattatcatctgcatattttcttctaaatgcttgtttctgtcatgtggcatcaccatctccattaggttgaatttctggccatgatcatcttctttacatggagtttcttggacatgatcatcatctttattaggtggagtttctgggacatgatcatcatctgatagactttgcattgttaccattatcatcgctggtggtgtggaatcctttattttctatatgtagtttgagaagcacatttcgagcatcttgtagatgtgcatttgccgcttgtcatggatattctgcagtattctgtagttttcttgtgtttagttgctacatctcatgtgtccatgtcattgtcactttgcaaacaggacattctgtaatagtataactgagttttcttactagaagtttgatactgtggcataatgggactagaagtttgatactgtggcataatgggggtgattcatacaatcatgtcatggcatgttcatcagggaaggacagt

SEQ ID NO: 14445 - DNA, 1501 bp, Oryza sativa
ttaatgacgagtagatgatgtgtggtgtctctttcctttgaactttggttgccttttcaccaattatattgctcgttttggttaagtaaatacattgtttatttcagaacagaacggttaatgttaacagcatttttacttacttactctgaaccacatgccggcaaaggggttctcggtgttcaggtgcgacgttgaagcagatgcacgtcggtgacgttgactgcttactgccctgagtcaccccgaagcgtaaggtttcatataccgctccttctcaaatggatacaaatatgaaatatgagtacgcggactggatggtaggcccatcatagcaaacaaaaagtttgattatgacagaaggacatttgtagaaaataagaaagataacatatagttgtgatctatgcaggaagacatcgatgaatacagaagaaagctagcagcgattctttacatctctccatcccaacaaatttcggaatcatgcacaggccatctccgaagtaaatctaagatgttcagctttgcattgggaggatattctttcattaaattctaagatgttcatttatcattgagatgttttattttggagattcttagtttgtcttgtcagatgttcatttcgaataagctaggtgttaaattttttaatattaaactctatctattatttattaaatgatactcaatctggttattcaacgatgtcagatgcggggacttcttctttcttttgtaaaaaaaataacgttctgctataatatatgcgcgcggtcgattgaaaaaccatgctttttttatgataagtactttctgcgagtttaaagaaacatctcgtaccacgacgaagcacctttgtgcttctgcactgcaaaatctttcgtaaagaagctgctcaatgcaacatcttacatcctgtcaaactgtcaaatgtgtaagttaatgttgtatcaaaatcggatgctacggagaacaaaatgatgtgtcagtatcattctttcttggggacgacatgttccccctgaaactgttcctatggtttgcttcgctcctgaatcagcatcttctggagatctgatggctgaggatgccaaatctcccaccaccaatcctttttggtggcttcgagactccgaatagagctgtcgcaattcgaagttggaactagaaaaatatggacagaatgagtcctccagcagcatgtgcattctcattgatctggtaggctctgcatgaaaaaacaaccagtttcagcagcagcagcagcagcagcattacagtttcagcagcaccagcagttcagtttcattccaacaacagcaattcagtttcattccagcaacaacagtgcagttctagcagcagcacaatttccaatagtagcagtatcattccagcatcaacaatagcatcattccagcaaacagcaccattaaagcatcacacaagcatcacaaaatgaagtcaccattccagttgtagatcatttaatcct

SEQ ID NO: 14446 - DNA, 1501 bp, Oryza sativa
gttctgtatcggttaattaaagaacggacaggaaccggttgtttttaaaaaccggcacctatagctttgagccaagccgacgagccgagaccatccatgcgtgcactgcgtaccgcacccaccgcgtccttatctactccatccccttctctctctcgcgcatatcgcgtctctctccccctctctctcgcagcggctgcctggcgtaggtagggtggtggcgggcgggctcccgcagccagtggcggaggcagggtggcgacgggctggctcccgcagccagtgtgggaggcagagtggcggtgggctcctctcctccgcctcccctccggcccccctgctccttcacattatcctccacgccctcccctccccctcccccttccaccacaaagatgggcagcgtccccatccccctccgctcccccgatgggcggcgtccgcacgggaggcgcgtggacaggcggtggatcctgtgcttctttggccggatctagcctcccatggccggctctggccggtgtggtctgtgcctggtgaaggggaggcggcaagctcccgcggccacgccctcccctccaccagatccggtggccggcctcccgcggccggctcctgtgggcgacggcgctggggtcggttcgagtgctgatctagggttggtgtgttttttttatctctttcatgttctctcgtttaatttgtctcatatgtgtaccgagaatgaattgttgttattgacgtgattttgattttggatgtggggatattgatgtgtaccgagaaggaattgttgttattgacgtgattttgattctggatgtggggatattgttctcgatctgaggatgtggaggggatcatgggatgtggggatggtttctggattcggctcgattcgagccggagtattttttggctcgtgcagacataaaaggtgccagctcaatttaacctatgggtgccggtaccatgtataagtgttgaccaattggtgtcggccggaaaaccggcacctattgccagttgccaaccggcgctaattgggctttctgtactagtgggtgctggttctaaattattagagtgccacgtggtgatttagcagtgtttgtaggagaccacgtggcagcataggagtgtttatagggtgtttcatcaacttttaagtatactaggaaggtagcccatgcattcgcacgggcatgcatcgtagactatgtttgagaacttataacgatgaaatattaatctgaaatttcattttatatatttagattatttgagcacatttagaaaaaaaattaagtaattggactattttctctaattaaaggaactcgatgttttatgcagtggctcagactattcatatttcagtttgttattttttttacaaagtgtacgtttaatttagctatacatgtttcaaaacatagcatggtgcgactctatgttgttgagttatttctttttcttttggcaaattaaatatgaaaat

SEQ ID NO: 14447 - DNA, 1501 bp, Oryza sativa
gtgcgacgatgccaaatggagcttgcaaagcagttcaccttatggtgaacttcaactactgtttttgctgagacgcgtgatgcagtttatttagctgctggttcttagctctatgaaattggtgatctgttcgtagtaggtcatctttcacaatcttgtccagatctctgtggttcagccaatgcagattactcgtactacaattttgttaagcattgaagtcagctgtactgaacagagcactcaattttcagatatcatgatatgatcatctcctgtttggtctcatataaaagataagaccatgaagcacaagcttgaggaagagagatcaacaagagtcgatggagagtgttactgctatggtaggcatgggatgcacccggagctgtcttattacatattgcgccctttcttctaaactaggacggaagcccgcgcatctgcgtgggcaatttatttattgtctataaaaccaatactaaaagaagtattatctcaccatattcactataagaaatagcccattgatatatactaaatgattaaaatggctatcattctgaatcaagaatcactttatcccggttatatataaattcagcattcgccataacttattttcattgtcttttttatagatggaattaatggctatcattctgaatcaagaatcactttatcccggttatatataaattcagcattcgccataacttattttcattgtctttttcatagatggaattgcagctctatccaaaactaaaccaaatacatcattaatagcacaaaaagttaatctccatatcatacccaattgcccataactcacagatgtctaaatttatatataaatatttaaaaataccgcttctaccaactaataggctgaaacaattgaacttatatatgaatgctcctctcacaatcgggtgaagctaaggagttttctctaacgccttattcatgggtcccgtgatatagtcgtgcttctcaagatgagcgttgaccataattttattggtaaataggttagttaaactttattgtagatggtggataaaaataatttgtggtatgatttagatgttataggtgttgaattgttcagcacaaaagttttttttctaataaaatatgataataggagaataaatgtgtgtaacaataagaagaaaataagggaataagggggtggaagtacgtacgtacctactatccttaaaaaaatgtacgtatacatacagtaatacgtacatgtcggtggacccggtttggggttaggaaattttctttgataaatctaatggcagtaaataatgggtccactaatttaacgaaaccaatggctagagaattcactaaattatagtgctatgtggcgacttagagcgcgtttgtaggatgccacgtggcggcttaggagagtttgtaggatgtttaatggacttttagtatataactaggacggaagcccaggtgcgcatgcaatttattt

SEQ ID NO: 14448 - DNA, 816 bp, Oryza sativa
tagaaaataatgcattaaaattatttagagtcaaaaaattaatgacaattacttcaaaaaattattgttgtctgtagtaaattaagtggataaaacgtagtaaacaaatatatgatttaagattaataaaaattctaataatcatatatactctaattaaacatatgtatatacatacgccatgcatgatttaaaattaataaaaattctaataatcttatataattagcatatgaatgatattaaattaattcataaaaactctaattaacatatgtaaatacatacgacatgcatgatttaaaacttttaacaattctaataatcatatataattagcatatgaatgatattaaattaattgttaaaaactctaattaacatatgtaaatgccacatgcatgatttaaaacttttaaaaatttgaatagtcatatataattagcatatgaatgatattaattaattgttaagaactctaattaacatatgtaaatgccacaagcatgatttaaaacttttaaaaatcctaattatcgcatgtaactagcatatgcatgatttataattgttaaaaactctaagtaacatatgtaaatgccacatgcatgacttaaaacttttaaaaattctaattatcgcacataactagcatatacatgatttaaaattgttaaaaactctaagtaacatatgtaaatgccacatgcatgatttaaaacttttaaaaattctaattatcgcatataactagcatatacatgatttaaaattgttaaaacctctaataatcgtgcgtaattagcatatgccata

SEQ ID NO: 14449 - DNA, 1501 bp, Oryza sativa
ttaaaacgtctagcgagatatactttgtatacgttaattgctcctttatttgttgatttttttaggaagattttatttgttgatttgatcctactggttaaattgtctggtcagtcatgctaaactgatcatggtaacgggccagaacttacctgcaaatcatcagatatataaatgtcagtcgtcacacctaaacaatatagaatgatgccgacaattaagagcaacattctttaatcctgatatcgtacattttgaggtcgtagaacatgtaaaaagaatcaacaaatggaaggcaaatgttgttccaggtgtgcatttcttttactttagtcatccaaccgtcctctagatccacaagaacattgctaaagtctccgggcaaatggatcgaataaaaagccttttttagatcgcttagttgtttcaattccatcagatcggaacctcgccataatgcaagctttacttgtcatgattctctagaagaaaggcatcaaaggagataggtaagaagaatcggttcggtacgcctctttaatcaggctcacgtacggttgatccattcagatcattcaagaagccaagggggtcctacttgatcgcactaagcacataaataaggcctaatgcaaccaaaaggttgtgcccccaacaaccaaatcagaagatactgcagcagtctgcagctaggattagtataaccatcctagcatttgtacattactagtcgtaatattttgtttctccattaggtgcttgatgatatcccctactatggttactctcttcaaaagcgaactgaaaatgattgtttttccagcaaactgaaaatgattgtttttccagcagggtttgaaggatcgcctagctggcttatcctgctactaataagttgacttccccagggcatccagtatttggtggatctgcttccacgtagcactgaactgggtcagtactttactaatcagctatcagggccgtagtttatgggaaatgcagttatattttccaaggcaaacacaactctactatatccccaaatgcactgttttccaagacaagcatatcaattctgttacaagcacaagtatacatcccaaaatggtgaggttttcatcagaaagggaattgcatgtgaatgcagctaacggatcggggtataattcaagctggattattcgatcctaaccttcatcttcaagcaatcaaattaacagccctgtttaacaaaagtttgagagattttgaatgaggatccgtgcatgcagcaggaaagtcggcacggaagctggagatgaaaagctgaaacatgatttcttttcaaagaaaaatgaaaaaaaaaaaacagcagcactgcgctggcagccggagccaatgggcgaggggcacgtgtccccggattcctcgaccgaccagggagactccgcacgagcagggcacgtgacggacgatccgctcgtctttatatacggctaatgcgtcgctggtgagttta

SEQ ID NO: 14450 - DNA, 1501 bp, Oryza sativa
aaaaaaagagaggagagtttcccggagagagagaaaggggaggcaaattgctcgggaaaagtcgggtgcttctcggccgccagatcggcggaagcgatatccgacgggtataacgccgccacgtagtcatccgcacgaggcaaatacgtggagcggcctcggctgctgcttcttccattcgctttcgcctacccgccgccgcgacacggaatttcaggcggcgccgctcgccggagaagtggtcggcccccgtcgagagggagggttagacagggagaaggagaggatgaggagcagcgaggccatggagctcctgggcctcccagcgcacacccgcccgtcgccttccgaggtattcatcttctcgattccctctctcgccgctccaccgacgaatctccaaatccgatgcttcttcctgggggttggtacggccttgattaggtagctcttgctcggaagaagcgattttagagctggattttggcgggacggggtgccaatttgagaacctgattgctatgcggttgggagttctttgagtttgtggtggtgttctgaacctctgaagcttttgattcaggttaaggctgcgtataggagaatggtgatggaatcgcatcctgatcgtgtcccgacgcatcagaagtctcaagccgagtcaaaattcaagcaggtcaggtacagattgatctctgatcattgtggaaaactcctaggccatcatgtttttcggtttcatggtgacggtgtgcttcaagcatgaactttatgatatgtgctttccacaatcaaatggccgatgtatgcttgtttttgtatcactagctttccaggacttatcataaacatgtatgtatatggctttgcaatactgcacgcggaagaatttttcatgtctgcatgataattagcaatactaatccgtttccagttggatgaatctgaatgcggatttaccaaatgagcattccgtacactttctgaagttgataaagtgtgagttttaacgtttcgtgcttctgttttttcagatatcagaagcatattcttgtttgaaggatggtatgtcacatttctgctcatctaaataatcaacgcaaactcattccctttacctatattgctactcactcaatcgcttaccaatgagatttttttttctttgttgtcgctgttttcaggaagaagatatgggagtaggatggaaggtaacaaaatcaatttcatgaacacaaaatttgctgttctttgtggtagctaatgagattcatcatcatacatgcagtacatgtgatgaggtctggtgttccgacgggatttggacgatcaaataagacattggttaaagccccttttctactcataatttttgcagcggtttcattgggtggattcagcgcttcaaggtaattcaaagatcccagagtttgccctctccattctgtttttatttctgaattgattgaggaatcaactttggttttttgaagagcatacc

SEQ ID NO: 14451 - DNA, 1501 bp, Oryza sativa
aagatgaagggtataaagaaaacaaataaatggtactgataaatgttatgtgtcatgatatgcttaaaaaaccaccatgggtcaagaaaaggaggaactttgctcccttcaatcacatatttgattttccttcaaaaaaaatatgtatagagatgtaggcactcatattcacacgagcacacttatctatataaagttttaaaatttttagcaatcaatatcttctttaaatatgcaaatcagtcgaaaatcacatacaacatataaaagatttatgttaataattacgtcatatcgctattttagcactatgttatatgcctactccttatgtttttgtattttaaaacctaaacccttctaaaacttttttccataatctgaaccttttaatcacaccagcacacctgatgtggtaaaacaatactgacacgccacactcatcgggcgtgacaggtttgtccggccaaataacattaccacgtcagccggatcagcgtggtagtgttgttttgccacactagtctagctgacgtggccaactagttcagatattgaaaataatttttgaaatgatttatttttaaaattaaaaaatttaaaagttcaaaaaacaaaaaaaggatcactccttattgatatatttgactaactacatcgatgtttaatatagtaggtggctctcatcttttctctatggtttatagtttataaaccatggtcaaattttaaatttaaaacttgattataaagttttttttatcgtagtttattttttagcattagcttttaatatcgcttaggacattgttaaggtaggatattaaaccaactctatgtgcatattaaactttttcatagtaaaaaaaatattgtggtacctctcctttttcaaaccagcattaactcaacaaaacttacctacctcccttagagcaaggataataatatagcccacttcctaatattagcccattctaaagtcaacacatataatagattagctataattttcttctcctatctctatctctcacttatacatttaatgtatttgtcttgaaacttgtgttaagctagcttttgcatgagagccaacaccattctcttttgtttacctctctcctccacatgagcttatagtatgcttatagctcactattatacttgctcttatctcaaaatcaagcaacccataatgtgaattttatccttaagcttcgttcccctcttgcttttccctccctaatcaactggaccgcacagctaatacccttgtcggatcccgactccaccccacccgaacccgctacccgcacccgcacccgcaccaacccatctccttctcctcctaactcaactcgactccaaccgccgctcaccggaatgcggcggtgacaagacgaccaaccacctcctgcgactgctcggatcccgcgacgcggcggcggcggcgaaatacggagatccggcagctggaggcaagagagagagaaagcca

SEQ ID NO: 14452 - DNA, 1501 bp, Oryza sativa
ctgtaattaggagtccgaacgtctcaagttagcatgcgagtattttaaaagagatttcttatacgctccaatattttcaaaagcgaacgaacttaaaaactcacttaaataagcgaatgaccttaaaactgacttatacacggatgacgtactaaagtaccgataaaaatatctttaatttttatattagtggagatagagattcattctaaaacagtagcatgacaaaattacatcacccgtagtggacatgatagttttattttgtcacgttagttaacatggcgtgatcaaataacgctgccacttcatttaagtcttgtttgacactactctgactctaactccacctaaagtcggaatagagctagctggagcgttataaaaaaaaatagataggtggaattgggttatgctactctacaattcacttcagatcttatctccggtagttaaatttaggagttgtaaatctatcaaacggggccttagattaggggtgaaaacggtaacggtaattaccggccgaccggcgttcgttttcgactttctaccggccgagccatatggaaatggtaatcgaccgaaacaaaaatggaaatggtaaaaaatatggaaatgaaaacggaaatggttttgctgttataccgatcgtttccgtatttaccgtattctcgcggaaattaccgtttcttataatatggtaattaccgtattctaaatatgtcgatattataggacatgtctatacttaacccacagcttatagattgaatgactcttcaataaaatctctaacttttgtacatggctaaaatgaagttaatttataatttatatagtataagcttgaatttatgtatatatatatataacatacttatgtaaagttaaatatatgtttttatagtttaatgtttccgtatttgttaccggtttccgatctgtaccgacatgtttccgtccgtattgttccgtttccggttttccgatatttccgatatcgtttttgtttccgactttatcgtttccaatttcgtttccaagaaaaatatggttacggaaatggttgaggctgttttccgatcgttccgaccgttttcatccctaccttagatgagtgtggcagcgatgttttgctatgttagtcccactgattgatgtggttaaaagaagtatttttaaaataagttttagaatgattattttaaaattaaaaaatcaaaactcaaaacataaaaataaaatcgagcggacatatagggactacaataaaaagttaagaacacggaaactacttttgtttaaattcaagggcctattcgcaaaacagcgcgtgaacgtggcacgcctgaaccgcacggaacaccggttcatctcgccgtcggtcgcgcgcgcggcgccgccgcgcggccatcgtcgcgcgctgcctccacctcgccgactcgccatagcccatagcgaagcaatcctctcttcccgtctcgtggagagccgaagg

SEQ ID NO: 14453 - DNA, 1501 bp, Oryza sativa
ccactgctacgaccaccgtcgtcgtcgagcacactgtcgccgccgtcctcgtcaagctgagcgacggcaacgacgatggccggcacttcctcctcatccaacgtgtcaaccggtcacatccctaaacccttttcccttaatctctattgttgttcaatcattcaaccaaatagaaccaacctgactagatctaaacctaggtgatcctagagagaatactaacaatggtatcagagctaccctagcgcatagatcggtttggggagagaaatccacaaagaaaaaggaaagaaaaagcaatgatccgctcggatcaaaagatcgaaaccttaacccttgaaccttaccttgtcgccggccgaacgttgacgccggcaaaggggtgaaagggggagggcacagggcaccgccaaggagcctctcgatggccgtgtgcgcacccgcaggtgcacgcgcgcgccggcgaggtggcccgtggcggcgcatcgccgctctctctctctccttcacttcacaggtggaggattagagacggtgggaggagaacagaaaagtgggcgcgccacagcgcgaggtcaccggccatggcgcgccggccatgatgcggcggcgcgaggcgcagcggcagtgcgacggcgcggcgatgcatgggccgtcaacgcagccacgcgcgcgaaagatagagagagagagtggagaagctagggtttcggctagctggcggctggggtcgggtttttgtccctccgatctcggcgcccggctgtctgatcgaaaccctagtgattggacggccggcggcggctggaccaaaatcggcccatgtggggagcgcatggcgggcggctttcccggctcaggcccaggttgcggccaagggaggggtgagggagcgcccgcgcgcatgcaaggcggcagtgggccgaccggcaaaggctgaaagagtctattttaggtccctcggggccgaagcaaaagaaaagaagtccattttttgtccttgtttcagaagcatttgcaattatagttattaaaatgtgtttatttctaagcaagttgaacccacgtgaaaattgtttagagaatagataaatgtgagaaatgcttctgaacatgtattttgtgtattttcatgcaaatttcaatggaattttgtatcgattttgcatgttttatatctgtttaaaatttgatccaaagtggtagtttttttacagagagtgaataacagaattttgttactgttcatatgaattttatatagatcttccgctgcaaatagataaaattgttaaaagttgtgtttttaaaataaattttgaaccaacgggagaatttaattttaggaacattaattttgtgctatgatgttgtaattttctgaccaacgttgataattgcaatgttatagttatggctctgtgttatatctatttttacccaacggtgatgtaggtctaatgcataatattttaatgttaattttgttctcacagctact

SEQ ID NO: 14454 - DNA, 470 bp, Oryza sativa
ctgtgtgacttgccttgctggccttggaactcttcaaactcttcttccgcgaaaacggactctccggaaacgacggaatctaagcagaaaagagcaaaatcaccaaaacagcacataaacaagcatgaacagtacatgtggatatttttaatgtgtagatctcaattttagaaaaatttagagacttgaaccaactaaatcggagctaagatgaattagttatgaatttttaaagattaaatcggattaaaacacttaaatcggtttaaattgaattatgacgcaataatgaattatttttgaaaaggaaaaggggatttattgcgtcagcgggctagggtttggtggaccggcgcatgggcggcggttcacgcgaacggacggccgagattgatccgatccaaatcggacggctgagattgatcgagtccacggcggttcacggcggacggccttgatgacgccagcaa

SEQ ID NO: 14455 - DNA, 257 bp, Oryza sativa
cctcaacttgttagccagatacaaaatcgtcccttaaccgcaaaaccggacatccgacgtcccccaacttacaaaactggtcacaataggtccctcggcggttttcaccctggttttgtcccacgtggcggctgactcagcgtgggacccacgtggaccccacatgtcagtaagccacgtcagcaccctatctctctttctctatttctctccttcctctcgctctctgctctcgcacaggcggctgcgcgcgcggc

SEQ ID NO: 14456 - DNA, 789 bp, Oryza sativa
cttatcatataagactgtgtagtgttctaatattatttgagttttaatataagattattttattgcaaattagacttagtatgacattattgactacggaattggtgcgactcctagcaattgactattgtagtcttaattagacttagcatatacgcacgaaacacttagcatacatgactattttagtcttagcatgtaatattatttgagttttaatataagattactttatttgtaattagacttagtatgtaattattgactacggaagtggtgcgacaagtagcaattgactattgtagtcttaattagacttagcatatacggacgaaacacttagcatacatgactattttagtcttagcatgtaatattatttgagttttaatataagattactatatttgtaattagacttagtatgtaattattgactacggaagtggtgtgacaagtagcaattgactattgtagtcttaattagacttagcatatacgcacgaaacacttagcatacatgactattttagtcttagcatgtcatattatttgagttttaatataagattattttatttgtaattagacttagtatataattatttactagctagggttgtataatatacgtcacatagacttagcttatatcacgatttgtaattagacttagcacgtaaggttttgtagggttctaatgtacgacatttacacttagcatacatgacttagattgttaaaacataaatgtctcgtgacttagcaaatgtttcttgtatcaacaga

SEQ ID NO: 14457 - DNA, 1501 bp, Oryza sativa
catatatagtctgattaaatgttttggaagttcttatcttttaaatagaagtttaaatttctaacagtaagaaagcaataagagcaatgtctactggaaaattcaaatctttaacttcaaagtttaaatataaattcaaatctctttaagcttttcatattgattgttctcatagagtttttttttcactgtgtagatgctccttttcagttaaaaaaacaaacaatattattaggtaagaaataatatttttttatatgtaatttgtcttacttttaggaaataatatgaagccccatatgcgaattgggccttagatggttaagctcattgtgttggaatctgtttgtagttttagatttggcaccagccgggtgttgtgtatggtccgacttgtactcgaaaaaaataaacctattacgccataaatggttaactcactaaacattaattgtagcatgagacataacctttagataaactcagggctgggctggctcgagggcttaggtcggttgtgcgaccgcctagggctcaggcttatcaccaaccaacctagctagcagagggtgtcatcgtccatccttatgcctgaatcccacgcggccacaccttacctcatcatgactagagtttattttatttttttttcatctatttagtccaaaaattaggctaagatcttgttttgttcttcttgtttaatttactccataatattatgtgtttattttgttagtattacttatttgtgtcactttagatgatacatgatttataaagtatatattacaagtaaacttatatttggccttaaggatttttatcaccgagtttgcctagggctcttaaaaatatagaggtggccctggataaactagagacgaagactatcatctaacaatagatactaagcaaatacatgatgatgtggctatatgtgaaggttgctttacagatagtgtgtgaatatatggcaatctaatggccaagagtgttgatgacttggctaaacatgaaaactgatttatggatagtgggttttgactatatacaaagaagtgataggaccgctgaggaaccaagttgtccgcggtctcttattatgggttgcattttccccaaacttccgtgggacttccttcaatacccatgtgtcgattttgcttttggaattgatactcgatatttctgccaaggagaggctccacttagatgcccacgcgtttattaatcgccaccaccttaccatcacaaacttaattaattccaatagcatataccaacaatttcagactacaaatgagaatatgtacaaacctcttcctcctttacatagttcagagaaatgggaaatggtgccacttgctctcacagtgatggacagtccatagaatcccataaaagaaaaagtagaacattcctaccagctagctagcaacatgtgcagctccctataaattgagccattggtagatcagccattgccatcagagatagc

SEQ ID NO: 14458 - DNA, 1501 bp, Oryza sativa
tggcaaacaatttccccgcaaaaaaaagtctcggcaaacaatgacctcctccagcagcctcttcatgcatcttctaagctagtgagttgtagattaaatgggatctatgcatatgtgtgtttgtgttggtcttgggtgttattttttatgaaattcgtgacttgtaaagtgccattattggatatacattttgtgcatttttttcaacttgatgaaatttgtgacttgtttagaattgattgtgtgttgtgttagtttatggatgagcaattgaaattttatttcatttttatccgatttatggtttaaagttatgggaacaacagatcaaaaatgcctcgaaaaggatagcaatgcctttgatctagctcaaagcatcggctcgatttttcattctctcatgaaagcaccatcaattaatctattctggttctacaactgacactactacattatcattgctgtttacacatggaatcgacactgacaacgatctcaaacaggcactgataaccttgtctagtcctgttcagtgattccccatatttgaatgtatttgaggtccacacctccataagtatgaaattatggggctgtttggttcactccctcattttaccaaactttgccatactttttaagacatatgtttgtttcacttctaaacttgtggcatgccacagttttttaattcaaaggcccacatgtcatacaaccattttttagccaaaccatgtttaaggtgtggccattaatttataagccacatatttagctaggtttggtaagaaggtttggcaatgtttgggagggaaccaaacaacccctatatattccccttcgaatcccctcaatcctcttttgaatgagattaaccgaacaagctctggacacgtcaagcaaactgtgcatgcatgcagttactcaaacagccaaattagcttagcaaaagtacttagtaaatctgcggtgattaattctatcttactataaagttataatccactaactcctaaatcttaacatgcaaagatgacacatcatcgttcactaacaagttgacacatcatcatccacgaacaaccaatacatttaacatcatgcaaacatgctatattatctataatttaaaatttattatattttagagcttttaaaatgaaagcatgttaaatcatcatcccccataattcacataatatttcaatatatatcttcattattttttataatatcttatgtacctatgtaagttcatcctcacttgattaatgctatttctctcttctctaattaatccatatcacatcaattgattttagtgcttatgtaagtttatgttgtttagctatcttacatattatttttacttattattttcatactgaattctcgcagcaacgcgcggggtttcacctagttattagagaggtgaatagttaatagagagatttcacccaggtgatgattaatccctggatcaatcacaataatgcataca

SEQ ID NO: 14459 - DNA, 1501 bp, Oryza sativa
gttggagctaaattttagccatttatccccgtgatactctaataaagtataaacaatgcgtggggataaggaagatagaacaacgtgattggacaaaggaagtataaacccccattctttacataaacaagtgatgcagccgttgctattaccacatgaattacagtaactgagacatataatacaaccagcaaactaagtctcagctggaaggatctggggcagcagtatcagagttgccatcagcgacgtggaaaataagctgctgtataaacccgtcaatgtacctctcatggagttccctgtcagctacaatctcttgcatcttgagggcatttgtaacaaacacactcctggtttcttcctcaaccatgacggctcggactgcagcagtgacaccatggcgatcgaatgacccgtcattctcatctcgtctcacctgcaatcctaccatattaccctccattgaccatgcattcggcccttggtccccaacgatgggcaacatgatgagaggtttcccaaacaggagcccctcgacaagcgagttgcgtccacagtgcgtcaagaatgcacccaccgcggcatgtgccagtatggtggtctgaggaacccaccccatggcgacatgtccatggccatgcgtctgctctagaaagccgagaggaagcacatccgagtcatcaacgccacagggctttctcagcgccaagagaaaacgtgtcccggcgagctctagcctgagagccagctcgtgcaccagctccacgcgcagcggcacctcgctccccagcgcgacgtacaccactgaatctggcggctgcgcgtccagccactgcatggtggcgtcgtcgaccatctcggcggtgcggcggcgtcctccgtcgggcgacggcagcagaaggccgagggggacaagcggctttttcatgaacgtcaccacctgccggaagggctcgggttcccacacatgcggcgcccaagaactcggcgaacggcggcgccagggcgtcgaaggccttccagagaagctcgaacttgtcggagggaacgtcgttggtgcactcggcaccaaccgagagaccatcgacgtgcgggagcggcagcaccacgaggtcgacacgcggtgccacggcggggctcaccggcaggaggcgcgcgatgttgcgtggtgtagagacgaaggacacgcggtggccacgcgatgccacgcgctctgcgagctctaggtaagggagcacgtggccgaacgcgagccatgggaagatcacaaggtgcagctttgacgaggattcgcctccaaagtctatggaaaagggttcactactgttcaccaagatgcacctgttattgaagatacaaattcttctactgttcagcagtctccaaaacgttctattgcaaaagaaaagcccaaaagaagtactaaacctcctcaaagatatattgaagaagcgaacatagttgcttatgctttgagtgtggcagaagaaattgaagg

SEQ ID NO: 14460 - DNA, 1501 bp, Oryza sativa
aggtctcgttgggtgaatttgggttgggggggggcagcgatttggttctgatctgttcggagattgtaacaagagtgggttgcggggggattaatttctatcgtttcaaggcatcgatgaacgaggagcgtcaggaattctcccctttcgtgggttgctgtccttgtcgttcgttcgtgtattgatttgtacggaggtctgacgatgatcgatccaggatacatatgaatccgttagggccaagtttgcttgatgccaactgtgcatggatcactgcgcgattttacgctttttagtgtttatatagaagcctgtggttgaaaatagtccatttctatggtaatttaggagatattcaccgtaatacatgtgatgaaaacttatgtagtgctgaatctttatgcaatcatgaatgctataataaactcacgcacgctgtacatgcgtgctcactaaatgttgtggctcaaggacctttgttcatttttcctacaggaaactttacctaattctagttcgtacgtgtagatttggttaggaacgtttgaaatagatggatgcatacacgtacataatgtattgaaggagatctaatattttcttacggtaactcctgtgtctagcataatgagataaattggagaatggctacaaaattagccgtttgcagctgaatatgtttgattataatggtttctgcaactcctgtccaaactgatagaaagtatggtgaatttatgtttggtccagatgaaccacaatgtgctgatacctattgttgtgtctgtacagagttgttttggattctttattctcgtcactggattctgtttacgtagattctgcttacctagtttctcttttactaactgtaaacattttttttcaggattcctatcgtgaataccataaccatcctttgttcttttgaagtgttcagtgcatacaactgctccctgtaggttagtactagcattctgtccaaagataagttaaatgtacttatttgtatatgcttaatgatgtcccatttgttcgtttttcatctgttgttttgtttgtttgtgtacatgttgccaacacctcttctgcatttaaacaaactttcttgatttctatacaccatagaagaccgaaaataatgtttttaggggggagttctgcagtttgttcttttttagtgcaatctttgtttaggaaccatggatataatgattcaagaatagttgttgtttagctgcactttctcattcacttgtttcgtttttttttctaattattttatgcatgagatcgtcctcactagtcaccacaatactttctttaggactaatatttatttggaaaactaaaatctgatgcctgctaaatgatctgaaattcatttttatacagttcttaataattgtgttagacctgactaatttgccttggtattttgttttggcacttctaatttggatcattcatgtttgttgttataaaattgatggtttttaat

SEQ ID NO: 14461 - DNA, 1501 bp, Oryza sativa
caaggcaaattagtcaggtctaacacaattattaagaactgtataaaaatgaatttcagatcatttagcaggcatcagattttagttttccaaataaatattagtcctaaagaaagtattgtggtgactagtgaggacgatctcatgcataaaataattagaaaaaaaaacgaaacaagtgaatgagaaagtgcagctaaacaacaactattcttgaatcattatatccatggttcctaaacaaagattgcactaaaaaagaacaaactgcagaactcccccctaaaaacattattttcggtcttctatggtgtatagaaatcaagaaagtttgtttaaatgcagaagaggtgttggcaacatgtacacaaacaaacaaaacaacagatgaaaaacgaacaaatgggacatcattaagcatatacaaataagtacatttaacttatctttggacagaatgctagtactaacctacagggagcagttgtatgcactgaacacttcaaaagaacaaaggatggttatggtattcacgataggaatcctgaaaaaaaatgtttacagttagtaaaagagaaactaggtaagcagaatctacgtaaacagaatccagtgacgagaataaagaatccaaaacaactctgtacagacacaacaataggtatcagcacattgtggttcatctggaccaaacataaattcaccatactttctatcagtttggacaggagttgcagaaaccattataatcaaacatattcagctgcaaacggctaattttgtagccattctccaatttatctcattatgctagacacaggagttaccgtaagaaaatattagatctccttcaatacattatgtacgtgtatgcatccatctatttcaaacgttcctaaccaaatctacacgtacgaactagaattaggtaaagtttcctgtaggaaaaatgaacaaaggtccttgagccacaacatttagtgagcacgcatgtacagcgtgcgtgagtttattatagcattcatgattgcataaagattcagcactacataagttttcatcacatgtattacggtgaatatctcctaaattaccatagaaatggactattttcaaccacaggcttctatataaacactaaaaagcgtaaaatcgcgcagtgatccatgcacagttggcatcaagcaaacttggccctaacggattcatatgtatcctggatcgatcatcgtcagacctccgtacaaatcaatacacgaacgaacgacaaggacagcaacccacgaaaggggagaattcctgacgctcctcgttcatcgatgccttgaaacgatagaaattaatccccccgcaacccactcttgttacaatctccgaacagatcagaaccaaatcgctgcccccccccaacccaaattcacccaacgagacctaccccaacgagacctacccaaatcagcgaccgatcaccgcaaaccgaacccttccccccacacaaccc

SEQ ID NO: 14462 - DNA, 1501 bp, Oryza sativa
gctaagaaaaaaaaaatgagcgggccttcatccctactgtgctaacgtgtcatccaaacaaatcaacacgtgacaacatcaggtaaagacgtgtgtcacaaatcagatatgtacacgtggcgcttcaaaatgagagcacgtggtgcctccaccttcggcaatgtggcgttagcgtacaccaccacgtggacatacaaaatgtaaacacgtggcgttaaatatgactgccacgtggtgtctccacctttggccacgtggcatcagcgcgcaccaccacgtggacataagaaatgccaacacgtggcgttaatatggctgccacgtggcgccaccacgttcgaccacgtggcatcagcttgcaccaccacgtggacataccaaatgtcaacacgtggcgttaaatacgactgccacttggctctagcgtacgggagatgatgatccagcgtggcgtacacgtcatccgccacatcacagccaacatggactccacgtgtgatagccacgtggcatggacgacgtctgtcctagccagctggaaagcagttctatgacgagcaccttcgtcatggatataagcatttctatgacgaaatctactgtttagtcatagaaaaacatatgtgacgcgacttctatgatgaatcccatttcgtcataaattcgtcatagaagttactttatgacgatttgcgcgtcttccatgacaaaagtagattgtcatagatgtgcctatctccactagtgactatggctcatcatcctccagtacaccacgcgacgtatttgccaacggtgggaccagcacgtctgcacatgctatcgcagaggtggagaatcaagcggtcacgccggcccagcacctcggcaccatcaacgcaatactgagagaaatcccctatgatcccgtacttaacgatgacctcgcacggtggacagaacgactacgggaatcggtagccaatctcagtaacgcgttcgaggaggccgctaccagagcgcaaccagaacaaccgacagctggcggtgctgacagcgaaccaccggaacaacggacgtcgcctcaacgagctacccctccacctcgcggcaccggcgatctccgcgaccatctgaatggctgccgaaaagcacgacgcgcgcgagacaacgagaattgttcccgacatcgtgtctcttcacgacgtcgcgagaacgaagagcgaggaggccgctcgagcgaaaaccgacgccatgataatcgtcacaaccgccacgaccgcgatgatcgcgaacagcggacgccggacgatattggtcgaggacaccgacatgacggtgatgataatggagatcggcgccgggacgacaatggtggatgatgacaggactctcgagaacccgaacgtcgtcctcggaatcggacaccggagccaagtgaaccatcgtcatcatcatcttgctcttcatcctcaccatccgatagacatccacggaggacgtacgatcgccaacaacccac

SEQ ID NO: 14463 - DNA, 1501 bp, Oryza sativa
ttcctcctttactttgtctaaacaaatctcagccatccgtttttattaatgacctaatctccaattaaactccctatcaatttctatcacccctaccaaacaagatattgggattaaaaatcaaattcccatattaatctcatcataaattccctcgtgtaaactcctaatccccttccctcgagttaccaaacaagctgttgggatacgatatctctggttttatggttgagtgattaccaatcagattcgatcaatagttgacggtgacgggccaaaatggactttttccttctgccactcctacgcctcctccacatacatgggtcatggcccactcctttctacctttgcgcaacggtggtaatgggtctaactttttgacctacacaatgtgacggttggatctaagaatggttgaactgaaaattataagtagtttttgtgctgaaaatatttgggcccctttgattcggaggataaacataggaatttcggagaatttcaatcctatagaaaaatttcctattaaggcctttgaacaaaggattgaatcctatgtgatcctttgaaatccctatggaatggacaatcctatagagattttgtaagaaatttagcaatagctctaacctcttggaaatttcccttttacaatcatctgttttgcacttacattcttattagaatcccgtgtttttcatactccatttttacattcatcagatttaaaggggctcttaagggttgaggtgggttgtgaaagagcccatggaccctgacccatcaccacccaacttccagcctaggaataagttcactttgggtccctctatttgtcgcctagtccgattttcgtcccttgaccgcaaaaccgggtacaacccgtcccccaacttccgaaaaccaagcaaacgaggtccctcggtggttttgaaggtggttttggctgacgtggcgcatacatggcttgtttgattagttttctgtcccacgtggcattgatgtggcgctgacgtggtaattatatatcgaaaaaataataaaaattgtgggcccacatatcagccacaggaaaaatttttaaaatggtgggtcccacatgtcagctacataaaaaaataaatatggtggggcccacgtgggccccatatgtcattctcaaatgaccaaatccaatcctcttcttcctcctctctccggctctccccatctctctgctccctcctctcgtcgggcggtgtccagcggcgagcggcggcggacagcgcgccggcagcgggcggcgtggcaacggacagcgcatggccggcggcaggcgacgacgcgcgaggcttgtggggcggcggcggccatctctctctttcgctgctcacctagccgtccgccgcccttctccctgatggccgccggcaggaaaagagggagcggcgcgtggcggcgggagaggagggagcggcgcctagaggtcggcgtccgggtggtcggcggcggcgacacg

SEQ ID NO: 14464 - DNA, 1501 bp, Oryza sativa
gtccccccccccccgcacttttgtcctgttcgcggtcacgcctctacgtagtactacctaggtgtaggtatgtttgaggaggagtggattggggagattgggaatatacgtaaaacgaggtgagtcattagcgtatgattaattgagtattaaatattttaaattttaaaaatagattaatatgactttttaaagtaactttactatagaaaatttttataaaaaacgtttagtagtttggaaagcgtgcgcacggaaaacgaggtgctttctcaccctatatcacacacacgaacgcagctttactgtatagaccctctagtcaaagagcaactgaagttgcaacaccaacctccgaccctggaccaaacaacaatatggctaccacatcactagagggatgatgaagatgaaccatcaaaaaacctgcacaggctgcagggtcccctactccacaatccacaacgctcagttcaaggttcctccaggctttttcccctgtcacggcctctctcgtcgtcgtcgcttgcgtagctctgtaggagtacgcaagcacactcgaatactacaccaccaccatcggttgattgacatttgaccctgattgacgcctctgcgactgcactgatcgatcgatctctgacatgcaccgatcgacacgtccggatcatgatatcttttccctctcttcttgcatcgtctgatgaatccacaatattcatatccttgctataaagcgcggttgcaagcgtacgctgctgtcgctgtcgccattgttcttcatcttcgtcgtcgtcgtcgtcgtcgtcgtcctcgccgcttgcagtcgctgctgccgccgccgtcgccgccgatgcaccaccatccgtcacacgtctttactactaggtactgtagtgttgtagcagtgcgtgtcgtcttgcgacgagctttgtgttggaccacgacgccatgcttggctgtaagctctagcttggcatcgcgctaaccccttttttgttggcttgcgcggcggcgtcacgcccgtggcggtgctactgttcagctgcagggcggaggagcagcagctgggtggcatcggcacagctggataccacatcggagatggcgccatcttccctcctcatcatcttcttcctcctcccgacctcccgctcctccgcactagtaactcacgccactgtctcttccactgttgcattccaagaactgctcctttgtttgattcttgctgcattttgttttttgttttttttttgaaaaggtccgaatccgagctccaagtcgtcgagcaacctcaccgccggaggacaccttccgccgttcgccgtcgccgccgccgccgccgccggggtgagtttggttctttcttcttgctgattgattgattcttcggctgatgcaatgcgaccagcagcagcatggcgtaccggtggtgggcatggcggcgcaccaggggatggcggcggcaacggcggcggaccggttctgcctgccaagg

SEQ ID NO: 14465 - DNA, 1501 bp, Oryza sativa
aaaaacaaaaaaaaaacatattatttatcgagcaaatgacacaagtttatattggtggcaaccgattactttatcaagtgggtagaggcgattcctttgaagaaagttgattcgggggatgctatacaatttgtccaggagcatattatttatcgatttggtattcctcagatcattacaaccgatcaaggctcgatcttagtgtccgatgagtttgttcaagttgccaatagcatgggtattaaattgttgaattcttcaccatattatgcacaagctaatgggcaagccgaggcgtctaacaagagtttgatcaaattgattcagaggaagatttctgattatcataggcagtggcatactagattggccgaagcattgtggtcctattggatggcttgtcacggttcgatccaagttcctccttataaacttgtttatggacatgaggcggttttaccatgggaagttcgaatcagctcgaggaagacagacttacaaaatgagttggcagccgatgaatattacaatctcatggccgatgagagggcgaacttggttcaatcaagattgagagcccttgcaaaagttaccaaagataacgatagaattgctcgacattacaacaaaaaagtggtggccaagtctttttcggaaggtgaacttacgtggaaattgattttgctgataggaacttgtcacgcccagaaattcacgaaccagaatttctaagctgaatgtgtattaaacccctgtccaggaccagccagggtacacaaacgacaattgttgacatacagatccacgtcttacaaaaatacaaaagattacaaatgcagcgaaaaaggtaaaagcgagctaagccaagacttgactcctgcagcgggcgattccattccacaggcaacccttgacggcagcgacgaaccaaccttttcaagacatctccaactgagaagaacttcaactctggtgtgggggaaaagagcaagactgagtactacccactatactcagcaagtcataccggaagaggaggtatgatgcaggatataaccaaaggaggctacggggttcatttgcataaagcaggcatttaaaaccagtagttgaaaacagtaaaaacagttgtagtaattaagcaatattaaccagtcactgtccaacgctacgccacgttgcaacaggcccaaccaaccacctgaactacaccagttaattaagctaaactaggggtgagactaatcatggtgaatctggtcgaccacccataaccgcgggcatggctattcgaatagttttactctgatcagaggtgtacaactgcacccacaagacacagccccacgacacgttcccgtgcgccgacatgccaccacgacataccggaaagaggccgtgacaggacccttcgcataaccctctctaaccgatcgcaccacaccttagggttcgcccccgtccccagcaggcaacgggcagcccccctttcatgccgcgg

SEQ ID NO: 14466 - DNA, 1358 bp, Oryza sativa
ccccccccccccccccccggccccgcgacgcgcacccgtgtcgacgtcgcaacctgcaaccaaattaaggtgatcgatcagtgccgtcgttgcccgcgcgcgcggtcgatccatccatccatccatctatatctgtatcgatcgagtacgttgatggctgtgggatttttaggtggtttggctcctgcgggcggctcgacgtacgactgagactgtatttagttgcaaattttttcaacaaactttcaacttttccattacatcataactttcatacacacgtaaaattttaaccttttcatcacatcgttctgatttcaactaaacttctaattttgatgtgaactaaacacactctgattcagatcctttatctttaaaagcaccatacatttatcattgacgggtggatgtatgagtatttatcgagctcacgtggtagtgataaagacacgtatgttttaaggtagagatgcgtacgtacgacgcggccactagggcactgcatgctcagcttcgctgatctctctgtcgcgcgcgcgcgcgttggaacaaattaggctggtggtgggggctgtgcaccggcggagtcgggccggcgccgccatacaccgcgcgcagctggaattgttatgtacgttatcgtgttactgtggctagccgctctcgtttggggcttttaacctgggaaaaccagagtttggtttccccaggttgtaggcaatgggagtcaattaaagaacgacctactcatctgttggatcgacttgccgtcgtccttggtcacccactcgatcatctgtgtcttcttctcgatcgggccgggggtaatcatcgcggggaaagcgacgcgatcctcgtctgcgcatggacacagatagtgaccggccccagcttagagcaagtttaatattatattataaccaaccactagctctaaaatatttatagctaatttaatactcttaattcatataataattgcttactgtattattaatacctagttccacatgtcatatatacattacgtattaaagtccgtactgcagctggctacagatagactgttgctcttctctcttctcttttatttctataaaatatatttatagctagctagcttataatctgagtacctgctctaaataggactggtaaattaagctactacatcgttaactcttcatgtaacgtttgactatttgttttatttaaaagtagtataatattatttattttgttacgacttgttttattatcaaataaaatataatcttaatttataattttatatatttatactaaatcttttaataagaagaatattaaaccttatgagaaaaattaataacgtt

SEQ ID NO: 14467 - DNA, 1501 bp, Oryza sativa
gaagacggtgatcgaccctgtccacaccgcgagcaacgctgagttggcgaggagcggcgccgcgaaggccatctcgtttgtacccagcgaggagagcaccctcgccagctgctccaattgctgctcgtcgcccaagcccgcgaccccggcgtggactggaggcggagggctcgctacgtggcggtatctcgggagcggaagtgtcatcgtggtcgtggccgtggccgcagcaggttcctcgagaacaaaaatgactggatctctatcaactggttcactcagctcattcattgtactttttattaagcattcgactgtctccagagcttcagactcaatacagcaagaagagaaggctctaagtctgtctttcccacaacaccctcctcggccaaaatagcctttacacgatataagttgagaaacacagtcctgcacttcatccactgacatagcaacaccaaggatgaccttgatgagcactggatttacttcaaatttgtattctgattccagaccagcaatcaggtttgtcagagctgcctcaatgtgttggtcagttaaatcgtacattcgtaccccaagagaaggcattaccatggccccagccatgattcctccatgtctctgttcaaaaggaacataacataccagaaccaaaaatttattaaaaatatgatcgatttcaacaacagaaaatacatttttttaggaatgcatcaagcgttgtggaatcaattttcagtttttgccataacataagaaatcttacttcagcatcttatcaaggtggttgttgagcttgctgaggggagtcgtcgatcagcgtcggggttgcctcctccgccgccgctccgaccgcggcgatggcggcctccccggacagagcctcggcagcggcggccgcggcagcggccgcgaaggggtcgagcacgtgcagcgaccgcgaccgccgcagccagagccacctcccgtcgccgattcctcttccgcccacaaccgccagagccctgcctccgccgctgcgcaccgcttcctcctctcccgccggccgctggccgccacgtgccgctacctctccgtcgcctggagagagcagaggagagagacgaagagaggagagatggggattggggagagagaggaggaagaagaagaggaggggtgagcatgatacgtggggccccaccatttttattagggagaatccactcagtaccactgagttttccccacttctacaatctaccactaactttatcaagttaaataatataccatcgtgttttcttaaatctctactgtgtgtcatcgccgtcagctgtaaaaagacatatttgcccctaactcattatacatgtttttttttttgtaagggagaagaaacatacaagcagctcgtgtgggctgcatgcatatgggccgatggccagcagttgcgtacgttggtcacctactatatcccggcgtatatatatacggccacgtatatcgggagcgt

SEQ ID NO: 14468 - DNA, 1501 bp, Oryza sativa
atggaggtcgtgggacaaattctttcacatgtgtgtgctacgatttttttcctcaccagaacaaatcttgtaatagatctaacgattcaaaattacgtgaaatttacgtacaagttacactgtagttatatgcaagttacagtgtaattacactacgattgtattataattacatctgttaaattattaggagaaaatttatcgacaaatgtataggtggtcccaatacgaatatggatcctctctctttctctctacgtcgtgaaccagtagatgggctggcgcgaataggcctttcagcacgaaagaacatacggcccagaacactgtgagcccatgatgagtcctgcgcggaagtgagggagctggctgaatccgggagaagcccaccgtgcaccagtcgacacggccctggtctaaatgggctaaatcacgggcagatgcatctctacatatttaaaaggaggaataaattcacttaggaccctcgtctttgacgttaagtttgactcacgtcctgaaaccacaatataaaatattacatacgaggtcccttaacttgtcaatgaatccgattttcgtccctcaaccgaaaaaccagacgcaacaggtccctcaactatcaaaaccggtgcagattacatccctcggcagttttgagagtggttttggctgacgtggtgcctacgtggctaatttgactcagtcttcatctgacgtggcattgacgtggcgcttacgtggcaattcgatccggaaaaataataaaaccggtaggacccacatgtcagtttcacacacaaattaataaaaagagagaatccactcagtaccattgagttttcttcacttctacaatctaccactgactttgttaagttgaataatatgccattgtgttttcatgaacctctactgcgtgccatcgccgtccatgagccgttagttggcacccgtttgatgaagtgaaaaattttttaatgactaaaataccctttgactaacatacactaacacttcttgactgaaaaccctagacgtgcacccaaaacgatttgctcagtataaggcggcgccgactcccatcgatggaacgccagccgcccaagtccccgacgcgcggccaaacgcccggctccccatcgacgacacgcagtcgagcgcagggctcctcatcgacgcgcggcggcggtcggtcgccgggctccccatcgacgcgcggccgggcgcagggcttcccattgacgcatagcgcatactccagcgccgccatggccgcgtgcggctgttccgatgtacctgcggatggattagctcgccgagttttctggataacgggaatcatccattttaatagctcgatcgtttttacctccggactccggtgtatgcgaccgcgtcgccatacggtcctgcgtcatccttccgtcaccagtttcttgccgatgaggaagtgacatcacgcgtgtatatatatatatatatacgctcccgatatacg

SEQ ID NO: 14469 - DNA, 1501 bp, Oryza sativa
gatgcacgccgagaaaaaaaatggagtgcataaaaaaggttgacgctatgattgattgtttgatttgatctagtagatgacaatacgtgggaaaatgaactaagcaagaaaaccatagttatattattaacggtttaaaagctaatgttaaaataaaccagataaaaaaatctttgtattatctgcattcctactatatttcgaaacacatgaaagttttaaaactattgttttattagtacatataaaaaattcaagacatgggaagagaaaagcatgaggtatattcttatgcttattttcaatggttttaaatagccggctaagacatttagcggttgatgatattctcaaacaactatagcaacaactacagtgggctaaaaagaatcatagcggataaattatatatgagagaaaatagctaaaaccattctcaaatagttgtagtcggagatttaaaaccatgtttattttcctccaaaattgctctagaattattaattccatataaaattttaagagaatggatatgaaattatcattcgtttcaaagggcttcgtacaattatattctataggatcaacatcctaaaacacgggaaagcatgtggtgaaaacttggaaactaccgttggattgaaaaatagacgtccgagattcatccacgtcatcacgagtaaaagttttactcacggatgatgacgtggacaaatttcggacgtctattattcgattcaacggtagtttctaagtgtccaccacatatgtagtttttaccatatattttcataaaaaagcccttacatatttttttaaatgagattctaaacgagaagaggctagatataagatgactcgcactcctttttaaatagctttaaaaaaatagccaaagggacaagaagttgcatgaggagccattgatgagatttgcgagacaaatgagcagtagggtcccgaagttggcgtccatagtccatatagaccggtcccacggaagacaccggcacatgccgacagcccacggttgcacaagcaaagcaggtgcttccagcaatttcaacccccgaaaccccgggataatcgcaaacccaacccaactcaacctccacagccactgcagcgtgggccctacacacccagtggaatcaccacttggcccacatgtcagagccaccacccatcatcacccatggcaatggccacccgtcgcctcgcctccgcgcccacgcatcgcctcgtctctctctcttctcgattccacttctacttctcttctcttccaaaatctcgcctcgcccagctcgctcgggcagcgcacaccacgcggcgtccctcccgctccccctcgccgctaaatagcgcgggagccgcgggctccggcgagcgcgagaggagagaggaggaggcggcggaggaggaggaggcggtggtgcgtcgcgagcgcggaagggaaggggagtagtagggggggagtggcgtcggcgtcggcggcgga

SEQ ID NO: 14470 - DNA, 1397 bp, Oryza sativa
cccccccccccctcccccatccccttcttcctctctgtctccagcgcacgcacgcacgaccacctcgcctcctctcctctcccctcccctcccccacctcgcctcgcctccacgcgcgcgacgcggccggcgacggcgagccgcacggcgcgtgggcgtgcctctcctcagccggcggctagccctctcctcgcgcgggggcggcggcggcggcggttgttgctggcctcattccaccgccatccctcctccgtgtctcgggctcgactcggtggtgaaggtatccatgccattccttttctctctcgcagccctctcctccctggtggtggagactggccggctggggcgtgggagtgtctgcgcttgggcttcgttgtgtcggtggagcgagattccggtgggatttgggggggcatctgtcgctgtaactcgtaaggggttgggggtttgacacggtttcgttttttttttaagaaatgttgtttccagtgatgttgtcgtgtctcaaaattattcagaaattttttatgtagatttcttggcgtagtcagttgtttcaggggaggcgcgtctccatgaaatctctgcatgttttacggggctttgcctgtagcctgaaatttggggggagtgggaaaaaaatgtttcaacaaaggcatttcatatcaagttgttttatgctactgaagtgatgatggaagatgtgataggcctaccaaggccggaaaattttccgcgtcatgcatttttcgttgcgagcaaggggcattgtgaggttttggtaactcaaacctgcatcgtgtctctgtttaggagttctcccttccccacgccacccgtctttgtttttggtaatgtttaacctgttacagaaatggaaatagtgaaggatcagtcagctgctaattactaccagtagctgttaggatgccgctgtgccataatgcaaagcataaaaagagatacatgatgtactaagaatgaaaataaagatctgtaattttttttaaaaaaaatccaaaccaaagaagccccttagtttaccttttcttttttttttactgtaattagccctctgtgatgtgtggaagggctgttcatctaaaatctccttgatatttcataatcagtatgtgtgattcttacaattgtttttctttgtttctattagcatactatttgttccaagaggcacacataatataccgatatgcatataatgttcattcgcttttctatttgatgtctttgtcaggtcaggtgctgatgcaagatataggttgttctatgagaaggatagctgtgcacatcaagacccaaatataatctcacttggttgtactatagtggtggttgaacactaagatatagcttattctgttgtttcaaaaaca

SEQ ID NO: 14471 - DNA, 1501 bp, Oryza sativa
ataggcagctgcgcagtgggcacagagcgaactattctttcgccttttactaaagaataccgtgtgctcgctgcaaatagcagcattgcaagcatacttgtgtagtattaagcatgctcaaataaatttgaaacaaattcaaggccatgtttgtttcattaattattagcatgttgagtccggcctcatcctcatgtgcttgcttgttaatcttcaatcgaagtactggttcagtagttatggattgtgtcctttcatcctcccttcagtttgtgagcatatagcaggaaaaaacttatgttcaaaataaaaaggaagaaaggaaaaacagaggggaattaaaggataggattattggtttgtcatgcaaacattcagagggaaacgttgacaaagaaataaaaagaacagtgtgacctatgtatatgaactagtatatgggttgtttcagccaataggttccatttgtcagaatagagtttttttgctgatcggcgagttgcttgaggtcctgccggagcaaacaagtcgacagttcaataaataatggtttcgtcagtgttggtttgtgagtcttcagcaaaacaagtattcagttagagaaaagaaagtctatgtcaataaggctggaattgatagttctgaagtcctgatcatagccgaattcatttgttggaacaggaattttgatataaataatactataatacaaaaaagaaaagtttgataaacctcgtttgttatatctagtctttttgtctgtcaaggtatagaaaatgtttgatttttgttctgaaggggaggatctctaatatattcagtcagtggtcagtgccaactctgataaataattgatgccattacttggagaaaaccttgtgaggattgtaagaaaccgagggaaaagaacattaaaactaaccagtcaaaataactgtgctgacaacaatcttcacttgatgacttcagtcatgtttttttactaattttattgaaggagaacaaccttttctttggggatccaatggtgtttttccacggtagtttctcacatgtgcttggttttagtcacccgcataacatctaaatcagtgtaacttttaggtgtgtcttctgtcatatagacttgcaaaaaacttcttaagaaaaaggcctgcttttattcatagcagtactaagagagtgctcttcatcctggctatgtaattgggaaccttttgaaattgtagcaaccctttgtccctctgtctaactgaaatagaggtccatgtccctgcaaatatgcattactgtacagcaatctggaaattagcacaggctgaaactggacagttcccaattgaagcccgtgctttatttgatatatttgcctacctatttatcatatatcttagttaatctaagtcgattatttaaatttacttatatcggtcagatcttttctagggttttgccagtatcggctaaattgttttgtcgatctagattagctattgtatct

SEQ ID NO: 14472 - DNA, 1501 bp, Oryza sativa
aatccaacttttgttggagaaaagaacagggatgtatttgaaaattttattaaaaaaaattatgggtttctatccaacatttgatcatccgtcttatttgaaaaatttataaaaaaagaataagttatacataaaatattattcatgttttacgatcaaataataataataatattaataaaaaaatttcaaataaaatgaacggtcaaatgttggtcacgaaaacatataaaatacttaagataggacggagggagtagtatactgcgacgacctgggttgtgccgtttttttatagtatagtttttcccaaagacattgatatggcaattcaaaaccgtaacagtcgcagtttgcatatagtacaattaataatgcagccatgcgggcaccaccaacgacgatttccgtcggcgaaatttgtcctaacgagctccgacgacgacttccacattgcagccgtaatttgccgaggtcttccacattgcagccgtacgtgccgacggcccgacgccacgtatgtagctttccgtttccaaactctgatcgcaacatatggccccgttcggtagtacttctagagtactgtttgattcacagtactgtttaattcagcttagggttattataatctgaattattagaaataagctaaaacaaaccgataacatattatgatagattattataatctataaagcaaattactataatctaatccactcaaaagatgctttttttattattgggtggctaacaactaacaaacagcttataatccaggaaaacaaacagctcacagcttattatatgtcggcctattataattcagcttatagtaatctggttcaataatctaaattacaacaatcttaagcttagacacgtgaaacgaggaaaccattgatgtttgattaattattttaaactcatgaaatgaatctatttgatattttaactctatttcaatgaaaataatttcacggatagtactgattattagtttgaaaagtgtgttaatgaaaactgtgacaaaatttgtatcttaataggaaaagaacatggcctatgtactctactttcacttcttgcatgtgtggtagctagctgcagtaaataattgactatactcgctcctctgttgcatattataagttgcatattataagttatttttattttttcatatcaaacatttttaaatttgattaagcttgtaaaaaaatatggcaatattttaaaacatttataaaaacaaaatataaaaatatattcaatgttatatattatttaatgaaattaatttgttgttgtagatttcgctaagtttttctataagcttagtcaaattaaaaaaaattaacttaaaaatataaaacggcttatgatataaaactaagagagtaatatattttgcagacccctcgttgagtatgatctgataatggattaccttacgtgtggcgattaacaagtcacttgacaatattatcttttgaat

SEQ ID NO: 14473 - DNA, 1266 bp, Oryza sativa
taaatcgtcaagtgatactataatttgcccattgatttttaattaaattggtggatctattatttcattttcgaaggttagatcgttttttcttttaaaacacacatatccacaacctccctctcaagtacataccaacaagccttcttcatgagaaattaaaatcaatattatttttacattaaaataccacatatctccacccgctaggtctagcaggtcctgatctgtcattctaaacatgctacaaacacttttaagatgctatacgatgctattaaattaaataaaatactagcaaatattaaaaatgaacaaagcattagactatcgatttgttagtttttctaataagaaaaaactctaagttggtatatgaaattcttaaattatagaaaattcttagaaattttgggaaacaacatccaaccataggattagacataaatcgatggacacattattttcaatcaaataaaacattattttaggtcactagatctatttttttttaaaaaaaacatcttataaacgctcttaagatgttacgtcgttatcttaaatcaatgaaaatcctaaaaattctgataagaaaacaaagcatccaaccatcggtttcgacatgaacatctgacacattattttaggttgttatattaatcatttagaaaaaacattccaaacctccctccctccctgcctgtagtgtacagcacgtatcccagtgcctgaggtcactttgtcatggtggttcaatcttaccagctagccagctatgttttgaggaagttgtttggggatgcaacaactaaattagggttgtggcaggatgcagagagagtagagagggtgaggagggatggagggaggaagtcatgtaagtgaagcaatgagccattcaatcatctattgccagtaagaactaagttagaaccgaagtatgcatatttaggagtaataatgcgcatcgcttaagttcacatacctatttgaactctgtgtgcaagtttaagaaatgtgctgcatttacttctaaattatgtacttttcatctgttgtgttgtaagtttaccagacatgttagattatcactcaatctggaaaactgtaatgtcaagagaaatgaaataagcatggagcacttaaacttcttgactgtgtcatggtgtttcaaatacctattgatgtgattataccctcttttttgtgttgcccttgtccaaattccccagcactcctaaatcattatttgtttaccaatataca

SEQ ID NO: 14474 - DNA, 1501 bp, Oryza sativa
tgctgacatgtgcatctcactatgatctttttaccttgtaataccacacatatggccacgtagaagccacgttagcacgggttgatctggtcaatatgttgcataggacaaaaccaatgtccaaaatagatggagctaaattgatccggtattaataggtgaagattgacgtatttcttttctggttttacggtcaaatattagactcgggttatactctatgagggtatcaaaatggacttcttgcaaaataggcattttttggtaggcaccaagccatagtatattgcccgaaacctcaggttcgcccggagttccagacgaataccatagttccctgtcccaaacgaagtcctttggttcttctacctcgagaaggctagttggcgaacagtcgcacgcgcctctccccacgcgactggacacgtgtcgcgcgcggagaggggtggcggacgtgccacgcggaggagaagggagagagagtttttccgtttttttttgttttttccgctttttccgtttctgttcggttggtttttccttttttttcttccggtttctgttatgtttttcccagtttttttaaggtgtatggatacaaaatttgtatttgtatgtatattaagtttgtatttgtatatatacaaagtttgtatacacgtatgtaaagtttgtatacgcgtatgcaaagtttgtatatacgtatgcaaagtttgtatatgttgtgtagtttttagttttattattttttaatacgtatgtatataaagtttatatttatcatatacaaagtttgtatatgtcctgtataaactttatatacatcgtatataaactttgtatatatgtatatattttttatgcattaaaaatatttatatatatacacatatacatacgtatatacatataatgtatagtagtagattagatataggctagaggagggggcgactgaccgcgcgcgcacccccgcgcggctgatcgcgtatcagccaccccccccctctaccttgcctcttttcatttttctcgtcactataaaaatgttgagcaaaaggtttgcatttcatggcaaatttgcaagctaaagtacagcccagtccacttgaaagagaaaaaaaaaaagaaaaagtacaccgaaggtccctcaacttgtcatcgggataaaaaacgtactcgaaccacaaaaccagatatgcaggtcccttaactatacaaaaccggtcacctgaggtcctttagtggttttgaccccggttttggtctacgtggcggctgagtcagcgtgggacccacgtgggtcccacatgtcagtgtccacgtcatctctctttcctctcttctctttcccttcctcccctttctgctctctctctcacaggccgggccgatgagtagggattagacggccgagcggcggcgctgtgacggcggccggcgatggccgcgcacaccacgcccacctcgccgctgccgccacgaggcccgaggcccccag

SEQ ID NO: 14475 - DNA, 1501 bp, Oryza sativa
aataatatttactcattgtaaaggggtgtatgttacacctgtacacctacccctccgttctaaaaaaaaaaaaaacctcaacctagaaaaaaatgtgacgcctcctagaataacgaatataaactatcctaagaggagtcacatgttaattttttttgacagaaaaagtacctaagaatatcctttgtttttattcttgaaaacaataatactaccgcataacgacagcctagctagcaactttcgttggcgtgaccgcgtgaccgagggccagtacgaataagcagtttgacggtagctattcgcgaccccaaaaaaaagatgaattatgaccgcacgattaattatatattaataactattatatatttaaaagataaatttgtttgattttttaaacaaaactttacatagaaattttttttacgaaacattttattagtttgagaaacgtgctaatgtaaaacgaaaaaaaatatcgagttgtttaaaagaactcgatttaagttttaagcggatgattatttgtttcctagacaaacagtcaaacacacatttcaaatttaaaaacgatcgcaccacttccctcttttatcttcaaaacttttcagcacttgcaaaatcgaatttacacatatccaaatatccaattatacacccacctcgttccaacctttgcgggcaaaaaacaatcgtaaaaaagatctggaaaatccgagcggcctccgcgactccgcctcgacataaaaaagccgacgcgtctcttccaccacccaccatccccatctcccaccttctctccttccccccaactcgcctcctccgccgccgccgccgccaccggcggcgacttcccatatctccggaggcctacccttcccaccgccgcatcctcgatctgcgtgctgccaccgcgacgaacccctgtagcggtcgcctcctactcggtagaaccctagatccccccgataccccgcgcccctctccgccgccgccgccgtcccggctgacggtatgaaagtgaccgacgatctccagtaagatcccggagattaggagtccagcttcgcgatggcgatccgcatcaccatgtcgtactccggctatgtggcgcagagcctggcctcgtcttttggcctgcgctgcaccgccgccgccgccgcctcctccggtgcggcgccgggggctggggctcgcttcctccaggacgcgctctcccgccccttctgcctcttcgcttcctcccgccactccgagtaccaccatgacgccgacgatcacaaccatccgaagcccaagcccaagcccaaggcaaaggctctccccgccgcctccgccatcgccgccaatggagggggccattcgctgctcctctcgcggtcgtgcgcaacgaaggctccggtgaatgacccgccatcatcgctggccatcgggttgctgatggtgttcacctccgggatgggctccgctactggccgcgtgggcgcctcatcgctctcgg

SEQ ID NO: 14476 - DNA, 1501 bp, Oryza sativa
ggcgcaggtgcaggcttagttcgtgacacaggcgtaacagcaggcgcagcagtgggcgctttagctacatcaactgggcgagccgatttgcgggatggcgccgcggaggtgatgaggtcactgcaagggagccacttggtcccctgcaggaatgggaggagcgccgcggggttgaacgctgacgatattgacggcgaccccgagagcgatgaggcgcccacgcggccagtagcggagcccatcccggaggtgaacaccatcagcaacccgatggccagcgatgatggcgggtcattcaccggagccttcgttgcgcacgaccgcgagaggagcagcgaatggccccctccattggcggcgatggcggaggcggcggggagagcctttgccttgggcttgggcttgggcttcggatggttgtgatcgtcggcgtcatggtggtactcggagtggcgggaggaagcgaagaggcagaaggggcgggagagcgcgtcctggaggaagcgagccccagcccccggcgccgcaccggaggaggcggcggcggcggcggtgcagcgcaggccaaaagacgaggccaggctctgcgccacatagccggagtacgacatggtgatgcggatcgccatcgcgaagctggactcctaatctccgggatcttactggagatcgtcggtcactttcataccgtcagccgggacggcggcggcggcggagaggggcgcggggtatcggggggatctagggttctaccgagtaggaggcgaccgctacaggggttcgtcgcggtggcagcacgcagatcgaggatgcggcggtgggaagggtaggcctccggagatatgggaagtcgccgccggtggcggcggcggcggcggaggaggcgagttggggggaaggagagaaggtgggagatggggatggtgggtggtggaagagacgcgtcggcttttttatgtcgaggcggagtcgcggaggccgctcggattttccagatcttttttacgattgttttttgcccgcaaaggttggaacgaggtgggtgtataattggatatttggatatgtgtaaattcgattttgcaagtgctgaaaagttttgaagataaaagagggaagtggtgcgatcgtttttaaatttgaaatgtgtgtttgactgtttgtctaggaaacaaataatcatccgcttaaaacttaaatcgagttcttttaaacaactcgatattttttttcgttttacattagcacgtttctcaaactaataaaatgtttcgtaaaaaaaatttctatgtaaagttttgtttaaaaaatcaaacaaatttatcttttaaatatataatagttattaatatataattaatcgtgcggtcataattcatcttttttttggggtcgcgaatagctaccgtcaaactgcttattcgtactggccctcggtcacgcggtcacgccaacgaaagttgctagctaggctgtcgttatgcggtagtattattgtttt

SEQ ID NO: 14477 - DNA, 1501 bp, Oryza sativa
tctctcgacggagaaaacgagaagagaaaagaaagaggagaaagagatgtagagaaagagcgagaataaagaaagagagcgaggaaacaaccaacggttacggacataatagcgcggaatccaaaatttaacatgggttggcccacattgactcccaggccatctgctcacaggccacacggtctcatccacacagggaaatgcacgaatcatggcgcaaatcctacggatagaaaaacgacaaatattgggggtgaaaatctgttgagaaagatctagcaaaatcgtatctttactgttcaaaacactgtttacctattgagtcatttcgttttcagatttgaaaaagaaaacttttagcccctgtttaaatctcaccttaaaattttttacactgtcacattaaactaatcgcatgaagtattaaatataagttaaaaaataactaatcgcattgcgactaatttgcgagacgaatattttaagcctaattactccatgttttgacaatgcgatgctacagtaaacatttgctgatgataaattaattaggcttaataaattcatcttacagtttacaaacggattatgtaatttattttgttattagactatatttaatacttcgaatatacgtccatatccccttaaaagatctgtcgcatgtcgacgtcgatctgtgcacgcgcgtcaggaacaaaaaccagaaacatttttgtcatctggagaacttggcacgtggacccgactagtagcggtcaccatgtcccgttttcgacgatgacgaccgatcaagcgtacaaatcacgcacgatactcgcacgcgtagcaatgacagcatcatatttccgattttttttctttttggtgaacttacaagttttatacaggtaggtggctcgtaaaagcaaaattgtgctccacatatcatatccattttgacataagcagctaggtcagcaagaacacgtcaagcacaaaacgagaacttgaagacaaaaataacgatcaagggcacgtttggaacgcaagatttgaacaatacgaaaaacacaggattagaatatcaaacatgcgcaaacccagctagagttcaaaacacaagaattttggggcattgcgtttgggtagtttataggaatataaccatagaaatttgatggaattaagagagagaaagagattaaaagacgcattggattcctcaaacgaaaaataaaatggagcttgaggtcacggtaaaattctcgatgcataggatagggaatttgacttgctaaaattctttgttccaaacatcgcatttaagaaaaaaaatcaagggttatcatccttaaaattcccttgaatttctttcgatccaaaggaaagggcccataaattttttgaggaattttcacattaatcatttcaatttcactagtaatgaaaaataaaaccctaagttcaccgtcagatatggaatttcaactatcacatattcacatgaacagtgtgaatg

SEQ ID NO: 14478 - DNA, 1501 bp, Oryza sativa
atatcccatctcggcaccaacatatcactgctgaggtagggtccatatgtaagatgtgttttatgggtctattgatattattttttaaaatgactacattattaaaaatctacctagttataacatgtgttggtgtgcttttcagttagaaaatgagtctttctatatattttattgaaaaaaatttaattacaaaaatttgacagaagcaaatataatacaattatagtgtaattatattataacttgcatgtaactacgatacaacttatatgtaatgttcctaaatctcgcagtaacatgctatttccacgaagcggacctctcgaagcggacctctcggaatagaatctcctcacatgtaagcatgtggtgattttttcttccttgctaatatgaattttaaaacaaatttaacagttcaaaattatattaaagcacactataataatattatatttatatgtgataaatttttaagagaaatgtgttgagatgtatataacaaaatcgttagaaagttttggtagtgtgacttctttattgctttttattaaaggactagctaaaggctcgtgtgttgcaccagaatttttagaagataaagccaaagccaaaaaaaattaataggttaatacaaaagtaagtgattaaggaaaaaaatgtaaggttaaaaccaaaaagcaggggaaggaccttaattgcaaataaagggcatcgatctgtccggtgcgaactcggcgagttttggccccacccggtcgcaacctccgagtcatggcatcgtggtcgcgcctgtattttctattatctggttttgatgcttcttaatccaaaaatacatattttatttattagtattttataataaactacgcatattttaaatgttatgtaaagggattatcgttgtatgatgctaaattaaattattgatcaaaacctgagccaacatgttaatactcattggttagatgcattcgtatagttccctagtgtttgctacatgcggatgaattaatttcttccttcgtgacaaaaggaagtacgaagtatgtcttagacgcagagatttcgcttggcatggctcctgtggtccggaccattgtggaccatacacctcgcatggcccattgtccatctgtagaggcccgaaaccgaaacgggacactaggacatagatgggccgaattcgtagacgaaagagctgggctaaaaattcttggaaaaagtacacgcaaggtccctcaatttgttacccacatacaaaatcgtcccccaaccacaaaaccggatatccggcgtcccccaacttataaaaccgatcacaatagttccttcagcgattttgaccatggttttatcccacatggcggctgactcagcgtgggacccacgtaggccccacatgtcatggagaccatgtcagcaccctctctctttctctgtttctctccttcctttcgctctctgctctcgcacaggcggcggcgcgcgcggc

SEQ ID NO: 14479 - DNA, 1501 bp, Oryza sativa
aaacttctagcggcttgattgtctaaatattgttcttcttttcatacttaatgctgtatcagttgagtttgacctattgagtcgtgcttagaatatcgatctctagtctgccttctagttgccgattagaatagcatcggagtttcagccgatcgtatctgatttaattatatttgttctatatgcttcaatgatatgttaaatcagccctttatattaagatattgctgtgtctaagaatgttaggcttttgctcgatatattatacttgctttaatatcttgatataaagtagtatcggagtattagctgatacatgctagatctatctgatcggctatgctacaaacatatataaccctgttattgatatatatttcgatctaagttatttatactgtcttggcatggtgaccgatctatcccaatcacttgatttaagtatacatcgatataaggagtatatatcgttaatatctacagccgatcgagtagatttagttcttctttacttattcatgactgccgatcgatacacagatgacatcggctcaaagataaatgatatgtcatcggcacctagccgatcggctatcatttatagatttaaccacggtttctttgcttctatttcttgttgattacaggataaaatcaactggcatgctaacaacatccgaaggcgagctttggagctgcactggagttaagcagatctcccaggccacgtgttttctgtcaacacgcttttggcacgtccagcgggtcctgtaagaagtcagacgtcagttctttctcatggccgagaaacagccaccaccactatctagcccaggttctgttaaaggcaaggcgttaaagcagggattgactgacatcattgatgacaacgtcatgctgatcgatccagagaaattcacgcctgagcagatggcagagtttgaagcaaccctgcagcaggcacgggatcagttcctaaactcatttatgcagacccgcaaggggacacttgttcagaagtataaaataaccaccactatctagcccaggttctgttaaaggcaaggcgttaaagcagggattgactgacatcattgatgtcaacgtcatgctgatcgatccagagaaattcacgcctgagcagacccgcaaggggacacttgttcagaagtataaaataaaagtggttgctgatagtcctgggaccgtgtaacgtcccgccttcccccaggccgggcccgcttacatctgatagctttcataggtcatagactgccctcacagaccaacacatgtcttttctgcacactttgtcctcactcgtgtgcacccggaaagaatttcccggtcggtcacccatcccaaattgctccaggccaagcacgcttaaccccggagttctttgaagattggcttccggaaaagaagttgcaacttgttgatatgagtattctattaattctattaagccctaggccacgatgttacaccctcaccccct

SEQ ID NO: 14480 - DNA, 1501 bp, Oryza sativa
acttacagcggttaccgccggtaaaatcaataccaatttaagaagcaaatacacaaaatcataaaaaaaacatggttgtttgtttcaaaaagcaaccaattgttccaaacgcatgaataggtactaaaacaattttgagtacttttgtttttgcaccacataaattttccggtgggctcaccgactcgtgtaaaaattatttttcacaatcaatggtgtcaagcatattcccatatgcctgaaaacacttttgagtggtttcgaatggtttcattttcgcaccacacaaactttccggcaggcccaccgactcaagtaaaaatttctcacagtttggatgtaaaccaaatctattactttggaggttttatcttcctgaaagatttcaatattctctttacataccttggacatgtcttgatggcttcatgttatttttagaactattcaccttaacaaccaccgtttgctaaggtgatgaacatcacactaacatctacccataatggcatccaatgcacaattctgcgacgcgtgagtcacatagaaatttttcacaatgaacgcatccaatccattggtatgaaatttatggtttggtgctttttgaaccattccgttccggtgataaacttcgcaaaaccataaacccagaatggcattcaatgcccaactttacgttgcgtgagtcaccaaaggtgagtattttgataactgagcagaagaatatgactatagagttcgaaaacccgtaaacacgtaatattgcttgaagttacacattgagcttttgttttttgcgggcttcctgacccatcaaaccttagcttcatccctaagggcggcttgcaaaatggcaccccctcgccgccctttcgcagcgccccccaaacccaaacaaaaaaaggggcattctagagggcggcaatgggtctgcctacaaaaaatcctaggccgccctcacagcccttctgtaggtggcccttagcgcgaaaaaaatgctctctgagaggactgaaagaaacctccgagaggatggcaaaggggctgcctgcaaaatattcatccctcggcgggcagtcgttaagggggttccaatggccgtctgctacgtaggataaaacttctttccggagagcgttttttaaaaaacgccttctccaagggcgtgaggcgactagtattgcaaaatattgaaacaaaaatcatttttcaatattttagtaaataaaataaaaaaatccaaatcgacagtagggagaattgactgataggttggaattttgtggatgcctacgaaatagcaaacacgataaacatgcatgcagagagcaagctagctaattcggaaaccacacggaaaatattgaacaatagtttgtcccaaaaaaaaaatacttcaagagatatcccgcctcttcaacttatatattatgtaccgtgataggaatgtggcatgcatggttatctcgcctcattctcagtcaacgatttcatcagc

SEQ ID NO: 14481 - DNA, 1501 bp, Oryza sativa
gttgtagtataggtaggggccacgagtgtactgtgggctacctagaggaactacccatgtgtgtgttgaaccttaggacgagtgtactgttcctaagtgtgtgatcgtaggatgataaattccctacgtgtgtgatttccatgaggggatgagtgtactgttccgcctcatggcatgggcgtctaagtctgtccaatacaacgatactgtgccacgttggtgggttcccgttgtgtccactaccacggcgttaagtttaaggcgtgggctcgccacttaatggttctcagtcatataacgtgtatggcctaggatggaggaacacgtatcgtgctcatgcaaggttagaaaatacttaatgtaaaagcctcgttgtgacctctagactagagatgaaaacggtcggaaatggtcggaaacggtacattattttattttttttttgaaaacgaacggaaacggtcgggaaatctccatatttatgaattcatctatttagtgccaacttcaatgccacattgacataaattaaaaaactaaattttgaaaacggtaacatcggtaaaaatattattattatattagttttgccgaaacggtattggtacggtcgggaacttttcataccgttttcacccttactctagaccgtactcaatgtgtagagtatagtggtaccgacgggtaccggacaaactagaccgattcacatcatgtgggtaaagctgtacaaactctgcagagttctaaaaactaatcgattagccgtgctcacggtcataagcgacatgatgatgtgttatgtgtataattttgtgctttctaaatgtttttaaaactaaatgatttgagatgatgataagattgatatatgtgatgtgattgccttacttcccgttatgttgtaagggaatgatgtctatctatgttgatatcatgccatgattaatatgctttacatattgcttaaatgatttgcttaaattgcgttacaaatggtttgccaactaaaattggctttatgctgaaaatagagaccacaaatagccttcctttgacttagagctttcatgtatgtaggttcgatagtgcccttgcaagtaatgtactgagtcttgccatgttttgtctaatttatgttttgcaggaataggcttagtttaagttgagtgatgcgggtttcgactgcttcttctaggatttgaacttaatggggtaaacccctagtcggtgtgcttgaggattgggtagtcaagcttccgctgttctctgatatagttatatttggctggtcggcctattgttggtatttcttaacgacatcactagaaatataatttccagcaatggcgcagaaatacttctggtatattatggttacagagttcatccgcaagcgcacggatataccattgtagcatttcacccgagagtattccaagggtatcgtatttattttatcctgtgggaagatcatgtagagagagcttgactaataatt

SEQ ID NO: 14482 - DNA, 1501 bp, Oryza sativa
gatttaatacacaaaatagtctggaaatttgggctaaatttctgggcgtgacagcacccccttgctgacgtcatcacgtgggctttattgcgcaataaaattaagtaaggcttttctctttatagtaaaaacacatataatcttctaaaaatcataactaattcatccgagctccgtttaagtccattcaagtctcagtaaattcataaaaatccctagaatccaattaaaatggtttctcttcctatttcagtagacttatagcatgttttgtttgtgtgctttgtttgtcgtgtagtttttggccgtttcgtcgctccgtggcgatttgaagtcattgcaaagatcccatcagcgcgagagcaaggaaagtcatgcttgtcaattgatcatattgcaaatgctctacatttcctttaaattctgcattgttttataatgccactgtatgggatatttacctactgttctcagccatattctttgtatgccattttcctttgttaaccggggatttaatatacttagatgttggtttaggaattgcttggccctgcttagttgaactagtacacaaagggggaatctcattaatactagacattggttattaacatagctttagattggtgctaccgcaatggtgttagttaattaaaatacactacacggtaggctgtgtgtcggcacccgggattgaattcccgaatacctggagcgtacagtgtactagtcccatgatcagtggctagcacacgcatccacaacattgttatcacatccatacaacatatttgacatataaatagataagtggtcctcataacttaacggtgcataggtcttacatagtagttaggccgaccggccaaataaaagagtttaaacgtagcagaaaagataaagtacataagttcttcagtatgcccatctaccaaaagacacaggcaaccgactaggaataaccctagaaagaaccatcctcgaaaactccggtacccggtgcaaagtaatcgtcactaggcacctcacatcctgcatccaagtctaaaaacaacaacaagaggtgggtcaatacactaggtattggcaagtcctacccaaaccttgggaaacataggactattgcaagctgagatcaaggatggctatatttgtggctattaatgaccaaatttggtaattcaagtatcggagatgaagataaaatcgaagcagaatccaagagatagatcgttctgaaaacagaataagaatcggctgcgatcagaatcagtagagttcgagtcggacaaggtagccgattgggccaattccgacaatgtgactcggtaaacgtcgtcgggttgagttaatgtgcttcatatggattgccacgcacggattgggtcctgaaaaggcaattgtatctattaagtaggatattttatgtaatttcattagagataagtttgggcaaaagtctgtcgcaaagacttatggtatcttagagtttgttaga

SEQ ID NO: 14483 - DNA, 1501 bp, Oryza sativa
tgagcctaattaattcatgattagcctatgtgatgttacagtaaacattctcaaattatggattaattaggtttaaaaaatttgtctcttaaattagctttaatttatgtaattagttttgtaagtagtttatatttaatactctaaattagtgtctaaatatagaggctaaagtcaagatccaaacaccacctaagattttctagtattgtccatatatatatatatatatatatatatatatatggggcaacatatcctatgcacacaggccctcacgtgtatacaggtgcacgccaactaaaaaatgtcaccaaaaaatttagaaaaaatcatacacatactttcaattgtattacacctagggttaaaatcttaacgtcaaattcattatattttagccgtaacaaaaaaaaatctgacagttttaaggttgcaattttgtcagaattttattttttttattctctatgtagaatgaatttgaagatgcgactttgcacgtagatgtaatattattgaaagtacatgtatgaatttttctagaattttttgtgataatttttagttggtgtacatggtgtgtacacgcgagggcctgtgtatgaatttttctagaattttttgtgatatatatattaatgaatgaaacagaggaagaggaagtactagttacgtatatctttgttgtagttcggatgatctgtacatatgaactggcctataataatgattcagtccaacggttcggtgtcagcttggccttaaaacattcggtttggttagatgtgatagaacttgcttatttaggctctgtttagttcacagcaaactttttctaaacttctaactttctatcacatcacattacatccaaaacttttctacacacataaactcagaggaagctactcatcggacgtccgatgccccaaaaaaatcggatggtcaaatgtcgcagttgaccaacaagtgaatcattaagttatatagggtgaaacaaaaaaatcagcaactgaaacatttaaatattttatgaaacatggtgaagatacacgttgtaacatgtcgttgtcacgtatgaaacaacaagtattaacggattgaaacatgtgtttttcttttaacaaaatataatcatgcgatatcttgttgtaaagatttcattaaaacgaatacaatggtgtgatcggatcatggattggataaataatttaagagaaaaatcattttgaagcttgctaaaatacatgtatgcatgtgtgtatagatgaggtggagagagagtagtagcaggtagttttaggaattttatgaaacacactaaagacgcacattgaaacatatcactatcacgtatgaaacattttattttaacagtttgaaacacatgtttttcttttgacataatataatcatatgatatcttgttgtaaagatttaattgcaacgaatacaacggtgtgatcggttcgtagatcggataagtaatttagaagaa

SEQ ID NO: 14484 - DNA, 762 bp, Oryza sativa
ctgttgcagtacacgacggcgacgccgaggaggaagtcggcgcacggcgccccggcgcggtggttggtgcagaagaagcccaaggcgaaggaggggccgaggcgcgccgggttgaggcgcagcagcgcggcgcgcgccacggagccgtcggtgtaggcgacgtggtggcgcagcgcggcgtcggtgttcgcccacgtcgtggacggcttcgccgtcgggtagtcgtacggctgcgcctgcgcgcggaggaggcagagcgcgaagcccacgccgagcagcgccgcgtgccgcatcgttggtagaaatgcaaggagtttgatggtggtggtgtgtggtgcgagttgtcgtggtggaggcgagtcggaacgtttttttatagctttggattgcgtgcaccgtggttggatgggcgttttccttgcatgggcatgcatggtgcacaccgcgcgcgccgctggttgaagactagtagaacaatctgataccaacgcggtgtcggtgtcaatgcctatctgggaatcaatccaccggagcaaacgcgtagcggtgcattgcgggccagctgcatgcatgtctcgtcccctctgtgtttgactctgctggcttaattcgtttcgcagtgctcaacagcgagcaggttatagcaattgtggcttgcgaccacaacgtttggtaacgttctcccaaagccactcgtttattttaacaccaaatgatatccagggatgcctcaggactataagctagctataaatatatttt

SEQ ID NO: 14485 - DNA, 1501 bp, Oryza sativa
gagagaatgtgagggaaaaaaatagaggatttcctaaaagaaaacagagaggaggatgtacgttttttttttaaggatgagaaaacataaatctgatttaatggcttgaagtgttatgtccactaattttaataaaaattaaagggtagatgtttatttttcaggatatatgatttagatgttacaaatgttgaaatttttcaatcgaatttccgccgttagctaatataggaaaaaagaattatacgtagaggggagggagagagaggggtgtacggggggagagggcaaatgcaacgactgaggggagaggtggggaaggtacgtggtctttctttccatctctctgtttgtatgagattaaatctgacggttaaaataataatgggcccatcaatttaagtgaaagtggatagttagatgttcttttctccggatttatagtatttttttttaaatttattagagtgccacgtggcggcttaggagcgtttgtagatgccacacgacggtttatggccttttaagataaatcggattggttatttttattatagatccaatggtaaaaaataatgggttcaccagattaaatgaatactaacggttagatttattttagaattctaaatttattagagcgccacgtggcggcattggagtgtttgtagagtgccacatggtggtatgagagcgtttctagaaagtctaatggacttttagtatataatagaagatagatagattaataattattatttattaatttgagttttatgtgatgcgagtcaaaaagaaaaaaaaaagaaaaggagggacgtggggcccaacgtactaaataatatatataatatatgaaaaaaataatatattattggcatgtacatatatttttgcatatatataggctggatttaatatctatgggctgaaataattaattcggtttttattcttatgatcgaaaaaagaaaaaaggagaaaagatgaacgtggggccgtgcatgacgtacgtacgtacgtacatgcacctatccacctatgggggttacgtgggcctttttaagataaatcggattggttatttttattatagatccaatggtaaaaaataatgggttcaccagatttattttagaattctaaatttattagagcgccacgtggcggcataggagtgtttgtagggtgctacatggcggtatgagagcgtttctagaaaatcgatagatagatagatagatagatagatagatagatagatagatagataatagatagatagatagatagatagattagaagtctcccactgtcatcacgtttccatccatctccgttaccgtcctcatcccgaccaccgcggtggacttcctagcgagggcggcgtcgatggcgaactgggtgagggtggcgtcgacggcgagctgggagaggaggccctgccggcgccaccttgctgctgaacgacgagaacacgacgaagagctcgacagggatg

SEQ ID NO: 14486 - DNA, 1501 bp, Oryza sativa
gtttttatcgttccttggtaagaactgagaacctaaatcatacaacataaaattcaaaattcaaaattataataattgaactaagtattttattgagattaacattttaattaatgttttcaaatttgtttattccagattgaacataaaataaataatccccataaaaagtaaaataaaaataaatctacaaacaaaatatgtgattgtttggaaaaaaaaatcaatagaacaagaatcatgcaacataaaattgaaaatacaaaattataataattgagctaagtattttgttgagattaacattttaattaatgttttcaaatttgtttattccagattgaacataaaataaataatccccttaaaaagtaacataaaaagaaatctacaaacaaaatatgtgattgtttggaaaaataaatcaaagggggataagtaagaaagaacctgaaaaggggcttccccagttcgaactggcaacctgagagcaggtgcagaacagcagaagggctgacaactgagctagcttctgcattatgtgtggtgtttgtatctcatgaagataaagattaagtgtttcacgcaaaacgaggtggtaataatatgtgattaattaagttttaattattataaacttaaaaaatggactaatctggtattttagaacaacttttatatacaaagtttttttttacgaaacgcatcgtttagcagtttgaaaagcgtaccacgataatataaaattttatcctccactagtagaagaaacgaacagcggcagcacacatatgcttttaaaccacacaaatatcagcgccaacacacatagcgctgagctcctcttttgtcgctaatccgtgccacgttggacgtaatattagcgccagccgctaattagggtggcgatgggacgtattatgtcagcgccattagggttgacgctgaggtcatggcctagttttaaaattagtttttgacacggtttattttgaaaataagttttatagaagggtccatttgtcaaaattacggtagtaaccttggtttcaaacacagcctaaattatgtcaggcagccaggcaggagccacacgcacttatgtcaccgagggagccacacgcacgtacgtcaccaggagagagtcgtgggacgatattcacacgtatcagggacgtacaatacgtatcggacaagtatcggtaattcttttatttgcttgaaaaccgagaaaatgtcggatacgtacggtatatgtacgtatctgtatccgtcgacgtatcggggattcggggtaacgtagctcgccagcgcccaacaccgccatcgtatgttgcgttgccgcggcgctggctgctagtggctacgctgccgtgtgcccgcgtccgccagccaccgtgtcgtacgtcgccgcgtgggactttgatactaatgtagtagtaccgttacttacggagttattgatacatgacatatatttgtccatatttgttgtattaga

SEQ ID NO: 14487 - DNA, 1501 bp, Oryza sativa
aggcttcactctcttcacttcaacacacacctcaagcaatatctaaactaccagatactactctaatatcatcgtcatgacgtagagtaattgcataagcaaacactatacccgcaccaaagcatctcccagataatctagccgtatattcagtataacaagaacataatgtaaagtaggtactcatatattcggagagtatttcaataccataaatgtatatagaagagtattctaataaaagtacaaatcttacaaaagagaagagataagctactagagccatacccgaactcttccgaaggcttcgaactttccatttttagctttaagtaatcgatgctgcgggaagtcgtcatatagaagaagaagaagaagaaggagaagaagaagaagaagtggtagcaccatctccggccatccctgtaagtttcaatcttcatcttctcaaatcatatcggctatcacatgactctaactgcccatattattttcagactttagccgatatgtttatggatgaagaagaagagaccacgagcacagctttggcacctttagccgatgatgtaaaagcaatcttgctagatatttcaaattggctagaaggttccttcactggtggagaaaccatctttcgtcggtcggccgaattccacaatagtcccggttgcaataaaaaccggggctaaaccctttttaaccgggactaaaaatcatctttagtcccggttcaaatgctgtcagggcctgtcaggcccccccgggatctttagtcccggttggtaacaccaaccaggactaaagatcgtaattttagtcccggttggtgttatgaaccgggactaaagatcccggggatctttatccccggttggtaacaccaaccgggactaaagtcccacccctatatatatgtcttcttcctcctccagctgcccgagcaagcttcaaaatttcttcaaaaaagaggggaggtcatgccaaaatttctagtgaatttattttggtgattatatacaaatcggaggtgcctaaaaggttagcaacttcatcctccaatgttttttttgtcatattacatttggtgctatgttttgcacacttttttgtctccaaaatttagttgtaagttgatgagagaaaaaatttgtatggggaagaaagaatatatagaaatttagtttatttgctaaagaaggttttataaaatagttgagaaggaaaatatagtgaaagttaatcttaaataatagaaaacaaactaaaatgaaaattaaaagaagtaaaacacattaatattagtttaaaactttagaaatagtaaataagaattatttggtgtaatattttataatttttgtatgaataatgatatgtcattattgtatgactgttgaaagagtttgtaattattttataattattgtatgactatcattattgtaagaataattatttgtgtatgattttttttatgtcatgtagatggattggtaat

SEQ ID NO: 14488 - DNA, 1501 bp, Oryza sativa
ggccattatctggtggggcccactcaaccacttcccctacttctcttttaatttttttttctttttccttttcattttcttttctactctttgctgcaagttgggaggagggcgtcttccccgttcttccggcggcggagacctcgccggcggcgagaaatggagcggcgatcgagcgttcgcttcgcgccatccgaggtgaggcctcgccgcgccccatccattcccccctctcgtcggcgcccctgtggtggggttccgcttggggtggtgctgcttctccggggttcttgttgggttggggtggggagagacgaacgggccggggcatctccgcgattgagctgggagaaatttctctggttcttcgggggatcggattcgccctgctgctgtttatgcctccccacgctccatttcgttcaagtggtgtggtttcttggtgggttttggtcggggttcttgtgggggccatgggaagttctctccccttgtgtatgatgaaattgattgggattttgatgctatggcgactttatttgctagtgcgcattcaggtgattacatgcaggcttgtgatgtactatagttattcagcatctgttgactaatcttgactacagtgtatatttgttccttttcttttttgcttactgaacaaaatgttcagtttagcattgggtgatcctggtagaagtttatactcttttcataaatatgaagagtcatgaggcactgatgtttttggctagaatgctgcatgtagtgatcaatgcatgcaacaataaaatactggcatattgcattattcatttaacccggtcatattgatcccaagaatagctaaatgtgagtcctaatcaaagtcacgaggttgagtcaaggaagtggctatcctcctattcagatattcttctgtggccactggtcagcattgctattttgccaactcttccttctttgttaaacttaatattcttgtaactgaagcagaataacttattcttttcagttctttgctcctgtaaatgggaaaaacacttcggttgagtttgttcttccactcttcaatatatcctaactactggagaaaaggatattcgatggtcctttgtgggcttttagtagtgcacaatgtgtacttattagattgctgtgttttgcatcctatggccaattttaagagttaaactctatagttcatcatttgtgtgttgcctatccatttcagaggaaggaagaagggaaagtaaatgctcctttgttagctttacgtagtttcatgattcaacatgaattctctagttgtaaatcaatctctatttagctatgcatgtaatgactagaaatgggaacacaaaggagatcctatccattttttttaaagttaggagatggggctcaaatgatcccaaccactgtacctaagtgaactactagtatagtacacagtctttccctctgcatgctgtattatcatggttaaatcagctatacaatt

SEQ ID NO: 14489 - DNA, 1137 bp, Oryza sativa
cgaatagcacgactttcgcaactatcgccacaagaacgacacgctatacgatgttgtaataaacaacattcctgcactgcgactttgtgttgccaagcaacttcactggtggcgagaaaaacgcccgcttgacaactttgcacacatttttcacaaaaggtacattcgcctttgctgaaatctacttcaggataaccacccgcacctcgtacaataatttgtgtttcacagattgttatacagttatcgcaagcggtacatttagttaaaaaattagctaaatttacccaaggcggacgcacggcattatgcccttgcaaagtcgcttgttttgtttttaaggtgcttaagaaatgcccacgtaaaaaactgcgacgtggtaaagattggtcagttaatttagccaaaacacaccttttacaaattaaactcgatatgatttattatctgatttttactggtctgccttcatcactccatttaggtatttaataaataaacggcgttattcttgataagaatcaaaaaacacgccgtttaattttatattagcaaagtaattaaaaatcattctcaatttaaacaatcgaaaataacatttcctaaccagatttaactcaataaattccatattttagaatattgctgttatatatcattttactttttcatagcatttattacatttagataatctttgctttcattattcttctcaacactttatttaacctgccatttcaagcattatggctacttacgttgtatgccaacagactcatcacatatttatcctaaaaaacagtaataaaattttatagattattaagaattacactcatcatataaagataataagattgaattaattctttattgcttatttttagtatattccattcatattttttcagcttattacaaaccttattttttctgttctatatctattcacgactcaatattcttgcaaagaatatttttataaatttagccttataaaataaaaataaaccgaaattagtatacaactatatggataacatattttattgcgggaaaatttgttttagaatcagtaaatattctctgatttctggtcgctagtatttatgaaaaacttcttcaaaaaagtcc

SEQ ID NO: 14490 - DNA, 1501 bp, Oryza sativa
ttaatcatgttttatcatctaacaacaatgaaaatactaattataaaaaaatttcatataagatggacagtcaaacgttggacacggaaatccagggtttgcctttttttttggacggatggagtacgtacgtacttgacgtacacgtacgtgccatgtgtggctttctgaagataataaatctaattgacatttttatgctatatctaacggttaaaaataatgggtccaccagattaaatgaaaaccaatgattagatgttttgctttttttataattcttctaatttattagagagccacgtggcggtataggagcgtttgtaggggtgtcacgtggcggtttcagagcgtttgcaggaagtttaatggatttttagtatataataatagatagattatactataactaaattataactttaatataaatactaaaaattaaaacataactttatacatatatttgttacaatataatttcccccaaaaaaaagttattataatttgctccgttttttacggaatgctagggttttggcggcgcctgggcgaccaggaggcggcagccatttttcttgtgtagagatggatctagatggagttctactccgatttgcagaaaaacgcttcagggatttcacccgtgggtgtgatccggttggaaaatcgagtttggaaggtctgttttggtcttctgcttgggttcgattcccagtacagccgccataccaataaatctttagcggataaggtaaggataccagatgagataatctactatggtatctataacaagcagggcaattgcttattgaccctggccgtgtttagttgttttggcaaaaaaaaaaatttaatacggatacacatttgaaacatttgaaatattaaacgtagactaaaaataaaacaaattacggatttcgcctgtaaacagcgagacgaatctattaatcataacaaacaaattacagatttcgcttgtaaacatcgagacaaatctattaagcctaattaatccgtcattagcaaatgtttaatgtagcaccacattatcaaatcatggcgtaattaggctcgaaagattcgtctcgcaatttacatgcaaagtgtgtaattggtttttttcgtccatatttaatgctccatgcatgtgtccaaacatttgatgtgacggaaaaattgaaagtttgaagtgaactaaacacagtccctgtttcgaagcctaactactaatttaactctactttttctagtttgcttatttgaccctgcttttcgaaaacgaacctaccatctgaccctattccgttaagatgagttaacggtgttaagttaggagcaaatagtcctttttgtccttacttatttggccctattttattatgtcagaacatgtatatattcagatctgttgacaaatttgtaattaatttgacatatgtttcacattcaatacaagtttgacggatttgaattcaatttgacaaatttgaat

SEQ ID NO: 14491 - DNA, 1501 bp, Oryza sativa
aattgggtacaatatgatcaattgtaatgcatgactttccttgctccggtgctgctcgaacctctgcaaccacttcgtaatagacgtgagtgtcggaactgccagattctatgtgacaaagaaagcacacaagcaaaacaggctatataagtccactgaaacaggaaatgaaaccatttctaatggattctaatcatttttatgaattcactaagacttgagtggacttaaacggagctcaaataaattagatatgaattctagaagattcattgtgtttttactataaacaaaagtccttaatcaattattttgcattaaaggccgacgctgacgtcagcgaggggaagggggtgccgacacacggtccccatccgtcggtgacatagcaccaggtccactgtggaccgggaccaccgtggtggtccaccaccggtccacgggtactggagcgcagctcgggacaagccggcccgatgacggcgagcggcggcacggcaaggagagggaggaggaaaagaggagggcctcaccgacgacgacggcgaccagcacggggaggacgacaacgatggcggcaaggggtgtacaggctccagaacgacctagggaagaagatcagaggggtttgagaggccacggcggcaaccattgccgaccggaggcggtggatatggagggctcaccggcgaactgagggaaggcgtgttatggctgcggacaatgacggacgaacggcggctgaggtagccctcgaccttgcgaacccggtggaggtgacggcgtggcttagcgcagcggctagtggcgaccagaggcggcgaaaaggcggcgtgggcgcgagttatgggacgggagcgagcgacggatgagggaaaaggaggtgagcatgagggtcgtttatatagtggcagggagctcggatgtggcaagtaggggggcgtattttgcagcggacatgggagtggagagggagagagagacatcggccagatttgaaaatctaatcccaccgattttgaggggagcgacatgcggcgggagtagttgacactaccgacggtcattaattttcatgacgtgtatgaaaccacctgactgtgcaatccacatcaggaaaactattcctgacgtgagcgcacgtcaggaatagttttcctcacgtcaggaatagttttcctgacggacaaacgtcaggcaaattattttttccccaccaagctagttctgacggtattttcctgacgttgacacgtcaggaccgattttcctgacggtttttcatttattcgtgatgggttttagccgtcagaggtaataatgtttctggtagtgggaggtagttgcggggagtggagcgcgtcggctgcacggaaagggtggagtggggcgcaggagatgtgcaggacatgcgagcgacgtttgcaccctccggctccgccggccggaggtaagggaagggtccgacaagcgacctgaggagagaagtagaggaaaaaaa

SEQ ID NO: 14492 - DNA, 1501 bp, Oryza sativa
cggagtttctcttcaaccgtacagtattccccctcgcgcgcacagtacacatgcacagtacggcaactccaaaaccgtttgataaaaatttctccaaatcacaaaaatggaaacccgatgagagacgattcaatttttcaaggtcccggcaacaaccaacaagatgcaaaactggacccaaaattgacgtacaactcacacgtgataaaccctagacacaaagtgatgaacagatgcaatactcaaaactaaaaattaaatctaaaactaaactagcactcgacacgacgatgcaatctagaattcaacaaagcaaaatctaatagaacaatgcaacggctcaaattgtctaggtaaagagtaaatattttttgtgtggcaattttctggttatgggaagataaattacctaatgggcaaccgcgctctgataccacttgatgcactagggttcccgatcttccgaaaggttctgataaacaacgatttgggcggagtcgcgacacaaatcgatctggcttcttgaacgcgctcgctcttaagccctgcaatcgcagcaccacgtctcctctggttatctcccgtgccgaaacgcggatgacctcgccgagaaggctaatccctatttgccaatcgaagaacacaaacaagaacgagatagaaaacaaccaaaattgcagatgaatgattaaacttacgagttggggtcttacaaaccgatctagcggcgtaactgttctcgacagattaatctaagcaaaacccaactctaaacgatgacggctacggattaagtacgattaggacatcctagggttgccctagggcgcacacccccttagctaagcccacgacacaattacaaggcccaaaatccgagtcagattcggactggatgagatacgtggcttgttttgcagattcccggcagctcggtaggaattttgacgtgggaccaaaaccatatgaaaatagactccataagctttccgacaagtactcatgggccccgaaattccttctagatcagcggctaggtccgtttgaagttgatgctgttaggaggcccgaatccgaatccaaaacgtgtacaacttgatctcttgtcttctatggaccaaaagtgacgtggtgaggtagaagtagacttggagaaggtcttggtttggtccccaatcaacttctttaatcatctatgcattagttacgttcggtctcttttctttcgcccaagcaagtacctctgcaaacgaaaacacacaaaactcattatgtagcaacgtttgtccaaatatataacaagtaaatctaatgtagaacatatgcacatttatttgattaatacataaggtagtcatggttatatccgagccctcatcaggcccatgcatgtatgcaaggcccagctgaatgccaggccctcgtatgagcgcaacatagcgttcttttttttcttttctcgatctctcccgttgcaagtatgttcgcctgttattttgcg

SEQ ID NO: 14493 - DNA, 1501 bp, Oryza sativa
  unsure (1)..(1501): unsure at all n locations
ggggtgagagccgccgccgccagaactcccttcatgcatctcgatctctccgatctcgatctctctccgtcgcgccgcccgccacgagacgccgcgccacgacgacgacgcgccacgccgccgccttcgacgccgcgcaacgccgccgcctgatgccaacgccacgccgccgccgacgtcgccacgccggcgccgtcttcaccgccgcgcgcgcaatgtcgacgccgacacgccacgccgtcgccggcacgccacgccacgccaccgccgtcacgccacgccggcggcgtcacggncccacaacgccacgccgacagcgtcgtngacacgccggcgtgccaacccgccgcccgatgccggcacaccgctgttaacgaacgagaacgagaacgatcgaacgaacgagagcgagaacgaacacgtcaacgtacgttgccgcgacattttgttactagaacgagaacgatcgaacgaacgagagcgagaacgagaacgatcgaacgaagacaagcgagaacgagggaacgaacgtgaatgagaacgagcgaacgaacgtgaacgagctagggaacgtgaacgagcgaacgaacgaggacgaacgttaacgtgaaatgcaatatatatatatgtatatatatatatatatatgtatatatatatgtatatatatgtatatatatgtatatatgttacttcgcatttatcctaatacatttttttgtatcttgcagaaaagacgtgttgtcggagtcgtccgtcaagcctgagtggaagagctagccctataaggaattggagcaggcaagtgacgtaataatataaatgattgttatatttgtaatgcaattaattaagattattagacctgtaattagacttatcatataaggttgtgtagtgttctaatattatttgagttttaatataagattattttattgcaaattagacttagtatgacattattgactacggaattggtgcgactcctagcaattgactattgtagtcttaattagacttagcatatacgcacgaaacacttagcatacattactattttagtcttagcatgtaatattatttgagttttaatataatattactttatttgtaattagacttggtatgtaattattgactacggaattggtgcgacaagtagcacttagattgttaaaacataaatgtctcgtgacttagcatatacgcacgaaacacttagcatgtacatgactattttagtcttagcatgtaatattatttgagttttaatataagattattttatttgtaattagatttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacaga

SEQ ID NO: 14494 - DNA, 794 bp, Oryza sativa
agtgttttcctcgttttccgtcggtggccgatgcctgaagaattcaagagcgaataactgaatatacctcctcaagactcaaagttaagaccctgtttagttcccagaaacttttcgtaaaaacaacacatcgaatttttggacacatgtatagagcattaaatatagataaaaagaaaaactaattgtatagtttgcatggaaatcgcgagacgaatcttttgagcctaattaatccatgattagctataagtgctacagtaacccacatgtgctaataacgatcgacttaattaggctcaaaagattcgtcttgcggttttcaggcgagttatgaaattagttttttcattcgtggccgaaaaccccttccgacattcggtcaaacgtccgatgtgacacctaaaaaattttcatttcaccaactaaacaggccctaagatcatatggtagactagtcttatgatatgtatctgaagttctgaacttctccatcgaaaaaatcgaacaagtttccgagcttcttcttgacagagttctgatttctgaaactctgaagtctgaacgcttatatgaaatgatccaccggtgatgttcctttcagacttgatagttggaagctagctggttgcaaacctgtgtcacacgtagtctgaaactggatgaaaggcaatcacatactcacatactcacacgtagtctgaacttctgatcgattatgcaaaatgaaggtaactggggaagttcatgacagtctgaactctgaaccaaagcaaagtaaatcatgtggaaga

SEQ ID NO: 14495 - DNA, 1501 bp, Oryza sativa
tcgggtggaaaccgctcccctaatctcgccggcgccattgatggcggccgacctcccgcgctggtttcctcccttccccggccaccctctatcgccccggcactatttaaacccctcccggacctcctccgttcggtttcgcctctcgccgaccttcctccttgccggatttcagctcgcgacgtcgctctctctctctccgccgtcgccgccgagctccggtccaccgccatcgtcaccccggaccgcctcccgcctcggcgtcgcctccttcggcttcgccgcgtcctcgccgacctcgtccacccttccgtttcgcccgccgaccgccggaacgccgccgtcctcgtcaacccgagccgcgccgccgccttcctccgctccggtcgccgttcccgtcgtcgccgtcgacccggggtgagccgtggaccgcccatttcgtttcccccttccctcccctctctcgggcgccgctccgccgcgccggtggtcgccggcggcgaccatcggggcgcgggcgcgccgcctcccgtcggctgtgccggcgaggccgccttcgggcgcgccccgcggctgccatgtggggcccggccgtcagccgcccgcgccctcgggtgcggctgacgcgtgggacccacggcgccggccggcgtaagccgcgtgcacccggtccatcgtggaccgagaggctgccgcgtgggccccactcccgtggacccggtccgcgcgcccctcccctcggctgacgcaataaatccgattttaaattaaaatttaaataaagaaattcgtaaatatccatttaaagagcatataaacttcaaatggccataacttggccatttgaactcggaattggaccgttcaagtctctaatttttccttaagaagccaagaacccatttttgtgctttgtttctgcttgttatatggagtttagtagagtaaaagccttttcttttccgttggtcgtgtagacgctgcagcttcggaagatccgctcttcgtggaagttgaagccgacgtttgggaaagcgagcaaggcaagtcacatcatccttgagcatattgaatcccagtttataaaattattttgatttaaattaatgcattatcgctttatttaaattcctgcgttatcactgttttatttagccatgcctatttacctttgttatgaccttattattattgctattgttattattaccttgttcaccctagaataaacaaaaccccaactagtggacactctattcatggttccactagtatgaatttaggtagatgcttcgctgtttaattaggcaacattaggtggttttataactttagacttggggaattctcatatcacttggatactatggaatggttggcttattgtggaattggacatacccctctcttcctctttcaaagcccctaaaacctgtttttcggtggggtttgggtgcatgctagttgtgggaagtagcaccccggccactataaggattaa

SEQ ID NO: 14496 - DNA, 1501 bp, Oryza sativa
agtattattttttgttgtaaacattatcctgttatggtcatacgaaaaatgttgttatcatctcaaccatgatctatggtagcgcatcatttattaatctctgctcttacatagatttcgagtatcgtaataaacttgtcaaaattacatgtaaacttacaaaaagaaacttgaaaaagagagaatctaccaagttccgagcagatagtactagtagtacttgcatagagcaggtacaatagcaagctataaaccaactataaccacatatcgagaagaaaagagaagagtgagaaaaaagcgagctacagatttgtagccggctgtaacacagactctaagacgttatgtgtatattagaggtaggacagagtattaatggagtagtaatcataaaggaagtcgttttggacagcaacacggtcttcaaaacacaactttgacctattgtttctattcctttatggataatgtttaagtcaaaccttgggaatataaatcataaataactctcaagttattgagtttgaaaatgtaaaaattatatgaatagatttgtcttgaaaaatactttcataaaagtatacatatatcacttttcaataaatatttttatagaaacaataggtcaaagttgtgttttaaagaccatgtcgctgtccaaaatgacttcctttatgagtaccgagggagtaactattatatccaactaggtgaaacccgcgcattgctgcgggaattcagtatgataacaataaaaaaaataacatgtaaaatagctagataacatcagattaaataaattaatgtagtttatgataatttaaatttatatagtatgtagaatggtgattcaaatgtaaaaagtaagctagtagtagggagatagtttggaccgtagattaattatctaaaggctaaaaataattgatgtgatatgacttaattagagaaaaaaaaggagaaaaataatttggaccatagattaattatttaagcacaaactaaggatgaactatataagtatataggatatcataaaacataataaagatatacattgaaacattatgtgaattatattggatgataatttaatatgtttgtatttaaaaaactcttaaattataaaaactataaagatatagtatgtttgcatgatgtttaaatatgatgattgttagtggatgatgatgtgtcatcttgttaattagtggataatgatatggtatcttgttagtagatgatgatgtggcatctttgcatgtcaagcttaagaagttagtgggggataactttatagaaagataggatgactagagtattagattagatataaatgatttagaaccaacaattggttatattattggacttgctcttaacgtccacataagccatgatgggatctaaaccaaagccattaaaaccaacacacctccgcactagtttttcacgggagaaagctaccaggggccccacctgtcaaccaccgaaaccc

SEQ ID NO: 14497 - DNA, 1501 bp, Oryza sativa
aaccgacacctataatatattatatgtgccggttcttttaaaaaactggcacctatagtatatgtgccggttctaacatggttaaaggtgccggttctatattttttcattgctcggaggtgggaaatgctctatagatgctggttttaaatgaaccggcacctatgagctagtccctatgagggttttttagtagtggttgcgagctgcatttacaatattagggggaaaaacacaactaatgcacaaataaagggacaattttgtaacagtaagtaaagacatatataccttttcacttcacaccgtcaacatatccctccaaaataaagataaaatttggctccgtttaaaagaactggggaaaaaatctttaaaaaaaacaggggcacatatccaagtaggggtaaaaataaaattaccgccactaccggagaaatgatctttgttgggtcactcaaaaatcacattagtcctggtttgaaaacacaccggtatttttttatctttagtcccggttagtaacaccaactgaaactaaatattaattttactctcgattcaaaaacatgtcaaagccctattttttagtcccggttggtgttatcaaccgggactaaaaatagatctttaatcccgattgtttataccatccgggagcaaattaagttaaaaaaaaaatagtgcaccaccgagccatgcgcgcctcatcatatttagtcccggttgtttataccaaccaggagcaaagttaaaaaaaaaccgagcaccacctagccgcatgcgcctcgtcctccccgcctcatccttatcccctccactccaactcttcttccagtctcatcctctcatctcccctccattttctctaactccttcatctcctccagccctccccctctcctccccttcctcccccttaccctctcctccccctcccccctccctcctctgacgtcgacgacggtgacagcgggcgccccgcagcgcacgaagcggcagcggcgcacggccggcggcctaccctccgccatatccggtgggagggaggccgggcagcggcggcctagcggaggcggccgggtggcggcggtcgaggggcggaggccgggaggcggcacacggccgggtggccggcggtggcgtgttttctgatttttttttgaatgatttgtaatttttgttgtagtttattttagatttgaggatgatttgttgtgcatgatttctgaatgacttgtggattgtggatgatttcgtggatgggctgagaattgtgcatgatttggggatgacttgttgtgcatgatttgggggtgatttgtgtgatttggggatgatttgtggggatttgagggtgataataaatgcaagaataaaaacaaaaaaaggaaaccggactaaaatggcgctagaatctttagtcccggggactaaagatccatttttactctgggttatttcatccgggactaaagatgggtatctttagtcccgaatt

SEQ ID NO: 14498 - DNA, 1501 bp, Oryza sativa
ttttttttttgctaattcggttcttgcaggtgattacaagtacaccaagtgaggatacttcccccgttgctcgttgatttgtaattcagtaagcacgatgatcgcgaggaatgctgcggcggcggctgcggcggtgttttttcttttttgtttacttgctttcccttccgcccccaactcgaacacgttgggggctccggcagcagattggggctggatctgtgctggacggcggcggccgctcgttggcaacggcgagcggctcgggctgcacgcttcctcgtcgacggcgggctgcggccccgttcgcagtggggcgatggccttgttctgctgctgccattgccggcccttgctctcggccccctcccagttcttcctccccttgctcgtaggccctctttgtttaggcttaggcttattggctgacttttaagtcagcttattggtttatatgatttttaagtcggtggatttaatgtcctaagtttagtggtggagtcatacatctatctcacataagctaaaaaaaacttctccaacctagcttttggcttgagtgacttatggcttcaaaaaagccaattgaaaaagctgcttatttgtttaggcttaaacttttcggcttataagttggcttataagcctaaacaaagagggcctctatagctcgtgcctgaggtgcttggacgccatagggttgatgcggcggtggcaatgccaggcattcatggggacggtagtgtgtgggtgggaggaaacagatcccctgactttgtgaaatctgcagttgtgccactgacatgtgggccccactttttcgcgatggctcacatgtcagttccacaactgtaaaatgcaaaccgcacaaagtcaggggagtctctcgttcgcgtgcgggatggggtgttggtctcttaagagttgagaatgagatggtgtagtgttgatttcatgcggctgcgttgatgttccgtgtcgaggagtatggcaagacttccttcgtcatggtgttgtttttattttcttgtaacccgtttggatttttactctgcttgttgaaatataattggcagcttttctgcctgtttagttttttgaaaaaatgtttgttgggtgagtggatagggacaatgctgaggatatgagcatcgtggagaggtttcttgaagaggtggaactggagcagggccagagggaggaaattgtggcgatcattaaggggatgggtgagttcttcatgtttatgaatctgtggatgaaactatttggcaaacagcagctggcttgagcttacttaattgttcatcgaacttcaaagccatataaatcttatagtttataaaatccgttttttttcctgtagtacaatcccattatgataatgttgtatcatatgaaggccataagtagttcttagtgtatccctagttatgcaatgcatacgttataacatctcaaatcttatgtgcaggattcaaaaatgaagtttcaaagaagt

SEQ ID NO: 14499 - DNA, 1501 bp, Oryza sativa; identical to SEQ ID NO: 13378

SEQ ID NO: 14500 - DNA, 1501 bp, Oryza sativa; identical to SEQ ID NO: 13997

SEQ ID NO: 14501 - DNA, 1501 bp, Oryza sativa
aattctattattccttttagaaaatgaattttatttcgggatgaatttatcaggacgtgacagagtccatgccttgttttaaagggggtgattatgatccaggaaaggtgcactgtaatgggttatgttgtgcgaggggtattgtcacgactcctttccgaggtaccgtggtggtattgaggcacatggtgacatgatgtggggttgtgtcttgtgggtacagtggtacacctctgatcagagtttaaactattcgaatagccgtacccgcggttatgggtgagttgagcaatgtttttcgtgattagtttcacactattcatcaatgttaataatgtggtaattaatttgactcctggtttggaatggctaattcctggtttggaggtttaatttgttcaactggggttggttgttcaaatgtggttgggcctatgcaacacgggtgtgttgtatggtgtttatttaatattgattaattatacaactgttttactattctctcaaatatttattaaatgttgtttctgcaaatgagctatattttgccatcctttgttatcctgtgcacttgcatatttgctgtgtggcttgttgagtatgttatatgctcattcttgcaatattcattcatcagaagaggagtacttcagtgaaggtgatgatctggagaattaggcttgttcttggttaagttgcctgtggagtggagtcgccatagctgttccgtagtttgttatagttttgttttccgctgcgtagaatgttatttgttttgagaggaactatctacctctgtaataattttaatttgcgaatattcaatagttaattatttgtactctattatcaatattgtcattgtgtgcctcggttgattcctggacgagggttaacacacatgtaagcgtttggaattttggatagaaattccgggcgtgacaagttggtatcagagccaccttgaccttaggataagccaaatggtaaaccttaagtagccttcaaaatattttgaaaaaaaaatagaactgctcttctctattctcttataaattaattaagttggcagcacatgcaaggttatgcacaaaaaatttatttaattcaaattcttttcttttaaaagcaaaaagttgttcttctcaaaatgtttccttttctctttaccaaatcttattgattagtcggcactgtacatttattatggtatcgatttaatcatgtttgcactagtactactcatcatttttaatggtgacattgtaccgtgcttataatagatcataagtattttagttttattttagttatttgtcaaaaaaaaaattatttgtctctgtccaaagagaagttaaattctacaaaatatttataaaatagctttgtatgtgtcttttcttttattttcttcctttttggtcaacaatcagttaagtctagatggtgcagctaacttagaaatatatgaattaattcttctcttccatgtctctttaga

SEQ ID NO: 14502 - DNA, 1501 bp, Oryza sativa
gtaatttctttttctatgagcaattttggcagtacgaatgtaagagacatggtcctaattcttgtttgtctggagaatgggaattggttgaaaaaaagaagctacaaatgtttaacaattgctttgcttaagctgttaatcatccttctgattgcaggtcacgccgcgcttatacttctagtttgatgaacatttgatctattaacttcttgttgattttcggtgacaacttggaatgcatgtgtgatgttagtttgaatgcatgtgactattctattcttttagagggcatgggaggctagccaatctttagaaacttttttctacatgttgctcatcaccgacggttgatattgcaaaagccgtcacttgtgatgtcacctgtgacggctctgcacatacatgccgtcacaagaaagtcacctgtgacggtttttactctccgacccgtcacaaatgagttacctatgacgggttgtaacatgccatgggttagcggagacacttacctttaacgggccatagagttcttgtccgtcagaggtgactgttaccagtgacggtcctccgtcaaaggtgactggtcctcactagtgaccactaatctgttaccaagcccaaacctgtcaatggtgagggtttggagccatcagaggtaacctaatccggtgtagtgttggtttggagccatcagaggtaacctaatccggtgtagtgttttaagttgtcaatcatactatcgatattatttatcgagaacaaattactatattgcaatttgcaaactgcttgatttattatttaccatgttagaaatgtttatttatatcactatagtataggtgctttatagagtatatattataagttaaaagaaatagccttaattcttaagggcctatagtgtgaagttcgcctagagccctcgaaaatgttgagccagccctggcctctcctctcttctccccaccactcgagcaatcttgttgatcagattccttattactattgatggattcaccggattgtgcatatttgcatcgtgggaagtgcgatctcaagcatgcacatgtttctttagattgttctttcacttgatcagcatcggctatcactgctacccatgatggtgatagctatacatgcagccatgtaggacgaccaagggtgacggtggtaatatatatggcatttgcgtggtcaccatcctagggcgtactcgttacgccattcatgcataatagggccttgatcggatctaacatgccccacacacaataagaataagactgcccggctcatctggtcatgccgcagcactacaagaaaggaatgcccctagcggccatgcgatttttttggcggtctgaaatcagccgccaagattacactttaatttggcggttcaaacttgccaccaagcataaagaaattttattggcggctattccatagcagacaaagaaatatgtattttgcttggcggttacaagcaaaactg

SEQ ID NO: 14503 - DNA, 1501 bp, Oryza sativa
tctcgcgttcaaacgggtggatttgcccccgcaaatctcgccggcgccattgatggcggccggacctcccgcgcctattccttccccgccggccgctctctcccccttccaaccctatttaaacactccctgcacctcctccgtccgtttccgcctctcgccgcccttccacctcgccggaatcgagctcgcgccgtcgctctctctctccgccattgccgccgagctccggtccgccgccgtcgtcgccccagaccacctcccacctcggcgctgcctccttcggcttcgccgcatcctcgccgacctcgtccacccctccgtttcgctcgtcgaccaccggagcgccgccgtccccgttgacccgagccgcgccgccgccttcctccgctccggttgccttttcgtcgtcgccgtcgacctagggtgagccttggaccaccgcctcgtttccccctttccctcccctctctcggctgccgctccgatgtgcccatggccgccgccggccaccataggggcgcgggcgcgccgcctcccgccggccgcgccgacgtggccgccttcgggcgcaccgagcggctgccgcgtggggcccggccgtcagccgcccgcgccctcgggtgcggctgacgcgtgggacccacggcgccggccggtgtgagcccgagtgcacccggtccaccgtggaccgtgagactgccgcgtgggccccactcccgtggacccggtccacgcgccccctcccctcggctaacgcaataaacccttttaaaattaaaatttaactgaagaaattcgcaaatattcatttaaagagcatataaacttcaaatggccataacttggccatttgaattcggaattggaccgttcaagtctctaatttttccttaagaagtcaagaacccatttttgtgctttgttcctgcttgttatatggagtttattagagtaaaagacttttcttttccgttggtcgtctagacgctgcagcttcggaagatccgctcttcgtggaagttgaagccgacgtttgggaaagcgagcaaggcaagtcacatcatccttgaacatattgaatcccagtttataaaattatgttgattaaaattattgcattatcgctttatttaaattcccgcgttattactgttttatctagccatgcctatttacctttgttatgaccttattattgttattgttattatttccttattcaccctagaataaacaaaaccccaactagtggacactctactcatagtaccactagtatgattttaggtagatgcttcgctggttaattaggcaacattaggtggttttacaactctagactttgggatattcatatcacctggacactatggaatggttggattattgtggaattggattcacacctccccctctattcaaaatcctcaaaatggttttaggctgggctcggggtgcatggttttgatattagcacctcggccatataaggaccggt

SEQ ID NO: 14504 - DNA, 1501 bp, Oryza sativa
attcgtctcgctatttaccgtataattagttttcgtttttatctatatttaatgcttcatgcatgtgtccaaagatttaatatgacgtttttggaaaaaaaaatttggaaaataaaacaggcctcagtacggctctacctattgaaagcatatttctccggctatgaagtgtagctaggtttatctgctttaacagtagtttctttgtaaactccgtaatctgttatgaacctttcttttccattaacggaagagggagaagaatagtttcaatgttataaaaaaatccagcgtgaacaagaagcgtcttgtgcccatagtagaaaaaaccggaccgaacaggcagttcaaccggagaaaaccgaaaatagaggttggcatagttcggtcgaatagaaagacaggacatgcaattgaatcgattcagaccactttaaccggcaggttttatgatgaactgggcaataaaccgccttcagtcggaccagactaaggcaagtcattgaatgaatgggcgacaggacagcctagttagttcttaggctcgttttttgggccgcacttgttttttttttagcaaaaatcaaatgaaaaggtgcgttggtggggagtcaacccgtggtcaagggttgcaaggcaactgccgactgccgtagccatcctaccagccagatgtttgtattgtaaaatcaaaggtgtttttgattattattgtgtgatgaacaattgggcattggaaattattggttttgttatttggaatttattcacgaagtggttttggagatgattggattcataggtgatcgcaggattttattattttatgtgaccggtcagaccgggctgtgtatgccggtcagaccggcggtgaccaagcggtcaggccggtcagactgtgtcgttttcggtttcgggttatttgtttggatatccgtgattatttcatgattatggcttctagatggatactatacgtatgtaatactgttatttgctactaatgagtcaagttggagatagcttggtctcggaatatggtttctttgtttatttcatgtgtaggtgactcgatgcctcgggagagtatttgcggtgatggaccgggagtcggcttggggataagacgacgtccgtggtggtcagagatcatgcgggatacttaggctagagttgatgagcgtggttgatggagattccatatggcatacgatggaggtattgtgtgcgtatgggatgcggagtcgaatttggaaggagtccgaatttgatatgattggttatgtaaagtttgtttcttgtactagagggttttctaaggtgtttaggactcctagtatgagtttggttcgtggctttaggctctctacctcgagtataaatagagggggagcgtgaggcttcccggtatcgctttagagagcaattgaattgagttttgagttagggtttcgagtttagtcaaaatttttgtaaggagtgctgttggtgcactttgtaa

SEQ ID NO: 14505 - DNA, 1501 bp, Oryza sativa
aaaacatcactaagaaaaaaaagtttgatggtttagcaaggcaacacgtagaaaatgatgcacctttgtggatggtggatggtgaagtcggaggagatgaagggatggcagaagcctgattgagtgaagcatgttgggcctgacattttcccataatttctctcaagataaaatgtgtccaacccacttattctaaaatagtatgatggtggctagggtttgaaggaaaagagggtataaacctagattagcggcataacacgtacgattgatattcatccaatggttacaaattgagtagccaattacaaaacatgccagttaaaaccaagatccctctttaaatattagcgacaagtagcgctgctcatacagtcacatgcattgcatgtggaagtgcaaatccatgcacataggaacaagcacctacgagggtttagatcttgtctccactggccgatcaaccatagtggtaatggcaactgactgatccctgccccctcctccgacttcatctatcacgtcagtgactgtctcttagcttccgaagacttcgacaactacgacactttgcgcctcatctgctccaagtggtgtctggcaccaccaaccctaagacgacggacttcgacgatgcagcttcctcaagaagctggccattctcgagctcaacggcaatagatacggggacgcctccattgccacattcttcaaacttgacaccggcagcttcgtacgcaaatgtgtcctagtgctacgtgactacctcttcatcgccaacatggccattggccttgtcatgatcttggagatgacgccaccccataagaccagcatgctcaacccctttcatgcgtaaggtcgcccattctagggagctcatccatgcggaggaggtcagggaggtggccacgacgaactcaccattgatggtgttcacctcctggttccatggaaggtgcgtgaggtgggatgatcaggagagcgagggcttccataaggtaatggcctactttcccggcaactttgtgaatctggcacctatcttcgatgaggtgcatctcaccaaccatggatccatcctctccattatcctcatttgtgtcgaggaagaatgcgaccaggctgttcaatagccctgctatgtggacatcatcatgatggctacaaccattccaactctaccgttgatggcagaaaaaagctcattaagaaaagaaaagtatgatggcttagcatggcaacatgctgaaattgatgcacctttgtggatggagtatggtgaggtcagagaaggtgaagggatggcagaagctaggctttaatttggaggcaatgactgagtgaaggatgttgggcctaacatttttccataatatctctcaagataaaatgtgtctaacccatttattctaaaatggtatgatgatggctagggtttgaaggaaaatatggtataaacctatattagtgaaagaggacgtatggttgatcttcatct

SEQ ID NO: 14506 - DNA, 1501 bp, Oryza sativa
tagacaactactgttgtggaacatcattagattactatgtagcatgtactgaacaaaaatctgatttattttgattttagaatacttactggagtcctaaagaaattggtagctcatggtgctaccattgctgctgctgatcatactgcaccaacctcgcctgcttgaagcggagaaccgcaacctcacggcctcagccactctgaggtctccggagtacctcaccaggccaacccgtgacttcaccttcttcgcgcctgagtacattataagcaggtgcaccccatgctgatcccctccacctctcggttcaagttgtgtttgcaagaaatattattttttattcggacacatgagggttttcttgcagtgaatccgattgttcatgtagtccatatggttgcctcataagtcacagaatgtttttgcaactaactgaaagtatgtcgaccttttattcacccacaaactttgatgtgcacccactgtgctgatactcgctcacattgttgcacactatgaattaatcaagatcatatttgtgtgctacattaattaattagctaggaacttaatcaagcatattgcttaattaaatgttgctataaaaatattctgtacatataaaatattcctttcaggacttatgacttatgcctggtaatactgatttggaaatacttcagattgatagtggattctacaagtttacaactatgggttgaattagattcgtattaatttggctgtttgtagcagttgaatgttaattttttaatcttgtcacaagcaggcttattaaacatgtctacacacaattcagaaagttcaactggatgaattatattgattttttaattatattgatttgctgcctgatagttttgagttctttaataaagaatgttaatagtactatgtgctctaaaaggtgcccatgaaataggtagagctgggattgacagtgcattctataatatacaaaaatataggttgaaataaatgcaaattatttaacaaatcattacagattgagtcttgatatgattttgagatgcaaattaattctatggtcaatggaattctagtgtgcaatttttagcttgtagcacgtgtacaatgtgtgaaaaaaataattatagaccatgttctttcaactatcttcattttagatttcttcctctatgcagacaattgaacaaactcaataataaatatgtcatgtcagagagttcaggtactaataatacaaataataatcaacttcaagaacacgtatgagggctaaagtatggtaacactttcagcaagaggttgtgatgatagatggtgtccccaagactcaatgcaaatattgtagcttaagattgacagccaccaaaaagtcaggcagaagtcaccttattaatcacatagccgaatcatgtccagctattgatggtgctgctagaatcaacttccttgcaacaattaagaaacagactggggaaggtttcgtgtt

SEQ ID NO: 14507 - DNA, 1501 bp, Oryza sativa
tgtctagattacttgagtagcaggggcagggtttacgattccgacgaaatccggttggatttcgcgaaatttcggcgaggctcgaaagtagaaaccatctaagatttcgaggagtgtcatccaaattcaaatttgaattgataaaaaaagaaaaaaatcttataaatactatgatattcatagaacttattgggatataaattttcgaaaaaaatgatgtattgtgtgtatttactaaaacttacatcaggaaagaaaaaaataaagaattaaaaaaagaaacaaattaccgatcggaatttctatgatttcgatcggaatttcgccaaaaccgatcggttttcgagaacttgtcggcaaactcagggatttgtattcaaaatttggtttatgaaatttgttcaggatttaccggtttttcactgtatttcatgaaattccgaattccgccggtgcccgaaacggaagggcctgtcggaatcgtaaaccctgagcaggggtcacattttctacaggttggcttttttttgggtaaatagccaaagtgatcctccaggtttcatgcaaggatcaatttagtctttaatgtttcaatctgtccatattagtccttcaagtttttaatttaattcaaacttataattgaacccacataaccaataactctcttaataaatgacacttataccccctcattcacatatataagagaaaaaattgcatgctatgaattctttttatagataatacatagcaatttatgtaaaacaaaaacaaattatgtacttgcaagtgtattcgatagccatgaggctcaagttcatatgcacatgttgaaataatgggaagtatatatgcaatgttgtttattcattttggttttcttttttctaatgtatagttgtacacaaattaagggcaaaatggatattttctaatataattgttgactagaaatagtcatatggcatattaagtgggcccaaggataattttaggccaaaacaaatacttagagcaagttcaatagtatagcccactgctaacttcaatctatagccaatctaatagctaatttatacaatagttacttactatattgttaatatatggtcccacctgtcatacacaccttgcgtcttggagtccttactgcaactggctacaaatctgtagcccgttgctcatctctctcatcgtttatcgcattaaaatatgtttataactggctaatagcctgttattatacctgctcttagaggacctatgtgaacaaaatgaaacctgaaagactaaattgagacttcggtaaaacttaagggactaaattaactattcacccctttttcttatatttaatacaaatttatttcccataatcaaggaggcgatatcgacttttttttttcccaaaaacgaatgggaggccataatcgagacggcgccgtgcggccaaaccgagctccgcagcgaagaggagtgtggggttgaggaagtcgga

SEQ ID NO: 14508 - DNA, 1501 bp, Oryza sativa
agtagcaggggcagggtttacgattccgacgaaatccggttggatttcgcgaaatttcggcgaggctcgaaagtagaaaccatctaagatttcgaggagtgtcatccaaattcaaatttgaattgataaaaaaagaaaaaaatcttataaatactatgatattcatagaacttattgggatataaattttcgaaaaaaatgatgtattgtgtgtatttactaaaacttacatcaggaaagaaaaaaataaagaattaaaaaaagaaacaaattaccgatcggaatttctatgatttcgatcggaatttcgccaaaaccgatcggttttcgagaacttgtcggcaaactcagggatttgtattcaaaatttggtttatgaaatttgttcaggatttaccggtttttcactgtatttcatgaaattccgaattccgccggtgcccgaaacggaagggcctgtcggaatcgtaaaccctgagcaggggtcacattttctacaggttggcttttttttgggtaaatagccaaagtgatcctccaggtttcatgcaaggatcaatttagtctttaatgtttcaatctgtccatattagtccttcaagtttttaatttaattcaaacttataattgaacccacataaccaataactctcttaataaatgacacttataccccctcattcacatatataagagaaaaaattgcatgctatgaattctttttatagataatacatagcaatttatgtaaaacaaaaacaaattatgtacttgcaagtgtattcgatagccatgaggctcaagttcatatgcacatgttgaaataatgggaagtatatatgcaatgttgtttattcattttggttttcttttttctaatgtatagttgtacacaaattaagggcaaaatggatattttctaatataattgttgactagaaatagtcatatggcatattaagtgggcccaaggataattttaggccaaaacaaatacttagagcaagttcaatagtatagcccactgctaacttcaatctatagccaatctaatagctaatttatacaatagttacttactatattgttaatatatggtcccacctgtcatacacaccttgcgtcttggagtccttactgcaactggctacaaatctgtagcccgttgctcatctctctcatcgtttatcgcattaaaatatgtttataactggctaatagcctgttattatacctgctcttagaggacctatgtgaacaaaatgaaacctgaaagactaaattgagacttcggtaaaacttaagggactaaattaactattcacccctttttcttatatttaatacaaatttatttcccataatcaaggaggcgatatcgacttttttttttcccaaaaacgaatgggaggccataatcgagacggcgccgtgcggccaaaccgagctccgcagcgaagaggagtgtggggttgaggaagtcggaagtccgaaggcatgg

SEQ ID NO: 14509 - DNA, 1501 bp, Oryza sativa
ggaggtagactatgtgtttatgtgtttagttccaaagttttttttccaaacttccaactttccatcacatcaaacctttcatacacacataacttttcagtcataattttttaatttcaactaaattttaaactttggccggactaaacacagcctagctagaggaacacgcttgcacagaaagtgccggtgctattgacatcacagtccagtttttttggtgaaataatttgaggggcattgcaatgcaacatgccgtcacgtctgatgctggcgtcagagtctgttgcttgaccttacgtaatcgctactagtacatgggtagcactttgtgaatgttgctgcaatggtgatagtatttgccggtttggcacggatagttgctgggattaacaccttgactcgaggtcaggattcacccaggattgttggaaccttcttcttcttttttttttttcatttttttgttgggtacatagtcgcaagatggttggaacttggaaatgctcaactggttatatttctcgtggtggaataagttcgtgggtttcagtacgaatgtttatatttaagaaaaagtacaaattaccccccccaaactatcgtggtcgtccgaattaccccccgaaccacaaaaccggacattcttcacccccaactatgaattccggacgaattacccccctcgaccaaatccatggtggttttggtctacgtggcgtacacgtggcagtccagtcagcattctatttataaaaaaaattgtaggacccacctgtcatacactactctctcttctctctctcacgggtcggcggcgcggcttcccccctccctgcccagggtccgaaaacagcattggtccatctcagttggtccacacctaacactgcaactcactgcgtttttcgtcctcgctttaacgcaaaaatcctgaaatcggagtttacagtctcggacagctcatccttataagctgctctccacctctccaaactaacgaggtgggactatatatagggggtgtttagatggggctaaaactttttagtccatgtcacatcgaatgtttggacgctaatttgaagtattaaacatagattaataaaaaaaataatttcataaatgagagctaatctgcgagacgaattttttaagcctaattaatccataattatgaaaagtttactgtagcatcacattgtcaaatcatggcgtagtaattagactcaaaagattcgtctcgcgaattagtccaaggttatggaatgggttttataattagtgtatgtttaatactctaaattaatgtccaaacatccgatgtgacatggatttaaaataagtccatatttcccaaacaggccgctacagtaccacgcaatactgtagcgctgctgctctgctcgctgctgggccgcatgcacgcatgcactctatggcctgctgctgctagcttttccttttttttttaagggtgttacacgagcggtggccgagt

SEQ ID NO: 14510 - DNA, 1501 bp, Oryza sativa
cttgtgattcgacctaaagataaacaaatagttgtacgaagaccaaactaacatttcaggccaacaaaaaaaactcaaaattaggaactagaaactctcctctttgcttccagcaacatacggatcattatttatttatttatttattcatttatttgagtattgcacccctgaaccctttttgcttctttttttctttttgagataataccctctgaaacctaactccatcatccacgcttccacctcgcatacttccgccccaaatttcaccaactccggggcgacgaatcaaaaaagcaaggcgaggtttggaggggctgtgaaggtgtatgtgtgagcggcctcacctggatcccgcacggtgccgcggaccgcgtagttcccccgggagaggagcagctcgacgtgcgacgaggccatgaaccccccggcgccggtgacgcacaccgtctgcctcgccgccgccgctgccatgccttcggacttccgacttcctcaaccccacactcctcttcgctgcggagctcggtttggccgcacggcgccgtctcgattatggcctcccattcgtttttgggaaaaaaaaaagtcgatatcgcctccttgattatgggaaataaatttgtattaaatataagaaaaaggggtgaatagttaatttagtcccttaagttttaccgaagtctcaatttagtctttcaggtttcattttgttcacataggtcctctaagagcaggtataataacaggctattagccagttataaacatattttaatgcgataaacgatgagagagatgagcaacgggctacagatttgtagccagttgcagtaaggactccaagacgcaaggtgtgtatgacaggtgggaccatatattaacaatatagtaagtaactattgtataaattagctattagattggctatagattgaagttagcagtgggctatactattgaacttgctctaagtatttgttttggcctaaaattatccttgggcccacttaatatgccatatgactatttctagtcaacaattatattagaaaatatccattttgcccttaatttgtgtacaactatacattagaaaaaagaaaaccaaaatgaataaacaacattgcatatatacttcccattatttcaacatgtgcatatgaacttgagcctcatggctatcgaatacacttgcaagtacataatttgtttttgttttacataaattgctatgtattatctataaaaagaattcatagcatgcaattttttctcttatatatgtgaatgagggggtataagtgtcatttattaagagagttattggttatgtgggttcaattataagtttgaattaaattaaaaacttgaaggactaatatggacagattgaaacattaaagactaaattgatccttgcatgaaacctggaggatcactttggctatttacccaaaaaaaagccaacctgtagaaaatgtgacccctgctcagg

SEQ ID NO: 14511 - DNA, 1501 bp, Oryza sativa
atgcggaattcagcagattggcagtaagatttaaccttatcttgttagagttgtagtactactacagttctagaaaaatggaatacttggagtgtactcctgcatcagcagttggggcaatgggacacactcatggcaattgtctgaaactgtggaggtgctcataattaacaaagcacaagtcagatttaaaaagggggaagctagcagcagtgattaaagatttaaagctgctctttgctccatgcaaagcagcaggaaacacgcactgtccgcatattctgtgttccatctccaatgatcaaacatcattctgaactttcgcaaaagcagcactggttcagcctagagaaacacactccaaatgcactactcaagaatgatagcgccatgccctttttgcatggtcagaattcacacatcagctagttgcagaatgatacgctacaagtgatcaatgaccagcgagcaaatcatgaacatgatgtgtgcagtactaagagcaagtttaatagtagctcactactaactccaaattatttatagccaatgtaatagctaattcatacaatagttgcttactatactattaatacttggtcccatctgtcatgcctgtattacgactcttgaagtcccgtgttgcagctagctacagatctatagcccactgctcttctctctcttcctttatctctttaaaatatgtttatagctggcttatagcctgctattgtacctgctctaagagcaagtttaatagtatagcccactactagctccaattcatctatagtcaatctaatagcagttgcttactatactattaatatatggtcccacatgtcatacacacactgcgtcttggagtccgtgttgcagctggctacagatctatagcccgctgctcttctctctcatcttttatctcattaaaatatatttatagctggctaatagtctgctattgtacctgctctaatactccctctgatagatgaagttccagaatacgggcaatcaaacttaaaactgcttggactactcaatcgtactaagatagtactctctccgtcctaaaatacagtaatctagtagtattagattagacacaacctagtactacaaatctgaacacaactaattgagtccaatctagtacttttttttgccgcgccggcttttccgaccaaacattgtaccaagaaggagaacattcagaacagtacagggaaaaaaaacaagagtcaaaactctcacaccaataggatcgataaacaacccatactagcagagccgaagctaacacacactagatctaatctagtattagcttgctatattttgagacgaagcaagtagtgaatttgtcctaaaaatgtatatctccatgtcgctctactcgtttcacttcactaacatataactataagtaacaaaaacatgtattggagactatggtgatgtaaaagaaaagtgtgggagaagcttattgttttac

SEQ ID NO: 14512 - DNA, 990 bp, Oryza sativa
acacacactgtgtcttggagtccgtacactgcatcaatttatagcccgctgctattctctctcctcatttatctccttaaaatttgtttgcagctggcttatagccagctattgtacctgcacttacaggaaacaggctttaattaattcttcacacttgaaacaattgtgaagaagatagtggtactggagcttgaagaaataaaccaaaaaaaattctagaccataggggttcccctcctagggtgtgtttaattcctgaaaaaaaagttgaaagtttgaagaaagttgggagtttgaaaaaaagtcggaagtttatgtgtgtagaaaaattttagatgtgatatgatgtgatgaaaagttgggaatagggggaactaaacacggccctagccttcgcttggaaaaagcaacttaaaaagatggaaaaagtccactttgactcccttaaaaatagaccgaatctgattcatacccctcaaccagaaaaccggataaaacgactcccccacctattgaaaccagtgcaatttgactccctcagcggttttggagaatggttttgctgacgtggcgctgatgtggtgatgttgacctggtcttcgtcctacatggcgcttacgtgacattagaattaaaaatatatatgtgggacccatttgtcgttcacataggaaaaatacttgtgggacccacagccatatcatcctctctttctctccaacccttcttcctcctccctctccttccttatctctcttttcttatccccttggctatggcagcgacgtgtactggagtggcggcggcggcgagctggcgagggccagagcggggcgtcggccgattcccctcctcttccttggctccccaaaatccctaatccctgcatctcatttcgcctcttcccgcgtgcaacctccatatcgcacgccgtcggccgccggcgtccactctcatcatagattaccgcctgcgcgagccatggac

SEQ ID NO: 14513 - DNA, 1501 bp, Oryza sativa
tttttgttggtcacaattaagataaagttagctaagcgtttaataagtctaacatgtgagctaagatgctaagaaaatactatggcaatagtaactgagacaataaatccaatatataactaatgaggaataagtaaggtatagcgtaatgtacgtgataagttgggattttcaacgaacctgctctcgctatgcacgatccgtgctaacccagacagagatggaatagccgagtagtagccagacaattcaacatcctctcacgcgttcctggaacgctagttgtttatatatatcgagcatagaaatatgtataatcactttctagtgatactaatactactagtatcataccctatattttattgtgaatcacacgaataaatgtatgttaactatataaaaattatataaagaatatgaagatgatgatttgatatacttgtataggttgaactctataatgaaatgttaatgatgtgtgttatgtttgcacgatatttaagggcatgttcggctgcccgttaacgcggctgggctgtagcagcttaaacaatgctactattgatgattcagttgttgcagacgtgagatgcaacgctgcggctgcacagcaatggctgccaaacacagtcttgggtgataatcaatctttgtgataatcaattaagatgttttaaaatagtaatactattgggtgatgatgtacatctttgtgataatcaatctggaaatataggaagaaccgaaggattggtgcagattccgagaaggcacattagatacagaaaatatcaaaagaatccacaatgcatacgtgatgacctttggctattgtctgcatatttgtagctaagagctcgtttgcgtcaagccaatgtgaaacttaaagtagggccaaagcgaaaaaggatattactataaaaattagagaaggttatatatattgaccctgttttgaaaaagagaatagaaatatcatagtaagtctcaaataaatttcacactaaaaaaagaggagttctttgattccccccctccccccaacaccttgatggcacgagagggcgaggagatcatcgcccagaaacatagtacgtggtcctcccgccaagggagctacaaactaggcttcgcgtgcaaactcacaataatttcattagaaactatgttttttaaattgacgtgagaaactatgctaggaaaatgtctaattttcctatctcaaccgtaaatctaggcataatacctccctcaaatatcaaatcatatcagtttaccttggttttgaaggtggcttcatctgacatggtgtctacatgactacgtggcatcacaattggaaaaaaaagaatttaaccagtaagaaccgaactctaattctttctcccctacctcctctctctagcatcgctcaatgactgtcccaaagctcgctgacctccccactactccctccctcggcaccagccttcactgttgtcggtgatatgggcccggg

SEQ ID NO: 14514 - DNA, 1501 bp, Oryza sativa
  unsure (1)..(1501): unsure at all n locations
ctcatgacaattaaggaccggttcgcgagctactgttgtgaaacatttatcgtgccaaccacaagccagcatgggcaacggctttatcttttgtatagcatggttcattatagtgcgcccgactgagaagtggcgagaagtccatgggggtcgctggggagtccatgccttgttttaaagggggtgattatgatccaggaaaggtgcactgtaatgggttatgttgtgcaaggggtattgtcacgactcctttccgaggtaccgtggtggtattgaggcacatggtgacatgatgtggggttgtgtcttgtgggtacagtggtacacctctgatcagagtttaaactattcgaatagccgtacccacggttatgggtgagttgagcaatgtttttcgtgattagtctcacactactcattaatggtaataatgtggtaattaatttaattcctggtttggaatggacaattcctggtttggaggttcaatttgttcaactggggttgggttgttcaaatgtggttgggcctatgcaacatgggtgtgttgtatggtgtttatttaatattgattaattattcaactgttttactattctcttaaatgtttattaaatgctgttttctgcaaatgagctatattatgccatcctttgttatcctgtgcacttgcatatttgctgtgtggcttgttgagtatgtcatatgctcattcttgcaatattcattcatcagaagaggagtatctcagtgaaggtgatgatctggaggattaggcttgttctcggttaagatgcctgtggagtggagtcgtcatagctgttccgtagtttgttatagttttatttttccgctgcgtagaatgttttatatttttgggaggaactatctacctctgtaatattttattatttgcgaatattaaatagttatttaattgtactctattatcaatattgtcattgtgtgcctcggttgattcctggacgagggtttaacacacatgtaagcgtttggaattttggatagaaattccgggcgtgacaagttggtatcagagccaccttgaccttaggataagccaaatggtaaaccttaagtagccttcaaaatattttgaaaaaaaatagaactgctcttctctattctcttataaattaattaagttggcagcacatgcaaggttaagcacaaaatttattgaaattcaatttcttttcttttaaaagcaaaaagttgttcttccaaaatgtttctttttttctctttaccaaattttattgattaggccgcactgtacatctattatgggtttgatacaatcatgatagcactagtactactcatctttcttggggtgacactgtactgcgcttaaaataaatcataaggaatttaaattttattttcttcccttttnggcaaaaaatcagttaaatcaagttggtgcagctaacttagaaaaatatgcattaattcctctcttctatgtttccttaga

SEQ ID NO: 14515 - DNA, 1501 bp, Oryza sativa
ttgataacgactgtcaatagtgccttgtccataagaacatgggtacgcgtgtcctacgtggacacaattaggcgctcagaatattaggaggtgttgtgcttctaataatatctctaataaattcatgctatctctaaaaattgtgaaataaatcttgttaaactctaagggaacatactctatactgcagtgaccttgttaaactctaagggaatacactctatactgcagtgacccgaaacttaaaaaaacttgattctaaactgcataaaaaatttaatagagcataattataaaattcataactcccaaaagaaaagtgataaaatagaaattctctcacttaaattcatcataggtcagtaccaacccactgcgcacaaatcatgcattttagagcattttggattttttttgcatctctcggtatttgcatatcatgtcattttgtatagattaattgcgttagtggtgaaggagagatttaggagttgtccgatttatccaaagaataaggcaagttcctctgttaaggactaaacttcgtgtcaccaattaaagtatatcgtgcatccacaagttctatttatggggtggccttagccaattaagttatttaatgacctgtctagaggagctatccatgtgtgtatgtgtgtttgatgtgcggatgattcattcgtgtgtgtgttcgggggaggggacgactaactattccgcctcacggcatgggcgtctaagtttatcgaatacaatggtgttgtgcttcgtaggggaccacgttggttgtgcctacgttgttaggttcaaggcatggacccaccacctagcgacactacattctaggtgtaatgtggagtaacatgcatcgtgctggtgcaaggctaggcattagataatataaaggttgtgttgtgacctctagaccacattcaacgtgtattgtgcggtggtaccaacaggtaccggacagactagagtgatacacatcatgttggtaaagttgtaccaaataggcagagtcatgagcgacttggtggagtgtcatgagtacttgatttataaatgtgtttatgaaaatggggcattggaatgatgatttgtgttgagttttggtgactatgacgatgatcatgagacttgttgccatggaggacaacaagtgttatgttattacaattataaatattgtgatatattcatattcatggtttgaattgctttataaaatccctttgcaaaagattgtgaactaaaacttgcttttatgccaaaatgaaagccatatatagcccaccttgatataagtttgctaggtttgatagttgcgagcgagaagtcagtggccatggagtagaggatcccagagttgtgggggctggtggagggcgccaagcagagcagatcacggctgaagtcgataaaggaggcggcccggcaggcgtgctcgaccggtggaatccaggtgagggctagtggtggtaattaagagtggcggtga

SEQ ID NO: 14516 - DNA, 1501 bp, Oryza sativa
cccggctgcacagatctatctccaaaccaggagctaaacaaattattaccaattatatcatcatttattatggtgagaagtgtgagactaatcacgaaagacattgctcaactcgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccatctgcacaacacaactcaccacagtgcaccattcccggatcatagtcacccccttataaacaaggcatggactccccagcgaccctcgtgggcttatctccgccacttctcagtctggtgctccgcaatgaaccatgctatacaaaacgtaaagccgttgcccacgctggcttgtggttggcacggttaatgtttcacaaccgaaaatcgtgaaccggtccttaattgtcatgagcacgactctcaaaaccatgtgctcacaacccaccattatcaagttttagttggcaatttaattaattaaccaatcacgattgaccatcgtgaactatcattaagccatcattaaataatagtgaatcataagttatcccgattgtgtgctaatgtttctaagcatggctaagcaactatgtctaacatctagatgaaccaatatatataaagctcaactagtcaaattataatatcccaaggtatcaaggaatagaataatcaatgcaaacaggccataacaaaggaatagattcacaccacccagtaacattcgaaaataaatgcacagttgaaataaatagagaatttaaatataggatcaacatgctcaaaggaactgtgcttgggatctgtgtgacttgccttgcaataatcggtcttcaattaatcttcttgaacacttccggcgctctcacgaaccttcgaaacgacggaaacgacaagctaacacgcaaaacaaggaaaacagtaagaaactccaaataaacaatacatataaattcaacaaacatgtaaatcataattttagatgaattatgagacttgaacgacctcattctgacttcatatgaattaaatatgaattttacaagatttaatctaattaaagcccatttaaaaaggattaaataaatttaattctatttatggataattttaatatgtagatctttattttatacaactttagagacttgaaccaactaaatccgagctaagatgaattagttatgaattttcaaagattaaatcggattaaatcatttatatggatttttattgaattatgacgcaataatgaattatttttgaaaagaaaaagaggattattgcgtcagcggctcgggttcacggtggaccgggtgcacaggaacggtctacggaacggacggtctagatcaaccctatccacaacgaacggccgagatcgatccagaccacggcggtccacgagacacggcgacga

SEQ ID NO: 14517 - DNA, 1501 bp, Oryza sativa
catgattttgctgcacttgcatgtaatttcgaggattgggttcaatccatatcgtttagtgtgtgcagcaaaattcaagtcagcttgtagcatgaaacatatgtaaaggtgccttgaaacaaaggacaaggataggtgcctaatcacccatattagcacctacgcaatatgaatgattgagagtaattttctctaggtagaaaatgtgcagtacatgggtttgttgtattgtttagttatatgcttttggaagctttttcaaagttgttcccttggcgatacatttaagtgtacctgctgtttatattaattattttctctcaacacacttaatgacactaatgatttgtaaattgcgaatatcattattttctctgctgatatttgcatccttcatgtcagtggcagatgctcatggcatgtgtgatatggagttaggcatgaaaaaattataagattactgtgatgtttagtattgcttggagtgactaaatcggattaagtgattgacaaattggcaaataattgatattaatagagtagctcactccattttatctgacttttttttcttaggggtaatcgaatgcctatgtcaaatttgagttcatgtatatttatacctatttgtgacttctatttggctttctctattgaatatcaaggagcccttattctttattgatagtactcatgttacatggtggaatgcattttcagggcaggttgtattccaaagtaggtctttgtgctgcccagttgtatgtttcagcgtcatatcgctcttatctggtgatttctggcccatgtgagcactttatttcttaactccggtttcttttttctgccaaccaatttcttatgggaaaatatcttattactgtaataaggcagtgtatccatttcctaatcttttgatacaaatagatgtttgtgttgggtagaggattcttacatccaaaaatatttcgtgattgtaccagcatagatatagccttcgtggaacaatcaacattttagacatacaaaacctatattcctttccctcccttcattatgtgtcagttcttaaaaaaatggatagtttaattgttggttctgtacaatatggtaacaaactgctccatggcatcctgaaaagggttgatttccttctattcacatttttattttcatcaagggaaagattcaaactacctcattattctttccttttttttttgtttttaagcaatttttgtatgaactacccatacatagttgtgcacatattttgctactattctagcttgtcaaggatatgaactcttatcaatgccagcattgagtgcagctgtttgggtttacaggacaaagaagatagaggggaggggcaaaagagaaaagcccgtggaaaatgggctggcgcctcattgagccaggttgacgcagtaccatgccttataattgataatgtacgcacttttgtgttttttttcaatcattgtctcaaatgaactag

SEQ ID NO: 14518 - DNA, 1501 bp, Oryza sativa
gatgtaatgctgggaatgggtctatatgaattggctgtgatggtatatgtgaattgacgctgggaatgggactatgtatatatatatatatacatatatatatatatacatatatatatatatacatatatatatatatgcttctgtcatttttgcagcgggcatggctagcaaagtcctgaggctagccaaaaagacaaattttattttttttggttctaaactcatccctgacgggcatttagctaatgcccgaaagagataactcatccgtgacgggctatagagtcaagcccgttagagattagtcatcagtgacgggcttttagaatacacccgatagagataagtcatccgaaccgggactagtttgattcaacacgtggggtcaaacctatcggtgacgggctctggctgaatgcccgatggagatgactactcatccgtgatgggcttagtggtgtgcccgattgagattagtcattcgtgacgggctcctaactacggtggtttgactggtcatactcatctgtgacgggcttggttgtcggcccgattgagatagcatccatccgtgacgggctttagcccgattgagatattttctcacatcagtgacctttgcccactgacggggccttacccgatagtgatgaggctttcagcccgttaaagataagcgatcctgttctagtggaagtcacgtgcggtggacccgcaaggagaaaccgcaaggagaaacaggcaagagggagaagctctagcatggtcatgtgtttcggacaaaacataaatctatagaaaaccatgcaaatgaaaacttttacgctagtataacatgttctttggaataaaacataaatttagagtaacgtgtgtgttcttggaacaaatcgtaaatctagaggaaatcacacaaataagaacctcaaagaacacaacctaaatctagagaaaatcatgcaaatgagaacctaaacgtacgctagtatcaggcaaatgacttaagtggtacctatacagtaccgatttaaatttggagacaattttgccattttctctctagtagcaaatttatgttttacccttggtacctaagtacgtacactaatactaatacttaaatactgtttacatggtaccatgttactgataattaagcgttggatttttactctttggaatgcaaaaactataaaagctctcatatatatactcccttcgtttctatatatttaacgccgttgatttttttaaatatgtatatacactagaaaaaatagtacctgtgcgttacaatgggtgaagtctattttaatcttattattgttatatggtttagttaagataaaattcactatggaagttcgcttggatatatatttttttagaaaatcatgagctgcagttagctaggagtccgatcgtcccaagttagcatgtgagtttttttaaaacagatttcttatatgattccttctgtaccaaaagtgaacgatct

SEQ ID NO: 14519 - DNA, 1501 bp, Oryza sativa
attaacaaaattgcaggggctttttttttggcaaaattgacatatgacgtggcaccccttactctccagcgatcccatggtgtttaaagaaacaaatatatatgtttttgtttttccccaaaattaccattatacacttctcgtggggaattcacaaacaatggacaattaaaatagatataagtggctcaacaattatgtgcagaaacaagtactaccattgtcccattgtctagatattgccagaaatgtgttctttttagacggatagtaataattttctatttgctaatatattttcataaacatttggtgcataatattatttgctaagaaaaaaataccacacattgcgtctttgtgatttcagttacatactcattctttgcaatctcagctaatgttagggttttcttttttaacgtagaaaagcctacccttctcatacacaactctttgcagaatttgaacgtccactttgcaaacaaatgatgaatccgcacattactccaaacacaccagaattagacattatatatattttagccaaaaataactttacttaatttgttctttccaatatggttattcacttagtccaataatgtattctgctatacactcttttgaataactattggattccttctgagtatagtctacaatgaatgtctgttacatatgttctcttctctatcttttgtttttttttattttcaaatgctaactccattcgctaccaaagacattgtcttataaattacctatgagcaggaaccattttgaacatgttgatgtaaatatgtaatgttacgagggtctacttgtaaaatgttttaagaatagaaggaggatgaaggggtgtgcagtgaggaaccccctgagaaattccccaaaaccaaacaacaatatggtatcagagccaaaccctagctcaccggcgatctgcggtgcagggtgaggcagctgggttgcgtcgggcctagagcaggaggttgcgagtatgcgaggaagatggctgggcccggagcggtggtgtcgctctcaggcgcgcgcgcagaggggcgcacgtgaggcggcgatggggcgcgtgtgcgtgggccgcgctgggcccggagcggcagtgtccacagcgcgcgtgaggcggcggtgtccacagcgtgcgtgcgtgcaggaagaagaggagaggaagaaggcaagggaagaagagggagaagggtgagaagaagaaggaagagaagaagaagaagaggagaaggagaaaggagtattatcactggtagatttgggattttgctgttgtgtgtggtttattttgctgttgtgtgtggttgctgcttgctgctggtagatttgggatcttgctgtagtgtgtggttgctacttgctgctggtaaatttgatgttacttgctgaagagaggagagaaggagaagaaagaaatgttttcagcggttggaaaggaggttgtagatgcttcctcacttatctgatgtgacca

SEQ ID NO: 14520 - DNA, 1501 bp, Oryza sativa; identical to SEQ ID NO: 14366

SEQ ID NO: 14521 - DNA, 1501 bp, Oryza sativa
cctcggattcgtccggattcatcccgcgaagttcgccggcgtcttcaatggcgcccgagatctccgcgcgcggtttcctctctccccggccgcgctctccccctctcggcgctatatatttgctccccgtgcctccctcctccatttccgccgttcgccgcttgctctcgccgtcggattcgtgctcgcgccgtgctcctctctctccgccgtgccgccgaactccgttccgccgggcgcaccgctccggacctcctcccgactcggcgccacctccatcggcttcgccgagtggttgccgaccccgtccgccgctccgcttcgcccgccgaccgtcggagcgccgtcgccatcgtcatcccgagccgcgccgccgtcttcctccgctccgaccgccgttctcgtcgtcgtcgttgtcccggggtgagccgaggaccgccgttcgccttcccccttccctcctctctctcgggcgccgctccgccgcgccggtggtcgccggcggtgaccatcggggcgcgggcgcgccgctcccgtcggccgcgccggcgaggccgccctcgggcgtgccctcgcggctgccaagtgggcccggccgtcagccgcccgcgcccgcgggtgcggctaacgcgcgggacccacggcgccgaccgccgccagccgcgtgcgcccggtccaccgtggaccgagcggctgacgcgtgggccccacttcccgtggacccggtccgcgcgccccgctccctcggctgacgcaataaatgagatttttaattaaaatttaaatgaagaaattcgcaaatatccatttaaagaacatataaacttcaaatggccatatcttggccatttgaactcggaattggaccgttcaagtctctaatttttccttaagaagtcaagaacccatttttgtgctttgtttctgctgttatgtggagtttattagagtaaaagcctttttcttttccgttggtcgtgtagacgctgcagcttcggaagatccgctcttcgtggaagttgaagccggcgtttgggaaagcgagcaaggcaagacacatcatcttgatcatattgaatcccagtttataaaattatgttgatttaaattattgcattatcgctttatttaaattcccgcgttatcactgttttatttagccttgcctatttacctttgttatgaccttatcattgttgttattgttattattaccttgttcaccctagaataaacaaaaccccaactagtggacactctactcgtggtatcactagtatgattttaggtagatgcttcgcttttaattaggtaacattaggtggttttacaactatagactttgggagatattcatatcacttggacactttggaattgttggattattgtggaattggcttcacaccgccccctctattcaaaatcccctaaaatggttttaggctgggcacggggtgcatggttttgatggtagcacctcggccgtataaggaccggt

SEQ ID NO: 14522 - DNA, 1501 bp, Oryza sativa
agcctcccgcctggagccctggacgcaatcacgcaagacagcaactcggcaagagtgcaagactagccgtccaggcatccagctgaaagaattctcttaactatacctgtgatggtagcttcaactgaaagaagtttctcaaaattgaagttgttgaataactatttgagatcaactatgttgcaagaaatgttaaatgatttggctacatgctctatcgagaaggatatcttagacactattgatcttaataacgctcttgatgattttgcatcaagaaatatccaaagaagtatcttcattaaggtagtgatattagttccaaggtacaaatatattgatattttggtcgactttatttctcaataattaccagacatgtatttgttttcattttgtaaataaaattagcgtctatatatcataaaattttatatatcgtttagagggcccatcacgatgagttcatctagggtacgatgtagtgaactcaataaccaagcaagaccgtgcttccgggttgggaggaggagctgaacatttctggactccaataaatcaaagagcagcggttttatgcactttcctgatgtcttccacttctattttctaaaccatgaatgcttacaaaaggcactacatcttaaccaatgttacaacatcttccatgggcatatatatacattgcctcacacatgcttatgcccatgaggccttgagaagggtacttataagcccatattagttggaccagaggtatgtttttcgtctggtcagctagctccgtttttgttcgtgctctcactccttcagtcagcccaacacacacctggtaagacgagttgacgataatgctttgcaattgggatactatcgctgcagataggcatatttgcacacattaattattttcttattaagattgcttcaattactgggtaataatgccccctgtcaaattaaaaccgaatgcctgtgtaatatgaaatggaataaattgtttgtctgtaatttctgtatggcataatgttttgccctttttttttcttcgtgtttatgtacctcaaaatatatctgtagtctagaaaaagaaatcacatgaacttcggttttgaaccataatctcatacagactgtttgcctccacaatagcttggctatgtttagactgtgcactgtacatgtagttgatgttctcatactgggaactacctggtcttgatcaagatcttcacggactctgccaaaatgcttgtgatcaccttgaaccatctctgccacatattagttagtaggagtactattagttttcccaatacctcccacttctactactctatattgtctgtctacagaaaacacaaatcttattcaccggtgatatgtttttgcttgcaataacattacaacaccatcctcatcctcagggaatgcatctcttcacatacgctcacctttcttttccaatttatcaacaaagcattgattgttttctgcaaaa

SEQ ID NO: 14523 - DNA, 795 bp, Oryza sativa
atagtatgtagaatggtgattcaaatgtaaaaagtaagctagtagtagggagatagtttggaccgtagattaattatctaaaggctaaaaataattgatgtgatatgacttaattagagaaaaaaaaggagaaaaataatttggaccatagattaattatttaagcacaaactaaggatgaactatataagtatataggatatcataaaacataataaagatatacattgaaacattatgtgaattatattggatgataatttaatatgtttgtatttaaaaaactcttaaattataaaaactataaagatatagtatgtttgcatgatgtttaaatatgatgattgttagtggatgatgatgtgtcatcttgttaattagtggataatgatatggtatcttgttagtagatgatgatgtggcatctttgcatgtcaagcttaagaagttagtgggggataactttatagaaagataggatgactagagtattagattagatataaatgatttagaaccaacaattggttatattattggacttgctcttaacgtccacataagccatgatgggatctaaaccaaagccattaaaaccaacacacctccgcactagtttttcacgggagaaagctaccaggggccccacctgtcaaccaccgaaacccacacaaaatacttggctctcaactcaaccgcatatcccccccttctctccgcgccgccgccgccgccgccgctcgccggacttacccgcatccgcacagaggcgcccccgccgcagaaagccccaca

SEQ ID NO: 14524 - DNA, 1501 bp, Oryza sativa
gtattgatctgacgatctgtttgtgaatcattccttagaaggcttccagcccagtgcccaccttatataggatgtggggcattattacaagatagaaaccttaaccaatatggtatcggtttcctaaatctactttacaacattatcaaacctagactttaggccgttccgtaatatacaagcaaacgtcatatccaagtcatgattcgttacatatcttaactaattaaaagatccatatttttccgttcgtcacctcgtcagtacgccaatttttcgtctgtcgcccccctccctccgcccctaaaatcccattcggaattcaatcacccctcccccccccccaaaaaaaaaatccaaatcggaattcaatcacacaaataaaatcggagaaagcatatacacacaaatatatctaaaaaatagaccgaaggggaggtcaccaccgaaccgccgccgccggctcccctcccgctggatccggtggaggggaggccgccgccgccgcctcccctcccgctggatccagctgagggaagggcgctgccgctgccacagtcgagctctcccggggccccatggcgagggagaggaggccggccgctgctccacgccgccaccgtcgtcgccttgagagagaggatcaggggcatcgcttgtcggtcgctgctccgcgctgccgcagccgctcgggtaggggtgggcgttcggtcagatcgaaaaattcggtctcggtcttctgtctttcgggtatttcagtcttcgaaaactcagggccgaatttcatccaaaaaaactcaggaccggtaaattcggtctcggtcttttgggtctcagtctcgatctgaccgaaatttttagtagtaagtttgaaatgaaaaattttgacagcacttcccctcttttgagacattttttcacatatatatatcacaaaaatacaagataatatacaagaataaatagcacaggtctcagaactgaagttccgggttgatgagtaacattacatcacatatcaagcacaagcagtagtaaataagtttagtagttcacagattgtgatcaagcaagaagcaacagccaactaggttcacaaattgtgatcaagcagtagtaaataagtacatgaacagccaactaggatgtagccgtcgtcgccaaggcggaggcggcggccgtggcgcgatggatgccgacacggtggagaacggaggcgaggcggctccggtgcggtggagggcggaggcgaggtggctccggcgcggtggaggacggaggcggctccggcgcggtggagaacggaggcgaggcggctcttgcgcggtggagggcagaggcggaggcggctctggcgcggtggagggttggaggtggaggccgggcgcggtggatggcagcggcgcgaccgcgctgtcgacgtttgatgtcacgattccggtatttgcatagtatgtggatcgttgatactaggatatacacgagactaagataaaagaga

SEQ ID NO: 14525 - DNA, 1501 bp, Oryza sativa
acccatttttagtcccatcctagatactacctctgtccctaaatatttgacgccgttgactttttagcacatgtttgaccgttcgtcttattcaaaaacttttgtgaaatatctacccctatatgtatatataaaagatatttaacaatgaatcaaatgataggaaaagaattaataattacttaattttttttgaataagacgaacggtcaaacatgtttaaaaaagtcaacggcgtcaaatatttagggacgtagggagtatatccttgttcactcattgggccctgaggacatatgggcttttatttttacaacaaactctatatgtacatataaagtttgttgtaaaaattcagtactaaccatataaaaaggtattggagaaacaatatattaactaagttgacatttcaattactcaaactagaaaggaaataagtcaaaagccctttgcctatgttgacacatcaatatgggaggccatgtgcgaggcaacatcttttgggggcatcaatgtaaggtaatgtatcaatattgtaagcaaggagtggtgctatgaaattagcaacgtcgattttgaaaaggtgttgttagcagcttcggtgtggatgtgggtgagatggtattggcagttggataatgagtcaacggttataatttgggggcagagtcaccgaggcacggtaggagacaaaagtttacgatgatggcgaaggagtagagatacccgatgatggtaatagtatgtagatatagaaggattagataaaaggactagggagagggagctgagagtagcggcactcaatagtgcagtgaagttggggtgtagtggactagtttgtgaattttttctatataaactattctttggtcttatagtgagtaacttacaaaactcaaaactagttaacggaaacgttgattgctctgcctgtccttgaccattctgctagaagctctgcgacaaataaatttcgcaaatctaaggtgctagtaggtgaatgtgtagcggaaagtttgaatatatggacctgtttggtacggctctaacagttgaatctagagtggagttgtggagttgagttgaaaccgtttggttaggctccaactctataagagatgaattggagttggagctatgtcaaacaagtcctatgtttgatgcaaattttatgttttgggaaaacaaagatataattaacatgtttcaaatttgcacagagcatgcattttctttggttataataagttgcatttcactgttgcagactagcagatagtagaaaacaaatgcgcaaaagcatacatttcactgtttcaaaaggttcctttcaggtctggtgcatcggcatcagtctctcggtgcataacacgccttgccatgctaagtgtcgagcaaccatatattaggcatgcattgccaatccaattcccacaattaagtgttcttaactcacaaactaaccacacttttttaccggagattatgatacagc

SEQ ID NO: 14526 - DNA, 885 bp, Oryza sativa
aagagttttaaaaaataattccatttcaaaagttgtatataataaacttcctccgcccctaccataggatggggcatataaatcaccatatggtaagacaatctatgtgcaatgaacccgtaggagggaccaactatggcaattttgtagccggccttctccggcgataaatcaccctcagggagggcgagaaggggcgcctgcaaaattaccatggtgcgcccctccagccttgtgccacgtcgcatagcacgtcctacataggatgggaggagtataatttcgcaaaactttaaaacgacgacttatttttaaatctttcaaaaataaattaaaaaattctggaaatgatatattgtgggctactagactcttggggttcaaaaacttacctaatgtaggaataagtttattttgcttccctcatcttttgcacttagttgaatcgcatccctcaaccgtaaaaccggatataatgcctccctgaacttcaaaaaccggtgcaaattgactccttcgttgcttttgaaagcattttctgatgacgtggcacattgacttggtttaagtatgttgacgtggcagcgtcataaaaaattaaaaatagaagttggtctgacatgtaggtgacaaaagtaaaagggacattgcttatttgaccctattttgaagtttaagtactaatttgaccttgttttttcaagtttgtttatttgaccccgtttttcaaaattgaagctaccgtttgaccctattttcaaacaccgttagggtttcatttagatcaaattaaaaaaaatgaatttacaagcctaaatgactaaaatgcctttattcactcattccttatcctctccatgctctctcaccacttccttcattaga

SEQ ID NO: 14527 - DNA, 1501 bp, Oryza sativa
ccacatgtgtattttttttccctgactgcttagagatacatacacacacatatgtcatgactcaagcagatacctacgagtacacaccccttaaataagctcgagagatggtagcaaacagttaggtggtgttaatttggatccagggacttaactttagtctctatatttagacactaatttagagtattaaatatagattacttacaaaactaattacatagatgaaagctaatttgcgaaacaaattttttaagcctaattaatccataattagagaatgtttactgtagcatcacataggctaatcatggattaattaggctcaatagatttgtctcgcgaattagttcaagattatagatgggttttattaatagtctatgtttaatatttataattagtgtccaaacatccgatgtgatagggacttaaaagttttaatcccatctaaacagggtcttaatctattagactaccgttacctagctaaccaacattttattaaaagcatacatttacatgtggtaactacagaaaccaagatttaaatctgatagatgaagtcatgcgctcataagaccacgactccaccaccgcactaaatatgattcatgtatgtgtttaattattctataggcaaatactgaaagtaggaggggtttcttttttaaaaaaaaatatctagaagtatgaatttccttgagaagtaccattgctcttttatcaaataagaaccaagtctggcttagtatgaaactgcttctttagcttagcttttcggcgacaactgaaacaagacgagtcattagcacaaaattagttttgtattaagtatgaaaaactaaaaaaaaattatttgatcttttaagacaatttttataaagaaaagtacgtatttaaaaaatgtatcgtttattagttgaataaacatatatactcacgataaacaaggtatgtctcgatcggttggtaggaggggccatgtgtatacagtgtacaacgtaccccttccacgtacgattgattccattaattcaagtggtcttgtttttaatttctgctgattgatttgataccagtgtcctaactaataaataggctgtcccttattttctttttatttcttcttcaaatacataagtaattacaagggaaaattctcacgtacgtgaaacatgtagtagtagctcacagtcacaaggacaaacataccatgagattgattgatgattggtacgtgtatactattctcccagaaaacattcaaatatggccagctatttatcactggttcagcttgcatcatcggtcacactcaggcatatatagcattaattaacattaatatagcatggccgatgcatgcatggagcatagccacattcttttagtgtgcataaatggactttgaactgccagcttgacacaaatatgagaatgtaatggaactcttttaatctctctagcggatctccactcgtttgttcaaacactatcc

SEQ ID NO: 14528 - DNA, 1501 bp, Oryza sativa
aagaatcccaattttgagtgggaaattgtagcttcaataacacgatttttattaatttgatcattgctctcagactagctataatccgggatcaaacatgatttttttttcctttttagtacaagccacgtaaatgccttaggggccttgttgccgaatgccgacaacttgcccattagatcacatcactacctgagcttctttcgtcaagatcaagtcctaaactactcctaatctccgagctctgtgtagcgtgtatcttcctcaccaaatcacttccccaacgcacgcaacacgcgaggtattttctatctattatcataatgtagcggatgatgaaaattaatggagtatttcttatctcaatacttatgttattattatcaattaaccccatatcattgggattgggaggcatatgcgccatggataccatcaccaatctatctataaaaccaaggtggtcgtcgtctccaaatgcagacgacgccattgcagaattgcacacacacgaacatcacgtagttgttgatggcgagaccgcacgccgtggtggtgccctaccctggctccggcaacatcaacccggcgctgcagctcgccaagctgctccacggccatggcgtctacatcaccttcgtcaacaccgagcacaaccaccgccggatcgtggccgccgagggcgccggcgccgtgcgcggccgcgacgggttccggttcgaggcgatcccggacggcatggctgacgccgaccacgacatcgggaactacgacctcgcgctgtccgcggcgacgagcaaccggtgcgcagcgccgctgcgggagctcttggcgcggctcgacgacggtggcgccggcgcgccaccggtgacgtgcgtggtggtcacggcgctgatgagcttcgcgctgtacgtggcgcgggagctcggcttgccaaccatggtgctctggggctctagcgcggccgcactagtgacacagatgagaacccgagagctacgggagagaggctacatcccactcaaaggtaacgaaattaaagatgatagggaccggactgtctaggtatcattttaaaaagaaaaaaaatagtttactctccaaactatttcgctatgatattactccctccgtcccataatataagggattttaagtttttacttatactgtttgaccactcgtcttattcaaaaaaatttgtgcaaatataaaaaacgaaaaattgtgcttaaagtactttggataataaagtaagtcacaaaataatataataattccaaaattttttgaataagacgagtggtcaaacagtgcaaacaaaaactcaaaatcccttatatcatgagacggagggagtacttacataacactaaactagcttggtccgcacattttacacggctagctgccaatgttccttattttctattccaaattttctttttttctaaattgtatttttattgaaactcttatttcaatatttcttattttttaa

SEQ ID NO: 14529 - DNA, 460 bp, Oryza sativa
cacatgggtgttggctcggtaaagggacatgcagggtgacgtcaggctgtcgaccagtagatcgtggctagaaatcgtgtcctagttagaacacggtagtactaatccagcggtagatttttggctcctcgacgtgcttggttggttggtagggatcggtgtcgggttcgacttggactcagccggccgataccttgcaccagttgatgtcgcacacgtcgagaatttaatgttggatcatgccgacaccatgccgacaccatggcaacacgtcgaagcttggttgatctcgagagatcaaataattggtgactatggttccgctcttgtcgaaagacatattccggtcaggttagatctccccatagccaaagtcgtcgagtagcttattgttggagaatctatctcttaaacccatctcattgaaatcctgaagcaccaaaatcctcctacctggtac

SEQ ID NO: 14530 - DNA, 1501 bp, Oryza sativa
acatcgaacggtcatataaggtaagacccactaccgatttaacctatccttcccacaatctaatccactcatttctcctcccacgatcttattctctcatttctcctcactatttttgcatttgtaggaaacacaatgacaccgtcgaagaaagctggtggagcaccgtagccagcaatcaccaaaacacagaggggaggaggtcggcagcggccatgcggacggcgacgagacaacgtgacgcaaagagggaggaggacgttggcgatcatgctggtgttggcggaggaggtcactggccacgcggatgacagcggggcagcgcaacacaaaaaggggggaggatgccggcgaccacgctagtgaccatgaagcaagatgatgtgaaagggaggaccggacgagggttggacctctgctgccgacatgaagagcgtgatgtgtagaaggagatgttagaccagatgccgacgcaactagccctggcaaggtcacccgactgatatcgctgcttgcccttgtcctcatgtacacaatcagcttgcttatctctcccatactggtcgtttgtttcccgtggccgaaatagaagaagacagaggtaggttttgttagagaattttagtggtattgtagcctatttgtaattttgttgtactttattgtattaatcaataaaggtgtttcattctattttgactcaatgttgaatccattgatctcttggtgttgcactcagtatgttagaatattacattccgttgaaacaatcttggttaagggttggaacatttttatctgttcgtgaaacatccgtaatattttcgttgaaacaatttttatcgacagcaccgtccaacaatttacaccaatttggacgtgtgatacatagcagtccccaagtgaaactgaccaccagttgaaaggtatacaaagtgaacttattcatctaaaagaccgcagagatgggccgtgggccgtggcctgcgaaacgcagcgttcaggcccatgagcatttattttttaaaaaaatatttcacaacaaaaaagagaacggataaaatccatcgaaaaaaaaaactttcctacgcatcctctcctatctccatccacggcgagcactcatccaaaccgtccatccacgcgcacagtacacacacatagttatcgtctctccccccgatgagtcaccacccgtgtcttcgagaaacgcctcgcccgacaccgtacgtggcgccaccgccgcgcctgccgcctggacacgtccggctcctctccacgccgcgctggccaccgtccaccggctcccgcacacgtctccctgtctccctccacccatgccgtggcaatcgagctcatctcctcgcctcctccggcttataaatggcggccaccaccttcacctgcttgcacaccacagcaagagctaagtgagctagccactgatcagaagaacacctcgatctccgagagttttttttcagctttagcttaagcagga

SEQ ID NO: 14531 - DNA, 1501 bp, Oryza sativa
ttatcgtctctccccccgatgagtcaccacccgtgtcttcgagaaacgcctcgcccgacaccgtacgtggcgccaccgccgcgcctgccgcctggacacgtccggctcctctccacgccgcgctggccaccgtccaccggctcccgcacacgtctccctgtctccctccacccatgccgtggcaatcgagctcatctcctcgcctcctccggcttataaatggcggccaccaccttcacctgcttgcacaccacagcaagagctaagtgagctagccactgatcagaagaacacctcgatctccgagagttttttttcagctttagcttaagcaggatggagcaccaggggcagcacggccacgtgaccagccgcgtcgacgagtacggcaacccggtcggcaccggcgccggacacggccagatgggcaccgccggcatggggacgcacggcaccaccggcggcatgggaacgcacggcaccaccggcggcatggggacgcacggcaccaccggcaccggcggcggccagttccagccgatgagggaggagcacaagaccggcggcgtcctgcaacgctccggcagctccagctcaagctcggtacaaacattttgcccccaattctttacccccccagtaaaaccttgcgtacaaattcgttgaaaaattttaatgtctttgtgacagtctgaggatgatggaatgggagggaggaggaagaaggggatcaaggagaagatcaaggagaagctccccggcggcaacaagggcgagcagcagcatgccatgggcggcaccggcggcgcctacgggcagcagggccacggcaccgggatgaccaccggcaccaccggcgcacacggcaccaccaccaccgacaccggcgagaagaagggcatcatggacaagatcaaggagaagctgcccggccagcactgagctcgacacaccaccacaccatgtgtctgcgccgccggcgacggccgccacgtcaccttcctgaataataagatgagctagccgagcgcaataaaaggaaaaaaaaaatgttactgtcgtgtgatgagtgtgaatgtgtgatggcgttctccagtacggaccgtgtctgcgtgttgtttgtactgtgaaagtacgctgtgtatgtacgtcgtatgtgtacaattccgctttgttgaaatacgtataaatatatactgtgtgtacattatacggtgtatatctcatcgtgcatatgtacacaacgttttggtgatcgttataatgttcatttttttccttattctgatcaatctggatcataggctcgagaaattgctatagatcaacggccggaaattgcagaacaagaaagtgatcctattgagtattagaaatgattgatcgttactaccttataagaagggccccggacttttgttctcgaataagtaaaaaaaaaacgaaatgattgcgcgtcatcccgatagaagggcaaatactccgtaattgtcctcgccgt

SEQ ID NO: 14532 - DNA, 900 bp, Oryza sativa
ctatatgtatatacacatatacaccatctaactaattaaccttaggacaagttgtgatctgattgcactgatcattgttgggatccatgttccaccacatggtttctgtcattgaacatgtgtggcccgtctgatagctgatgggcagcatgtacacaccaatgcactaccgatcagatcaattattattattcttgcaaacattttctcgagctgtgtcgtcagtactataatatatgtacaaatgtttaattatactgttaccaatgacccgatagtagatcagcttattttaagcctatatgtaacatccaagaatcgtcgttattattagtttccgtactgaaggagttgacattacatgaattgaatgtgatggcgatagcttatcgtctcgcgtttgtgtccgtactgatcacgatgccgtccctgattaagtttcctacagatcaccgcgctgatgggatataaaattactggagtgtagtactaaactactagctagtggacaattaaaaataacagtccgtacgtgtatgtacatgaatatatacatacgtcatccctgatatcagcacgtacggtgcgtgagagcataaatatatgttacacctgagagtttattgatcatctttaggcctaatattgagaaaaggggagcaattgagcaaagccttgagaagtaaaatttctgactggattttgaaggtggcatatatataagatcataatcaaatcttgggttcctctgtgatgtttgtaaagggaaggattagataactcatctcaataaaaaaagggagaaaaatagaaaacatcatcagaatatccagaaacaaaacccaaaaactaattaagcaacatcatcggaaattttagaaattatgattttgtcatagg

SEQ ID NO: 14533 - DNA, 1501 bp, Oryza sativa
aatcaagcgcaagtaatgttagagctctaaactcaatatgaagtttacagaacaataatcaatcggaactaaacataacacttgtaaacttatggtactttgcgaatccacacattgcacaaccaaaatatttacttacctctatgagccgacgccgtgcaccacaacccctgcctcggcctcgcgcctacgatgcggccggagcctgaggacggatgggaggcacgaagacgccttcgtggcctgcacctccaaatgaaggtggcattggcggttctaacccagcaccaatcgaatgcaggccgccgactcctggtgccgccatcggaccgccccatatccgcttgctccttgaccactggggcacccacgaaacccgaccgtgcggttcgcgctccgagacggacgtgtaagcccagagggcattggctgccctcccatccgccgccgcgaaggtcttggtagccatgcatggcggaccactcgtatgcggagttgaggtcgagcgtcctgaactcgagctgagaggggttttggctgctcgaagaccccttgccgaatcccccaaaggtgaaggacgtgtggccgccttcacgagaggggtgcagaggctgcgcgaggaagtctcgggtcgggatgccggcgccgaatctatgctcggcccagtagaggggcctggtgccgccgccgccgtagacacctccggtgttgtcggtgccgtaaccgccgacggtgctgccgtcgccgtacccgccaccgttatggctgtcgccgtagccgccaccgttgttgctgtcaccgtcgtacgcgtccatagccggttcgggtggtttccgccggatacgccactacggatgtggtggatctggaagagaaccccttggattcacccgggggaggatcgggaagatggagggagagtgacggcggcagagatacaaccctagggtttgcgcatgggaggagccgagggggaatggataggagcggcggcgtggatgcctcccacaggggtattacgggccactcatgccctaggctactgttgggccttcaatgtgtcaattggccaaattccaggtgcccacccgtttagttccaaagtgcagactgtggcctcgtgccagattttttttggcactttggccctatctaaacacggcctcacttttgcctcagattatttcagttccaataaggccctgtttagttcacaccaaactttccctaaactctcaactttccatcacatcacattacacccaaaacttttctactcacataaactcctaactttttttccaaactaccaactttccctaaacttcttcccaatttcagaaaaacacagcctaaccccaaacttcttcccaattttagaaactaaacacagcctaaacacagcctaagatcacttcagatgagcaaagtacgagagaactacactgaggccgtttgaattttgggcagccaactaaacaccccattccaatttggaagt

SEQ ID NO: 14534 - DNA, 1501 bp, Oryza sativa
atggtgtcctccatctctgtggttttcttcatgcttcttctgatcgtggcagattccaccttctcatcctgctatgcattaacacgtatgcagcaaagctattaattttactctgcattttttaaaaaatatccaaactacactgaatatgttttctctgtataatttgaggggttcatgatatgcctttttcccccctcttttaatttagtttgcaattagtggctcatgaatcatggatggttgaactgaattgcgtttttgcagctagacaaacgtgcaatgacctaggagatttagcgtgcactgacgagacgtgcaagaagatatacggagacagattagaatactactgcaagccaggcgtcacccctacggtatgctgctgtatgaacgtcacagcatcagttcccagtggtgtcaagaatcaaaacggcgatacgcttcttaattagttataattgatcatgttccatgtaaagttcgtcgatatgtttggagtttggtgccaactcaataaataaacatgcatacataatttgggtttgttaataaacgcggttactgaattggctttgtgctagtattgttgcacaaagtgttcccctccagttaactactccatgattgcgtactagaggcagcagagaagagctttccaatgcaatctgaaacgtacgtgttcttttgccttgttgcttccgacgtacgttacgtgacatgttcaatgtctgaatctccagcaattcagcatgaaacacagcccgttctcgttcatgtagcaacgaagaaagcttgtgctggtaattatatttacgcatccaaaaagactctgaaagtctgaaactgtcaagtctgaatcgctgcaacagacagaggatcaatagaaggcgaaggttgcctcatctgtggctctctgacgctgatgctcaaagtcaatctgaatcacttgatttacctcagggattgaacagtgcccatgattgtttgctctttttttctctcgtgaacaaactgcagacaaaggcaccgatcactgaatctcctgcatttaagcattacaattacaatggtcaatggcaaactgtaactgtaagaatcaacagtcgattcattaatgcatgtagaagaaaaccattcagagaggcaggggacatgcagcattaggatttagagtaattttaccatccaacgaattaaacacgtgatctcggggttaaaaccatcaccccttacgactgcactatcattctcatggtgcccgtcaagttaaatcccaaagtctgaagaaataaatgcagtctatcgctgctaatcctaaaaaaaatgtacgcatgtagttctcgatcgagcccatacgtcatttgtaatgacgattacacaaggaccttgaggaatctgagcacatacatgcatacatgagcactgttttgatcaaacaaagtctgccgtagatggatagcatctttggttttcagccagcaactttctttgctaattt

SEQ ID NO: 14535 - DNA, 460 bp, Oryza sativa
cccttatgaattactggtataacaaaactactctttacataaattgaatatgtgatgtaagcatgctgatgttgtacgtgctccgtacaagccaggtaaacatacgtgggaagggataataaatactgagatgtatgtatatatgttggcgtacacgtacacatattgacatatacatgcaatgtacacgtacgcaaggaggtgctactagctgtctagctatagtcgtagaagaacatgctcccttcgtctcacgaaagactccaatttttagttttttatataacatttgactctttattttatttaaaagttttgtatgaataatatttttattattattagatgatacaatataaatatttcttatacactgactgatttttttttattttttttataaaatatactgtataagatgaaagattactaccaagtgtgtaattaagatggcttaaga

SEQ ID NO: 14536 - DNA, 475 bp, Oryza sativa
tgctgagatatctttaaacattccttataccttagtgtgagttacttaccaattctttgctttaattaccttacatttaattactgtaatacatgtcgctgctatcgttacagttgatacgtggccttaaatatctaagttccgaacgactacgtagagtagtaagacagtttatttacacacgtatatatggagcgaacttacataagtgattaaaaacaattatatttttattgagggggggggtcaagctgtgccttcgcacagggcccacgaagtgaaggggcccaaccccatatatgctgtagataatagcccatgggaattaggaagcccattagcccaaactagcccaggagaggaagagacacgtacaggaagaaattttcgtcgattggcttccttccgccatcgcctcatgttcgctacttctatgttctgccgcccttcctctgttcctcgtcttgttccgagg

SEQ ID NO: 14537 - DNA, 1501 bp, Oryza sativa
accggcagcgcggtgagccggaagctggcgctgctcttcaccggcatgactatgcctctctactcttcttccccgacccgccgcccgccggctgacacccacgtcgagctcgccgccggcaccaccaccaatcaccaccagcaaccacggagagatggcaatggcatacaaatgatacaatgctgcagtacacgggttataagggctttgttctggtgatgcaaccaaggagtgctcaagtaaataagaaccgggtcaatgcaatcgtaaatttatttgatagttttcaatcctgctaagctagctattggaggagatgaattagggtgcgacaaagccaaggaaaggatgataaaaccggaggaaaggtctaagttttggactgtttcggatttgtccggacggcagaggaaacagcttagattgaaatcatcccagctgggacagatttagctgaagttactacaaattgcccattcatcagggatgctggagtaaaaaacaagggacgttattatgattttatattcgtatcaacctgcgcgtcgccggcttgcttcaagcacatactaatagcttgtccgttcctgctggtccatatgttgtgttgttgtgttgtcggtccccctcgcaagcttgaaaagtacaccacaccgggaaggcaaatcaatccatcagctcaaatgcggccgtccgtctggactactttgcttgtcattgcaagaatttctgcttgtttgcgccgagcaggttcttctcatctccagccaaactgaaactgaaattggtccacaaccacctcaagccccacttctcttcttgtagtatgtacgtccaagacctgatgattataatccatgcttctggtgagaacagaaaatggataatgtaccaaaaccggttgcatttttttttgtttcaacattcaagtatatacagtataccaaaaggatataaacgcagccaagaatatgtatgaacataccaacatagccgtcctatcttgtcctatgtcctggcatcgaccttggtaaccactgcattcaccaatagacagttagacaccacaggccctgcacataccgcatcatcatgtacaggggaagggacagcaacaaacaacaccggcaagcaaaacttaagagcccaggaaaaatgctaaggtgagggctagtacaaaaaatgctgacctgggatctcagatgacaaccatagaaaccagcatccaggctgcttgcaaaatggaagagagaaccagcatcctcccaaacagcaggaattcagatatagaccaagcctgtaacagaatcacgaccgttcatcacagtttcacagcaactacacaagtaacaaacaaaaccagtactatatggctgacatacagcagacagaaacatcatgggcttaactctgcttcactggaaaggatcaaaactataacacagaccatcacacaagcactattaataccaagagaacacaaaatcacgaaaaacaaata

SEQ ID NO: 14538 - DNA, 1501 bp, Oryza sativa
gcatgatacaagtatatgcgatctaaaagaaatgtagcttgttatcaagacaaaggtctttgtgactacagggtaactcaagcagatgtcctggttgtgatactcatccatgcagaggtgaagaatgaaaaatcaaagaaagctagttttaaaagcaaaatagaaagggcaatttctttctgctgctcttattggtcaaaattgtcctactgatgtgagtataatagaaacgatttcttggattagttttgttggactactctgtgccataaaaaggataaagaatattttttctgaacaacttgacaaatgcccataacattaatactccctccgtttcacaatgtaagacattctagcatttttcacattcatattgttgctaatgaatctagacatatatatatctatctagattcattagcatcaatatgaatgtgggaaatactaaaataacttacattgtgaaacggaggaagtatcagataagcaaaaggttttggatcttaacgaacaatcatgtaaatagcttatataactgctaaattttattcacataatgctaactgaatttaagtttcaaatgccttgctatgctttctttttctttctttcatttttcctgttgctgattagtgcagcagctttctgaccaaaggtgtaaagcatcactgctatcaaagtcattcgattgatatctgattgattaacgtccagaaccattgacacataggttgtgtttaggtcacggtaaaattggtcaagtcctcaacgtacatggagttggataagcttgttgcaatccattagcaaacaccaaatgctgagttttttttttcttcgctcaagattagaatattctgaaggttacgccgatgcattcaacaggaaattaatctgctcattatatacatggaaaccttgttaaattaatttgaattaaaaaaaacacatcaagatgcgtttttcagtttaattaagtacacacagatgagtcagtattcacctcaagaaacgggcacccatattggtaacttgtgtgcatctccggtgagctttcttgcctctgtggctaaccaggtttaatcaaatttttaaggagaaaatcagatgccagaaatgccttgcgccctggctttgagcaaagatgttctagaagacgtgtgcacctgtcagcatggttggagctgctgtcaaccatgaccacgagattaggagaaggatgcagcggtggccggtggcagtaggcggaggggaggcagcggccgtgcgcccgtgcgacgctggaacagcgcaccagattggcagtgcactggaatggtatactggacacgtggcgtgattttaccatacgcaaacttgcgttcaggttttgccacgtggcccaatcagcgccagggtccgatccctgaaatcggtataagagattgatagcaactggcttaacttcaatcgttgaggtattggaggtaattttcataatgtgcgtaatgatccatat

SEQ ID NO: 14539 - DNA, 1501 bp, Oryza sativa
agtaagataggattaggtacaaagcatcctacattatatgttaacttggttttcatcccatttaatggctacgtggcgcttggatggcactagaagagttttttattaaaaaaatctcaatgggatcaacatcttagtcagacaaaaataattaataaaaagtaatgagccgacggccctctctccccatctctcgggtcgggctgcccttcgccaggcccaagtcaagctcatgacactgattccccctcttcgagactatataatctctccgtctcattttaagtgtagtcgtgagtttctatgtctaatgtttgaccgttcgccttatttaaaatattataaaataattaaaaagtataagtcacgcctaaagtactattcatattttatcatctaataacaataaaaatactaaccacaaagaaatttcaaataaaacagaatatcgtgaaaacttgcagttgcacttaaaataggacagatgaaatatgtagataacagggacagtgacaaggacgtgatgtaaccccgaagtgcgagcaatatgaagatccaaaggggatgagagtcactgactttgtgcagtttgtgccactgacatatagaccataccaaattgagacccacgtgtcagtggtacaactatagactgcacaaagttagagcatatctgtttctatcgagagtagaagaacctgccagattgcatacttgcatcgtgataaatttaatgtttgtaatttcaggtttagtaccttttgcagcactatacaccagccaaaaagtaacacatggaatactaactttttggctggttactatctcacagtaccccctccattcccatatgctccctctttgtctgactgaggccgttgatttttttaaatatgtttagccgttcatcttatttaaaaaatttaagtaatcattaattcttttcctatcatttgatttattgttaaatatatttttatgtatacatatagttttacatatttcacaaaagtttttaataagacgaatggttaaacatgtgctaaaaagtcaacggcgtcaaatatttagagacggagggagtactgagataaaagtcttacaatacggagtattaaacaagttcttaaaaaaagagtactagtactgaacatggtgtatatatatatatctatacctaattaaaaaatatgtaaggattccgtaaaaattttttgtccgtcgttttttacttccgcaatgcggttttttttccggttttccgtcttggttttttctccagtttttatttgggcccggttttctttgtccgatttttttctgggtgggtcacgattttatgtgttgcggttttttgtgggcccgttttttccatcgctgtttccgattatttttttcttggtgcacacgaaaggattgaatcccaaatagagttacctaatattcatctttatctattataaaaattaaaccttaattttcatctgccatctgtgttaga

SEQ ID NO: 14540 - DNA, 1501 bp, Oryza sativa
cgtgccgcccctcagtgagttccccgcgtcatgctcgtcgcgttggtgccctccattctcaccgccgtgacctagatcgccggtgaccgtgatgtcccgagcctctcacaggtgatgacgtcatcgatgatgtcataaagcccttttcccttctaaaaataaatcttaaaatcagtttaatcttgtaaaattcataactaatttatatgaagtcagaatgaggccgttcaagttgctaaattcatctaaaatcatgattatatatactgtttatttggtttttattagttttttttctccgttttgcgtgttagcttgtcgtttccgtcgatgcgaaggctcgtgagtgcgtcggaagagattcagaagactaattgaagaccgattattgcaaggcaagtcacacagatcccaaacacaattcctttgagcatgttgatcctatgtttaaattctctatttatttcaactgtgcatttattttcaaatgtcattgggtggtgtgaacctattcctttgttatggccaatttgcattgaataccctattccttgataccttaggtaataaattgattagcttgaaccttatatattggtttggttcagctaaaagctatatagatatatatatataattccttagccatgcttagagacattagctcattaatgggatgaatcatactacattattacttatggttatatttaatggtagctcacgatggttaatcgtgttatgataattaattgataactaaaacttgacaatggtgggttgtgagcacatggttttaaaggtcgtgctcatgacaattaaggaccggttcgcgagctactgttgtgagacattaaccgtaccaaccacaagccagcgtgggcaacggctataccttttgtatagcatggttcattacggggtgacagactgagaagcggcgagaagtccgtgggagtcgctggggagtccatgcctctggttattgagggggtgattatgatctaagaacggtgcactgtggtgagtcgtgttgtgcagagggtattgtcacagcctctattcgggtactttctagtatcgcaacgcatggtagacatgatgttgaggctgtgtcttgtgggtatagtggtatacctctagccagagtaaaactattcaaatagccgtgcccgcggtcatgggcgagttgagcaatgcttttcgtgattagtctcatacctctcacaataatttgcttagctcctggtttggagttagatctgtacagccggggatggttgttcaggatggttgggcctgagcagcatgggtgtgcagttcagtgttgattaaaattgatgattactctattgttttactattcttaaatatttgctaaatgctgattttgcaaatgagcctatattatgccatcctttggtatccttgtgcacttgcatatttgctgtgtggcttgagtatttcatatgctcattcttgcaataatcaatcaacctca

SEQ ID NO: 14541 - DNA, 1501 bp, Oryza sativa
ttaaataagatgaattatcaaacgtcatactaaaatccaacagagccatgtactaagatattaacaaaatgcagggagtaactactttgaattatttgaataagataaattatcaaacgtcatactttgaatgcatggtagccctaacttatgcattgttggatcttggaaaagaattccatttggtgcgtgtttttaatagagttcagagatatggtcctatcacattaaagacattcatgccacgaggctaaaatctggaagtgaaggttgaaatggccacgtcgcattaacgaagttcctcatttaaatctgatctgaaagctcagtttgatccgtgcaactgtatcatcatatcatggaaagtttgaatcattttttaataccttgacttcctttccatcgttcgttatttccttttttttccacccatttcatgtacaactaatacgagacagcacaatcacgtactaatactgaaatgtccatttgatgcacagaaaaataagtgtagcacacggtagtaccaaagtactccctccgtttcaaaatgtttgacacttttagtacgtgtttgaccatttgttttattcaaaaaatttaagtaattatttattcttttcatatcatttgatttattcttaaatatactttcatgtaaacatatagttttacatattttataatttttttaataagacgaacggtcaaacatgtataaaaaattaatggtgtcaaacattttgaaatagagggagtattcaattatcttcgaaagactgatatattctacctttgttatgattattactagtacgcgtcatgacagaagaagtacttcaagtccctacggatctcatctgaaatagtaatggttaggcgttacattaaaattagtagtcctagctagaaactcttttgtttttatgtcgtgcaagtgtacccttcggtatttaatgtttgatatggatgaacatacatttaactaatttctcgttaaaaaatttgtgtaaatgtagaaaaatattagtcatatttaaagtaccatcagtgacaaaacaaatcaaaataaataaaaatcatattatttgctttataaaagaaatgattcaacacatgtgtaaaaaataaacggcatccaacattcaaaaatatataagaaaaaaaggactatcaaaagaaaatctgccacgagttttttaagacaaaaactttcaaatctaactatagtataattataatataattttactataactaatataatataatttgtatataagtattaaaataatacatgcaactttatatctaaatgcagttacaccgtaatgtacattatacttacactgcaactacagtaacattggaaagtttttttttaaaaaaaacttgcgacagtattttttggcaatttcggaaaaaaattgacagaactaactagcaaaatagaaccaaatgccaatgcatgcgcactttgcatagtgtcgcaactcgcaag

SEQ ID NO: 14542 - DNA, 1501 bp, Oryza sativa
cagcgcggcgacgtgcgcggcgtggcccacgtccacggcctcgccgcgcgcggcgtggccggacacgcggcggacaagctcggccaccttctcctccaggagagccctcatggcgtcgagccggcgcggcgagaagagcccgacggtgctgagccgccgcagggcgcgccacctgcggcgcgggggcaggcaaaccacggagttctcgcagtggccgccggcgcgcatggagtcgccgaaggacctggcggcgatgtcggcgttgtgccgctgcaggacctcccgcgccatctccggcgacgacgcgacgacggcgcgcacggtgccgaggcggagcgacatgagcggcccgtggcgcgcggcgaggcgcgcgagggagcggtgcggcaggtggtcgagctggtggaggttgccgatcagcggcagcggccacgggcctggcggcagccggcggcgagcgtcggcgaggagctggaggacgtaggcggagatgacggcgaggaagagggagaacgcgagagggaggaagaacgccatggtcgtagcaaaacgtgcaactcacctcacctgtccttgtgtgtatatactgctgcattgcttgctgatgaagactgtttattgtttgccatttcggtcgtaacatactctatgttcccaacctaggtgtgtttagatcctaaaaatttttggccaaaaatatcacatcaaatgtttggacatatgtatagggcattaaatatggacgaaaaaaattaattgtatagtttacatgtaaattgtgagacgaatcttttgagcctaattgcgccatgatttgacaatgtgatgctacagtaaacatttgctaatgacagattaattaggctttataaattcgtctcgcaatttacaggcggaatctgtaatttgtattattattagtctacatctaatacttcaaaggtgtgtacgtataattaaaaaaattttggcccaaagaactatacacggccctaatttctaatgaaaattttggttggaagtgaaggaactcaagtcatggatgacaaccagaaaggactatgataatgctgagattgactataataatttttatataactagatcgaagaaacgtatcagatcgtgcggctacgaacggagggatcactgttgcactgtagcaagaggaatgcggccacgtagcgacggcaaaaacaataagtttattatgatatgatatgcatggttcatacagtgcctgtagtggctatggtagtagcagtggcagtagtagtatttgtagtagtagcagtaacgttaatatggttagtagcaatatctgtagcagtacttgtgaatttctagtgtactgcatatttgctgagcttttagggtttgtgtattattacgctgttatcgctcgaggcttgtcttgagctgtatctatggtattgtaataactggaaccaatacgatgtttctgctatgctactctgatgtgcatatctctgagtaaacg

SEQ ID NO: 14543 - DNA, 713 bp, Oryza sativa
  unsure (1)..(713): unsure at all n locations
tttcgtgattagtctcacacaactcattaatggtaataatgtggtaattattttaattcctagtttgaaatgaataattcctggttagnaggtttaatttgttcaactggggttggttgttcaaatgtggttgggcctatgcaacatgggtgtgttgtgtggtgtttatttaatattgattaattatacacccgttttactattctcttaaatatttattaaatgctgtttctgcaaatgagctatattatgccatcctttgttatcctgtgcacttgcatatttgctgtgtgacttgttgagtatgtcatatgctcattcttgcaatattcattcatcagaagaggagtatctcagtgaaggtgatgatctggtggattaggcttgttctcggttaagatgcctgtggagtggagtcgccatagctgttccgtagtttgttatagttttttttttccgctgcgtagaatgtttttctttgagaggaactatccacctctgtaataatttattatttgcgattattcgatagttatttatttgtactctattatcaaattgtcattatgtgcctcggttgattcctggacgagggtttaacacacatgtaagcgcttggaattttggatagaaattcccggcgtgacagggatatatgcctattggatctaatggtcgtgtatctcagtactggattcctaaatttttattat

SEQ ID NO: 14544 - DNA, 1501 bp, Oryza sativa
ttacgtgacaattctatccagaaaaataataaaactcgtgggatccacacgtcagtttcacacacaaattaataaaaaatggtatcatcctcacccctcctcttcctcctctctccccatctcccctctcttcagaaaagctggtccattcgcgggatgatgggctcccgcgctagcatcacgaaccgcaccatgttcccggagtcgtcctggatgccgtcggcgagcacctggagcccgtacagctcggcggcacgggatgatgcgatggcggcggtggacgagccgccggatattgttctacacctcccgcgccttcttcctcctcatcatcctccagatcccgctcttcatgtcgcccccttctccctcccaatcccctctgatttagctctgtttccgtgtcgatcgtgtggtcaatcttagcaaacgagcaaacaatggttgcctcaaaatagatcctgtatgcatatcactacttgtagctagtaggtttgattatagtgcatatgtgcgtgtgatgagttctcgacgagcaggacggcgcggtcggcgatccagagctccacggcctggaaggcctcctcgaactggtcgcaggggatggtgttgcaggtggtctggcagtgggcgcgggagaacggggtagcgcacggcgggcggacggccgtggatctggggatttgcgcggggcgcggcgctggcgaggtttcaatcctccagaggcgaggtgttcgtggctggaaagggcggcgttgcgcagccgttttgacgatggtttccctggcctaccggcgagcgcgcaagagagagatggccggcggccggtccactccatttcgtcgtcgccggccgcatctggtgcccatccccccagcgcaagagagagatgaagagaggggagatggggagagaggaggaagaagaggagtggtgagttggaccgacatatggggctcacgtgggcccatctttttttaattatttactctgtgagactgacatgtgggtcccatgggttttattatttttccggattaaattgccacgtaagcaccatgtcagatgaagaccgagtcaaattagccacgtaggcgccacgtcagccaaaaccgctctcaaaaccgccggaggacctaatctgcaccggttttgatagttgaggggcccgttgtgtctggtttttcgatcgagggacgaaaatcggattcgttgacaagttaagggacctcagatgaacttattccatgtaaagccgtaaagcccatgaggtccgtgaagagcagaactgggcctcctccattccatctcggcccaaatcgcgactcgactagctcccccctagctagggtttcactacataaacacgctcacgacgcctctcccctctctctctctctctctctcctgcctccgcttctctcccccgcgccgccgccgcctccaccgaaagcagcagccgccggcgagccagccagcagcctagccatgtcggaatcga

SEQ ID NO: 14545 - DNA, 1501 bp, Oryza sativa
tcccatctctaccctaccaaaatttggtagtgccattacctgacattagcaaattttggtatggtagagaaccaagccagccctaaatcagctacaacattccgtggatttcatttgggataattggtgatatcatccatgattagattggcactctggaatttgccccatactagaactactcccttcgtttcatattataagacgttttgacttttttctttaagttgtaacttaaagaaatttgacttagaaaaaagtcaaaacggcttataatttgaaacagagggagtaattgataattaggtctagaaggtggcaaatcctttgactacccaatgggtggcatagaaaatggacgcgactccctgaatgttgtgtagatggcccaagtagattcttagggcgagttctaaacagcaaggggaaacagctacttcctcgtcctctgtgagcattgcttcccaaactgctaaataatgtgtttcatgcaaaagttctctatatagaggtttcttcaaaaatcaaataaatcctttttctttctagtttttaacaattaatattcaactaatcatgtgccaatggcttgtcttgttttgtgtgccataaaaaacactaggctcagttcggaatgagtgttggcttgaatttttgatggcacgcaaaacgagccaagtcattatcacatgatcagctgaacaagctgtagaagagatacttctgattagcttatctagtgatatgtagtttgggtgcattgtatattagtatatactctattcctttaataaggtgtattataaagtcaaaagactaagtgtatactttggccactagttactcataaactaatttgttaatgagtacataactaaattatatgaaaatacattgccgtataattctattcgtatagtttctacatgttaaatatacttgtaatttgagtaatagtggttaatgtttataagcttcacttatataaacttgataatatattaatattccttataagaagaaacagaggaagtaggtgatttgtttaatcagggcttgttgtatttcccttgggatagtgtggcttattgttttggatgttaatgctatctcaaattcacactggtgatacaaactttttatctcaaaacaaaagaaaattagcactctagtatgatggaatgcaattttttatggtgattatctattgatttaagataacaatatactatggcaaaaacgcaaaatattttagtatggaaaaccagttttagtgacagtcattatcagcatatgcacttctcctgcttggtactgaagtgttgctttggctacttgcttgaactgtattgacattatggtacacaaaatacacattatacctttggttacttgtttcatattattgattgattcatgtgaaataggaactgcacatgcaccgatgtatgtggagtcattgacatgtttgaatcactaatgttttgttattctccacaga

SEQ ID NO: 14546 - DNA, 1501 bp, Oryza sativa
cagggccggagccggatctcgcctagacctacggggagaagacgcccttgtggtgaagacggcaaccaaatcattggggagtttcatcaggattggcggataggctccatcgtcttgatcagatcgcgttggagtagattggatctcgtccgagtggttttgggccgactcggatgaaatgatcttggagtagatctcggccgagttccggataccgaacgggatggagacctggccttttccgactggttcgaacccagtcgaggagagaaatcttgcccaagtcgtggtgatgaaatccaggctgccgaatcaaaacgcctgcccggtgggaagacgaaatcgtcgatgccggagacgaaacccatcgcactactcggtgaaaaaactgacgctacccctacctggcgcgccaactgtcgaaacatgatttcggcaatactaaaagggggtggctatcaagctagaaaagcggatgggtttagagaaagaatcatatacaggtttaggccttcttaacaagaagtaataccctactcctgtccggggattgccccgccaagtgtattattgatcgtatgacctgggagaaaaatcgtgccccaatagacacccgtaccctccttatataggggaaggggtccgtattacaaggtacagcccatattcctaacggaataggtagttacagataagatacaattgtatccgactaggatcctgggtattttcttgacatacaagtttagaatttaacctaaattcctttaaagatattctatttatacatggcaccccatacccagtcggatatacatgccgtgtaggtatagggtatccataatctccacaccgttgtgcatctattttcatatcattctctactacagccacgtatcttttcttccctcaaaaaaccatctcttttcttttgatgagttctctgccgtattatttaatttttaagatggggagaaaagttttacgaggtttctttgttttctttaataatggttaacagggtttctttacgtgagacggttacagaggtgaaaagttgcatcttccaaagggcaggtagttaactctataatgccgttttggagcgataatcttcgttcgttcgttcgggtcttccataattaaataggcgacttgatcttctctagctcgtattatgaaacacttacttgtgaaaggaattaaggaaagaatggcttgctctgactgtatggaacatacacatagccggtggctgaagaaattacgaaacactactacaaaacatcaaataggtatcgccactgcagtgccgatagtgctaaaaccggcacctataagccttttccttcctccacgggttaaaatggcaaaaaattggcaccttttagtaattataggtgtcggttttaaataaaaacaggcacctattatattttgtgtcgttttttttaaaaaaaggcacctataatatattataggtgtcggttagttgaaaacc

SEQ ID NO: 14547 - DNA, 1501 bp, Oryza sativa
tccgataccagctagttattaggtgatacctgtaaggtatcatacgattcttaccacatagaagatgatagttgcgaggtatcaagtgatacttgagtaggatcatgttaaacctgggaggtatcatgatcctccttagtatcatgtccggtttcaccaggtttcataggtgatactttgggaggatcatgtgatacctgggaggtatcatgatcctcatctgtatcatgtctggtatcatcaggtttcacaaatgatatcctaggaggatcacatgatcctcctcgaaagtatcattacgtgtgatacctgtgcagtaccgcatggccctacttaggtatcatgtctagtaacaagattctatgggtttcacaaatgatactttagtaagatcgtgtgatacttgcgtttctaccacatatcagatgatacttgcgaggtatcggatgatacctatcaggtatcatgcgattcttaccacgttgtggatgatgcttgcgatgtatcaggtcctgatacctaccaggtatccatgcgattctaccacatatcaggtgatacttaagaggtatcagatgatacctatcaagtatcatgtgattcttacaatgtagaagatgatacctatcaggtatcatgcgattcttaccacgtagaagatgatacctatcatgtatcatgcgattcttaccacgtagaagatgattctaccacactccacagccagccataaccaagttagcaagttcttttcaccccatcttgtctctttgctcccccgaagcagtagatggataggatgaaggcccggactcgcagcgggatcaacggccggcgacgaaggcgccgaccggagagggcccgcgacagagttggggcgccggcggagggcgcaccggccggccacgcggatggagccggaggtgggcgttaacggcggcgccgtggatggcggacggcggtgctggagctccaggcggcaatccggcgaccacatcgctggcagccacgtcctccgccgtcgctccctacgccgggctcgtcgccgcagccacgtcctccgccgtccgtgcctcacgccacgctgaagctcgtcgccgaagtccgcgatgccgggggatcgttgggggtggccgcgtcggagctcgtcgccggcgaccgcgacctccgtcatccacacccatgccacaccggagctcgtcattgacttagttgcagcagcacgcatgagagagatgtggtagaaagaatagctagatagaagaagagtggattggttggtgtctatcctatcccgtcgggacggtataccggtgtttagcatttccgtattatttactctattgagtaaattacattgctgatacacaaatttggattcagacggcagtggcactccggaacgatctcctacgtgcgcggacagctcacccatgacccatctacttaaacgtgctcatcgatgtttcaccccgcgtgatctgaactgagaagcgccgtc

SEQ ID NO: 14548 - DNA, 1501 bp, Oryza sativa
tttgataacaacattaaggacgaataatattccttgcagcatgtactctattttttaatatattgttttagaatattttactagagggcatattgtttatttatcttaacactagcttcgagatgacaaattgctctagaatgcattctgcttatttccaccgatgatttacagatttaacatgaaaaattcgttcctgttcacaaacagttaatatttcacttgagcgttcagtgaccaaaaagtgaccagtctattgggagatccatcacctctgctacaaacatgctcacatagcgatcagagtaagggcttaaggccgtgtttagttctccaaaattctcaacttttcatgacatcacatcaaaaactttcctacacacataaactatcaactttttctctaaactaccaatttttccaccatctataacatagcctaatgctaccacatgggggcatggtgtcacatttatttcctggatggttgcaaccatgaatgttcttactgcactgtagatctcccatacagccaaccggccacatgagattctctcattttttggtcgaaaaatatgggatgctcatttggacggagccatgttccttatttaaggcttaacacggccatgcattatgactaacctaaccaccgatatacatactattgcaggtttatcagattggccagtgggacatcatcggcacaatccatatattctctcattgttcagattcgatacttcatgctatggtggccatccctcatacgaatgatcatctttgcatggttatattatcaagataatgaagaagtgttttatttctctacttcctgcatcttggtgcatatacaagacaaaaggtccagcattctttttcattaaaacaaatctcaggtttagcacttatttttcaaaccattttcttagcttagcattttgccttttgatctatcatcaagtcaattcttctctccgttgtgactgtgacagcacggccatcatggcttaacatttgccgtgccaatttaaagcaggctggaagtagttgaaggccattgccagaaattgctgatcaaaccattaattttgtctatatcattctcgttatcataagcaagtcgcactagtattacttggaagcatgagatccttgcaccgtgcacagtatgatatataaggaaggttacacgtgggccgtctacttgttgtttgtttactctttttaaaatatcaattttgagtgactaagattgctcccatagattcccataccaatttataaggttgccccatttcttatcttcctctccttccaatggttgccaccgccagcattgcctctccctccacttggcagtgttgcgaggtgctccgcccatctttttaggacatccacacaagggcatgctctatatggtgaatgggcgagtgtcctcgcctttccacgttgaaggtagagccatcatcttgggtggagccatgcctagcctcgtaga

SEQ ID NO: 14549 - DNA, 231 bp, Oryza sativa
catactagccattaatccatatatgtaggattgtaggcagacattgttgtcatgtcggactagtaacaagtactgttgacacctgaacattttgagctaccttctggtgttttgacgtgttatattcatttgaaaagtatttccgactaatgtattttctgcatgaagcttaactttgacgtgttgcaacaccatcatgggctaacgtttttccaatcttgtccaggtgaa

SEQ ID NO: 14550 - DNA, 1501 bp, Oryza sativa
taacaatggcgcccgcttaccttctcatgttacgacaaaaggttatggcatgagtgttgattttgtagattagtcattactttgtacaatatatgcttatgtatgtctttctttcgggaatattcttatgtatgttcttataaatcccttgctgggggatccttcagagtcgaaatcctggcttggctgcaagggataaaaatcattttggactctatctagagactaggtctgtttggagtagcatgcatacctatatgttcttcctaaaatctttagttttttaaacaattcatattttcaatcagattatgaggggtatagttatagaatccagaaaacgaactagaaagcagaaaattaaagataaaaaaatcatctttttttccaattttctcactagctgttctttaaaatcttaagcttctcaaataggaccaaggcaaaaagctctagatcaacttattttgagacagttttgaatgccacaaatcaaactttttcctcatgtaagtcacataaaacaactttctatgtgctcatttggcaacagccaaataaatttctcttcatattacttacacactcaaccagcatcttcattttccattctccaaatcttctagatcccatatgtcaatgtctcctcccctgttcttctctccgtcatgtgtctacctctatttctctcttgtgtgatccatgacatcatgggctatgacggaggtaggcggacactactacagaaaagcccaaaggcgccagttctaaaggtcctatcttataaaccgatttcagggttacaaccctgactcctcattgggccacgtagcaccacgcccagagctccagccggattctcggccggagaacgtgccacgtattcccaaccatcctgcagccgtccgataatatatcaatggtgaaaaaaccttcaacggatccttcacaaaatgtgcaatctcatctagaacagtcgggattagaggggaaaaaaattaaaaaaaaagaatccaagcaaaagaaataaaaacatcaagaacatagattccccttgcttgatcaccatgccgtcaccgagtatggactatggagaatccgacaaggatagaggaaaggacggcaggatctttggcccggatccagcgaacaccaccctcgccacctctcaacagctatcccctgactcgatccaccgccagatctgggccaacgtggctgaaggaaaagctggtgaggagaaagaaagaggaagggagggaatgaacgatgccgggccaccgagcaccgctgcctgatcctccaccatcgctgaatcaagttcgagctattagcacaagctaagcaagcgatagggagagagagcagcagccatggcccatggcgatttttacggcgagcgaaggaactgagagaaaaaaagagtgggcaagggaagagataaaaagatcgactcgcaatgagcggcgaacgccacgcggagagataaaagcagttcggc

SEQ ID NO: 14551 - DNA, 1501 bp, Oryza sativa
taagatcaccatacactgcttatgtcatgattattgctttaaagttttggattaaaatatgccgattcatgaccatatttccaacaattacaaccaccttccagccagaattcatttagaacctcagaccaggctttattggctaagctatgactaacctggttctgagcgtgatggatcttcctgacagagatttccctgtccccgtcaatgagcctccttatctccctgactaggtgcgcagaggccgacaggtctttttctcttgattgcagcatctgtgtcagcgttaaccaatctgtttccacttcaaaagggagcatagtccagtgaagcgctaatgcaattccttccacgcaggcaaggatctctgcctcaagcgccccattacagcgctccataaatctgcaggcagaaaagaccatggccccattgtcatctctcaggatcataccgattccccccgctcttccactggatcaaaagagccatcgatatttagcttcatctcgatctcctttttggtttctcccagtgtggtgcaggggccttcggagcttggtgacaaaccgaattactctctccgtcccaaaatatatatagcaaactttgtagtggatgggacacatcctagtacaacgaatctgaacaggggtacgtaatctctatgtaatccatccttagcttgatcgtcaagttctccattaattaacatctaagatgtccactttaaatgtgaacacaaatacgatcaaattcccagatttaagtaattatatatatatatatatataattctcaccgatatcaaaatatgttttagataagagggagttcagtttttgttgtagcttgcttacttgcggtgtgtgtaaattgtaatcggtcagctcttggctctgcgtaattggttgttgagtatgcgtgacctctccatttgatggttttgggcagcgacgatgcttcttaatttacacggcaatatatgatcaatgattacttcgtaaaggcagaggtgttggcggagtaatctgtgtcaacagctctaaatataagatagaaaaatacaatttattgcccctttttatctagtcggtataaaaatgagtaaacctcgctgaaaactattaaaaaaatatctttcacctatttaatagcgatattgacccgtatagatgataattctactttttctagagagttgttaacagtgaaatttggtaagcccctaagagagttatcacgtcgccaatagtcggattactgttatattcggttaaggaaattaatctgttaaagaaagcttatctaggagtcaccgagttcaagtaagatgcgacatgacagtttatctattaattaggcacaatttgttagtttcttttatctttagaaacgtgtgtttagtgtcctataaggactttatgctttccttttatcttttaggaaagtttctttcttgtcctacaaggactagtatgtccccatgggtataaatatg

SEQ ID NO: 14552 - DNA, 706 bp, Oryza sativa
ataggaatatgcaccccgacgagtacatctacaacggcaaaaatttaggcccgattgagatgacttcgttctaacggcccacgttgtctaggcatgtgatgagccatcacagatgagaggatctgtactagtggacgggagatgctccaggtttcatttgtcccgatcttcatctaatttcatcttttagatcgtgaccagatatttggtatttgagaacacgtacgtaaatttgttttccaatcaagtttagtttttttatgccaccatctaatcttcgtaattaccaataatactcaatcatattaatcactaatggtttgtgtaagcagaataatcacgcgtacacgtatggcagagcctctacagacgtcaaaagagctagctttctttgggatcaaactagcttgctacacacataggctgttgatatcgcttccattgcactaaagatgattagagcaagttcaatagtaatctatagccaatgtaatagccaatttatacaatagttgtttactatactattaatacctgtttctacttatcatacatacattacatcttaaagtccgtgctacagctggttacagatctgtagcccgctgctattctctctctttttttatctttttaaaatatgtttatagctggcttatagcctgctattttacatgctcttacacaggttgataggctgctgata

SEQ ID NO: 14553 - DNA, 1501 bp, Oryza sativa
tcgccgttgtatctcgccgtcgtctcgcgcgcgtcatcgtcgccgcctccgccgccgccgcatctctggggtgagagccgccgccgcctccctctctctctctctctccccaaaccgccatcagccgcctcgttgccgacgctgccgccggcgtcgtcgcggccgaacacgactccgccgcaccgacgatgccaaccccgacctcgatgcggccgccaccggcgacgacgtcgcgccggcagtgccgacgaagccgcgccacgacgccaggccgcgccacgccgatgccgcgccgccacgccgccgctccgctgccgccacgtgaacgaacgaagaacgatcgtgaacgaacgaaacgtatgtgaacgtgaacgaacgaacgaacgaacgtgaacgaacgaaacgtacgtgaacgtgaacgaatgtgaacctaacgtgaacgtgaacgaacatgaacttaacgttgtatatgaacgtacgtaaatgaatgaacgtgcgtgaacgaaaagtgaagttaacaagaacgcaaacatgaacttaacatacgttaacgtgaacgcacgtaggtgaacgaaacgtgaacttaacgagaatgtgaatgtgaacgatcgtgaacgaaacgtgaacttaacgagaacgcgaatgtgaaatacaatatatgttactttgcgtttatcctaatacatctttttgtatgttgcagaaaagacgttgtcgtcgtcgtccctcaagccggagtggtagctagccctcgaaggaattcgcacaggcaagtgatgtaaatatatgattgttagattttttttaatgcaattaaaactattagatttaatatacgaaacttagacttagcatatatgattatctaggtttgtaatgtacgacacttaaacgacttagcatatatgattatctagggtcctaatatacgacacttagacttagcatagtataagattattagatttgtaataagacttagcatataagattgtttgagttagcatagttctaatacaagattatttgagttttaatataagattatcagatttgtaattagacttggtatataattattgtctagggtcctaatatacgacacttagacttagcatagttgactattagagttttaatacaatattatttgagttttaatataagattattagagttttaatataagattattagatttgtgtaataagacttagtatataattattgtctagggtcctaatatacgacacttagacttagcatagttgactattagagttttaatacaatattatttgagttttaatataagattattagagttttaatataagattattagatttgtaataagacttagcatataagattgtgtagggttataatatacgacagttagacttagcatatttgacttagcatatatgattgttagcatataagattgttaaagcaaaaatgacctatagacttagcaactatttctcgtatgaacaga

SEQ ID NO: 14554 - DNA, 858 bp, Oryza sativa
tgtgtatgtgaatgaatgtatatgaatgggggatgttggggtgtgatatatcacggcctagggcttaataggattaatagaatactcataccaacaaactacaactattcttccggaagccgatcttcaaataactttgatattaagcgtgtttagcctggagcaatttcctgatgggtgaccgattgggaagtgaactttgtgcaaagtattggcctgagaagggcgggacggcatggaaaggctccgattgggaagtgaactttgtgcaaagtattggcctgagaagggcgggacggcatggaaaggctagccaaaaataaaaatttattttttttaggattatactcatcagtgacgggcattaacttaggcccaattgagatgactcatctgtgacgggcattaacttaggcccgattgagatgactcatctgtgacgggctatagttaatgcccgtcacagataagggtcatctgtgacgggctatagtttaggcccgattgagataggtcatccgtgacgggctatagtttgacatgtcgtctgggttaaagctatcagtgacgggctttaattagggcccgattaagataggttcatccgtgacggccgtttgcccgattgagataatttttcacatcagtgacttctagcctgttacggacgccgtacccgattgagatgggggttaccgcccgattgagatgatgttatccgttctagtgattcaaaatattccattgtgtggcaaaaggaaaacttatggggcaaataatacattaattttgcctagttaattacatgcgtgccattcacatagatgtaataatatatatacaaaatgtattcccctg

SEQ ID NO: 14555 - DNA, 1501 bp, Oryza sativa
gttgaaaggtttcaccacgatagagacgcatcgaaaaaaaactctcaaatcaaacgtgatgcttagtgtcaggggtgacgcgctgtcgtgatgcagttgtgcacgtcagtaatggtttcatgtgggctgcactacttgctgtcacagcgcatatgcactagcaagcagccctcctgccaagcagcccatgcgactgctggggcagggtatggctagggatgataatgggttaaggcccatgagttttttttttcaaaaatacttcttataatccttaaacacttttgactaaaaatatatagaaattaagctcacccttttacattttgtacgctgaaatgttattggacccattgcatgaccggtcgagacagcaaatcggcccaggtagatgagccggccctgtgcagagggcccaaccggcgaaggtagtcagtaataagtgagctgacggtctgtttgttggacggagtttttaggagggatttagagtctagagggatgtggctattaactgttttgtttagatgggggacataggaattttggtgggatgaggatggggaattgaggaatgaactccctccttttcaatatctgggtaggggcaggtaattgggagggaattcctcctttacttcgcgtaaacaaatctcagccatccgttttctttaatgatctaatctccaactaaactccctatcaatttctatcacctctaccaaacaagagactgggatgaaaaatcaaattcccatcttaatctcaccgtcaattccctcgtgtaaactcccaatcctcttccctcaagttgccaaacaagccgtgagtgtgagatctgccaacatatacgttctctctcttcgcttacgcctactccctccgtcccaaaatatagcaacctaggaaggaatgacagtccacatacatcaacttagaagggtcacattccctcctaggttgctatattttgggacggaggttgtaatttacaagttcagggggtgtttagatcatagtgtaaagttttagcgtgtcacattaaaatcatggagcaattagactttaaaagattcgtctcgcaaattagtctaaacctatataattagttattttttaaatctatatttaatattttatataggtatttaaacgttcgatgtgatatggcgaaaaattttaggtggaatctatacagggcctcagatgcaaaggatgaggacaaattaagccggcttcatgcgtggagcaagccaaccaaagcgctcccgctgccctccacgtctcagcacgcaccacccctacgtgtccccaagccgagcaacctcctatccatgcaaaatactagagcggcaatgcaaatctttgctctctctctgccaaacttgtgttcttgcgaccctgctctgctctgatacgtgtctgaagctgaaaacgatcgaagagaagatcggtcgaggttgcagaggagcaaggaaggaagcaaggaagaaggcgacga

SEQ ID NO: 14556 - DNA, 1501 bp, Oryza sativa
ggagctccatgaagatgaaggctttggtgttagctcgtgcctgccgtcaagcgcctgtggtcgtcgccctagtcttccgctgtttttcgtttgtctttgtgtgtgctgggccttcgctgcccatgtaataagttaactatttacgcttccgcttgttaaactctgatttgtatcaacttttggtgtaccttgcctcctaggacaaggattaatgcacgcacgtaaggaatgcccgttgggttatttccggtcgtgacaagttggtatcagagccacccttgaccctaggacgagccgtagatcccaagccttagcaatattttcaaaaataaaaatcctttgttatttgtgaaaactgtctagtctctctctgtcttgctgcttcacttaccatcaaaatctgacctttaaaatgttgcttttcttttttgtttttgtttgtagatggccggcagcgtcacccgtcgtggtttggacatgactggcttcgtcttggagctacggggcatgtgcgtggtcttagggtatccccatggggtggactaccaggccaggccgctcccggagcaggagggtgaggacgcggagccccacgctggttgggaggtcaccgccgtgatcctctctggctctcccgagcggacttcgctgacagtcaccgcgggtggagactccttccccgccgcttgccagagcgccgctctcctcgccatcggcactcttcaccagcgctacccggacgagttgcagcactcgccctaccgctaccaccctcgtcgcggaggagcccgcgactacgccaccttccgggatgctagctcggaggatgacgctaccatcgtgcacctggcgcgcatggtggaggcgtacgacgcggctcgtatcgacttccaccagatggtacgtcgcgggatggtcgagaacaatctgaagatcctggagctgcgtcaggagaacctgcagctcaagaaggacctcgacgcagtggaggcgcagctgcaccagctcaagatcgcccagggagagatctgccgccccaagcgtcgccgcgtctgccgcagccagaagatcaccgcccgcaagagcacctccaggcccgagcttgttcgtcagtccctggcgtggacttgcttcgtcgagacccctcgtgccgagcctgcgcccgtggttccccaggagggggaagcctccggcgttggtagcacggagggtgcgctgttgctcaccttccgccctggcccgtcgcagcagtagacgagcagttagtaggcttgcgcgtgtgttctttctcgtttgtcttcttgttgagtcgtgtggggcatggttatgccggtgtgtggcataactgtgtcggagcctgccttattttattcgcctaagcaacttgaacattaatgaaccaatttaatagcagtaataaattcaagaattatggtagtcgtgggtggttagttttaattgttagctctctctctgtttgcgggttctgtgtggggttttc

SEQ ID NO: 14557 - DNA, 1501 bp, Oryza sativa
ccgggccccctcctaagtgggcagggtcctccttttatatctcaaggggataccacatgcaccaattctacctctttttcttttgggtggggacccatcctatctttactaaaacttggctcgccttctcttggaagcttgtttttgagtgtggccacgcgtcctcactcgtctgacctcggggatcaccctgtcatcccttcataaatgggcggagacttgcaatggctgctgtccgaatgaccttctgatgggacggcccatacctacctccactccgccggaagcaggttcaacgtgggaacgcggttgtctaccgatgacatgaccagtgtcagatcggtgacaaaccagtcatttttgtcctccacgcgtcagcttagcaaactgcatgtctgcccttcttcatacaatgtctttcttgcaatggttgggatgaagcctggtatatatctgaccgggaccaacgtgccatctccaggagctagcacgctggctccggctagggacgagtgcctagaggctctcatcctgacgggatggggcgaggcgtgtgtcagatcgcctgttgtcacctaacccgcaatctgaccggtctgtgaccggtcacagaccggataaacgagcgcgctgcactgcgttacatgcggcgtgacgcgctcgtccaaaacgcaataaatgcggttaggtgagccccgctgtgctcacctaacccatacacgcggcgtaaaacccacaaggggtcggggcgcctcggccctcggggccgaaacgggagcggtccgacccctcggggagacaaagagaagggcggccacatcaatctcgggcccccctccccgagggggttaggccacgtgggtgatcgtgtctgcctcaagcctctagtcatgatactcccggtcccatgtcaccgacagtagcccccggcgttatgccagggcgatcgcccccctcgagggaaacggtcgggcatgacgccactcctatggcctggtgacaggtggggccggtttctactgttgggcagaaacccagcggtcgcaaatcacgtacatcggcaatggtaactcgactgtcagtaatgagcggtctcttcaagactgccacattacttgagtagcacacgaatcgggacgagccggttcgttttgcctggagatatggtgatggcgcttcggtcggcgagcgtaattaacgcgcgcacgatatgttccatctcgactgccacagccgcatatccacctcatgcgccgcaaacgggcgaatgggattagtggaagcgtgggcgcgagaaacgagggggcgagatagtgggcgcgagaagcgaggagccgggcacagcgtttggcaagggtataaagacgccgaggaagagatttgcttccttcctctcgccattattccccttgtcttcgccgcttgcgccctaactccttctttcccgtgcccttccctcaccacacgcgctcgctctcaaacatatcttcttccggcgtca

SEQ ID NO: 14558 - DNA, 1501 bp, Oryza sativa
tcgtcattctgagcagcctgggtcaaagttgatggtgaggccacacatagctgaaagtagacgacgagatctttccaacaagtactcatttgccccgtttgccctccggagtgaagagcattgacttcatcaaatcagcgctgctagtgctgcttgcgatttggttcctctcccatattcctaacaacaagtagatcacaacaaccatttagtagcacccaattctgagaagaacttgtatgattagctaggaatgactttacctgataattaagttcacgagctcgagctctagtcattggtccttgctgtgcaataggcgtggttgtatcgttggaagggatgtcctcatcacgttttttctttattttaaacatttcatttccaccatatatcacacacacacacacacactttacacgatcttgatcttgagtatatttagtcatctattttagtctatgtttttgacttagtaataaatgtgaatgcaagtatgccatgtttgatccctaccaaactacacatatcaaccttagagtaggaatcaaaaaggcaaaatggtgaggaattcattttgatacacttggagagaccgagtgaatcatttgaggaacttggatttcttttacaaaaatcatttgaaaacttccggaataaaagttgaatgaagattgggtgattagtactctaattgttgttctgtctttcaaccgcttaaggcaagaagagacaatgtctcgtgggaatcaggggtaagggtaagccaccgtgccaaagattatttgatttaagagagagtacatatgccttgaacctatacatttgagatatacagcatagtagcaactcatgatcaacagccaagtctttgtttcctttcatcctttactcgtgacgagcaaaggttcaagcttagggggttttgttgacggtcgttagcgatcagtttcgaccgtcaatactaccaaaataaaggagaactagttatgcttacaatgcatatttgtgttagaataataagtattccactagtactgggattgctaacctcttgcagagaatgaacataagagcatccctagcagctcatctatatttcatcccccaaatgcccatatggattatcatccaaaaagattcctcatccatatcccttccaactccaacacatcatctatactatatcatccatatcccatcatcctatattttagtaatatcttccaactaaccttacatttatattttaagggatatattttgaacaacttaattttaacgttgtatttatcaccataatattttgaaacgaataaactttaacagatatatttttattgggtgactgaagcatttaaaatgataacccaacaaattaacattactacattttctcccctcatttaatcgctagggaactgctagtactacttcctcactgcttgttctctaccatctccgattctccgctagtactacttctctttgcaggcagtgg

SEQ ID NO: 14559 - DNA, 1501 bp, Oryza sativa
ccccatttttccctctctctctccctcggattcgtttggaaactttccccctaacctcgccggcgccattaatggcggccgggactcccgcgcccgtttcccccctcctccggccaccccttccctctcttaaccctatataaatcctccccgtgcctccctccaccgtttccgccactcgccgctctctctccccaccggaatcgagctcgcgccgtcgctctctctctccgccgtcgccgccgagctccggtccgccgccgttgttgccccggaccacctctcccctcggcgccgcctccttcggcttcgccgcatcctcgccgacctcgtccacccctccgtttcgcacgccgaccgccggagcaccgtcgaccccgtccacccgagccgcgccgccgccttcctccgctccggtcgccgttcccgtcgtcgccatcgacccggggtgagccgtggaccgccgattcgattcccccttccctcccctctctcggccgccgctccgccgtacctatggccgccgccggcgaccataggggcgcgggcgcgccgcctcccgttggctgtgccggcgtggccgccttcgggcgcgccccgcggctgccgtgtggggcccggctgtcagccgcccgcgcccttaggtgcagcagacgcgtgggacccacggcgccggccggtgcgagcccgggtgcgcccggtccaccgtgggccgtggggctgccgcgtgggccccactcccgtggacccagtccgtgcgcccctcccctcggctgacgcaataaatccattttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgtttctgcttgttatacggagtttattagagtaaaagccttttcttttccgttggtcgtgtagacgctgcagcttcggaagatccgctcttcgtggaggttgaagccgacgtttgggaaagcgagcaaggcaagtcacatcatctttgaacatattgaatcctagtttataaaattatgttgctttaaattattgcattatcgctttatttaaattcccgcgttatcactgttttatctagccatgcctatttacctttgttatgaccttattattgttattgttattatttccttgttcaccctagaataaacaaaaccccaactagtggacactctactcatgataccactagtatgattttaggtagattcttcgctatttaattaggtaacattaggtggtttttcaactctatactttgggaatattcatatcacctggacactatggaatggtttgattattgtggaattggattcacacctccccctctattcaaaaccctcaaaatggttttaggctgggttcggggtgcatggttttgatagtagcac

SEQ ID NO: 14560 - DNA, 1501 bp, Oryza sativa
aggacgtggccctcgtcatcggagcgggccggcttcctttttcccctcctatctcgtcgcttaggacgtggccctcgtcatcggtgctgggcgagtttcaggcccatgcctcctccttccgcgccaccttgtctgccagctcgaagagctcggcagtggtcatgggctccttggaggcaatcttctctagcatgcggttgtgccgcacgccattccgaaatgcataaacgaccgcgtgggccggaatgcatggaatagtgttgcggacctggcagaagcgttgtatgtacgagcggagggactcatcgtccttccattgcacagtatgcagctctgcctcctctcctaggcgggggtacgtgccctggaagttcgtgatgaaaactgctggcacaggtccacccaggagtggatggagtcggggggctggggcatcagccagccgcgcgcctgaccgttgaaggccatggggaagtaattcgccatgacccgttcatcgcccccccactgccgtgatgatcgtggtgtagatctggaggaactcggagggattaatgctgccatcatacttctccgtgaggttgggacgaaacttcgggggccaccggacgttctggagactcacaacgaagcccctacaaccagtccatccaggggtgaacgtggggggcgggccgcctcgcaaggaggaacactacactctggaggaggatgcgccttctcccatgcgggcagcacggcgctcgtcctggcgtcgctcgatgttgatccgagcgtcctgctccccgtagaggccatcgtgatgcctctgatttcccgaggcccccgacgatgttggggccgtggaccgcctcgaggtcatggctgaccgacgggcgctccttttcaccgatgaggaaatggtgggggggtgcgtgacataccagtggcggtggaacggccacccacagccagctaccgctgggtagtggtgaccaggttggcgacgtcgtccaaccatcgcctgacgggggtctccggctccgagttcacgggaggatgccgtagaagggctcccgctgtccgaagcgcgcctcggggcgagccgctgtcgccgtatgtcaggcggtgtcgcgctccgatgcgccatggcttccccctgcccggaggcggggagagggctgagccacccgaccgggtgggatcctccctccgcgaggggtcgcggcggggcggagtccgagagttgcggcgacggtgatgggggccgcggctcccgctagcatcctcactcccgaagggagtgggggtgtgcaccaccacttcttccttcaagacctcgaccatgatcgtcgaggccggaggaatacttggggcggaagaaaacgacttctctttgaagcgccacctggtgcgccagctgtcgagaagtgatcctctctagccttttgtgagttcggccgggggaaagggtttgcctctcgagatcgtgtatcctccctgagggtttctagatcgcgta

SEQ ID NO: 14561 - DNA, 1501 bp, Oryza sativa
  unsure (1)..(1501): unsure at all n locations
tgaattatatgacgtacgaactggtgtaaatgatgtcattattgattcgtctactaagggccaagtttgggacttctgtccatttgtcttacagctcagtttgacatcaatgatctgtccattaggttttatgccaagttacatactaataatcttgcctgagctgtgagcacacttctacatttcggtgccgaatcatttcgttctctctgttgagattgttccgactgatgtttcattccactggcctttgaattagacgccgactgcaaattgatatacacatcttgctgcgtaagacgagtttacgtttgcctttatgagcccaaggtcacgtttgccatagccgcatgggttgtctagccgagcccacgaggaaattttatggccgcgacaaaatctcttgtatgctaagtgtattgccatcaattattgaaagaagtaagtcattgagtgattactcattaatttccctttaaaaggctattacctccgtcctaaaataattgtatttctaagattcaaaattcgtcccaaaataattataattctagagttctaattgtcccatcgatctcattcaaatttctccttattttaccatcaaccatcttctcactctcatataaacactatttaatgagaggtatcatatgctttcttctcaaatatttatatatgctaaataacatagaattacaattattttgggatggacgtagtattttattgtaggatgctaagtgtattgacaccagtcgcttagggtatcgggcgaacgtacgtacccacaagcaaaaaaaatcgcacctacactcgtgtgtgtatccggcggatccatcgacaaaaaatgccatccctatatatcctggtacgtctccttggtgcaaggccgtacgataggaacgagtttggaaaaccgaagacgttggtctgacacgtagacgactccggaacgaatttctccgtgtcgtcccgtcgtccggccgcaacaaaaaaaaaaggtttgaaaaccaaaagacgttgatctgacacggtagacgactcgggacgaacttgtccgtgccgtccggccgcaacgaaaaccaccaaacgtgctgcaatgcatggccattggccagcaatcaagcctatccggtgggtgcggacggacggcaggcgcggcgaacgggaggccagccgcgcgtcgcgcccggggagacacgcatgcaaatccaaagccgctagtggagcgcgcaacgttgccgagtccccgctgcttataagaggcggcgaggcggtgccacggccatctccgtccttccatcccagccgcgcgcgcgcgctcggactgacccccacccccaccgaggcaaagcctcgtactccttccctccaccaccaccgcgcgccgtccgcgcggctgcggctgcggctgagggcgaagccctccccctaccccnnnaccccaccccacctcatcactcaccaccaaactaataaacccgtcctcccctccccc

SEQ ID NO: 14562 - DNA, 1501 bp, Oryza sativa
tgatgcaaaatcacctaactaggcccgaatcgatcttcactccacgtccaggttgagaccttacacatcctgtcacctccctcttcccatttgaaagcttagggtttcctatttcgtcattgccactcaatggattccctcgttgatgatggaggccatcctctcttctttagtgactgtagcaggtagccacgacttcatggccaccagctctagcgtcggcatgcttgttgttgtcagatctctagtgggtggtaaggtcttgctacccaggaagaaggaaggactcgaagaggatgtcaaatccagaagctcaaggggcgccatcatctccaccgctgtcgttggtgttgggatcctcctctccttgccgtcgccagggttcactctatcggttgaaggtttttgatcgggagtcaccgaaatttcagaaatttcagaaattttgaacaaaatttagttgaatttgaacaaatattacccaaattcatgaaaaaattgaaaaattcaaaaatttcggccgaattaatatcgtatcggaggggaccgaaatgacggaaatttcggttggaaatttcggaccttgccgtcgctgctgatgatgccatcatcctgacaagctattgccccccttcttgagccaccaaaacagttagatctgacacgcgagatcataagtgtcagaccaaatagccttgagctcctgtccaacggatctggatggacaagctccgatgatggtggcgaactgcagggagcgatggtggatgagcagcgacgagggcaaggcccgttttcttcttccttactttctttagttgcctgtaggtatatggcggagttttactgtttaacacagtcttaatttgtttcagtattttttttttcaactggctagtatagtctcaaatcatattgtgcttgaacctcttttggatgaattggtcttataaagtttattaaatttgatattgggattttctactaaaatttagcatattttagacttatgcaatatgtatattttatactatatatatatatatatatattatattatagaggtaaccttactcgctatcaaatgaaatgaagaggtaattaaccatactcaaagacaaaattggcttgctagctctgtccttatttgcattttctgtccaccgactgactgtatttggcgattgaggtcggtgcaggagtacacgcggaggctggtcgtcatggatcatggagatgagtttattgcagagagttctagagagtgtacgtaggcgcgtaaatcaacaggtagcgtccacgtcgctgctgcgtgtcctcgcatcagctttcatcacttcaattccctatatatatatgtgtgtgtattctgttccttcatagcaaattaaaggcgatcatcgatcgcttaactaattatatatatatccagccagccgcatcaggagagatcgatcatatacatcgatcgaagagagagagagagagagagtaattaaca

SEQ ID NO: 14563 - DNA, 1501 bp, Oryza sativa
tctgacacttctctttcccctcttcctctctctcggacgccgtcgagagtagtggccgagaggcggacggtggccggtggaacttcttgctaccttttagctaagtttctactctctccattccaaattaaccaataaaaccaatgctaatttaaacagcatcagagaacaagaataatttaaatcgcattaagacacgatacacatatttctcccacgatacatatatcttaaaacacattatcaattacacattagttgtatcttaaaacaccttaccaattacacatacttaccaattacacattagcatataagaccttaccaattaaacattagcatacaagcatgcacacatttttcatgttttattagttatacttctttattaattatactctgatgaaattcgttatataatgaacaataacaattttagtttccaatttcagttatatgttgatcaatttaagaaattttatataattatacgatgattaatttagaaagaggaagagaagagaaggagagagtaattatatatcgaccgaggcgatgatcatggattatatagttctatttgaaaaaaaaaggctagctactagctagcagcttgtcgcatagtagtactatgcattattcgtactagtattacatacacacatacgtatacggcctggcttaattagcaggagaggagaggagaggagacggttctagcacgcatgtgcatatgcttgaaggcggggcagggcgcgattacgcttggcggcccaccaccttgtgctgctgctgatgcgcgacgcggccggcgtcggagaagaggtccacgggctccgactctgcgatcttcctgcagccggcctcatcttcttcctcctccggacagacgcggcgagcctggtcgaagagatcgacgggctgggagtcagcgaccttgccggcctcgagcggggtgccgttgatgaagccagtccgtagcatctcgtcgtcaccgttcaccttcgcctgggccgtgccgtgcctcacctccttcttgctcgtcgccatgttaattactctctctctctctctctcttcgatcgatgtatatgatcgatctctcctgatgcggctggctggatatatatataattagttaagcgatcgatgatcgcctttaatttgctatgaaggaacagaatacacacacatatatatatagggaattgaagtgatgaaagctgatgcgaggacacgcagcagcgacgtggacgctacctgttgatttacgcgcctacgtacactctctagaactctctgcaataaactcatctccatgatccatgacgaccagcctccgcgtgtactcctgcaccgacctcaatcgccaaatacagtcagtcggtggacagaaaatgcaaataaggacagagctagcaagccaattttgtctttgagtatggttaattacctcttcatttcatttgatagcgagtaaggttacctctataatataata

SEQ ID NO: 14564 - DNA, 1501 bp, Oryza sativa
attaattggtagtaccaaaatctaggtaaattttggcactatcaattttttggtagggcaaagttagctaatctatgtttggtttaataccaatataaagctaaaatttagtatgagagtgaagaagattatagaatgtagccaaagtgagcgtgggcactactaattgtttggcttcaatctaaactagcatgtttactattaaagttaccaaaattttggtagggtcacagaatgttaaaattgttcagtttgaattttgaataacatttgctttgacatgctgatttactctaaactgtacgaagcctgacaaaatggtatctgatcaatttcttgatctgcagatgagagcgtggtcgctcttgccaatggctgccctcacctgcggtcgctggggctctactactgccagaacatcaccgaccgggcaatgtactcgctggcggcgaacagccggcgggtgaggagcaaaggccggagctgggacgcggcggcgaggaagaacgccggcgccggcgccgacgggctggccagcctgaacatcagccagtgcacggcgctgacgccgccggcggtccaggcggtgtgcgactccttcccggcgctccacacgtgcccggagcggcactccctcatcatcagcggatgcctcagcctcacctccgtccactgcgcctgcgctcaccacccgcaccgccatgggagggccatcctctccaaccatgcctactagcaagctccctcttgtagaaactagaacagctcggatttgaggaagatgtaaattaaaaccccaggattgcttacgatggactggggaaaactgcttctgtgtttgtggatggatggtgtcatggatcatatgtttcttttggatcaaaatctctgaagagtatatgcatgaggaataagtttactttgtgacccttaaaagtgatcgaaatctaatctgtgaccctaaaccacaaaaccggatatctcgacccccaactcttaaaaacggtgcaatttgactcccttggtggttttggagggcggtttcgctgacgtgacgcttatgtggcagtattggctcggtcttctgtccacgtggtgttgatgtggtgcttacgtggcagtattgactcggtcttctgtccacgtggcgttgacatggcgcttaggtggcattagaaataaaaatatatacgtgggacccatttgtcattcaccaaaagtatgggtgggacccactgtcatgtggggctcacataaatcatattctcccctctctctttctctccgcgagtgtgggacggtggccagcggcggcggagtcctgggagtggcactggagcggtgacggcggcatgcgggcgagggccggagcggcggcggcggcggagatcgagcccgccgtggaaggttggccgtcggaaggaagaaaacgggccacgagaatggccgtgtcctcgccaccctcggcctcgtgactgcactatccaccactgtgctccac

SEQ ID NO: 14565 - DNA, 1501 bp, Oryza sativa
gtctgtgctgcagctgactataaatctatagcctgctactcttctctctcctcttttatcttctcgaaatgtgcttataactggtttatagtccgctattgtacctactatactagagtggcctatagtactagtactagtagagagagaggggaaacgaaacagtaaaagctgaggctcggcaagttatttgagctcaactcggaaggctcgcaagcttaaagtgaagctcgagctcgattttaatcttaaacgagaggagctcaaatcaagtttgtaacgagccgagctcgagtagctcgtgagcctcaaacttttttgacaaccctaattagtggtagctgtccatacgtacaaattgataaaatacagtgacccaagcaataagctgtaggcgagaactacaagaaatggctcatggctagcagagggaagttagatagagggtagcggtaaacaaaggttgagaagttaattaaagatggtttggcttaaacaattaccacgcctttgtttatatttttccctaaattaccccttaaagaatgaacgatggatgtgaataagaggttgagcaccataaaaggtctcaatgtataaatatgaatgaagtaactaaaataatttataagtaaagttttggagtaaattgcgttgacaatacaagaacttggcgggtggggtgtgattaagtgcaagaacttgaaaattggacgtaccaatgcaacaacttggctaggtgggtgcgtttgtgtggttcaaaaggctgccacgaaagaaaatttgccacgtcagctgtccaccttggacaaagtcccatgtcaacatcagcatcataggaatgaggtcccatctaattttacaaaaaaagtctcctaataattcttatattccaattgtttcttttgttatatcacaatgaacaaatatatgtgcctttcttctcggtttctcttcgtgatttcctcaagacctcaatagaccgagaggcaacgacggttagcagcgagtgcaagggaaaacgacattgcttctgcgctagttgtgagggcatcgtgagccacactgatctgattatcctaaaccggtgcccttactgattcagatctgattatcccaaactggtgcccttactcattcagacctgggaactgtccctggtggtgtaataaccgcatgcgcagggatggcgccgactcggcgaattcttggggtatcccctccttatggtaaatcacttcctggtggtttcatatttttatttttgttcaattggttattgtttatatacttagggtttcattgatttggaccggttgttgcctgtttgtctttttttctgcttgaatcttgtgatgtttattattacatggcaatgtagtctaattactggcacactagatttcttaactgagatcgattgtactgtaagtgttggtgttttctacggctgagtgtgatataattgtacccttcaagaatagttcttgacatacctggc

SEQ ID NO: 14566 - DNA, 1501 bp, Oryza sativa
ttttattcttgtaggattttttttcctatatacccctttaaattaaaggaatgaatcatattgaatactatgaaatttctacagaataactcattacatacaagttttcgaggaaattaaacatgaggtagaacctcatggaaagttatctttgagtctttatttcttctcaaattcctgtgttttttcctacggtctaatcaaccggtcattcctttaagtttttatttttttccattcctacgatttaaaggaataatgtattggtcttggaacatatgtaaagctagcttttgcatgagagctaacagtctaacacctttttttttgttttctcttttatccacataagtttttatagttggtttatagttcactattatctttgttctgtggttatctctattttctctctatatataaataatgcatttgcttagaagaacgtactccctccgtttcacaatgtaagactttctagcattacccacatacatatagatgttaatgaatctaaacatatacacatgtctagattcattaacatctaaatgaatgtgagcaacgctagaaagtcttacattgtgaaacggaggaagtatatagctagctagctcctgtatgaaaggtagcactcactattttttttctcaactccaggtaagcatgctattgaacttgctcttaggtaaaaatcgacaaccataaaaaccgcctggcttttctctggtttttcgggtcttttttttttttttgctagagctactaggctctccgtcctccgatcctccatccatttctcctctctctctctctctatccatttcctatctaccgcctccgggcgagattgccttcccacgggcacaacctcctttccagtgcggcgggggcctccacggggcgcgtaggtctgtgggaggaggcgacatggaggctgacttctcctgcaagtagtgccacctacctccatctttgctgcaatcgagctcaaggtactcaaggtactcctcattctcccctcgtttccgcggcagttcatcagccgcacttgagcatattggaaatgtatcccaaattgaatccccttgggatagaaaaagaaacaaaagggaaaagagagagaagtttttaatcggtttacctggtgtcaattcatatttgttgtgtgttgttaattgttatgaattaaagtatctgcgagaattggagtattttttttagtttgaataagtggtggacgtaggattttataaatgggggtacgataaactaatttatttataaaactgtttgatgaaaacaaaacaacaaacacatggaaaatagggaaaccttatattttattaatcatgattcattaacatgaatgtttatagatacatgggggctcccgtaggaattcgccttttgccttcgtgaggaatgcttaataaaaaggtatgctgactggagattgcttgtagtccgttgattcccagcgcctagtaatgaggctacc

SEQ ID NO: 14567 - DNA, 1501 bp, Oryza sativa
ggaccacctgtataccaatgactttcgcagacggtgcaatggcccgcctgcgaaaatcctatggacgaacaaaaaataaaacgtgccccgccggccacgcacctcgccaccgccgccgtcccccggcctcctatggccggatctgggaggggaggggagccgcgccgggagccgtcatcgtcgccgccccgcgtcgtggctggccacacgcctcgccgccgccaccttcccccggcctacctccggccggatctaggagggaaggggagggaaaccgcgccgggagccgccgcctccgtcccgcgccctgccagccatgcgcctcgccgccgctgccatcccccggcctccctctggtcagatctgggaggggaggggaggggagctgtgtcgggagccaccgccgcccgccatcccgccggccacgcgcctcgccatcgccgccctcccctggcctccctccggccggactgggaggggaggggaggggatgggagccgtgccgggagccgccgccgccgccccgcgcgttgttgtcaccaccccacaccccgccggccacgcgcctcaccatcggagccctcccccggcctccctccggccggatctgggggagagcgcgtcgggagaagccgacgtcgccgtccatgctgccgctatcaccacgtccacgccgtccgtgctgccgcggtcgctccccctccggcggggagggagggaggggaggagagcggagggggatggcccggtgggagaagtgttgagggagcgagagagagttgagagggaaatgagtggtggggaggggtggaggagaagataagtacttaatttttttttgataggtacgatttttgcaggcggaccatataaggttcgtctgcgaaaatagattttcgcaggcgccgcttaagtagtccgcctgcgaaaatgcgccacttaagtggtcagcgaacttcaccccaatttatattttcgtagacggtcatttggttccaaggatcatgtccgcctgcgaaaaaaaggacctccacgtcgggaaaaatgatttttctaatagtgagatcttgttaatgtagtgtaacaaaacagcatggcatcatggatatgacttatgtcgccactaggacaattggcttcctgtggatctttaatatgttcgtgacccatgagattgtttttgcactgtgtaaaagaaatggaaaatatcctatgatcaggggcctcatgtttcccaatggaaaccatattttgttacacaaacaggtttgtagaataagaaagagaagaaaccttccttcctaggccaggggagtccagagttgctatgagaacattatgatagttataagtgcatctacaggtcccaagaaacaatattggtgcacacacattcacaccgtccaggtttcacattgtggagcatagtctctttaatgtatttactttttacaatgttttgccgcaatcctttcccaattcagtagcttccatcatttgc

SEQ ID NO: 14568 - DNA, 1501 bp, Oryza sativa
aaagtaatcaatgcaagcaggccataacaaaggaataggttcacaccacccagtgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcgcgaaccttcgcaacgacggaaacgacaagctaacacgcaaaacgaagaaaaagactaataaaaaccaaataaacaatacataaaaagtaaacaaacatgtagatcataattttagatgaattatgagacttgaacggcctcattctgatttcatatgaatttattatgaattttacaagattaaattccaattaaacctattaaagaaaagactattccaaattaattaaacaatttacaaatgatttataacggagacagaagattaaagcaacctccggaaaagattagattatattggtagatgacatgataaaaagaaaaaggactaatatgccattgaaaagatagaacgaatttatattgattttggacggctgagattaatcttgaccgagagttgaccaagatcggatggcttagattgatctggcaagcgggcctcacgagataccgactcaacgagtcaattctacgtgacacgggatcacccaaatgatcaaccgaaaccggcgaacggaaccggcggctctgaactaaaggacgactcaacacggacgaacgaacgaagcacggggaacacctcattcgaacgaacgagcgaacgactcaacaacggctgcggctaaaccggtggactagaaacgattcatggtaaaaccccggtacgacaaacgatagaccggtaggaacctagggttgcacctacggctgcacaactcgactaaaagcagcggctaggtttaagcggcacacaactgcgacacggcggcactagggcgacttggcttggctaggcggcagctcagcggatacacaaagctagggttagggtgacggcacagccggtagcaaccatgcacggctagaacagcagggctatgagcaaaaacgcaaccggcacggctgcggctgtggcaaagcggcaagcagctgcagctaagcggctcagccggcacacgcgcagcagcggcacggcaagcagcagctacgacacagcgatgacgacacacacggagacgatgatgacgttagggccaaacaagattagattagatcggattaaggccctagggaaaacctcacaggtgaacggcaaaggagcggcggttgccggcgaaccacggcacaaacgcaaacggagggcaccgggagcgagaggggatcaaagtgacccttaccaccacttatgcgacgacagacggcgagggagatggcaggcgacgagctccaaaggcggcgaccttgggttgacgatggcgacggctttccggcgacgagaggcaacaaccgagggcg

SEQ ID NO: 14569 - DNA, 1431 bp, Oryza sativa
tgttcagtcatgttactcgctaacatatttgtgatcagaatccctcatgttttttaacggagggattagatggcagtagtttacgtttgttagaacatttagatggagctaagcatacattttacatgatctattagggcaaaaaagaacggcactgatatgtgaatacgtgatctttaataatgtgccaatattatttgcttaatctatatgtctagtctatctttggaacttatcccattgaagcctggtttggtttagaggggattgaagaggattgaagggaattaagggggaataattccacaccataataggtgtggaataaatcccctccgatccctccctcatagggattaaccgaacaaggtctgacagcgctcttgttcgagtaacaacactggtttatttattgttgtcttaaaactcttagagctactgcggcctcttaaaatatagcccaagctagggctcttcttcccctctcaaattccttaggcaactggctggcagccggcccctctacaaattccaacttgaaaaattcagtctatatacaagtattgtgataagaatggaaggagttaggaagaaaatcaacacgacaagtgttggtcatcatctccaacgagcacacgacattacatgttcttcccgtcgattatctcccatgcccagatgttttactacttagaccctctgggtgaggtttagcactgtggtctgttggctcatcggaaagcagcggcaaccggctctggcccctgctatctggcaaagaacagaatgcagacatttgaagaacaggacgagcttgagcatgcaagaacggtaagctgtaccgtgcggaggcgacgtgatcggctcatgtagaagttaatttagaaccctagcaaccattatttgtttcatgagctatgggtttaaaacacgaccagccatttgatttttgcaacgactttgtatatgtagaacgtttacgaaaggcagaggacacaagtcctataaaattaagcatattgttatatatatatatatatatatatatatatatatataatttctgtacatatatagcataaatatatattctgaagatgcaaaatatgtgcaaattagacatcgatcaggtcgatgcaaacaaactagagtattgcatagtttcttcagttgccatatagtttgctgcaatttttgttccattaattatattttgaataccagagccggggaaattctttcacctgtttcatcagttttagacaccagggaaaatcaattttcgcaagcttgcatgggaaaacaaattaatgctagaaaaaatgcccatgtctgctggtgtcaagctaaagtgaactgcgagtgaaaacaatttttgaagacaagaaatttgaaaatcatgacgacgatggcaagctccaaccccggcca

SEQ ID NO: 14570 - DNA, 767 bp, Oryza sativa
cctcaaccgggactaaagatcttttcccgctatttccaaattctttttaaacccggttagggttaagaaccgggactactgataagcgcactgaatattattttccattacatatgtgtttctaaaatagaagataatgcattacaattatttaaagtacaaagattaatgacaattacttcgaaaacttattgttgtctgtaataaattaagtggataaaacgtaataagcaaatatatgatttaaaattaataaaaattctaataatcatatatacttagcatatgaatgatattattaaattggtaaaaactctaattaacatatgtatatacatacggcatgatttaaaattaataaaaattgtaatcatcatatatacttagcataggaattatattaaattaattgttaaaaactctaattaacatatgtaaatgccacatgcatgatttaaaaattttaaaaattcgaatagtcatatataattagcatataaatgatagtaaattaaattgtgaaaaactctaattaacatatgtaaatgccacatgcatgatttgaaacttttaaaaattctctagtcaattataattagcatatgaatgatagtaaattaaatgttaaaaactctaactaacatatgaaattgccacctgcgtgatttaaaacttttaaaaattgtaagtatcgcatataactagcatatacatgatttaaacttgttaaaacctctaataattgtgcgtaattaacatatgccata

SEQ ID NO: 14571 - DNA, 1501 bp, Oryza sativa
cgtgctgggccttttgactccttgccctcctatagtcctatttgcttgcagctggtagtccactagagtagtgagatatttttttcatggccaagcaagcaatgttgttgtcgtgtgatcatgttagtcaaattgcagacgtgtgcatacatgcaacatatcaccaatcattcagaaactttaagttctactctctctctattccagtttaatcatcctctaaataaataataccaaaactaaggacactaaaatgtatatcattcttaaattaatcctcatcggttaaggtgcttttactacagtactatagtattttttttcctttttcttttacttcatcaaaacatctctgttttcgccttgcagccttgagagtttttgagtccctgatttgttctgcttgttgctggtgactgctgagcaatttggtgcaatacactgaatctgatatccgacattgaatccagaaagcatgcgtgcaacttgctctggctggctaggcatgggcgtctgtgttatccgtgcccggtttgcgatctgtgtgtgtccctctgcatgcgacgaaacggcacgcatgttggtttgcatctatcagacattcagacatagaggagaatctttcgtacaagaatggtggtgcccatgcgtgcgaccgtgcggaagctgcaacagcccgtgacacacgcacacccccacgcctcgtcgacgacagcatctcagtattggaatcgtacagtaaaacaatcttaatacatacaagtggcagccaatctgataatacactaaacctttttttgatctttgttactactgtaacaaggagcagaggtcatcttctccttaccgtgccggcccataaaatttatggcctgggcctggaaagaccatggcaggtgttgggctggtgtcgcttgcaatgggcccgaaacgaacgtgagcccattgggctggcaccgatcgagagcttcgcgatccatcgactgcacagcaggccggtgtccagttcccgtgcgatctcctcaatccggcccgttcccgatgcccatggccgtctgctgcttctgcctccgtgaggcctctaatcacgaatggaagtagatcatgatcatgcataggaataagttcacttgatgaccctcaaaagtgatcggaatctaatccatgaccctaaatcgcaaaaccggatatctcgaccctcaaactattaaaaccggtgcaattttactcccttggcggttttggagtgcggtttcgctgacgtggcggtattgacctaatctgtgtgctgacgtggcgcttacatggcatttcaattaaaaagatacacgtggataggaaggatagctatactaatttggtatactcaaaatacacctttggtacaaaattgacaatctcacaaggatgaaatatcagtaattttctatttactggttgatcccatcttttacggaatcaattccttttttgaatgtacaaaaatttggggagctcagca

SEQ ID NO: 14572 - DNA, 369 bp, Oryza sativa
ggaaaaaatccgaattactcccgaactatcacagtcaaccgaattacccctaacttaaataccaaacattttacagtcaactattcgagccagacaaataaccatttgactccatccattcttattttggtcctacgaggcagcaagtagtcaacaacttttttaaaaaagaatcggtgggaccaacctatcagattccctcccctctcacctctctctatcttagcttcctcattccccaccttctctctccctcttctcccctagctcaagagtgcggtggtggctggcccgtcaagctcgccggttgtgcctccatctcgttagcacaataagcatactgccattgtgacactctcccacacgagc

SEQ ID NO: 14573 - DNA, 1501 bp, Oryza sativa; identical to SEQ ID NO: 14319

SEQ ID NO: 14574 - DNA, 1501 bp, Oryza sativa
gcttggcttccaacgtagccaagaatccgcgaccaactatgcttaggttcagggcttccatctgttgattaagttcgggcgggatgccacggacgttaagagtgttgcaatggctttttcgacttagagcgtcggcgaccacgttggccttaccaggatgatagtgaattcccacatcataatccttgatgagttctaaccatctcctttgccgaagattcagatccgactgggtgaagatgtatttcaaactcttatgatcagtatatatttcacagcgattcccaatgagatagtgccgccagatttttagagcatgcaccaccgcggctaactccaaatcatgggtagggtagttgccttcgtgagtccgtagctgacgtgaggcataggccaccacatgaccgtcctgcatgagcacgcaccccaatccttggcgcgaagcgtcacaatacaccatgaaatccttgcgagtatccggcaagattaacaccggcgaggaaaccagcttttctttgagagtttggaacgccttctcgcattgcgggctccacacaaatttctcttctttcttcaacaactgtgtcatgggtcgagcgattttgaagaagttctcgatgaacctccggtagtatcctgccaaacctaagaaactgcggacttgagtgactgtcttgggttgcttccaatcagtgacagcggtcactgtttcggggtccacagcaactcctttaccagatatcacgtgccctaagaatttgacttcggacaaccagaactcacacttgctaagtttggcatacaattgatgttcccgtagctttcccaacaccagacgaagatggtgctgatggtcttcctctgattgtgagtatatcagaatgtcatcaatgaaaaccacaacaaacttatccaagtattccatgaacactttgttcattaagttcatgaagaaggcaggtgcattggttaaaccgaatgacatcaccgtgaattcatacagcccgtatcgcgtggtgaatgcggtcttcggaatatcttcttcacggatggcaactggtgatatccggaacgaagatcaatcttggagaataccgtggcacctttaagctgatcgaacagatcatcgatccggggaagagggtacttgtttttgatggtgacttcattgagagctctgtagtcaacgcacatcctcttcgtcttgtctttcttctccacaaaaatcacaggagcaccccagggggaagtactcggacgtatataccccttttctttcaactcttccaactgtttcttaacttcggccagttcatttgctgccatacggtagggtcttttgtacaggggagtggttcctggagcaagatctatccggaactcaatctctcgcttgggcggcataccgggtagttcttccggaaacacgtcttcgaactccatgacgatggggatttctgacagtcttatctgatgaagttctgaacttctgacagaggtt

SEQ ID NO: 14575 - DNA, 1501 bp, Oryza sativa
aactttgaggagttcttgccagtaaacgaggcctcgcggcggcagagcgagtccatggcggcggtgacccgcgctctagctcaccagcagctgctgcctcctctccagctccacgaacctggcgctcaccgcgtccccctccgcctcttccgccgacaaggccatggggcccacctcgaaactctagccgccgccgccgccatcgaccccacgggcctatgagataactcgggcggcggtgttgtgtgccgtgctccccgcgcttgagacacaccgcatgggaaatttcgtctcatcaccaaacagaggagcaaaaatgatttcgaaattatacaaaatggccaaaatggtaaaatgacggtgagcacgtgctccatattgacattttaacgaaatgcgtttttgagatggtattctagcgaaaccatgttttgaacgtggctaaatgtccattttctctggaagagcagaggttgacagatccaagcagcgtgaccacgccagtcgccaccgagctccgtgcttagcttcctcaccaccagcaagccccacgtcgacattcagtcccctcgagctgttagctgcatcgtcagatctgtggactgtcaccagcgcggacgttagcccctctcttggttgcctcctcgccgtcgtcgacgcgcactgagcagctgtgctctatctcctacgccgatcatgcatggcaggtgcagaagcacaaactaggaggttctatgggaagtgggaactcacgcggaccatggcaatgacacagtcgctgcaatattcaaccgcaactccttggacgcgcgactatgactctttttagatgggactaaaactttactatcacatcggatgtttgatactaattataaatattaaacataggctattaataaaacccatccataatcttggactaattcgcgagacgaatctattgagcctaattaattcatgattagtctatgtgatgctacagtaaacatgcgctaattatggattaattagacttaaaaattttttcacgcgaattagctttcatttatgtaattagttttataagtagtctatatttaatactccaaattcaaccaatacgatagggactaaagtttagtccctggatccaaacgctacctacgtctcaggcgcccgatccgggggtggaaaaatcggacgcccacgtcaccatgcaaaactactttcaactattttttctcttaaattatttatccaaatcatgatccgattacaccattaaattcgttgtaattaaatctttgaaacaagatctgttgatgcgaaaacacgaggcttgggagatctgcttaactccagtgcaggtccaaaagcttgcctttaggttcgtgagcgtgccagttgatttgatcctgcaatcaacaagaaagaaaagcaaagaaaccgcggttaaatccataaacgatagccgatcggctagttgctgatgatatatcatttacctttgagccgatgt

SEQ ID NO: 14576 - DNA, 1501 bp, Oryza sativa
atcaaacatttatatgtactaaactgttctatccgtggatctcctaggtcccaacatttactatctgcccaaagtaccaatggttcgtgtaactttcacttcccaaactgaccagatggccaatcccccacccaacatattcacagcctagagtgatagtagaacatgcttggatggacacatcggagtgggagaaatgaggccagctggtgaacatgattaacaagtgagcgcacaaataagtgaagcaacggctgcattaccaccatccatctctagggtctactccctccatttcatattataagactttctagcattgcccatattcatatagatgttaatgaatctagacatatatatgtttagattcattaatatatatatataaatgtgggcaatgctagaaagtcttataatatgaaacggaggaagtagcatatatgaatcataaaacttcagatctcaaaaatggtggtgtcaagtgctgtttcattacgaatttaatttttagtctattattcttaatttcaatgttaataatcagcagtatgtgctaatatatgcaaaaacataacgcacataggagaaccaacttacatcttatggttacggatgcctcgagaggagaagcggaccgagggagcgtctcgatgagaagaaggggaactaggggagtagggggagccaggagaggaaggtgagccaacatctgccatcatctcaatcactatgatcctgagttaaaggaatttccagatcatgtgttaagctacttctaattatatatgaatgatttatggcagaagatgtgctaagtacctctgacttctctgacttgaaggctgatgaacagccagagctgttgtcatttcctcctccacaaccatatgcatcttgccatcgccaacaagtggggtactctccacaaccatatgcatcttcccatcgccaacaagtggggcaccctccacatccatttgcatcttcccatcgccaacaagtggggcacttcagatgaataaaagaacaaggaaatcaatataaaggggagtaaaatcaatcactcaatcaatcaatagagctaagggtaaacatgcacaacttgaaattcaatccgtgtggctcggaaggggtcggcaggttggggcgcacgatgtaagcgggcgatggtaccagagacggcgttacgggcgctctgcggcagcaatcgattcttaggttaagtcatgctcatggcctcatgggtgtggagagggagggcatgaatgaacttacggaagaggctggccgaaggctttatcgaagagtttgttggggaaaacagcgtcccgcacatcccgtccttctaggagcgaccgcgagttcaccggcgatagtgagcggcggaacctatcactccctttcggcagcgaacaacgggccgacgagcggcggaacctaccacttcctttcggcagcaaagaacggcccgacgaggcgccggcgccggcgccgccct

SEQ ID NO: 14577 - DNA, 1501 bp, Oryza sativa
agaaggacgggatgtgcgggacgctgttttccccaacaaactcttcgataaagccttcggccagcctcttccgtaagttcattcatgccctccctctccacacccatgaggccatgagcatgacttaacctaagaatcgattgctgccgcagagcgcccgtaacgccgtctctggtaccatcgcccgcttacatcgtgcgccccaacctgccgaccccttccgagccacacggattgaatttcaagttgtgcatgtttacccttagctctattgattgattgagtgattgattttactcccctttatattgatttccttgttcttttattcatctgaagtgccccacttgttggcgatgggaagatgcaaatggatgtggagggtgccccacttgttggcgatgggaagatgcatatggttgtggagagtaccccacttgttggcgatggcaagatgcatatggttgtggaggaggaaatgacaacagctctggctgttcatcagccttcaagtcagagaagtcagaggtacttagcacatcttctgccataaatcattcatatataattagaagtagcttaacacatgatctggaaattcctttaactcaggatcatagtgattgagatgatggcagatgttggctcaccttcctctcctggctccccctactcccctagttccccttcttctcatcgagacgctccctcggtccgcttctcctctcgaggcatccgtaaccataagatgtaagttggttctcctatgtgcgttatgtttttgcatatattagcacatactgctgattattaacattgaaattaagaataatagactaaaaattaaattcgtaatgaaacagcacttgacaccaccatttttgagatctgaagttttatgattcatatatgctacttcctccgtttcatattataagactttctagcattgcccacatttatatatatatattaatgaatctaaacatatatatgtctagattcattaacatctatatgaatatgggcaatgctagaaagtcttataatatgaaatggagggagtagaccctagagatggatggtggtaatgcagccgttgcttcacttatttgtgcgctcacttgttaatcatgttcaccagctggcctcatttctcccactccgatgtgtccatccaagcatgttctactatcactctaggctgtgaatatgttgggtgggggattggccatctggtcagtttgggaagtgaaagttacacgaaccattggtactttgggcagatagtaaatgttgggacctaggagatccacggatagaacagtttagtacatataaatgtttgatatatctaaggcttataatttatttaggtctgtaatcaaatggtatatatgttattgacatgagaaaacattttgtagtcaataatacagaggggtgagatttatcatgttaacctttgaaacttttgatgaaatgttttaggcctcagtgt

SEQ ID NO: 14578 - DNA, 1501 bp, Oryza sativa
tgtatcaactttggtgtaccttgcctcctgggacaaggaataatgcacgcacgtaaggaatgcccgttgggttatttccggtcgtgacaaattagaaactatgcttgtggttttggacatcactgcatttagggcctatttagatctaatgccaaaactttacaccctatcacatcgaacgtttgacacatgtatgtaatattaaatttagacaaaaaaaataactaattacgcggactgcgtgtaaattgcgagatgaattttttaagcttaattagtccatgatttgataatgtggtgctacagtaaatatttgctaatgacggattaattaggcttaataaattcgtctcataatttacaagtggattatgtaaattttttgttactagtctacgttttatactttaaatgtatgcctacatatccaatgtgacacgccaaaactttgcaccccttgatctaaacacagccttatattttgttaaatgcaacctgttataggcataaaaatagaacttgaaactgtggtatataccaacctgttatttctaatacttctaatatatccagcagatctcctgctgtcatttgcttcaaaaaaaatatttttgtttcatattataagtcgttttgactttgattaaaagttaaactattttaaatttaactaagtttatagataaatatagtaatatttacaatatcttgggttgaaaatgttactactttttctacaaactttgtcaaacttcaaacagtttaactttgatcaatgtcaaaacgacttataacctgaaacagaggagtatattaaaagggtaaaaaaacttgtctggaaaatgagcagctgcagctgtgaaaacattacaagagaacgttgagattgaagttagcacgcagtgattcagatcgaccaaaactccggcagaagtgtcgtggagtcttcctgagtttgggcttggagtctagacttgtatatgggcttgcatatggtgtagccgtgcaggaatgggctgcttgcatggcgttggaccgattcatatatagataatagagtcgtctcacgccgtcatgttgttcgttgtcgccgtttcagtcggatgctagtcggatgatttgcgtcggacggatagcagggttgatattttttacagcttgtgcatgcacgtaatatttatagattatttcgatgatatctatagtgatttgttctattctattagacattttcctcaagaaaagttgaattctattagacattttctattagacaatattgtccccatatatgctaatttttatggataaactgagcggcgcaacggtttcctaatccatgtatgatgtttgtacggctgatcaacgaggatcgtcgaagggagcttgacctttttatttgagtttgatttgaccatttgtcgcgaccgagaaaattgccttttcccgaacgctagtatattaatccccgtcccaggaaaagccggggtacaccaaacaa

SEQ ID NO: 14579 - DNA, 1501 bp, Oryza sativa
ccggcggcgaccatcggggcgcgggcgcgccggcttccgccgaccgcgccggcgtggccgccctcgggcgcgccgagtggctaccgcgtggggcccggccgtcagccgcccgcgccctcgggtgcggctgaagcgtgggacccacggcgccggccggtgtgagcccgggtgcacccggtccaccgtggaccgtgaggctgccgcatgggccccattcccgtggacccggtccgcgcgccctctcccatcggctgacgcaataaaccctttttaaattaaattttaaatgaataaattcacaaatattcatttaaagagcaattcatgaaattattcatgaaatgcaattccatttattaaaaatacttccttagctcaaataaatcccagaaaaatctaggaattatagaattaagcaaagtatttaatgaaattttatctggccccattttatattggaatttattaattaaaattagatcttctcttctaagctttgaaaataaattctaataattccaattaaacaacaatttataaaataaggattttttttaaacaagaaaagctcttaacaattataattagatcattaatgatcaaataattactgaactgttatttgtatcatttaggaattgagctctgaaaaatccgagaatatttcagagagttgacttaatcatggagaatttaataaaaattaaatccatccatgctttaaatttagaaaattttatttcccacatttaacttcacttgtaaattaaagaacatttaatataaattctaataataatttattaaatgatttataaatcctgaaacaaaaatcaggatgtgacagatctaccccccttacaaagaatctcgtcccgagattcggaacggctagaaagaaaaagggaataggtaaactgcagtctatcttattccataactccgataattattctaaggctttaaagaaaactactgccgctttgaaactggtggctgagttgtaacacttgaagacgcaactcttgaagacgcaactggcactgcattggctcctgtgacgacaatgttgttgacttgcggctgctgatgctttggcttcggacactctcttgcaaagtggcctggcttgtaacagtttaaacatacctgctgctcccttccactactgttattctcttgagactgatcctgctgaactggcaccggatgattagcttgctcgatgttaacctcattgctttcattagtctctgatttgatctcaccaccgatgttcaactgctgcgactatcctggaccagcggaagaagattcaccaatttggagtggcttgatacgctgcctctggctactaccttgtgcctcctggaatacagtcattttccttttacggttatccatcctgttcttcttgtcttcaagtcgaattgctttgtcaactagctgctgaaaatcaacatagtcatgggagatcaacgtaactgacagttcatccttc

SEQ ID NO: 14580 - DNA, 1501 bp, Oryza sativa
ctcctggcgcagttccaggatcttcatgttgttctcgaccatcccgcgacgtaccatctggtggaagtcgatacgagccgcgttgtacgcctccaccatccgcgccaggtgcacgatggtagcgtcatcctctgagctagcatcccggaaggtggcgtagtcgcgggctcctccgcgacgagggtggtagcggtagggcgagtgttgcaactcgtccgggtagcgctggtgaagagtgccgatggcgaggagagcggcgttctggcaagcggtggggaaggaatctccacccgcggtgactgccagcgaagtccgctcgggagagccagagaggatcactgcagtgacctcccaaccagcgtggggctctgcatcgtcaccctcctgctccggaagcggcctggcctggtagtccactccgtgtggataccccagaaccacgcacatgccccgcaactccaagacgaagccagtcatgtccaaaccacgacgggtgacgctgccggccatctacaaacaaaaacaaaaagaaaagcaacattttcaaaggtcagattttggcgataaatgaagcagcaagacagagagagactagaggattttcacaaataacaaaggatttttatttttgaaaatattgctaaggcttgggatctacggctcgtcctagggtcaaaggtggctctgataccaacttgtcacgaccggaaataacccaacgggcattccttacgtgcgtgcattaatccttgtcccaggaggcaaggtacaccaaaagttgatacaattcagagtataacaagcggaagcgtaaatagttaatttattacatgggcagcgagggcccagcacacacaaagacaaacgagaaacagcggaagactagggtgacaaccacaggcgcttgacggcaggcacgagctagacaccaaagccttcatcttcaaggagctcctcttctgggtttggaaaaattgagcaagactgagtacaaccaccgtactcaacaagacacacccacaagtgcaggataaatgtaaaggagtacaagggggttatgatataaagggttagggtttgtagtaaacagccttaaaagacacttagttgctcaaagctattttgtaaacacgtttccagagctatacaatattattaatcaaggctgtgaacccacacgagcctgccttaacccaaggcctacgatgattcataccgaactggcaacccgaccctgggtcccagctcgtcccaagccaacccaggccatccgttccaccttttagttgttaagcaggttttaagaattaaaacactaacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagacgtgacatagtttccaacccatcctagcctt

SEQ ID NO: 14581 - DNA, 1501 bp, Oryza sativa
caagcaacccccaacgaaaaagcacgaatcaatcaaaattcagaaccaccaccaccccaagcgacgacatgccgatgctgattgactggatttcttctcctcttctccggacgcgactagcaagtacaaaaacgaatccggagatctagcggaggaggaatgcgtgccgccgctcaccgcgtgctgcccttctcccgcgacgcctcgctccgagcggcctcctctccgtcggcgcggcacgcgccgccgctcctctctcgtcggccgccctctccgccgagtgccggtcgccggatgccatcctctaaattaaaagaagaaaaagaatgaaaaagaaaagaaaacgataacagagaagagaggagtagggaggatgacatatgggtcccacgtgggtcctccaccatttgtttttaactgaagtgggtcccatatattttattaattttttttatcaaattgccacgtaagcgccacgtcaatgccacgtgggatgaaaacctagtaattggagcgctacgtaggcaccacgtcagtcaaaaccggggacaatactgccgagagacctttttgcacgatttgcacgatttggtaaattgggggatgcgttgtatgtggttttgtggtgtagggatgaatttcgaactcggctacaagttaagggacctcgagtgaacttattcctttttgtgcgagtaagcgcctgccgtttaacgttggttgaaaatcgtgcggtccaaggtctccataaggcctctttcggcaacgaaaaataacggcccagttgcagcggactatatgcgaatgtgccgggccgttccaacttccaaacaaggcctcacagtcgcacgcacaatatgacgggtctattttgtagaactctaaccgataaatttagtttcgggagttggacgtggagtggacttgtgtagtagcagcctaaaaccagcttacatctttagtttattttatgatagcgtctcacctagcactatttctattttaggcggagctgaaattatttggttagacttcacctcaagaaagatggagctggagctgtgataaatagagcgacgtgtcagagaacaagaatttccgtgtggaaaatagtgtgtttgtctcaaattgtacagatggttccatgagtgcacgatcccaagggggattccatgagctgtacatttgcagcttgagaaactcgtcgactgggttaaaggctccgtttagttaacacgtaaaaattttacgcactatcgcatcgatcgtttagtacatgaatgaagtattaaatataatctaaaaaataactaattccacagattacgactaatttgcaagacgaatcttttaaatctaattgctccatgatttgacaatgtggtgctacaataaatatttgctaatgatggattaattaggcttaataaagtcgtctcacggtttaccgacagattttataattagtttttctattagtgctcgaacaccccatacgaca

SEQ ID NO: 14582 - DNA, 1501 bp, Oryza sativa
taaaatctgtcggtaaaccgtgagacgactttattaagcctaattaatccatcattagcaaatatttattgtagcaccacattgtcaaatcatggagcaattagatttaaaagattcgtcttgcaaattagtcgtaatctgtggaattagttattttttagattatatttaatacttcattcatgtactaaacgatcgatgcgatagtgcgtaaaatttttacgtgttaactaaacggagcctttaacccagtcgacgagtttctcaagctgcaaatgtacagctcatggaatcccccttgggatcgtgcactcatggaaccatctgtacaatttgagacaaacacactattttccacacggaaattcttgttctctgacacgtcgctctatttatcacagctccagctccatctttcttgaggtgaagtctaaccaaataatttcagctccgcctaaaatagaaatagtgctaggtgagacgctatcataaaataaactaaagatgtaagctggttttaggctgctactacacaagtccactccacgtccaactcccgaaactaaatttatcggttagagttctacaaaatagacccgtcatattgtgcgtgcgactgtgaggccttgtttggaagttggaacggcccggcacattcgcatatagtccgctgcaactgggccgttatttttcgttgccgaaagaggccttatggagaccttggaccgcacgattttcaaccaacgttaaacggcaggcgcttactcgcacaaaaaggaataagttcactcgaggtcccttaacttgtagccgagttcgaaattcatccctacaccacaaaaccacatacaacgcatcccccaatttaccaaatcgtgcaaatcgtgcaaaaaggtctctcggcagtattgtccccggttttgactgacgtggtgcctacgtagcgctccaattactaggttttcatcccacgtggcattgacgtggcgcttacgtggcaatttgataaaaaaaattaataaaatatatgggacccacttcagttaaaaacaaatggtggaggacccacgtgggacccatatgtcatcctccctactcctctcttctctgttatcgttttcttttctttttcattctttttcttcttttaatttagaggatggcatccggcgaccggcactcggcggagagggcggccgacgagagaggagcggcggcgcgtgccgcgccgacggagaggaggccgctcggagcgaggcgtcgcgggagaagggcagcacgcggtgagcggcggcacgcattcctcctccgctagatctccggattcgtttttgtacttgctagtcgcgtccggagaagaggagaagaaatccagtcaatcagcatcggcatgtcgtcgcttggggtggtggtggttctgaattttgattgattcgtgctttttcgttgggggttgcttgccatgggattggtgaacgaggcgagctcgtcgtggacacca

SEQ ID NO: 14583 - DNA, 779 bp, Oryza sativa
agatgttctgtggatcgtttccctctggggaaaatcttgtatgtgtgcgcgttgggggatggacggcggcttactgatttttgttttatctaagcagtagtttacttagttttcactcttcgtgtaaatttcacaaaactaccaaattatctcaaacctacagatttgaagtgttatcacaaaactaggggtttaacactaaatttatcacaaaactacatatatatggcaaagtatcgtaaaactacagatttaatattgatgttatcacaaactataggttttagagtttaatcctcagcactactgttatttttgggctataaacgttgctgttttgtgattaaattggaactaaacctgtagttttgtgattcttctttttttttttactaaatagttctgatatatacttagcctcaaatctgtagtttcgtggtacaacaccttcaatctgtaaatttgtgatagtttgatcaaaatatctgcagttttgagcgtatagtatttgtaaccattttttctgtttgtagaaattttgtgttttgttctgcttggttgaacaaattttcataaaattcgggggcaatcctttgcaaaaaatatctatggtcttgcaaaattgctctgttgtgttgtgttctgcttgtttcttgtgcacaacaaacagtggtttgatgagagaaccaaatttgattgtctgcctattattgtgtttgagctttgtattatttggttatgcggtgcattatattcacaaccattcatggtgttgcaga

SEQ ID NO: 14584 - DNA, 1501 bp, Oryza sativa
aagggggcaccacccagcgccgacgacagctgtggagacggtgggcgccgtggaggcccagggagacgtcacgcgcaccgctggccgcgtcgccgttgtcccccgccggagccggtcgcccccgccgccgggctaagtgggtccctctatttggtcgcctgctcggccgcccacccgcgccgccggctgcccgggaaggagagagagaggggaaagggaagaagagatgaggaagatgaggaggctgacacatggagcccacgtgggccccaccattttaaaattatttttatgtgcagctgatatatggggccacactttttattattttttcgagatatacttgccacgtcaatgccacgtgggacggagaactagtcaaacaagccacgtaggcgccacgtcagccaaaacagacttcaaacccgttgagggacctcgtttacccggtttacataagttgagggacgggtcgtacctggttttgcggtcagggatgaaaatcggactgggcgacaaatagagggatccaaagtgaacttattccaacggaagaggagaaggcccataattcatagtgggccgtacttgaggactggcccaaattttgccgttcgtctttgcattgcaggtttttctctgaacctgattcggctcttgccgctcacagatccagccagcttctttcaaggcgaaactgatcaatggtactgaccaaaatatgaatattttttttattttttcatgaagtaatgaagagaaaggtaaaattaaataggtggactagtcgtaattggttaagatgaaagagtaagtaaagaaattaaacaagagatacattgtgtttgattgagatgaataagtatgccaagaaattattatattttgagataattttaaaatgctagaaactgctatatcttcggacgcagagcagtagatcatttgtcagattggatggattgtgctactgtacatgcatagtgtttcagactttcagcaggtggagcaaaatggattcagaatgttgtcaagagttttacctattgtttcagaaatcagaactccaattgcagtctgcagtctgcatactccctccgtccaaaaaaaaaaaaagtcaaacctggtttcctaccaacgtttgactgtccgtcttatataatttttttttataattagtattttcattgttgttagatgataaaatatgattaatgctttatacgtgacttatctttttaattttttcataatttttttaaataagacggacggtcaaacgttagacacgaaaactagggttcgtcttttttttttttttttggaaacaatacgatcatctttatggtctttgattgatgaaccagcagtggcgccaatccatccgtggctacaaaagcatgtccacgtaggacaggtgggccccaccggaagcgtctctatttaaaacctcgcctctcactgttcagtgttcagtgccaccaccatcttcttcttcttc

SEQ ID NO: 14585 - DNA, 1246 bp, Oryza sativa
cattcgatgtgatagagacttaaaagttttagtcacatctaaataggacgttagaagtttatgtgcaccgaaaaattttgatgtgatgaaaaagatagaagtttgaaaaaatattttgaaactaaacacggtggtaatctccaaatgatttttcactgccatgactggatcacactttacgatgccagcagagtgttgacgagaatgctccttgatgtcctggatgacgcacctccacgaagaccaagatgtatttaggaccagcagatttgacttgcggctttgttcgttgctacctgagtcgcctccttaattaagatggcgtgggggcttacccaaaaacggatcgcagaaaagtaccctatagtttgtttcattttcatacttatggattatcaagaaattttatatccaaatcccatatgtcatgtctaatatgtggccatcaatttattagcgatatactccgtatttggctaggttgggtaagcatgtgtgagtgtgtgaggtgattggccatccaaacaggctcaactctccaagtctgaggtgattggtgatcgataattcaactgggcgtaactcgtgacagttactactgtactatatttttgctatcttaattacaccaattgaagtgccgccagctagattaaggagacttcttggttcttaccactttattaaaaagctaacaatttagagagccatagtagtatttaacagtgctttatggcagtaattgatgccaatctaattagagtaagtttaatagcacagccaactactggctctaaatcatctatagctaatctaataatccattcatacaataattaactataaaaatatactacacaattaatacccgatcccacatctcatacacacgtaacgtcttatagtacgtgttacagttaggtataaatttgtagcccgctttttttctctcttctattttcttatcgatacgtggttatagttggtttatataatgctattgtactgcaattgtacctgctgttaggatgagttgtcgagtttttcaaagcaatcatgtttaaagtgaaagcaatcgtgttattcgtttctggaagcacgatggcgttgcaggatcgaatttgactttggagcccgggaccgatcgagagagttgatgaaccagaataccttgccagttgctgcccgaatagagacaagttggaccaacgacccatcccgatcagattgtcaagctcgatatctt

SEQ ID NO: 14586 - DNA, 1501 bp, Oryza sativa
ggctgtagagtagtatagtagcagcgtttgacgggatttctacaaattatatatatatataaaagaaacccaatgagacaataacctttaaaaactaccaggtccattttttaaaggttcaggacttctaatagtaaaaaaacccaatgataattatgttcgattttaaaatctcaatgacaataaactagggaggcgatgggccaacgtataggagtacagtggcaaagctgctaatggtttggcaggacttacagaaagtaaaaaatgaacccagaaagataattatatttgtttttaaaatcccaatgacaataaagagaagaggtagtggacgggccgtagaggagtataatggcagcgtttgacgcgacttctagaaattataaaaacgaaacccaataaactctaaaaactatacaatccaatttgtaaaggttctaaggaaaataaatagaaacagtggtagatcgagtaggcaaataaaaagaagaaaatgacataagtaagtggtagcaactggtgtgactgttaacaagaacttaagacaatgagatatctatttaataaattttaagtaaaatcatattaaaaaaatatataattttattatgggtgctagccgcgcaattgcgcgggccacccagctagttaataccatatccagtaaaaaacgataataaaacccgaatccctcaacgctggaccatttcttcaaatgaaaaaggaaaaagtatactttgactccctcaactatgacccgagtatgattcataacctccaaccacaaaaccaggtatatcgactcctccaactatcaaaactggtgcaaaccatatccatgagtggttttggaagcggttttagctgacgtggcgcctacgtgacagtgttgacccggtcttcgtcacacgtgtcgttaacgtgtcgcttacgtggcattttagagtaaaaacaaaagaacaaaaatacgtgggactgacatgtcatttacacagaaaaatagtgggacccaccgacatgtgggcgccacaagtcatctcgtgtgccgacaggacaagccaacggagacggaaggccagcgaaggccatcggtgccccggtggccaataagagatgacttattgcctcgaccgccagcgaaggccatcgatatacccggtttcgtggttggagaatataaatcatactcggccaatagttgagggagtcaaagtatactttttccaatgaaaaaatgattgccggcccaaagcccacgccaactggcagcagtaggcccatcaccttggaaaagccgggagatagatgggctgggcttcactcgatcaaccgaaaactactgtgattttcgtctcaaaaaacaaggaaaaaaacttggtggattcttgcatgaactcgtcaaaatcccaagccaagccaactccgtcgtcgcggcgtcgctcacatcgatggcaccgcaagccgcgcgtcttttctcaatcacaacctgagccagtga

SEQ ID NO: 14587 - DNA, 1501 bp, Oryza sativa
tttcttatagatgacagatattttctgaactaacaacatgctctcttattgaccttgctatgaaggtccgagagttggtgccattatgctaacaagatcactgccaaatcggtgtcatagtgcagccttgcctctatcccaattcacagaggaaaatttactatttgctatcctcctaaaatacacatggccaaatatcactctcctaaatttttattcccaaatacacgtgtactagcttcgatggagtacaagagcccgtacatattcaatgaagcgccaggggaaacaataggagatggtgtcatgcagtcttagacggatattgttacatatactccctccgtctcataatataagggattttgggttgatatgacacattctagtataacgaatctagacagacggtttatctagattcgttgtattagaatatgtcacatccatccaaaatcccttatattatagaacggagggagtactatttgtttaatcaagtactcttacagtcttattgtttggcttatgcttatccatataagccaaatttaaataagtgaaaggtgaaacccaaaatgcaaaactactgtgccacgtcatcaagaaaagatgcaccgtacgattttagcttcagaagttacgagccatcggattccctgattggcgaaatctcttctcgatccttcagcaaacttcttttgcgcgtaggtccttccacttccctggctcaaaaaaaacaaaacaaaacgaaaactgcgttccccatctgttcccttcgccgatcgccaattatctctcgctggactgcccgtccgccgcggggactgctaatcggcgactgatcgcgcgcgcctgcggccgcgcggtcagttatagccttcccctatatacacctttactactgtactatgtttatatatttatacatacatatatatacttttgaatatatacataccaaatcatttttgatgtataaaaaatatatacacatatacaaactttacatacatcgtatacaaagtttatatttgtatatgacgtatacaaactttgtatacaacatatacaaagtgtatatacgtatgtatacaaatgtatacgtacctataaaaacatgtatagaaactttgtaacgtattaaaaaacaaggaaagaaaaccagagaaaatatcaactttgtattgtatatatacaaagtttgtatacatatgcataaaaaaatatacgtatataaagtttgtatacgtgtatataaagtttgcatacgtgtatataaaatttgtatgcgtgtttacaaagtttgtatatatgtatgtaaactttataaacacatacacagagtttatatatgtgtatacagtttgtatacacatgtaaactttgtaatgtaaaaaaaagaaaaagaaaaacaaataaaaaagagaaacagaacgaaaaaaggaaaagagaaacggagcgaaaaaacaaaccaaaaaaaaagaaacgcgcggcgtcc

SEQ ID NO: 14588 - DNA, 1501 bp, Oryza sativa
agattgatttggtgtaacacaagtttcaatgagaatgttacagtaggtggaattagaccctatttagatgagactaaaacttttaaatatctatcacatcggatgtttggatattaattataaatattaaacgtagactattaataaaaacccatccataatcttggactaattcacgagacgaatctattgagcctaattaatccatgattagcctatgtgatgctacagtaaacattctttaattatagattaattaggcttaaaaaaaggggctgctatataacgggatcccgttttcgaacgggatgatcccgagtaggtatcaggtctgatacctatcaggtatcagacaattctacacaacaggatgatcccgagtaggtatcaggtgtgatacctatcaggtatcacacgattctacacacgtttcaggtgatacttgtaagtatcatgtgatacttatcaggtatcatgcgatttctaccacgtatcacgtgatactcgcgatgtatcatgtgaaacctatcaggtatcagatgatttcaactacgtatcgcgtgatactcacgaggtatcatgcgatacctgtcatgtatcagacgatttctaccacgtatcgtatcatgtgatacttgtcaggtatcagacgatttctaccatgtatcatgtgatacttgcgaggtatcgaatgatacctaccaggtatcaggtgattcctactagatatagctgggcattccgttaggggaggagcaccccgacacgtgcggtcggcccctgcagccgttccttgtagacgaggacagcgacggcggctgcaggggacgggtgcagcggcggcggcgggggacgggcacgatggcggcggggtacagcgacggcggtggtgggggatgggcgcggcgtcgatgggggacgggcgtggcggcggcaggggatagcgacggcggcggcgacggaggcgacgggggacgggcgcagcagcggcgggggacggcgacggcgacgagtgagcagtcctggtgcgtgtatggataagaattgcgttgtggagaaggagctatcctattgggggacggtatcccgtcccctagcattcccgtaaaaaaattgtctcacgaattagctttcatttatataattagttttgtaagtagtttatatttaatactctatattagtgtctaaatatagggatgcatccaaacaccaacttatagatatgcacaggaggaaataagtagtcagatttgttgttccgtagaatgattatctattcatttgacaggtgatttggggtagcttgggtgcttaattacgatcacgggtctaaacatggtgagctagttgaccaaaccaaagcgtgaagtgttaacaacataaagatcttgtgttcatactccaattatcatgtgaggggtataatggtaaaaccaccgtgccattcctcgcttatataagccacatggtacacgagtacttggcgaaatctcgagca

SEQ ID NO: 14589 - DNA, 807 bp, Oryza sativa
taacggtcggaaaacggtaaagtgcgaaacttgctcggagtcgatttacagcaaatccgaaacattaccaaatattccggacttggggggcatgtgttaacaaccgaatttggtaacatcagcgtcgggagagaagagtagatcgaagcaaagtcggaagcggaaatcgggtttgaaagcagagcaggaatcggctaaaatccagatcggctacgataagatcggctgggtatgagtcgtgttgggtaagtcgatgtagccgattccgacaatacgacttgtacgcgacatcgggttcaatttaatgtacttcaagatgattgccacgcatggatagagtcctgggaaggcaattgtatctattaattaggatattttatgtaaattccttatagataagtgtggggcaaaagtctgccgtaatgacttatggtatcttagagtttgttagagataatggtcatgtccgctatgggcatatcttgtaatcctcgggtataaatagaccccgagccctatgtaatgtcacaccctaaaaatcctaaatatataaattgttgtttaattggaattattagaaataattttaaaagcctagaagagaagatctaattttaaataataaattccaatgtaaaagtggctagataaaattttattaaatactttacttgattttatagttcctggatttttctgggatttatttgagccaaggaagtatttttaataaatggaattgcatttcatgaataatttaaattgaaaatgttttaaaaatcctccttttggctttgggccgaaagt

SEQ ID NO: 14590 - DNA, 881 bp, Oryza sativa
gatcctctctggctctcccaatcggacttcactggcagtcaccgcgggtggaaattccttccccaccgcttgccagaaccccgctctcctcgccatgggcactcttcaccagcgctacccgtacgagttgcaacactcgccctaccgctaccaccctcgtcgcggaggagcccgcgactacgccaccttccgggatgctagctcagaggatgacgctaccatcgtgcacctggcgcggatggtggaggcgtacaacgcggctcgtatcgacttccaccagatggtacgtcgcgggatggtcgagaacaacatgaagatcctggaactgcgccaggagaacctgcagctcaagaaggacctagacgcggtggaggcgcagctgcatcagctcaagatcgcccagggaaaggtctgtcgccccaagcgtcgccgcgtctgccgcagccagaagatcaccgcccgcaagagcacctccaggcccgagcttgttcgtcagtccctggcgtggacttgcttcatcgagacccctcgtgccgagcccgcgcccgtggttccccaggagggggaagcctccggcgtcggtagcacggaggatgcgctgttgctcaccttccgtcctggcccgtcgcagcagtagacgagcagttagtaggcttgcgcgtgtgttctttctcgtttgtctttttgagtcgtgtggggcatggttatgccggtgtgtggcataactgtgtcggagcctgtcttattttattcgcctaagcaacttgaacattaatgaaccaatttaatagcagtaataaattcaaaaattatggtagtcgtgggtggttagttttaattgttagctctttctctgtttgctggttccgtgtggggttttc

SEQ ID NO: 14591 - DNA, 1501 bp, Oryza sativa
tctctgcagtaaaaaatcgacggggcaggagaggcatcatcgtcgttctctgcaccaaaactcatgccatcgatcgcatcgcagcatttttttcacaaccgggggggcgcctttgataaagggtggtgatggctccctgctcattcacagctggagcctacgcctccctgctccctcctggggaactgttcctaatcgagtgattagcattaactaaattggctaatcacgtggattgacagccttaaaatagggtgctggtattaggcttcgacgtcaccgcctgatccttgaatgttttttactgcttgtagtatagttgctgcagctgagattccatttctgatctgaacatctagcatttcacatttctaatccaagtaccccgtatagtgatactttgtactgctgtgttagttctacttaatcaaagacttgactataatccacacgggtaagtgggtcaatagatctgcatcaggtttttgaatgctccttccgttgcaagccatcctgcagactccatcaagccgtgctagccgtgcaatgcaagtgcaagcaggctagcaacagagggcgcagcactttatgtatcgctgatcttctacttcccctgcacgactctgtttgggccaagctgtttttactgtcacctttttttctctttaccgtgcacgtactagtcctacatacgggcccactcgccagctgtaaccaactagtgtactgtttcacgtacggctagctggctagctgtgctgagcaagcaagagcaagcgaggcagaaacaattctttccccgactggtcacagcggctgtggccagtagccgcgtagctcagcgagagaaagaaagaaagaaagggtgtgtttagatggggaaaaggaaatttttgggtgtcatattgaacgtttgaccggatgttggaaggggtttttggacacgaatgaaaaaactaatttcagaactcgcctggaaaccgcgagacgaatcttttgagactaattaagccgtcattagcacatgtggttactgtagcgcttatggctaatcacggactaattaggcttaaaagattcgtctcgcgatttccttcataactgtgcaattagtttttctttttatctatatttaatgcttcatgcatatatccaaagattcgatataatgtttttgggaaaaaaatttggggaactaaagaggcccaagcgtgctgaaagctcgctgtgaacaaagccgcaaaagttggagaaatccacagcagctgagctgtgcacgcagactgtagtagtagtagagcgctagactgaccactggtccctatctcctgacgcgtgggtcccccgttgcccaacggctagcttggcctccgacgtggcgccctcgtgtcacgtgccacccttccaccgtaagccaaacgtctcgcctatataaacatcgcacccagcttcagcttgagattgagcccatcagtcgagtcgatcgaacagcacagcaagt

SEQ ID NO: 14592 - DNA, 1501 bp, Oryza sativa
atacggaccctttcactaccacagaacatgtgaaaaacctcttaaggtatcggttttctcaaccgacactagggatgcggcaccaatgagtgctccagcaccaatcccattttaaaaaccacacctttgagaccacttgcgatctataaaaaggctcgatgcatggctggatccaattaaccattattgttatgggctctctaacccgtaaacaaggtggcccatagcaaatttagaataagttcatttaaagtcccttaatttgaatctgattttcgtccttgtactggaaaaactaggtatgatgggtccctcaacttacaaaaccagtgcaaacaagatccatcaccaacattgttctcatttttcgctgacgtggcacctacgtggctaatttaattaggtttttggataacgtggcattgtcgtggcatttacgtggcaatttaatttggaaaataataaaaactgttagcctacatgttagttagaaaaaaataattaagaccggtggggcccacgtgagccccacatgtcattctcacaatcctcttcttccacctctctccccatctccctctcttcattgtatctctctcctctctcttctcctccctccaggcgcaacggccgacggacagcgtggaggagggcggtggtcggtggggagaaggggtggctgttgacagaaaacacgaggcctgggagatctacttaactccagtgcaggtccaaaactcgccttcggatgtgtgagcgtgtcagttgatttgatcctgcaatcaacaagaaataaagacaaaagaaccgtggttaaatctataaatgatagccgatcggccagatgccgatgacatatcatttatatccgagccgatgtcatctgtgtatcgatcggcaatcgtgaatgattaaggaaaaactaaatctacttgatcgggtgtagatattaacgatatataatttttatgtcgatgtatacttaaatcaggttgtcggtgacatgggatcgggagtatcatgactagaggtttgaggcagacacaatcgcccacgtggcctggcaccctcgggggacgtcgggcccgagggtgatgtgttcgccctcctcttagtccccccgagggggtcgggctgcacccccctcggccccgagggccgaggcgccctgacccctcgtgggttttcgctccgcgtgtatgggttaggtgagcccaccggggctcacctaaccacattaattgcggtttggctgagcgtgtcacaccgcatgtagcgcagtgcagtgcactcgtttatccggtctgtgaccagtcacagaccggtcagatcgcgggttaggtggcggcaggcggtctgacgcacgcctcgccccatcccgtcaggtcgagggcttctaggcgctcgtccccagctggagctagcgtgttacctcccagagatggcacgttagccctgatcagatatatgccaggcttcatcctaaccattacaggcaaaa

SEQ ID NO: 14593 - DNA, 1501 bp, Oryza sativa
gatgtgataatgcaggtctaggctacccaccatatccatatgtctatgtctatgtgtgtgtatgttgcatatattcatgctctaaacttttagctgtccacgacaacaatctctcgtgcttatcccctacaaaacgatgtgcttccctcttctatgttgcaaaaatttaatttgtcacaagtcggtccaatgagaatttgcctcaccatgccatgtccgtatgtatttagacaaaatttgatcacatatcataaattgctcaaagatgggatttttttttcattacgggtggtgttcaatgagaatatgctggctaaaaaaattatttgttttaatgttactcaatagtaagagggagtcggggatttatcccatgctactcaatgagatatatatcaccttagatctcattttgttttttttagcttatggctgtgtgtaatatgatagaagttagaggtgtataaaacatttgcattatcttaaaacaaattgctcaaacaagtaactcatcttatttcgcgatggaaatcttgtccaacatgtgccatgtcccaattttttccaaaatgtaagtctcacaccgatttcttttgtcgtaaacaagatcacacgcgattcagaaaatactccctccgtccttttttaaatgtaaccatataagtttccgtgtctaattttgatcgttcgtcttatttgaaaatttttataattagtattttcgttgttataaaatgatagaacatgaatagtagtttatgcttgacttatgttttttaatttataaaaaaaattttaaataaaatggacgattaaagttgagcacagaaaattatggcttcactcgaaatgggatggagggagtagtcaacaataatgcaatagtacgttttttaacatattagctagctcaaattgatcccactgtcaaattgctcgagctaatcgtggcataacgcatgtacaagacttaaccgatcaaataaattaaaacaactgtgtgccccgatgagcgcgggcaatttgacagtgggatcatattgtggctcataatacagagtggaggcgcttacaagaacaatattcccttagttgccaattgccattggaataggcgcaatcaaagaattgattcccgtgtgatggctccaacactctagctacgtccccataatgactccaactttacaggcaacccacgtgaattgatatgttccatgggattcacataaccaaaacaaattatataatgaagtgactggttgctttataacatactcccctgtcccatatccccttatagattgattctttttggacggaggggtaggtgactaaactgtgcctatcttacaaattatggtaattagttcgtaccccgcactttgctacagaataagtggatgaatacatgctatatattatagaaatggtagatatatatttaaataatataaaaatgatgtgaagataattaatgatttgacaatgcttgcatatt

SEQ ID NO: 14594 - DNA, 1501 bp, Oryza sativa
acgtttaatgaactatataaacaatacagtttttacaaaagttttccgtacggaagttttttcacatgcacgtttaatgaactatataaagaatacagtctttacaaaagctttccatacggaagttttttctcctattttcccaacttctctctcgcttttcattttccgccgtgttttgctccaaagttttcttcaaattttcaacttttccatcacatcaaaactttcctacacacacaaatttccaactttttcgtcatatcgttctaatttaaaccaaactttcaattttagtataaactaaacacagccttcataggcataggcatgctttctgaacaaatgtttaaatgttacgtttctaaaaaaaaagaaactttataaaaagctgcttttaaataatcatattactatccaccattcctaacccccctccacagaacagtgcctcatgtactaaatagaacgtactccctccgtcccaaaaaaaaaaaaaatacaaaccctaagtttccgtgtccaacgtttgaccgtccgtcttatttgaaaaaattatgaaaaaaattaaaaagataagtcacgcataaagtgttaatcatgttttatcatctaacaataatgaaaatactaattatagaaaaatttcatataagacggataattaaacgttggacacggaaacccagagtttatctttttttttttttaaggacggagagagtatgaattttatagtactaaaatccgatgtaagattatttgtacacgattgctttgaacagagtaaggagtccaacaaaatcctttggaagctactactaaaccctaaaccctaaacccctactctcttcctactacaccataaaatttttaaaaaataaaaaaataaagttaaaaccgttgactttttctcacatatttgactatttatcttatttaaaaaatttacgtaattataatttattttattatgagtcgttttatcactcatagtactttaagtgtgatttatatcttatacatttgcataaattttttgaataaaacgaatagtcaaacatgtgagaaaaaatcaacggtgtcatctattaaaaaacggagggagtactaggctattatatttgaattttgcataaactcaaatatacattgtctcgtgtaaattccacatgatatacatgtttttccaatggtattaccaaacgccgttttctataaatttccgatagactcgtaatattacgatacaacaaaccgtgacatctaatttccaagttcttttttttttcttactccaatgttctcaataaatcattcattccaaagggggaaaataaggagcccttaagcaacacccattcaagatctcaaattataccacccattctctaaccgcagatacatatccagtttgcaatctttgtaacgggtcaatcagttcaccacagctgatcgaatcaacaaccatacataccacgagttcgagtagagatatatg

SEQ ID NO: 14595 - DNA, 1501 bp, Oryza sativa
ggcataatagggtttcatttgcaaaaagcagcatttagcaaacatttgagaatttaaaatagttaagtattaattaagcaatattaagccaacgctatacaacataccctgttgcataggcccaaccattctgaacaaccatcccggctgtacagttctatctccaaaccaggaatattccattccaaaccaggagctaaccaaattattaccagttatagcattatttactatggtgagaagggtgagactaatcacgaaagacattgttagacccgcccataaccgcgggcacggctattcgaatagttttactctgatcagaggtgtaccactgtacccacaagacacaaccccacatcatgtcgccatgtgcctcaatatcaccacgatacctcggaaaggagttgtgacaatacccctcgcataacacaatccactgcagtgcaccttcctggatcataatcacccccttataaacaaggcatggactccccagcgacccccgtgggcttatctccgccacttctcagtctggtgctccgcaatgaaccatactacacaaaagataaagccgttgcccatgctggcttgtggttggcacggttaatgtttcacaaccgaaactcgtgaaccggtccttaattgtcatgagcacgaccatcaaaaccatgtgctcacaacccaccattatcaggttttagttggcacattaattaattaactaatcacgattgaccatcgtgaactaacattaagccatcatgaaataatagtgaatcattagttatcccaatagtgagctaatgtttctaagcagggctaagcaattatatctactatctagttgaaccagtataaataaagctcaaccagtcaaattataataacccaaggtatcaaagaataaggtaaacaagaaaaaggggctataacaaagaataggttatttccacccaatgacattcgaaaataaatgcagaagttgaatgaaaacaatagctttaaataggatcaacatgctcaaagggttgtttgggatctatgtgacttgccttgttggccttggaactcttcaaactcttctccggcgaaaacggactctccggaaacgacggaatctaagcaaaaagaagcaaaatcaccaaaacagcacataaacaagcatgaacagtacatgtggatatttttaatgtgtagatctcaattttagaaaaatttagagacttgaaccaactaaattggagctaagatgaattagttatgaatttttaaagattaaatcgggttaaaacacttaaatcggttaaaattgaattatgacgcaatattgaattatttttgaaaaggaaaagagggtttattgcgtcagcggctagggtttgggtggaccgggcgcacgggcggtggttcacgcgaacggacggccgagattgatccaatccaaatcggacggccgagattgattgggtccacggcggttcacggcggacggacccga

SEQ ID NO: 14596 - DNA, 1501 bp, Oryza sativa
cataaacaagcatgaacagtacatgtggatatttttaatgtgtagatctcaattttagaaaaatttagagacttgaaccaactaaattggagctaagatgaattagttatgaatttttaaagattaaatcgggttaaaacacttaaatcggttaaaattgaattatgacgcaatattgaattatttttgaaaaggaaaagagggtttattgcgtcagcggctagggtttgggtggaccgggcgcacgggcggtggttcacgcgaacggacggccgagattgatccaatccaaatcggacggccgagattgattgggtccacggcggttcacggcggacggacccgatgacgccagcgatgacgtcaccgacggcggcagcggctcggcgggcggggacggctcgggcggcacacgcttgccggcgaacggcggcgcgaggacgcacacggagggcaccaatgggtagcggacggcacgacgaactcaccgatgaccacaacggcggcggagaagcaacggacggcgccggcgacgaggaggaaacggcggggctcttcgggttgacgacggcgacgatgctccagtggtctccgacggcggcgaaggggcggacgaggacggcgacgcgacggcgaacacgacggcggccttcccgagcgacggcgacggctggaacgacggcggcgcacggctggagcggcggcggcggcagcgaagctagggcgcatggcgctaggacgactccggcgacgagaggcgaagacgagggtggcgacggaaagagaagagcacggggatccttttaaaggggctcggaggcgacggcggaggcccacggcgacggcaacggcgaaggaaactcgcggcttggagaggaagaaaaccgatccgaatcgaactcgattccaaagctttccaaagcgattcaaccgacgattccaaagggaaaaaggtagaggagatcccggagagtatttcccctcaaccaattcggccggagaaggaaagggacggccggatttggaagggaaacggcggcggcgcgggctagggttttcggcggcggcggccgaaggaggacgaaggagaggagagagagaaggttttgggccgactttcggcccaaagccaaaagaagacttttttaaaatctttttcaatttaaattatttcttaaatgcaattccatttattaaaagtacttccttagctcaaataaatcccagaaaaatctaggaagtatagaattaagcaaagtatttaatgaaattttatctggccacttttatattggaatttatttattaaaatttgattttcttttcaagcctttttaaaataaattctagaaattccatttaaacaacaatttatatttttttgaatttttagggtgtgacattaatatacttagatgcaataatatcttgatataaagggcagatctaacatatcaatgaagcatgtagagcaaatatagttaaatcagagaagatcggc

SEQ ID NO: 14597 - DNA, 1455 bp, Oryza sativa
atatctgaccctaatcttaaaaatggtgctactgattctatagcatggttttctttcaatgacaggataagagacatcgaagtcaccccaacagatcaatgccattcatttttaccgttagatcaatgacttcattaccccacaggtacttttattcttataaattggtatgctcagtttatcagtaagtattaaacgtggtcacatatattattccttttcttttgaaaaaaaaacattcaatataaatttgtcttctacacatgattcgccataattaagcacatttgtattcttttgcatcaatgatgcttctccacatgatgtattagttctaaacttattatcgaaatttcatgccgctaacgaaaagttgaaaagcatgaacatggagtatattgatcaacttattttgctgttgagataatgtgatgggttctgagctaaatcataaaccaggtaacaagataaagttaatagactattgatcatcgatattaactcattttcttagtttattttaattttctcaagacatgatctgaatatgttgcaatgaagatggtcatacttttctcagctatgccttatgaatggcatacatacagggctaaaattgtcatccggcatggtctctgattcatgtttaccaagatttttgggaatttggatatagtttacctctttaggaatgcatatagtagagtcatatgtttcaataattagtgattagtcaaatgcatacttttctcaactattataatcatcaaagttgtctgaggacccataaatgttctttttttctaccttatattggttatattatgcacttctactacatccagttttacttcttggttccccttcttcgtatagatgataccaatagatgtattttatttagtttccttgtgttctgggactgacatcattctttgttggtaattaggtacccaaaagcagcacaaataatggatagtaaagattgcagaacaaattaagggtcggatgtacagacagttttaccaagtgtttagagaactagcgttaacatgccatcagattccatatatgtggagatatgcatgtatgaaagttcatctaatagatggtttgttgttggcgtgcccattaagtgcaatctgtggggttatgcccgtatagagatctactagctaatagatgttttctaattattacaaggcctcattgtacattaacttgatcttttagcgcattatgttattacaatttgaacaaaatttggtttgctcagtaccgaaatatgtgtgattatagatattcgtgacaaaaaatactagctggctatcaaatatagttagtctcttatgcacgcgcgcagcatagctcgtgattattgctagttagatttaattattgctagttagcttttaaatcgctatgtacaagtttataaaagttttacatataaat

SEQ ID NO: 14598 - DNA, 1501 bp, Oryza sativa
gtgctctggcaaggctggagggactgccgaaggaggaagaagacggcgttcttctctgatcactagcaaggatgaacttccagcgatctccaggcaaaatggtggggttgctgagctataggaggttaatgcgtggccaggggtggcggcgccgaggtcttccatacgtggcttgggtgggtctacgggaaagggtggcaggagctcgccggtgcagtcgagatggcaggagagcaagagagctcgaggtggctgtgaaaatggatcgaagggaggaagacagcgccattttataggctgggagaggaagaaggggaacggtcgtgagaggagccacaggccattaacagcgactatgaattgggaggtttcaaatctgcgatataaagccaaattaataggggggaaaatatgacagaattggagagatgaaagtagggaaatgatttttgcaatcaatttgaagaagagacgtctgggaaggcggatcaacctcggtggcagtgctagtgctagctagggagaggggaactgaattggcgggttggaggtggaagacgacgacgcaacgacttcctgggctggctgagccgtgcccacctaggccgagcaaggtagacccgggagaaggaggggactttgctcatgagccaacggaggaggacaggaagcggactttggctataatcggcccaaagagaggacatacttgtttttaggttttttattttcataaactctgaaatttgttttgctgcatattttaggatgctctgaaaaaatcaaggaaaaactgaggtgacattttagagcatggagaatttaagaaacatactctaagccacattcaaacttttcttgaacatgttcttgaacttttctcaaactattatagcttttaattatttctattattcattttagaatgtgatctttaatttgggatgaatttatcaagacatcacaaaaatgaaacatgaaacaattatatgaagccaaaatagttcaaagtccaaccatggattttatcccatacatattgcgggccacatcatgcgctacatagatatatgtgctagtcatataatgggtacccattaacaaacattcgctaaattgaatatatatgtacttcgtgtcatactttttttcttctttgtactgacagagtaacttaggctcatcgtcattggcattataatgtagagaattgtttaattagttacaagagagataagaaataatctatatacattaaatagacgatgatatctccaaaagtaactgtacggttttgagtttcaccttcagctgtcaaattttagttcttgtttcgtacgtgaagagtcccattctgagattctcaatcaactgacagttagttgtttcagtcatgcatgctactctgtttggtatacatgcttttgtttaatattttatagtgcaagtctatagatatatgttcatcacacttagacttgtttggagcagggtaaccagt

SEQ ID NO: 14599 - DNA, 1501 bp, Oryza sativa
taatcggaaatgtgtaggatcatggcatagcaatttgattagcagaagcatgtgtagtgcggagtgggcagatcaacagctaggagttgagtgtctactcatacatgtgtaggtggactagattagccatgcatgtaggtgattagcagccatgcatggtgattagccaacaggggcggatctatcatggggggcgcagggtctcaatccttcactactggcgtaaggaccatgggtgccgccatgaagccccctctaaatttttgtgctataagtagatgggatgggggatgtagctttgtctagcttcttcagaccatcctgttatttcttcatagatccgccactgttagccaagtattaggatatgcacgtttggagcaagaagcggtccaggtagtacgcatgcatgcagagttagttagctttggattcatgtgtgtggttgcatgcattagcaatgtgctcctgcttatggcgtccacggctgtatcgtgtgagcgagagtagttgggttgttggccaaaaggctcggggcccaacggcctggcccacaacacggcgttttggtccggcccaagcatggcatggctcgactgctgtcgggccatgctggcccagcccgattggtgttgggccatgcttgggcctctgcctcgacatggtgggctagcccgacctagcacagtccaatgaccaaggaggcaaaataaacttatttcagccatataaggcatggaccaaagagatgaggcacgtaaaatagacttattccagccatataggacacgacccaaagaaatgaaggaggcaaatagacttattccaaggaggagcacggtgggctttcgtgccttcagggcggtctggcacggcccgagtcttattgggccgtgcctgggccgttggtgcagcccgtgggtgggcccgacccggcccgatgtaggtcgggccatgtcggtccgactgattcagacagaataaattgaacagaaactcaaagaaatctaaccaaaaacatatgcgaggctgcaccaagaaagctaccagaacagagattaactaagttgaaacttcacgcgcccaaatcaagaacagatagacaccccaaaaaatcatgtgatggtcattccctataccaaaatcttcagaatttctgtttgttacagggggtaacatgagtcacatctctggaccaaaaaataatcacaatgataaactacaagagtcacaagaatgaactaatgcaacactaggagctaacaaactcggtggggtcaccgtgtattagacatctgacggttctgggatgtggatcagagatcggacggtggatcagttgccacgacggatcacgtcgattgcttaggttcttgaaaccaatcttagtgttagtagcttcttggagattccgttatgttctttggatagagtttgtactttgggttggctgactttttgatggagctatgtgaatatttgtgcaatgacaggcaccaat

SEQ ID NO: 14600 - DNA, 1501 bp, Oryza sativa
gctttaccgtcagcggcagcgcaggggagggggctcggcagcggcaaggggatcgacggtgacagagcttggcggtggtggatggcacgtggcggggctcagtgatgacggtgcgtggtggcagcaaggggctcggtagcgatggcgcgcggctctctcctctctgcgcctccggcctcccacctccctccgcctctcttcggctcgacggcgactgcaccggcaggatgactttgtgtccgccagatctagtgctggtgcccctcgacggtggatggcgacgagatgcatgctgtgaaaatcgatttgcttcactgtaatggatttgttgatgttaatttgttgatgtgaatctgttgatttgttgaatttgttgatgtgaatccgctgatctattgatgaatatgttaatgggaatctagatgttgatgagttttttttttttcaaaatgatgttgaggtgtttttgttttgaaaatcatgatgaatatgtggattttttttttgaaaaatctcttcactcgcggttgacctaaaggtgccgtcagcaaaaaaaaatccatttttgctggcggatttcttaggacgacgcctgcaaaattcgatttttgctagcagatttcttaatacgccacctgcgaaattcaattttcacaagtggatgaggcccgctctggcctttggttgctggtggctcgtcttttcgcttgtaaaaattgattttccccgtcatggaaaaaccgatttcgtagtagtgtgaactccacttctttgtgctacaataggaaaccggcacgaacgttccaggcagcaacccctggagcgcgatcgtggaggagtccttggctttggcgagcacggagagggctgaactgctgtgaagaaaaaacgcaaaaactagagaaacaaatcacacacgccggctgaactggtgtgatgaacaaatgcaagaacttccagaaaatattttcagatgagaactcacgaactgcacatatatagctcaattaaaatccacatatgaagtgaaaaaaatggtgtttctgatttagtccgacacggtaagcgtactgtcgtcacgctgtagggggttgagcaccttggcccgctcctcgacggggacgcgtcggggagtcccatgatccgcttcacgcaatccctccctgccaccgctgtcacctgcatcctcctcctccttgccacccgtatcgacaacctgttgcggcgcgagctgcccgctgtggacgttcccgttgctgtcagaggcgagagcacctgcagtatccccgcatcgtggtcgactggtcgtcgtcgtcccgtgccgccggcgctgtgcagtagcacgtaaaaggactggccgtaggtcgaggggctagacggaggacgtgaaaggaagttttagaggatggtttttgttgatgtgacgctgacatgataatgttgacctagtctttcatccaacgtggcattagaattaaaaaaaactatgattcacacataa

SEQ ID NO: 14601 - DNA, 1501 bp, Oryza sativa
gtaaattaatgcaattcatcattggaagaaaatagtggtaaatatagtgaatatatacaccatgagctgcagaaagagcaccacatatgcagacacacactacctggtgagtacagaagagtttttttcaactagaggatgcctaattcagacacacgaatacagaacaaaggaagatgatgataacagctagccaaagtatgaagcactggacagagccagccaagtgatcacctcaaccagcaatccatcaatatttccttgatttattaatctcaagcaattaacacatcaagcagtagcagaatgcagggaacatgccaggatgccaatcctatcacagaaatacagtgaacccaactgctctgctctgttctgctatacaactgtttgtacctagtatactagccctaaccatccatctatgtgatatgttaaacactctagttgccacccttacccataaattagagaagctattacgagttattacaagtcaacacaggaaaacatccggccccgtcatttggcttattcgcagcatattagtaaacgaaaagtaatttgtgaataaaacttttatatccgtgttcttagcaatctaaaagcgaaggctgaaaaataaaacttcgatgaaaaaacccccaaaatcagtttcaaatttatggttgaaaattcaaattttggatgataagcataaacataagtgaaaagattaggccgatcatctttaactcacatcatgcattttcagccagtggacaatgcacacaaaaaccgccttacgaataactagaacagcatttatgagttaagaccgattgactcaaacaacaaagattcagtaagaagagcaaggagcatgtcatgtttgttaaactcattggcattctccataacatgattaagctcataacacccaagcatcaaacagcagaatcaatttacacaaggactagtcaagcacagcagttcacttcaaccctacatattctagcaagttagtgcgaccactaaccgaagtaaataacaaaataaaaaaaatgaagcaacagtagtacccaaccatcccaacccagttctaacccctaaaccgcccatggtaacatacatttcagaaataaaaaagaggaaaaatttatatgccttcatgtttgctcaagaaacgcaaccatcccaacccaactctaacagtccaaccctttcgtccatagaaacacgcactgcaaaaagggaaaaaacaacatatgccctcatgtttgctcaacaacgcagcagcagactaaacaacaccaatccacatccatccgtccctaaatccacctaaacaagccaccgctgatgcctcctagataaattcatccttgcaattagcagcatcacgcctagattaattaaaaaaaaaacagaaaagaaagctgtagatacgcgagagaggatggatggattggattggattgacgtacgtagttgaacgcccaagcctcctcgtcgttgacct

SEQ ID NO: 14602 - DNA, 1501 bp, Oryza sativa
tgttatatcctaaagaaacaatctttcatatagttgtgaaacaatctttcatatagttgtgagagttctttgatgggtaggagccgacgtactcaagatctttcatatgcttgagagagtcaggtggttcaaaataaaacaaagccaagattaaccggtccaaagaaaaaatattagttaaagagtgattcaaaataaaacattggtaataaaatatgatcaaaagtgaaatttactccttttttttcatctcattggttttttaccagccaccgaaactatttatttaacacagttatgatccatattgatcacatttaattgtgtggatccactgaacttatgacattaacatattcttacatgaaaatttgttactccctccatttcatattataagtctattttacttctttttcctaagtcaaacttatttaggtttgattgagtttgtaaacaaattaacatctataatatcaaattagcttcattaaatataacattgtatatattttgataatatttaggagtattatgtttttctatacatttggtcaaacttaaaggaagtttgattaggaaaaaatgacaaagcaagttataatgttaaaaagtttgactaggaaaaaatgacaaagcaaagttataatgttaaaccgaggaagcatgtgattttgaacaaattaattactcccgtcattgtttcctaatttcatgtcaaatagaataattgcatatgaatttagaggagagaaaaaagtaatgagttcttaccttattattcttcattatatttagataattccgcgtatttactagtatttaaaaatcaaaatcatttgctccatggagttttttagggcttgtttgggagcatatatatccccatcaagaatccccgcctaccccacgtgccctttttttttatcattgttggtgggatataagacctctcaactgacctacttccttaataagacagcaaagccaaaaaggccaaagatatgaaggtgggtcaggcatatccacaaacataataatacagggcacaatgtagagtataattaagtaaatgtatgcgttcatttataagtttgattgaatctacaatgctacaattcaatatatgatcaaactcagcaagaaaagaataatccaatgtaggatctgatacccaaaaaaaatcacgcagcataggtttgttagtgtaatttacagaatacagacaaatttccagacaaccttatgctgtttatactattccaagtgtgggcataaaatgtcctaaaatatttcaaatgaaacatgctttagttctttaaatttggggtagtggcaatgacgatcatagatgttgcattacattaaagatgaccttttctccctaggttacccagttacaatctgttctgtgcttgatcaatcagcacttaaatcacaacacttgttaccataagcactaagaatgaagggaacagaaagacctttaaggtgcaatata

SEQ ID NO: 14603 - DNA, 1501 bp, Oryza sativa; identical to SEQ ID NO: 12534

SEQ ID NO: 14604 - DNA, 1501 bp, Oryza sativa
ctccatcaaacaacagacagctgcagactgattacactagtgctaacaacaacacatgatactagttagtagtagatggatgaaacaatcagcagtattaagcaaaacagtaacaaaataaacatggcatcgcacgaaatgaaatgagcaaacagaacaatcaacaacaaggatgaacatcatcaagtaataatcaatcaggcaaggactaataagatagacatagcatcccacgaaatgaaatgaacaaacagaacagtctgattcaacaagaaggatgaacatcatcaagtaaggagtagatcggaaggaacatattaccggcaaccaagtgagcaagcagatattgctccttgagttccttgaggtccttgggcttgggcttgggcttgttgggtacatcagctggagctagtggagctgttgctgttgctggtgacgacgggtgacggtacttgtcccgaatgttctgcacccttgaaatctcatgcatgatgtccagccgggctttttccttggtctccagcagatttggattgatcacgatgaagccaggtacagagtcgtcggcggaggcttgttcgatcttggataggatgagaggcgcctccgctggaggaaggtatggcacaatgaacactctaagaggctgatcgacaggagcaggagcaggagcatgattctccgcctgaacaagagccgccgccagcccggaggcgcttgaaacacgcacaatccatccggccttcaccacgatgttgtcgacggcgtcatggagcaccttcggctggccctcctgcagcacctccacggggagcccgagcctcctcgccgtcttgcaatccttattcagacgcgcctcggggcatgccattctcgcctgcacttgcaatttgtatttcaatcaatcacaaccagaccagaggtccaaagcagagcacatatgtaaaaataatcttgcaccttaacgagctgagaacacgttaattgcaagaacaagcgcgcagcgcgtggagagggaggcgaacgagatcaccatggaatcacggtgctcgtccccctacggcgcggccggcagggcacttcattcccccgtgccgtatcaatcagcaaaatcaaaacccgaccaacagggagcgatcgatctactactctactggagtggatgacaacaaggacaagcaagcgagaacgatctactactctactggagtggatgacaagcaagtgagaacgatctactactctactggagtggatgaacaagcaaacgagcgaacaaccaaggaggagcatgactcgctcgtctcgtcgaggtattaggcgaacggagatcacaataatggagatgaaatcgtctgcctccctctgcccgggcccggccatttcacatgtactactagtactagcgcatcggcaaaatcaaaccaaaacccgatcgatcgcaacacgtacgcaacaaaccaaaacccgatcgatcgcaacacgtacgcaacgcaag

SEQ ID NO: 14605 - DNA, 1501 bp, Oryza sativa
gtgggtgtgaaccattggaaacagaggagatcagtgggacggatttagcgtggagagagcagtcggcggccttcacctgagacggtgcaccacagatgagtaggtagctagcagtacaggtgcgaggtcgagagggaggcgcaacgttgttgggtgggttagaagtagggatgggggattattttgatatgcgatctaattatgtcgtgtattaaattaaatatttgaaacaacaattcacattattctacttttgaaataaatatacttcaagcacgagagagatatgtttggaaccgtgttttacatctttggtttgtatgttccatacctgcagaaaatgttataatgttccaattaatgaatttatttttaaagatgttttaactatgtattctagctttgtggtgtgataatttctcatatatcttgtttcagatgtctcaatgactaaacacctttttataacttaatccgtcaaattgatgccagaatttttttttcggggatgatggcagaatttgttacaggacactaaaaaattgtggtttttgttgtaagacaccaaagaacacatatcttcttgtagacatcgcaaaaatgtgaaaattagttgcccgacactcgctaaattattttattatttttggtggaacggagagagagaaagaacgataaatgtaccgaattgaccggcgatagccgaaacgctggtcacagggtcggttgatccccgccagagacgcgcagggtcagagctcgccgctcaccgtcgacgaccagtgccaaatttcgccgtcagccggcgacgcgcgacggaggagctagggcagatccgaggcattcgtcacggctgccgtggtcagatggcctcctgcccaagctactcggcgtcatcttcaagcaactgaactgcctcgtcgaccgcattggcttcacggccgtctaccgcccatggcgcactgccgcggccttcgtcaacgccctgcactgcgggctcccgtggctgctcctcccgtcccacgacacatcgtcctacttcagcctctactccgactctccggcttcacccgccacctcagcctcctggaaggcgtctgggacacgtgcttgtgcggcgctcatgacggcggctgggtcaccgtcgccgtcgacccgtgcgccgtggcgaggattcgcggccggccgtcaacgtcttcaccggcgtgagggttatacacaatgaccccacgggcaaactcgtcgtcttttatgaaagtttctctctccgtttccacccaaaataataaaataatgcggtgagtatctagctaattataatatttttatgctgttcacaagaagatacgcgttgtttcggtgactttaagtgttatatagcaaattttatcaattttgatagtctgaattttaggccgagcacccaatccctaggcttgcatatgggctacctctaccacgattccaacgtgggcttcatgggctgcttctgatccttacc

SEQ ID NO: 14606 - DNA, 1501 bp, Oryza sativa
aaaaaatagaaataccttcaaattgagcaagagatccaccaccacttgtgctctctgagaggatgcagagagggcgcagcaaaagagagcccgagatccaccaccagcactagcccctggatgaggaagagagagggggaaatgaggggatagagctagagaaaaaacaaatgccccaatcgcacactgatttgcgcagttaaaatgcccaaatctctccacctctcccggcacaaaaaacgcacacaaatcgctccacctctccacctctaccggcaaaaaacacacacaataatcgctcccccctccacctctgctggcataaaaatcacacacaaaaatggatcgctcctctctctccggcgcaaaaaaccacaaccacctctgcacgccgcagcttaccgccggatttggtggagaggaaaccgcagcctctgcttccctccccccctcccccacaactaccggcacgatgagacgaaaacgtcgcctctaccgcggattccgccgcctccgccgttgattccaccgctggcgcgacaggacgaaacagccgtaaccttcccccctcccaaaccgccgccgcggcgacgtctccggcagggatttggccggagattctcgccgcctccgctctctccctctctccgccgctctctctctcgagcgccacaggaatttttgaacagtgccaactctctctctctcggtcggaaaaagtgcgactcgcggtcgggacaagccgacccgcggtcaggacgcgcacgcgtgccggatgaaggccacgtcgcccgcgcgccgatcgacggctgccacgcgcgtcgcgcgatagcgctaaacggagaggcctctccgtttagattatacgatttaatttatgaaaaggtataaaagtaggatattgaataataaatatatggaattaaataaaagatttaatatcttagatcccgtatttatgagatagatcccatatctagacgagcgaaaaagggaaaatacgaggcagaaagagtttgagaacgaacccaagctgagcagcagcagcttcagacgcatgtgactgttagtatgtgacgatgacgtcacggccccttgctttttccagcttccaaggcccaaggggtcgcttgccgtgccgtaatatccatccatcggattccaacggccacgattacacgtgcgccaccgcctccccccctctcttcgtcacctcaccccccaacccaaaccaacaaaaataaaaacgacgaaaagaaaaaaaaaaaaagatcgcgcacacgacccccccgacccgacgccgccaccacccacccccgtcgcagcagctcacccccacctccaccgccatagccatagccaagccgcgggagctccaatccgagtcgaccccggcggattccggcagggctaggcgcgaatccctcgccgcggcggccgcctgcatcgatccggggcctcgcgggaggggggggaccggatttagggtttaatttatgca

SEQ ID NO: 14607 - DNA, 1501 bp, Oryza sativa
agggtcattggtatccgtacctgagggcacgaatactgagacctagcattgtagtcgaccaaggaggttaatgcagcaattgtaggtggggcctgttggttatattgcaaactgcggccaacatttcatgtgtaatttagagatgtgcattttgagaaatgaaatacttagtttcaaattatgggctcaaaataatcaaaggtgacctaccttgcttgatatcttgagcttcttcctcgtattccgcgcactaggactcttctggctccgaagctacacgtggaacgagataactcaacaaaacgaccaaggaaaagctcgtattagtgagtactaagtgtgccactgaatagatctcgatttttgaggaattttagaagttgaacagagtcaatcgaacagacagttgaagagatatggattttctaagattaattgattctctgtctaaagaaaaaaagtattattgaattaaatggaaaaagaaaaaggaaaaaggggatggcttctgcctttttgggctgaaggcggcgtgtggcccagcgtgctgcgtgggcacagccgagcgaacacacgacggagcagctacgacgaacgggggaccgagtggaccggacgaggatgtggcctaggacgagtgcacaaggctagtggactcggtcccccgcgcggtatcccgagtgggtccactcgtctgcaaacacgattcacatagagcgggagcacgcggggagccgtcctaggtgcacgggaagcaaatccgtgcgcctgggtggatttgagtgacacgggcccacgtgtagcctcacagctctccgtggtcagatgtgtaaaattatcataatatgtgtttttcaaatagttaaataatatatataggcaagttatatgggtcaataagcagtaaaaaggcttatgacatggtaaaattacttacaccaatatgccttactgtctgatatattttacatgacaacaaagttacaagtacgtcatttaaaaatacaagttacttatcaattgtagtgtatcaagtaaatgacaacaaacctacaaatttgctattttgaaggaacacttaaattatcaaatatagcttgccatgcaaaaatgacaacatgcttacaagttattatcatcttaaagttagactcatcttctcaagcataagagctttatggtgcaaaaacaaatataatgacaaggcaaagatacatattaagagtatggatagacatttctttaacaaactccatttgtattactccaaaagcaccagaagtttgtcatggctgagtcatgaaatgtatagttcaatcttgcaaagttgcctttccttttgtactgttttaacactacaagccatatattgtctgtacgtgcaacaaactatatcaccatgtatcccaagatgcttttttattgctatataaactagcttggtctgtctttgaactcacatcaattagcttaagtttccataagcaagtacaaatagcta

SEQ ID NO: 14608 - DNA, 1501 bp, Oryza sativa
aaggttagtgaaccaaatactagtggaattttctcttcttttctttctattattctggtctcttgtcttctttagcgagcgaggctgccggtggcagagggcgaagcagcgacgggcggagcaatgcggctgcaggctagtgaggcagagggcggcgggcgaacggggcagtgggaggcgagtacagcggcggccatggacaccagagccgcccgtccttatcggtcgtgcgattgctgcccaattccgacggcgcggggatgacttgggcgacgtgcaggggaccatggcaggcgtgctctcctacatccactatgccctccctgaccccccccctgtgctttgtcgccgtgctccactacgtgctcgccccgcatgacgccgttgagtgcatcagcgcccttcccgtccgcgcaccaacctggcacccgctctagcgcttcacactactgcctacctctacaaacccgtggcatatagcatcatttaatggtatctaataatctaagcaccacgcttacattactaaacactactctgcatgtctgcatatgacatggagcaatcatataaatgaacattaaaccaatacaatcgcatatctctagtaagctagctacataattattatgagacaagtatgaactaaaatcggtactcaaataattatgtaaatgaagtaaagaaccaaaactatataaagaagaatatttcattactgaataaagtcttacaagagagagagaagctactagagccataccggagttctccggaagacttgaagaactaagagactattctatctctactccactagcactagaacaaagtaaataaactagagagagcttcttgattgatccttcttgatgtgtgttgaaccggagaaggtgagctccttaaatagacttcatatgacggttgtgaccattggaattgtcggaaataccccgcaaccatcattaagaagcaaccctggacgtccacgtggaaggacgtccacgtggaaggccaggatcagaggcgacaatggcggtttggccgaaccctagcccatctggcatgtgccttctccggtgatccgcttgatggattctaaactcagtggtatggtggttgggccaaatggcaagtgttctaatgggtttgtgggcccatttatccataagtatgccacacgtcgagttctaattaattagacggttattttccattgtttcttctccatttatatgaaggtctcatgcatacaaatacattgccaagtacaagtggaaatagattattcttaatcaaatatgcatgcaagcaggctccactatccgccgctttgcctgcctgctccagcccctcgccgccgcccactgccgcgctcgccggccgttgcccccccccccctctaccgccggcgacctcttggcgctcgcccaccactacccccgccctgttccgttgagcaccgctgcttcacctgcctgctccagctgtttgccacccc

SEQ ID NO: 14609 - DNA, 1501 bp, Oryza sativa
cgcgtcgctgtttccactctaccactcgccaccatggagccggttgtctcggtctcgtgcgtgcggcggcggtcgccgttgtggttcacggtggacggcggtgtggcggaggagtagctgctcctgctttgggcaccggcagacggcacgatggacggcagcgacgacaacaaccagacgcgggcagcgctcctacgtgtggaggagcttgagaacctcctcagcgacgtgccgcggaggctgtcgcggcttgacaccaatcgcggcatgctcgaggggcagatcgccgcggcgtcccgcggccacagagtagctgtgccatctgcacgagcagcaacggggagagggggctcgtcggcctccccttccccctcctccacgagaagctgtcgccgccgctgccgcacgcggtggggaagggagcgaccgccgctgcagctcgtggtgggcgagggcgccgatgccgcatgcggaggggaagagcgtcgccgctgctgctagcggtgggggaggtcgcccccgccgcacgcagtggggaagagtgccgccgccaccgctgccggcgagaagagaagcaatgagagagaaagagaaagaagaaagaaaatgaagagagatgtggggcccacatcactctctcacttacatgtggggcccacgtactttttatatttcttttgctaactagggtgccacgtcagtgaaaccacccatatatactatcataagactttgagtgcacggtttgtgtgagtttaggggtaaatatttctgcttttgtggttaagggattaaaaaactcgctgttaaggtgagggacctccgatgaacttattcatttcatccatcctggctcagtgaacaagattcggcccgcaggccacatgccacgtgctgcatcctccaacgtgcaactgtgccatgggtcccccacgtaatttcgtccccacatgacagtgaggttagccacgagatcaacggtgtgattacaaagccacacgatatttgtgagtcgccgcgtcggacggaccacgtggttggtaggtgcgaggcccaaccttttaaattcccctgtcggctcgctgtccccgcccacgcggcgacgccacgtgtccccaccgatcccgccgctcggccgacaggtgggccccactcatcccaaccgccagcgggtcccccctcgccccttccacgtggccgcaccgccgcgacggacgctcgtgttcccgcgaagaaattaagcgaaggaatgggagctcgacacggctgtctgctgccacctcgcgctcgcgctctctgctccgtcgcgattcgccacctcgccctcgtctcgttttagcgcccccccgagggcgacggcgacggcgacgacgacggcgacgcgcggtgttgcgacgaaatatctatcgtgcgtgggctagcggcggtggcgtgacgtacgcgggaggagaaggggggaggcgctcgtgctcgtgcgcgcggccggcacgacgccccatgg

SEQ ID NO: 14610 - DNA, 1501 bp, Oryza sativa
cgtaagtcatgaatcaaagcctgaaactcgagacgcgtttcttcccaaacctgaaacttcgggtgtgtttagttcacgctaaaattggaagtttggttgaaattgaaacgatgtgatgaaaaagttgaaagtttatttttttttgaaggactcgcacaagacggtgcgaagttctattgatagagcaggaaaaaaattacaagattacaaccctggaggatcgtaaccaggaaaaaagaaaaaatgtaccaccacccacacaccgacagcgccaacacacaagcccgggagaaggctagcaccggaccggccgccgctaatcgtgaccgaccgtcgctagaccaacaattcaccaccactcaacctctgccgccatgtgggatcactgcaccagcgccccaccgccggccagcctttatgcgccaaaaaccgccacatccaccggcagctcttccctcgcgcaaaggtcgcctcctccaccgccggccgcgcctctcgcgccaagccggcctcctccaccggacgcgcccctcgcgccaatccggcttccctccatcggccgcgcctctcgcgccaaaccggcctccatctccgccgctcgcgcctctcgcgccgagccggcctctgctgccatcggctgcgtctctatgtgccaagccggcctccgacccctcctctaaacactgtgcgccgccggatgcggctgtctgccatgcccccgctagccgtccgagattgccatgcctccccataccgtggtgacggtcgccaccaccacagccactgctgcccttccatccccgccgccatctcaccatcctctcgtcctttctcgccgtcgtcgagctccaatggcacacggcgcagaccacccaccgtggtagcccgcgccgccgtcgccgcgagctcgtcaccaccatcgccgcgacaaacagactcctccggcgttggttccgccgccggcgcggccaggttcgccacaccgacgccatcccctcgccacctccgccgccaccacagcagccgctgctacccttccatccccgccgccattttgtcatcctcccgcaccttgtctctatcgtcgagcttcgacgacacacggcgcagacggcccaccgtggtagcccacgccgccgtcactgcgaactcgtcgccaccaccgtcgcgaccgccagacctccgggcgctggatccgccgtcggcgcggccaggttcacctcaccgacgccatccccttgccgccctcgccgtcgtcgccatccccgccaccagacgccgccgccggtcgccgtcccgccagatccaggcgcagatctggcggtttcctccgccgccgccgccaacgcctcgacgccgctgccaccaccaccagacaccgccgccgcaccgctcaaccccgccgccggctgctccaccgccagatccggccggcggcacggatctggccagttccgccgccctcgagcaggtccccctcccatgcccgagcgcgaggaca

SEQ ID NO: 14611 - DNA, 1501 bp, Oryza sativa; identical to SEQ ID NO: 14610

SEQ ID NO: 14612 - DNA, 1501 bp, Oryza sativa
gaacaattatcacatgtaaatgtttatgaaaacacggtgatgtgtttttggacggtaaacaatgcggtggtcgtcactattgccggttagaccgggtggtgcatgtcggtcagaccggaggtgtctgggcagtctgaccaggttgcttgatggtcaggccgacaggctctaggtgggagtcggtttcgggttgttttcgtgggatttctagattgcttcatgtttataatttctaaatggtttctatttgcatgtgatattattgtgtactgatgtgagttaagttggtgcgaacttgtactcaaatatagagtttctttgttgttcatatgcaggtgttgcttgaggccatggaaatatagccagtgatagatcgggactaggcttgggggaatttgaagtccagatggtaaaggatatcacatgggatgctcaggttagagaacaatgcatgtcgatgtgaaagtttccatatggcatacacgtgggtgttgtctgcatatggaaagcagagttaaatttggattaaaatacatgtttggaaagattagagtttgtaaagtttgtttcttatatgggaaggtttcctaggggattaggacttcttgtatgagttggattcatggctaggggcagccacattatgggtataaatagataaggggttgaggctagaagatatcgactttttgggagagaaaagttagggtttgcttcgaggtttcaatcctagctcgtgagttgagaagggggtgctttagatgcactttgtaaacacattgatgcaataaagttgatttattttcaagagttttattggtacgtgtttttctagatcccgacagtttgaccagtgtactactggtggtctaaccggcgaaacggcggtggtctaaccgacagcaagcaagcgctcagaccggcgacggcgagcagcagaaggcgaggaagcggtggtccgaccggtcggacaataccgatcagaccgggggcgtagaggcggtcagaccgatgtgtacacggtggtcaaaccgactacgtcaagatctccatcaactacgagggttacttttattttcgctacaagtttttggttttttgtgttcctactattcaccccatggtagatttgtttggtcttgttcgatcctacatgatggaccacaccagacaagataaatgatattggaagaacaaatgttcgatgatttcatctctgtgacaaaagcagcatatcttactatcttttcattttaatttgatgtagagacttcatttgtgtcctaaggccctggatggatcaaggactaaattttagcccgtgtcacatcagatatttggacactaattagaagtactaaacatagactaatgacaaaactcattccataactctaggctgattcgcgagaccaacgttgattccttcgacgtgtcaattggacaaatacgcattggaaatgtttgatgcttcttggggcttctttggcgaccgtgaagt

SEQ ID NO: 14613 - DNA, 1501 bp, Oryza sativa
taccggcaaccgactgactctgtttagatccaaactttttcttcaaatttttaattttttcatcacatcaaaactttcctacacacataaacttttaacgtttatgtcacatcgttccaatttcaaccaaacttctaattttagcgtgaagtaaacacacactacgtcctgctaggcctcacatccttgtcaccgtcttttcgtcctgattagttccacgcattttgtggaaaaaaactggtggcactatcgactcagatatcagaataatgttcctgagaggcttcaacgacgtagtattaaaatcagtgataagttatatgataaactgataatgcgattaattgcatggactgtgtagcaaaattaacgcagcttttataagatctgacaaattaaaggttctgaagtatgcacatttgtgaattgcgatgccctggattcaggaacctctctgcaaattgttggtgaagcagacaaatgaattggacgggaaagggaacaggtgagaggatgaaaatgaaagaaagagagatcagagagagaaggaaaaccacgggattattctgatggtatttcacccggatagaaagaagatattctcctggtagtggattcgtgcccctcttttttcaatctgatgcgagacagagttcttagtttggcgagcacggttgacaaagttattcagaaattataatattctgcttgtgattcgccaactgggcattcatctatgcagacattgaactgataatctatagtatgcacagagataacgtcaacattacgaaacccaaatgagcatcttttccatcccaagctgcaagtctccatccgtttcatatcataagtcgttttatttctttaattttttaaaaaagttttatcaaatttatagaaaaaataacaatatctataataccaaagtagtttgttaactattatattgaacatattttaatgatatatgtttgttttgtgtttaaaacgttactatatgtttctataaatttgattaaacataaaaactatttaactagaaaaaaattaaagcaacttatgatataaaatggagggagtagattagccatgaatcaaagcaacttaacgagaggccatgcaacgtgagcgccacgtcagtgaagaccgagtcaaattagctatgtagacgtcacatcagccaaaatcgccgagggatctcatctgcactagttttgacaggacccattgtatctggttttcctgttaacaagttaagagaccttagatgaacttatttcaaagaaaaaaacgtaaagcatcaagacctccctagtatagatggccataaggtccaaggctcgacggcacggcccacgtcacggcattttggcatggcccaagcacggcacggctcaacgagggtcgggcccgtgccgacccgcgatggaagacgagggagagaaaatagacttattttaaaaaggcatgatgggccacccgggccttcggaccgaga

SEQ ID NO: 14614 - DNA, 1501 bp, Oryza sativa
tagaagaaatgggaaaagactacaacctcgtgtgtatcgggggacggaaaagcctcaccgcatgctggccgccacccgatgatctccttggcagggagaacgccgtgcgccaccatctccttcaggttctcctccgttacgtcggatggtgcccattggccttcaaagctttctttctcttccgccatcgattttacccgaatgcgctgatttgattcgagggatggctagggagaggtgagggattgcggcggtggatcacgggaaggattttgctgaacttttcgaaggtggattcgagtggaatgatgaaccctagtttgttggcgcagctctgtactgtagcagggattggggaaaatggcgagagttccggcggggaagacgaagtgacgcttggatctcggaatttattgttaagggtatcggaggtgcaaatgggcttaggcctgaacagtacctcagcccagtacttttaacagcgtggcccattgtgctccttagggacttaggcattttttgctttggcaatttatgcgcacaatagtgttgcccaatgctgataaaatcctttttacgcggtcatataattctttggaattattgcaatgcaaattaaaaggtgcccgacagaaaggtgttatgctgtttttgtaagcttttttaggctacaaaagctgtctgggttaacttgaaatgacttgtttttaccatagtcatttctttggtatgttatatgcctgttttcattatggtaaatagtcatagcctaggctattagacttattcattactataatttttataatatttggtgggtaatctttggagttttttattcggatgcctgtcaagtatgttcattcgtgaaccttttagagtgttaaccactcggattccttttattatggctaaaaagcagtcggctataatacctctttaggtgccgcgtatgcttttgtcatatgatgcacgattgtgctattattttgtcttcaactatatgtttagtttgttaactaatcacatagttgggggctacacctaattaggtgcatctattcgatgcaccatattctttatcttttcgccctttacagtcttcgtcttcgctactcggcaggccttggcatgaaaagtttgaagcactcggattattatctttgagaaggctatgatggttgactgcaaaggtctcgggggctactgtggagattatggatatcccatatctacacggtgatgatatttgggctgaatataggataccgaatatggatagaatatcttatttgtatttcgggtttgtttctcaacttgtacgtcaaggaattaccttgagacttagtcggttacgactgtattttatctgtatctgcatattccgttagggatatagattatcttttgtaacacggactccttcccatatataagggggatccgggtgcctctaggggcagttgttgattttctccaaattatacaatcaataagacac

SEQ ID NO: 14615 - DNA, 648 bp, Oryza sativa
tcaaccaggaataaagatcttttcccgctatttccaaaaattttttaaacccggttagggttaagaaccgggactactgataagcgcactgagtattattttccattacatatgtgtttctaaaatagaaaataatgcattaaatttatttaaagtacaaaaattaatgacaatcactacggaaaattagtactgtctgtaataaattaagtggataaaacgtaataagcaaatattacgttttaaaattaataaaaattctaataatcatatatacttagcatatgaatgatattaaattgttaaaaactctaattaacatatgtatatacatacggcatgatttaaaattaataaaaattgtaataatcatatataattaggatattaaattaattgttaagaactctaattaacatatgtgaatgccacatgcatgatttgaaaattttaaaaattcgaatagtcatatataattagcatatgaatgatattgaattaattgttaaaaactctaattaacatatataaatgccacatgcatgatttaaaaaatttaaaaattgtaattatcgcatataactagcatatacatgatttaaacttgttaaaacctcaaataatcgtgcgtaattaacatatgccata

SEQ ID NO: 14616 - DNA, 1501 bp, Oryza sativa
aagagtacctccgggcccgagcttgttcgtcagtccctggtgtcgaaactagatttcggcaataataaaagggggtggctatcaagctggaaaagtgtatgggtttggagacaaaggatttatacaggttcaggccttcttattcaagaagtaataccctactcctgtccggggatgaatccgccgagtgtcttattgattgtataatttggagaaaatcaacaactgcccctagaggcacccggatcccccttatatatgggaaggagtccgtgttacaaaagataatctatatccctaacggaatatgcagatacagataaaatacagtcgtaaccgactaagtctcaaggtaattccttgacgtacaagttgagaaacaaacccgaaatacaaataagatattctatccatattcggtatcctatattcagcccaaatatcatcaccgtgtagatatgggatatccataatctccacagtagcccccgagacctttgcagtcaaccatcatagccttctcaaagataataatccgagtgcttcaaacttttcatgccaaggcctgccgagtagcgaagacgaagactgtaaagggcgaaaagataaagaatatggtgcatcgaatagatgcacctaattaggtgtagcccccaactatgtgattagttaacaaactaaacatatagttgaagacaaaataatagcacaatcgtgcatcatatgacaaaagcatacgcggcacctaaagaggtattatagccgactgctttttagccataataaaaggaatccgagtggttaacactctaaaaggttcacgaatgaacatacttgacaggcatccgaataaaaaactccaaagattacccaccaaatattataaaaattatagtaatgaataagtctaatagcctaggctatgactatttaccataatgaaaacaggcatataacataccaaagaaatgactatggtaaaaacaagtcatttcaagttaacccagacagcttttgtagcctaaaaaagcttacaaaaacagcataacacctttctgtcgggcaccttttaatttgcattgcaataattccaaagaattatatgaccgcgtaaaaaggattttatcagcattgggcaacactattgtgcgcataaattgccaaagcaaaaaatgcctaagtccctaaggagcacaatgggccacgctgttaaaagtactgggctgaggtactgttcaggcctaagcccatttgcacctccgatacccttaacaataaattccgagatccaagcgtcacttcgtcttccccgccggaactctcgccattttccccaatccctgctacagtacagagctgcgccaacaaactagggttcatcattccactcgaatccaccttcgaaaagttcagcaaaatccttcccgtgatccaccgccgcaatccctcacctctccctagccatccctcgaatcaaatcagcgcattcgggtaaaatcga

SEQ ID NO: 14617 - DNA, 1501 bp, Oryza sativa
taggaatccttgacatgaacgaccttaggtattcatgatactgttgtcaggatattaatcgataataggcataatctcaaatttctcctaagggccaaatttgtttaaatatctgtcactctctgtgcgtaagagggtctatgaaatgatgcctttaaaaaagagtaaagtgcacaggcggtccttaaacttgtagggttgtgtcatctaggtccccaaactctcaaaatgctgatccagatcccagaacttgtcaaagtgtatcatctaggtcccaaatcaacacagcccctctaggatcctacgtggcgccaatgtggcatgccacatggacgcgacgtgtcctttttttcttcttttcttttttgttttcttctcattcttattttttccctttcttttgctcgggtcacagagaaaggagaagaaaggaaaaaagaaagagaagaaaaagataagaaaaaaagaaaaaaaattaaatgagtcctatttgtcagtcaaaatgatgacatatcatgttcgtgtggcatgccacatcagtgccacgtaggaacttgaaggggctgtggcgatttgggacttagatgacacactatgacaagttctgggacttgaatatgcattttgagagtttagggatctagatgacacacctctacaagtttaaggaccacccgtgcactttactctttaaaaaatgaccctaaatgagatatactaagaatagtagttaagaattcttagtccacacatgatggacccaaatgtggtatatgtccctctctaatgttaatgtagtttaccaaatagggctcttctaatgtgttggcggatggcatgaggcccttcgaccaaatctgccgaaacccatggcgaagactgtggagcaagaacggcgtgaggcgaagagtcgtgcgagtgccttgccaggccagaggcgtctcaggcaaagggtgcaaggtgaagactatctgccaaaggaagatgacttcgccttggcaagttcgcctccgcgagggccaaaaaagcctttccagcccatcaagcctaggggcaatagggccggcgatcgccagacagcccatcaggggcccatgagcccctatatcatcatgtacccctgtaaatgtccctttcataagggtaatcatgtaaattcccctatataacctaaaccctagtagtaagaacctgtaatggggctataaaatagtcccctagggccatgtaatggggggagaaaaaagaagggaaactcaaaatttaatacacttcgtcttcttcctaccactgttgagtaaccacgtctttcgacgtatgcagttgtcattccgacaacagctggcgccgaccgtggggacctccgagcgaaaccactgagagggaatgccaccgaagaaggtcatgaaggagaaggttgcaaggcggaaggaaagcaacgccgcaccggacatggccgccgaggagggagcagagccttcggtgcccgtggccgaagatg

SEQ ID NO: 14618 - DNA, 1501 bp, Oryza sativa
  unsure (1)..(1501): unsure at all n locations
atttaattgtaaactgatggataaatattttacttttttatataattncccccccccncccccccccccccccccnnnctaagtggcattttaggagtatttgtagaagtgtaggaatagtattaatnataggtgnaangcccccccccnnttgtagtccactattgtttgtagtatattgtttttatattctatttacctataatttgttgatggttgcgcacttagtatcaccctttatcttcggtgttggatgacacacgtgctcattagatatcagctatcgtttggtgcattgtgcatggatatctcgtaagtaatattatttagcgatttgtggacaatggcttgtatatagaattatatatggagataagtgaggacatatgttcgatattttaggttatgattaaccaagaatattgtatactacatatgtttagtaccctaagtaacaaatttaagattgtgttctaaagtgcttatcagattggctactctcttatttatattgaacatgtttcccgaaattgctaaacatgtttcctgaaattgctaaacaatatattatatggtgcatgttttgcaaatactttttatataaaagtttttttttagaaagatcaactaaatttatttttgctttttaatatttaatacaaaattaaacatgtgctaatgacttgcattattccaagtgcctacataaactcacccaataagcttgatctaacgaagtttaaagtaggagataaaggacaacgacacgatgtaaaaataatatatttgatatttaatttctaataatatataaataaagaaaaaacagtacataataaatttactaacctcattttaatatattagttttttttacagtatggaatgagtaatttttgagggtgctatttataactgggttttttcattttcaaaacgcaggtctaatagtgtacttcctccgtataaccttgtaagactttctagcattgctcacattcatttagatgttaatgaatctagacatatatgtgtttagatttattaacatctatatgtatataggcaatgctagaaagttttacattgtgaagcggagagggtacatgttatgtttttttctttttccgggggtacgtacgtgtgtgtgtttttttctatatagtattcgtatgtgactgggtacgtacatattttctttttgtcaaatagtgtacgtgttatggtttttttttcttctccgccggcatgagaagtgaaagaaaagcgtacacacacaaaggggaaacggaggtcagatggatacgtggatagtacgtacgctacggagggatcatacttgcgttggacggatggatcgagattttgatttccttttaagataaatctaacgatcaaaattaatgggtccatcaatttaaaggaaaatcgacggtcagatttctctattttaatagagtgacatgtggcgactcgagagcgtttataggatgccacatgt

SEQ ID NO: 14619 - DNA, 1501 bp, Oryza sativa
ataaatgtttgaggttgaattgattatcataaaaagaattaggtcaaacattatgatacattctaagggggaggatccatgtgtataagctgggcctggaagtttgagacatgaaggccttactctggttgcggctcgtcgttttgaatttgtcatgccaaataccggtcatgaatatttgacatttagaacaatattcaatcaaacctttaaaaatccggccatcaatgttatattaaaataagtttataaaaaccaataagtttcaaagtatttgaggcaaatctaggcataccttttttttattaaaaaaactaagcattagagaaattataatcaaagtttttaattttgaccaaatctaacaccgaacatcaaatgtttgtgataaaagagagtaataaacaagtactgtgagccttgttttctccaagaagattcaagcctcatttggttgaaaggattttttttaaagtacataaatatgcaatcctttggaattgacactataccacagtgaatccaaaggaatccaccaaaaggaaaactacagtaaaacttgctatcccttcaccaaaacagaggaaaaaagaatccactcaattacaatcttttcgatcctttggcttggctcacgcaggaacgacataaaagattcctatgtttcacagtgcttattgtaatttgtaacaactctatctaaatctcattacatgaggctcctcttcgtcgccggccctgcgaaaaaacaagcaaaataaaatctcttaggcctattcggttcacgggatttcccaatcacaagaataggaaaaacatagaaataatgtaggaatgcacgtgcaaaaaaaatgattggaacatattaattttttctacactgagctaaacgagaggatggagtggatgtttttattcatatggaattagtacattttggagaattggcatagctttcctatgaaaaatcttcttttgaatcctatgaaccgaatgtataaataatgtttattgcaaaagaattaatatttcctttagaaatacttctcctggttttctgctccagaacgaacaattgaggcctcccatcggatggcctaaacagtcaaagaaaaagccaaattttagattttcaaacttaattttgagatattttcaatggagtttcttttacagcattagcttttaagtcacaagaacacatatatataaattttaccaataaatttatttttattccttaataagccgttttgtcttatcagtaaaaaagccaaacgatgtggcctgagcaaaacacaacagcacaaaggatttggagagggcccacatgtcatggacctgaaaaaatgttaggtcagcaagtgacagccgtcacccagcctcgcaattgccggccgagtcgatcaccacacaaccaaaaaaactccggcccacttggagttggagcccgtggcaaatccatccatccatcgcctctgcctcgcctccaccaccgaga

SEQ ID NO: 14620 - DNA, 1501 bp, Oryza sativa
tagctttgttggtcctgtccagtttaggaaccaaccaatagtccaaggcagtaagaaaaataaaaactaaagggggagtgacaaagaagaaaaagtaaaagacaataaaactcaaatgttcctctcctcctctccttgctgttcttctcctccttgtcaccatcatgcctcaggcgagctcctcgcggccatgctaatggaggcaaggcagcctagctagctacgcatatgcagcagtacgtatgtactcgatcatctgctgtgcagcggttcgggcactatagccgaggccgatgccgacgagcccagtgaccaccacggcggacggcgacgggctagctcagcttgacatcgccatttcgcgccggcccagcctgcttcaccccgcgctcctccgcgacgaccgcgcgctcctcgctctcgctagcccgcgtgtgccgccaccgctcgcgagggttaggaatcggggacggaggtcggaatggggtacggggatcgggaggagtcagcagtggcttaggttgaaatttttgggatagagatgtctttttacattttgcaagtcaatttcttattttcttaaactcatttaatctgagtccacctaacagacgttaaacaggggcaaacagaccattcaacatcaaaaagtgagggcaaaatcacaaagtttaaaaagtaagggtaaaatcacaattgcaaataaaagtaggggcaagaatacaattgccctaaacaaaaaagtttgtgagaacaccatatcatcctgctacattcctcctcccttcccatctccatctcctgtgcagctaagcctgctaatgggttggatgggaatgggtctaatggattggttttcaatttggcttcacttggtatgggtgtaaacgggttgagatagctaatggattggatcggcttgggtgagggatggatgtgggttggattggattggtttttggacataagttttggattcaatttgtaggttagtctttttttttctcccttatagttgactgtttggttccacatatagatggccaaataggctgcctggcccggcatggcccatgcacgactaggcctgggttgaggctagtcgggccagtatggcctgaccaacacccaggccaggctgggactgcccatgggctgcacccctggcccaacaagactcgggctatgccgggctggcccaaaggcacgatagcccatcgtgcttctctattaaataaggatttttttctccctcatctctttgggctatgtgggccgggccgtcaagcctcgggccatatggccatctatagttccacgtatctgtcaatgcctaggtgcttactctctctgtttcattaaaaaaaaacttctaaatttaaatctggacatagggggtgtgcttgcacatatggacttcatattattgtcatttcaaccaaaatcaccttggttttaagtgattcggagggtgtccggcgtaaatagttgtttctataat

SEQ ID NO: 14621 - DNA, 1501 bp, Oryza sativa
tatatatagtacaatattaattcctgacgaacaatattagacttcttcagtaagcaaatcgataacagataatcaaggatatccttagtagtttaaagggtgcaataaagtagcatccaaaaaaatcataagggagcatacatagacaaacatagcatcatcttgagcgctcataagataacttactaggctacaagtttatgatcaagatacatagaaccaaaatttcactacatgtaaggttgtatgtatgttcacgagccagtgaaggacactacagaaggatagatgccgactgagaaaatacaggaagaaacacacaagtaatgtgcagtttgacaaaattgtgttctggagtattctgaaatttcttacagtgaataaaaaaactagcacacaacatgaattattacaatgtatcatcctgaggttcattgcattactagctgactgttggttaggccacagtttgtaatttggataaattttgtacctgcctcataaattgcattagtactgtagttttgctttacacaaaactttacctttccagataagagtcatgcatcctacataaaggatacataaaagggaaggacctagacagtacattactgcatttattccatgttggttccaagttccagcacaaaaggctaaatttttgcctccaacaagaggaaagacggaaccaaaaggttcccaacacaagcacaaaggtcgtgtgccgaactgccgatttatcaaagtagagtactaatagtgactgagatcatgatcttatctgtaaatcctattgtgagttgtgactaagaaaatcggtatccaactatccatgattcatgctgcttcaaccatattgacaaaacttaatcggaataaccggaggacatatatcactcatagggtcaaggcatttctagcagggtcaatattgcacgaaccaagacagcaattactacgcttaacatctcaagcactgatgaaccaactgaagttaatcagcttcctaacttcataaatctgcaaacctaccttggacacccaaataatttggtaccaaaaaaattgtctacaatcactacactcccaaatcagtaaatcgcataatcacaccacaccctcatagtggtcctcgcattcattcctggaacattcccccacacaccactgctgcctaagcatcaagattcagatccagattcagaccaggtcctgcaatccgtccggtgtgtagcgacactcctatccccaaaacaacccatgcaaatcactatctagtaggaacccaaaaatggtgctccctttgttcgcaaatttgacagtgaattgttaactaacactagtacagctccctttcgaagaacaacgaaattaacaaaaaagaatcaatcagatctatccatacgcgtggttggcaaaatagcagtgagagaacaggttgagttaaaaaaaataaaaaatgttgaaggaggaggaggaggaggagtgtatactgttg

SEQ ID NO: 14622 - DNA, 1272 bp, Oryza sativa
tatgacaaggaaaaatattatctgctcggtttcaaaaaaatatattatctgctatatgaaaaatataaatcaatatattatacgctatattgtttaaatgatttttttaaaaaagagttaaataaatatttttagacttcgatacggtcttcaacatgctactttgaccatttttcctgaaaagttataaaaaatgtctgcgtttagtttgttgctaaatttggtaaatatataaaaaaaatcctgtcaaaattttggtaatattactgacttactaaaattttggttttatccaaatttaatgaggtttattttgactgtctgaacagacctttaattataagagtgcgggctgcggcgtctactgtgctgggcaagcttaattaattagtggcatcgaacgatgctacgtcacgttcccactcccaccaagtcaaggatatatactctttttctcgtttcttttagaaacatgcaagggaggaaaagacaaataaatttctgagattcagaatttttattaattttgtaccttaaaaaattgataaaaagttaaatagcaaaacccaaaaaaataataatgccctcgtgatcgtacacatcccatccatctacccacggcctgtttagttggagggagtttttagaagggattgggagtttagagggatgagactattaagtgttttgtttggttgggagatatgggaactttggtgggatggggatgaggaattgaggaaggaactccctactttttaatacctgggtaggggcaggtaattgggagggaattcctcctctattttatctaagcaaatctcagccatgcgtttttattaatgatataatctctaactaaactccctatcaattttcatcacctctaccaaacaatgtattggaattaaaaatcgaatcctatcttaatctcatatcaatttcctcgataaacttccaatcccttttcatcaagttaccaaacaagccgccatatcaatctgatttgggtcaacgatgcaacaataattagcaagtggaagacaagtaattaaggaggcaggagcagcatggaaaaagaagaatagaagattactagatattgtactgctgagcgaagaggacagacaggtaagctagctaggcaatcaatcatattcgctctccaaaatgaagggatcgatcatctcacaaacaaaaacgtgagggatgaaggacaaggacaagaaataggtgaagctatctacttctcgatgcatctatgtacggagg

SEQ ID NO: 14623 - DNA, 1501 bp, Oryza sativa
  unsure (1)..(1501): unsure at all n locations
gagaggatgaatgccctgtagcggtggctggtggcgagaagctgcgtgcggatgcggcggtgctcggcgaagatctcggcggcggcggcgcgcgcctcgacgtcgaacatgtggtagatcccctcgaagcggaggatctggagctcgcacgtgaggcggaacagcacgcacaccaggaggaacacgcccgtgcggtacacccacgacgccaccgtggccaccagcgccaccgcgcgccacggcacgccgacgccggggagggggagcggcggctcgacgcgtacggtggcgaagaagaatacggcctgtgcgcggcctcgacgcagagcgacggtagaagcagcgcgtcgaggagcggtaacgcncggtccagctcccgcgcgtacccgcgccgcacgaacgcggtgtcgtcgcggagcccgccgtcgaggaacagcagctgccggagcccgccgccgcggcggaagaagcacgcgagcgcggcgaacgagatcgccgccagccccgtcgccggggcctgcgcgacgcggttgaacgtgatcgccgacgcggacacgggggacgccccggcgtcggcgcgcagcgagagcgacacggcggcggggacggcgagcgccagcgcgaggaacgccgcgtacgacgcggcccgcgcggcgcgggaggagtggtccagcgcgcaccactgcaggaacacccggaagctgcgcagctcgtcgtggatcaccgacttgctccgcgcgtacgccgggttcagcagcagcggctgcgacgacgccgccgccgacaacaacgacgacgaccacggcgacatggaagacgtctcctcctcctcggaatccattgccattggaacagttggataattcggtttgattcgtatgcatcgaaatatatagtcgtcgtgatcgagtgagcagtgtggggggtgtgcaagtgttcgacatgaggggaaaggagaggagggaggaggagatctcgtgatcgttcacaagggcggcgacgactgatgaatgcagaaaaaggcaaggggaagaaggcgactagctacgcgtgcatatgcacgaactgttcgatgatcttgatcgccatgcatgcattgtccatgatgttcttccttttctttttcgttgtcaaaggttgtcacctgttcagctcgatgcacactcttggctgagctatactgaactgaataacttgttttgttttttcttaaaaaaaaagctcgttccggtcataaatatttaactcctggaatgagattgtgatcaaaatttcaaaattcagaccatcgaaatttctttaaatgactaatttaaaagcacaaaaaagtggcaacaatagatttaccttgaaaagtactgtcataatatcataaacttatacacatatacagattggcagaattttaaacgattgataaatcttcttctaagcttcaaatatttataatcagagggggtaacttttctttttttgtgagtaaaaaaataaaatgaataag

SEQ ID NO: 14624 - DNA, 1501 bp, Oryza sativa
agtatttactctaatagtaaagactaagagggactatatatatgttattctagtgctttcagtcgaaattttaaaagtttgaatacaaccttattcaaaacattaagagcaatggaaccggagagagtaatataattagagattatagtgtgtcgtatttgtgggttttacttaattaattaagccggcctgatcagtgtctacctacacactggcatggactcttgcaaagtcagatggatgctaatttgtacttttgtgcaggtatagagcggtcgcggcccagcctcgatcgctcacgtccgcaccgtcgccgcgcgcgcgtgtgacacacgcacgcacgtacgtacgctccgtgcatccgtccctcgccgccctcggtgctatactcccctcgcgttaagggggtgtatatccagggtttaaaattttaacgtgtcacatcagatattatatagaatatcgtatagggtgggcactaataaaaaactaattatagaattggttagtaaaccgtgaaacgaatttattaagcctaattaatctgtcattagcaaatgtttactgtagcaccacattgttaaatcatggagcaattaggcttaaaagattcgtctggccgcaagctgtataattagttatttttttaacctatatttaatacttcggatgtgtttagatctaaagtttggatccaaacttcagtccttttccatcatatcaacctgtcatatacacataacttttcagtcacatcatctccaatttcaaccaaaatccaaactttgcgctgaactaaacacagccttcatgcaagtgttcaaacgttcgagtgacagggtaaaaaattttgaagtgggatctagacaagaccttatttatacaacataaaaacactatatctatacttctttaaaataaaaacatcgatggtacaatctgacaagataggaccaccatccttcatccttcatccagtttcagacccagagatcaattgccacatctagcaacaatatgaatacccaatggataaagcgcgaggagagagttgcagacccagagcagattgcagccggactgacatggatagagattagtagatggtgtggcactttcgtttggtggtaaagtaagccatactgttagttactcctctaaattttttgcagtgtagcaagctaaaagatggagtgaacccataaataaattcaacctatagttatatggctagaaacataaatgtagctactttctctgtgcacgagacactagagatagaactacgtatgcacggaccggctcatcactagaggagtaggtgtcaaccggtttcaagataaatatccctatataataataaacaaataaataaaatgaaagaaaattaaaaaaaaacacttgcaattttgcaaacagatgcgccaggttgcatggacacgtggcatttctcccacgttactcctgcatgcgtgcatgccgccacgtgtccacccctccc

SEQ ID NO: 14625 - DNA, 1501 bp, Oryza sativa; identical to SEQ ID NO: 14624

SEQ ID NO: 14626 - DNA, 1501 bp, Oryza sativa
gcgtcacaaaaccacgattcatggcgcagcagcgtcgtcaaaagcagcaaccaggcgaaagcaaaaggctttacaaagactaaaattaaaagcctagagcgcactaatggttttgcattaatcggtcagtgaatccggtcagggtgacaagcagaaagtgcaaaacaaaatttgatgattcacatatctctgcatgatcatcgatgaatctcacagtcgccggctgggattctgacgaattcctgatcctagtaggctgctgcagctgtttcagcgacaacagtttcctctgattcctgaatcttcagtggatgtttctggacctcaataatcttgcccccttgggcccacacgtcatctgcctgacgtgtcaccgacacatcccggacagaatgctgaccggtgagctcacatgtgacacaacactgcactaagaactgctacagtgtcagtagctttgcagctagctatgcactatgctctctgccactgcaagtgatctccaatacaagtgcaaccatgcatttctcgatctccctttcaccaccatgccagtggaccaatcgataaacgcaagttgatcacctaaacaagacagaaaatgcttcttctcgaatgcttgaaccaccaagaaaaatcggacgggcagtctctaacacatatgcacatatccaagtctgtatctctatctccaaccatataacatgcacctttaatgatattcaaaacgaattttctcttaaattacttatctaatctataatccgatcacaccgctgtattcttcataattaaatctttataacaagatatcgtatgattatattttgatgaaagaaaaacatatgtttcaatccactaacactggttgtttcatatgtgatagcgatatgtttcaacgtgtattttcatcatgtttcataagctttttaaatgttttagttgctaattttttgtttcatcctatataacttgatatttcactcgttagtcaactggaacatttgacggaccaatttttttttggtcatgctgcatacgcaggtggtgtgatgacacgcaaacatcatgcgtccgatatttgatggaatatcggatgtccgacgcagagtcatctccaaacaagacagaaattatgcaactaattttgaactgtcgctaattggtacagtagttaccaattcagaatggacggcggtgatgaacctggcagccactatatataaaccacactcaaccaagatactctgatcaactggtgagtttggagtagggcatagattcttggagaactgggcaaattttggcatggattctggtgctgctgccgtctgcgcggagaaggcgagtgagatcatcaagatcggtcaggttgatgacgtgcaggagctgcagcgacgactgtgctccgccaccaccgtgccggagcggtacatcagggacggcgacgaccggccggatcacgccgtcgtcgacgacgagcgcgcgcaggagcggattc

SEQ ID NO: 14627 - DNA, 1501 bp, Oryza sativa
ctcaggcccgacccccctcggggagggccacgtggcattggagggcagcctcctccatccaatctctgggaaggagtggccgccgtcctacctcgggcctgactcccctcgggggagggccacgtggcatcggggggcagcctgatacccccgggaccatatcaccgacatgtgtgtttggcagtcgtcccgtgcattctgctaataacgatgatgtgttaatttggaatgtgtttttttgtgattgatactgataatggcactataggtacagaactccagatagctaggcatatgcctttcttcttttctagccagtgacagtgactaatcttactggctccagtgacttacaggaggagcaggggagtctagctttcgttgctgtggctgcttttctatccattcatggaccataggaagtgcaacaagtggcatatggagttagcactttgcatatatatgcttcatgccaaaggggaaagggaaaaggacctactatacataaagtttgggatgatgcctctcagacatctttgaggttggtccactcttgttgtggattcctatgcacataagagtactacagcagatgtgcttgacagtggaaaagcgccccttaatttcttgtagagattaatcctctttgtttcaagcaaagctagactagagcataaggaaatgtcagcttcaatcatctgcattatctgatctagattctagcttaaaaaaactctatgcactaattcacattgagttatatgtaccactcaaattctagaacataagcttaagttgacgaggaagctatacatgtagatgtagttcgtttaagcagcttgtttttctttgcataaaattaagttgtagattactgtttcaaattgattactgttttcaaacaatacacataaatataaaatggtttgacaataaggtagaagggactattggcttagtggtggtaaagttgtgggtgcacggctttatccatttagaactcaaattcatatgtcctgtttttgattcaatagatattttgagatgttaggatgtactgttgacctccatctctatatctgagcgtgtgtacaagtatggagtgtcttccatgtaataacaaaatgtagagcgggatatatatgtaatttccatgctggtgaagtgaaaaaacagagatagaaggtccaatcaacggggagattcctgacatatatatattggttttggtcagaactgaatgctccaagaatcaacagttaaatatacttacaaacaacatgcaaggaagcacagattccttgttgatttgattattcctctgttttcatccatgcgtccatgctattaactctaaacatctcaacaaatggggccacgagttgctttggcaactaggtataattcaactctttggattctagcgaccaatatacaaccttgaactcaaaggaatctccatgacgacctgcaggagatgcatgaatccattaattgaact

SEQ ID NO: 14628 - DNA, 1501 bp, Oryza sativa
gagtttagttgtgtgatgaggtgtgacctctgaactacattggtcttaaaatataatgcattttaatcatatggttatatgggtaaaatcctaataatataaatctggagatatatctcgtgtttatcacccggattgttcttgagttgttgttcctaatacttgggttgttcaaaattactgtattttagaacggaggaaatggtggtaaacactgtttggagttttgtgtggtgtgatacataggcagatcacgcatggtccgcataaatggatagctagacattgcacagttggatagctagaagatggtaaggacttttggagtttgtgaggtgtgacctctgtacgacggtgcgttagcgacaaaagagaagcccgcgtttgtttgcactgccaagtgtcgcgcacttatcaaccacgtgccgcccaaaccctcggaacggtgccgcactgccgccaactacgtggcgatatccagatgttcccagcagtgcatgcttatcacaacacagcaccgtaatgactatgtaaaatgatttcgacagcatcattcatcaaaacaaaagcacaaaacccatattaacagtgacatcttcgtctgcatcaaccaaacctagacacgacgttgccacgtcaaaccccattagtccttgacttagctaatcctaattaatgctgaaaaacctaaagcccaaaccgtgtgccgaccggagctctcaacagcctctgtttccggcaagtaggccgtccacggttatggatcagagagccccaagtgacaaacggtttgacagtactacttgcctatgttgtggtgtaggatataatgtacacgtcatcgcctaccccttgcttgtttcacttaatccaaagagttgcaaagaaagggggtgggtcgccgtcgccgacgctggtcaaggggtggtgatgtcatggatgctcttgcgcttggagtcgcgggcgccggcgttggcctgccggatgaagtacttctgcgcgtggctcgccacctgcgtcggcgtccgcgtcctcaccgagaaccgcgagatgttcctccagtctccccgcccgtacctgtccaacccctcgagaaacaacctgcacacacacgcatggtggagcaaaacgaagtgaatttacacgggaaaggcggttgcgattgagggggggtggctggcaggtgggggccatctgccagctgggaagagtttgttggtttctctcggctttgacgaagcaatgcggaaaagatcgcgagaaaaatcgagaagcctctggaacagagacgagcaggggaggaggagggaagggaaggagacgagggtttgaggtgtgcttccgtccgtacctgtgctcgtcttcggaccagggtacgccgcggcgccgctcctcgccgcggggcttgccgccgccgccgcggcggtcgttgccgtcgttatcgtcccaggacccgggggcgtcgacggcgccgcgcatgatgagatcgatgtcggcgacg

SEQ ID NO: 14629 - DNA, 535 bp, Oryza sativa
agcacaccgagataagaaaaaaaaatgaagaacagaagcagaaaccaaaagtcaggccaaaaatcatcatcatcgcaggggcaactctttccgggaagagaaagatttatgcgcattgactaatactagagataacatggagggaaggggggagacgatggtaggaacctaacctcagacgttgctgcttccatggggaaggagctccatcccctccaaaatttccaaagcggagagcctctctctgttaatttggagtttggagggagcagagcaaaggcaaggcaaagcaggtggactgggacggcgggtggagtggggcaacggtggccggagcggcggcgcgcgaagccagcgggacagccgctcgccggtggccacctcaacgatctccagccgaccagcccatccacttgctttggctgctaccaccattgttttgtataagaggcagccctacccttcaccggtgagagctccacgtctccaaccaaaatccatcgtcttcaacccaacccaaaccaaacaaccatca

SEQ ID NO: 14630 - DNA, 1501 bp, Oryza sativa
caagtactaccgcagccgaggctacacaccatgttaggccttgttcttgctcgtttaatccgtcctacaaggaaattgcggaagattcgaaggggaataatttcacatctattcaggtgtagaattaatctctcaatccccttcactttcactcttttgaggatgaaccgaacaacctcttagcaacagggttttaaatgtcccgctatagctgccgctatcttccgctatagctgtttgagaagggttctagctatttgttctcatatacattttagccgctatagctccatttagttcgctatagctaccgatatagctgtttgagaagccaatcgctaaatgccttaccccgctatttaaatcattgcttagcagggggagaagccatgtgtacccggtcatcgtagtggatgcatgccatttccccgaacaacgaccaagcttgaatagactagccatccatcgatccacgccatggaagagagggcagaggagtagtgcgcgtacgcttcccttccagcgtccagcgcggctcttctgggatgtcatgcattgccacccaaccagctgacaaatacagcctagatgagccattcccttgggcacaacaagcatcttactagcagccgattggtttggttttggtggtgcttcgattcccagtgactcctaatccccattgatcatcgacaaaagatttgagtgctatatatgcacatgtgtgtgtacaaatgtagtacatgatcagtgttttttttttgccttatttttcccctcttctcctttcaggctggtgtactagaattttgttggatcgcatggactacatgtctggtttgcttggtttcttatatattcgggatgggaggagaggatcaaattaagagcaggtataggccacaagggtgagtgatattgaaagctgtggcaattaatcaaggtttgtcccagtactgtcgttgttagtaaccattgtatccgatcaactgcattccttttgtctactagacctagtttgatcaagcgagctctaattaggtgtaattaagctatgtggcacatgtagtgtgcatatttggactactgcagagttcagagttcagagtgcaggctgcagtgtcatgcacgcacagtccttggggttggggagcttggcataggcagtcatttataggaataagttcatcaaacgaatccgatttttgtctttaaagcccaaaaccaaatacaatatatctcttaactattaaaaccggtgtagataagatccctcagcggtttagatggcagttttgactgacgtggtgcatatgtggctaatttgactgatgtggtattgacgtggcgcttacgtggcaatttcatccgaaaaaataataaaccccatgggacccacatgtcagtttcacatataaattaataaaaaaatggtggggcccatgtggccccacatgtcattatcacccctcctctctaccccatctcccatcgtcttcat

SEQ ID NO: 14631 - DNA, 1501 bp, Oryza sativa
tttcgttcgtaccactcgatcgttagcagctacaactcgttggagacttggagttatgattctctagctatgaagatcgcaggagacgacaagggccgcatcatgtaacacgcattttcgtccccatcatcttcaattcatccgatgcatggcaatatggcatgatgcactacgacccccctatttttccacaaaaagaaaagctgcaccatgcaatacaccgcgcctgtggctgtgtctggctagctacgaccctccttaatttgtctctgagagacatgtcaactggcatacgacaaatgtgctggagaacagtactgccatacgtaccccccaaatacgtgcagctacttgtaccgcatgtgatatacgtaaatatacaatgggcgcgtcggagttgtttctcgttgtccctttacttacgctagcaaaacagtaccgccgccgggctctagagttaccgcgcttaccgcgactccgcgagtgtactgtaaaagaaaaactacgataacctctttaaattcaaataaatttaaaatatacttcgaaattttgataaattttatacggtttcatacggtttgccacggttaccacacgataaccgtgcttaccgctagagcgcggtaacctgaccccggtggtttgggaaaccctgccgggctctcaaacactacgtggttagggatacaagtggacgagcaaactgtttttttccatttatgctaattttaattatataataggatagagctatatatactattattactataacatgcgtgcacacaaatctaaaatactggttgcagggtgcaaactctaccaaatcattgggccacgtggccaaaccaaaaaccaagttcacatatcatcaaaatgtgccacgtgtccagaagagcacgttcattttgaacgtgtgtgaagagtctagataaaacaaaggaaaaaatccagagcattctaaactcggttgaaaaaaatcacacgataacacgaaaagaactggtgaaaaagattgcatgctgaggaaacaatggataagaaaaaaatagtatccaaaaaactgccacaagttttttaaaggaacaacttttaaatctaactataatataattccactataactataccgtaacaatattgtaacttgtatataagtattaaaatactatatgcaactttatatcacttatatagagattactacagtacagttacactattatgtacaatgtaactatagtgtagttacattgtagttatactacaactatactacagtaacatttaaaagtttttttttgccaaaaaaacttgtgacaactttttagcaattcccaaaaaaatataaacagcgagccgatgttagctgtcgtaaatcggcaacgaggaagacatttaccgcaatattttccggatccacggaagctgttgccaacgagcaagatccactcactcaatggagcaagtggagggcgtcgagccataccagctgtga

SEQ ID NO: 14632 - DNA, 1501 bp, Oryza sativa
aacacggagaggaaggagatgaccaccaagagaagcagtttgcctttgggatttggcctgcggcgacatggtgtatagtgtatgtacgtgagtattgttacactaatcgtgattagtgtggtaatctgatgtgatttgatgaatgcatgatttgctctttatattgatcgagctagctagtgggccctacatgtcagtgtgcccatccatacttttgataaatgacaaatgggtttcacacatattttttatttctaatgccacctaaacgccacgtcaacaccacgtgaaaaaggagaccgagtcaatactgccacgtaggcgccacgtcagcgaaaccgccttccaaaaccgtcgagggagtcaaattgcaccggttttgagagtttgggggtcgaaatatctggttttgtggtttagggttacggattagatttcgatcacttttaagggtcacaaagtgaacttattcctttaattagctgcgggtgcattgtggtagcccacggaaggggactgagtgccatgttttggaaaaagtccactttgacacccttaaatgtataccgaatctaattcgtacctctcaaccagaaaaccggttaggatgactcccccaattactaaaaccggtacaaatagactccctcggcggtttcaagggcggttttgctgacgtggcgttgttgacttggtcttcgtcccacatggcgttgacgtggcactgatgtaagattagatttaaaaatatatatgtgggaccaatttgtcactcacacacaaaaattataataggatccactgacttgtggggtccacatgtcattctctttccaacctttctgcctccctccctctcccttatttctctctttctcttcccgtcggcgagtagcgcggagagcttgccgagggcacggatggcggagcagagggcggcgagggagcggagtggaaggcgccaagggagtgcacgaagccgtgaagccgtgggcggcggtgggtggagaaggccggcgcgaaggccgggcgaagcggcggcatcgagagctgccagtcgccgcggtcgctcctgtcgcgtatcctacagtgaggtgacggcggcggcagcggtgggaagatcgggtgccgggtgcggctgccgtggcggtacagctccacctccgtgttgatgcgatgttgttaacactccgccgccgccggtagtggcggcggcggcagcggtgggaagttcgggtgctggatgcggctaccggcgccggccaaggtcaaggtcatcgggagggcgccggagttgtccctcgacacgccgaggagttcttgtacactcgacgaggggagaaatggtataattcttgccgtgcgcggcgccagttcagtgccagagacgagagcgacgacacggaggaggtgactgacacgtcggcgtccttcgccgccaaggagggcgtcgtcgccgccaagacggacgacgtggcggcaagaaggccaaggacggtgg

SEQ ID NO: 14633 - DNA, 1501 bp, Oryza sativa
gcctacttgtcagccatcttctccctctctattttttcccccaaatcccccaaaaagaaacagtagagcaagcggtcgaggaagccgagtgcgtagttgttgtgcgggcactgcactacacgttgtcgtaggtgtagacgagggtgtggttgttgctgctcagcatcagctctggctcgctcctctcttggtactgtgccgccgcgtcgccggacccggacggccccgctagcggcctcgcgcctggcggcgataggtccggcaagcacttcgccgaccgcttgctcccgaaccgccccggcgctgccgctgctgccggcttgagcgtgcccccgccgcggatgagccggtggattccgaggtccgccaatagcggctccatgtcggcgtcgagcaggatattgctcggccggacgttgccgcacgaacttcttgtcgtggaggaaggccagccctctcgccatgccgcgggcgatgcgtcgtcgctgccgatcctgcgcaccgccagcacggcgccgtcgtccaataccgccatgtacatgatgctgctgcccgccgcgcctaggatgtacgccgacgccttcagtagcgtctccatctccagctccacgtcgccgtccaccgtcaccagcaccgcgccgccgccgccaccgtccttggccttcttgccgccacgtcgtccgtcttggcggcgacgacgccctccttggcggcgaaggacgccgacgtgtcagtcacctcctccgtgtcgtcgctctcgtctctggcactgaactggcgccgcgcacggcaagaattataccatttctcccctcgtcgagtgtacaagaactcctcggcgtgtcgagggacaactccggcgccctcccgatgaccttgaccttggccggcgccggtagccgcatccagcacccgaacttcccaccgctgccgccgccgccactaccggcggcggcggagtgttaacaacatcgcatcaacacggaggtggagctgtaccgccacggcagccgcacccggcacccgatcttcccaccgctgccgccgccgtcacctcactgtaggatacgcgacaggagcgaccgcggcgactggcagctctcgatgccgccgcttcgcccggccttcgcgccggccttctccacccaccgccgcccacggcttcacggcttcgtgcactcccttggcgccttccactccgctccctcgccgccctctgctccgccatccgtgccctcggcaagctctccgcgctactcgccgacgggaagagaaagagagaaataagggagagggagggaggcagaaaggttggaaagagaatgacatgtggaccccacaagtcagtggatcctattataatttttgtgtgtgagtgacaaattggtcccacatatatatttttaaatctaatcttacatcagtgccacgtcaacgccatgtgggacgaagaccaagtcaacaacgccacgtcagcaaaaccgcccttgaaaccgccgag

SEQ ID NO: 14634 - DNA, 1501 bp, Oryza sativa
gaagcgtcacagtacaccaggaagtccttgcgagtatccggtaagattaaaactggcgaggaaaccagcttctctttgagagtttggaacgccttctcgcattgcgggctccacacaaatttttcttctttcttcaacaactgtgtcatgggttgagcgattttggagaagttctcgatgaacctccggtagtatcctgccaaacccaaaaagctgcgaacctgagtaactgtcttgggttgcttccaatcagtgacggcggtcactgttttgggatccacagcaactcctttagcagatatcacgtgccctaagaatttgacttcagacaaacagaactcacactttctaagcttggcatacaattgatgttcccgcagctttcccaacactagacggagatgctgctgatggtcttcctctgattgtgagtacaccagaatgtcgtcgatgaagaccacaacaaacttatccaagtattccatgaacactttgttcattaagttcatgaagaaggcaggagcattggtcagaccgaacgacatcaccgtgaattcatacagtccataacgcgtggtgaatgcggtcttcgggatatcttcttcacggatacgcaattggtgatatccggagcgaagatcgattttagaaaagacagtggcacctttaagctgatcgaacagatcatcgatccggggaagagggtacttgtttttgatagtgacttcattgagggctctgtagtcaacacacatcctctttgtcttgtccttcttttccacaaaaatcacgggagcaccctggggggaagtgctcggccgtatgtaccccttttccttcagctcttccaactgcttcttgacttcggccagttcattcgcggccatatggtagggccgcttttacataggagttgttcctggagcaaaatctatccggaactcgatctcccgcttgggcggcataccgggtagttcttccggaaatacgtcaccgaattcactgacgatggggatttttgacagtcctatctgatgaagttctgaactgccgacagaggttgggggtgcaaagaaaacagagcagatcacctttgatgtcgctgaattcgatacagcttacaacgccatcatcgggagaactgcacttgcgaagtttatggccgcatctcactacgcgtatcaagtgctcaagatgtcgggaccgaagggaacaatcactattcaagggaacacaaagctggcggtgcaatgcgacaaacggagcctcgacatggtcgagcaaacgcccagcccacccgacacgactgagccacccaagaaagtgagcaagacaaacaagacgctgaaaccggacggcgcaatcaagatcgttccgctctacagtgccaaccacgacaagaccgttaagatcggggcgatactaagcgagaaattggaactcgcgctcatcaccttccttcgcgataatgctgacgtgttcgcttggcagccgtccgaca

SEQ ID NO: 14635 - DNA, 1501 bp, Oryza sativa
accccccaactattgaaacaggacaaataacccccccggctcaatccgcggtggttttggtcctacgtggcatatgcgtggcagtccagtcagtaattttattaaaaaaattagtgggacccactgtcagttccccacccctctctatctctctcctctatctcaaccccccctctctctcaaatccctccgctcaccatctcactagcacggcggctgagtcgaaggctaagacgaaggcggaggggatgaccggcggcgggtggtgttggtatttcttacgaccacagagaaatccgcaagcgcacggaataccgctgtagcacttcatcttcggttgaccccaaaaggatatcaaactcagggaacgtatgtaatctacctaagcgtaagacgatccaaggacaacaactgatgataggtagactaggctagagaggactttctatgtggtttaattatctaagctaagcaaaggtaattccctatctgttgcttcgggaaccgacccccgctggtctaccagcgtggttcctgctatagctctttgatgtatccgaacgtggaggattactaggacgggattcagggctgtcaccacatgccgcctacctctgacaaatccgtggcatacacaacaaacaaaggtaatctctaacttagacaccacgtctaagttattaattactactctaatacttgcgcaagaacttccttctctatccggagtcctagtactagagtacttagtataaatactaaacaattaatccgcaaagatggaaacatatcttacttaaacaaagtaattaaataacataagaaagaaacacgaatgcttacttaatagaagaagtttctccgaacccggagcagattgtaccgacagctccagtactcctctagaattcctcctaggaagctacactcgtcgaggtagaagtcggatgagcgccaaacttctgggcactcctccagagctctctaccttattctaatgtacaaaagatacaatacagtctcttgtaattcagctcaaagttgtgtattgaaaatgagagtgagctcctccttttataggcaggtatgacggttacagcctatgcgaaatgaccaaactaccccggaaccgccattaggatgtgatcaggaccatccacatgaaatttggcgatcaacggccaccaaaatggttcggccgaacccgggacggctccatttggcccgtttttcatcgtggacactaattttgaggccctcagcccattggcatgatagttgggcccatttggagttgttaccaactgggactaaagataaagcatctttagtcccggtactaaagaggccagatccggttgctctttattcttttcttttcttcattgtttttaataaattgatttcacccccatcccatccccaaaatcccaaatcaatcatcctcaaattgcctctaaatccacaaatcgatcatctcaaatactcagatacatcacaa

SEQ ID NO: 14636 - DNA, 1501 bp, Oryza sativa
ttaccttccccaaagaaaagttcgaccggaatttggttgtgaattgtgaccggtgggaggattattgagtggggtggtgaaattagcctgaaaaccgttgccatgactgagctaatgccatattgatgaggacacgactagctcggatataaccatgattatcttatatattaatcaaccaaaggtgcatatgttctatatttgatttacttgctatatatttgaacaaatgttgctacacaatgagttttgtgtattttcgtttgcagaggtactttcttgggcgaaagaaaagagaccaagcgtaaggaatgcatggatgattgaagaagttgattgaggaccaaaccaagaccttctccaagtcttttttcatatcaccacgtcacttttggtccataggagacaagagataaagttttacacgttttggattcggattcgggcctcctaacagcattaacttcaaatggacctagccgctgatctagaaggaatttagggacccatgagtacttattggaaagcttatggagtctacttttagatggtttttgtcccacgtcaaaattcctaccgagctaccgggaatctgcaaaacaagccatgtaccttatccagtccgaatttgatttgtgttttgggccttataattatgtcatgggcttaccccaagggggtgtgtgccctagggcaaccccagaacgtccctaatcatatttattcagtacccgtcattgtttagagtcgggttttgcttagattgttctgttaagaacagtttcgccgctagatcggtttgtagaaccataaattcgagtgcttaatcattcatatgcaatttggttgcaatttatcttgttcttgattgtgttcttcaattcacatgcagtgattagccttctcggcgaggttaaccaggttttggcacgattgataaccaaaggagacgtggtgctgcgcttgcggggctcagtagcgtgttcgttcagaagtcggatcgagttgtgtagcgactccgcccaaatcgactgtttattaatacatttcgaaagatcaggacctaacaccttcatcacatctggacctgtattattttataagcagtgatatatatttaaatactttgttccgctgaataagaccagtgataacctgattttaacactctgcgtgtaaaggtgttcacacgtagttttgaaaattaggcaagttttttttaaaaaaacaaccacacaagataaacacggctttacatgtacggaaaatgttaaaatcggcacctataatgcttttggtatctgaatgcgcgtctatgggatgccattttttaaactggcacctatatggtgacatagatactggtttttaagaaggactggcacgtatatgttatatcagacgtatgtgtcggttgttaacagaaaccggtacgtttaattgatacctgttctatcaaagtagttctttcggacccactttaaaatcgacatgtttcaga

SEQ ID NO: 14637 - DNA, 1501 bp, Oryza sativa
ctgtagtagaaagagaagaaggggaggaggaaggggggagaggagggaggagtatatactataggagaggggaagggggtgatcgatgggagcgatcacccgcccaacaggatttccaaacactagagtcatgggcggaaaaaaaattccattcttgaaataagtttttttaggtaagtttttaaaaaggattaaaatgtaaaaaaaatccagcctcacgcaggatacgttggtgcagcccattggatcaacatcactgaacttacaagccactagcctttccggccgccatctagcatttttaatggaaaagacaggaaccaatacttgtatataataaaatagtagtatagtagcggagcgagaatcctaatgagcgattgctcgcgtgagggagtggatagcgatcggttggtgggcctctctttccagttcccacgttgctttctttttttttcaccgcattgcttttctattttagtaagtttatacattttaagtttacacatctaaagtttttactgttaaagtttatatatgtttatatatataaagtttatactatgaaaatttatatactcgatttaaatttgaattcaaattttaatatattttaagcgatcagttggtgggcctctcttcccagttcccacgttgctttcttttttttttgccaccgtattaatttcctattttagtaagtttatacattttaagtttacacatctaaaatttttgtgcggttaaagtttatactatgaaagtttatatactcgatttaaatttgaattcaaatttaaatatattttatataaaatatttatatacacatagtttatatgtacaaagttagcaatgtatatatgtgtgtgtgtgtgtatatatatatatatatatatatatatatatatatatatatatatatatatatatatatatatatatatatatatatatatatatatatatatatatatatatatatatatatatatatatatatataaagtctatgtacatgaatagtttttagtgtaatatattttttatttttttcacacttatttttaaattgattttaaatttacgaagaacccacgactaattgcgtaacgcagcgttgcttttttttacacgaggaaaccgcgtgcgggcgtgatttctgatcgctggcctccggcgccagcgatcggtcgcgcagcagccacccctgtagcggagcccactggatgtgtttaaaattttcaggggggaagggagggagggacgacccccctcccctgttatcccatcatcatctcccttgttgggttctttagagttcttccttccttccttcatgctccgaactccgaaggaggtgccccagagagttcatccaatctgaccaaatcacgtaagcaatcgatccgggagcgaagttgcacgcatagaaaactacggacggcggctccggcgacttggctccagtccggtatgtggtatccactcctccaagttc

SEQ ID NO: 14638 - DNA, 1501 bp, Oryza sativa
attttattacttaattacggttaagttctatcatctggattatagtttttcatgctaactgctgggagagaaaaaaaggttgtacgctgtttaattgtgttaaaagtgtgtttgagaagaggggagaagagaggactgagaagaataagagtattttgtgtctgaaaaatatggatcaataatgttattaactactagtataattttacttcttgacaaaaaacaaagagtgttaactactagtataattttagggctactttgaatcgtaggaatgaaaaaggaggaataggaaaaacataggattctgacaggaatgtgtttgtaaaacagagaattgcaaaacataggaaaaacacaggaatgatcgtttgattggaccacaggaaaacacaggaatcggatgagagagatagactcaaaggatttttaccaagaggttggacctcttgctaagtttccttcaaaacctatatgcaatatgcaacaagccattccatcggaattttgtaggatttggaaaacttcaatcctttaaatcaaagggttacatagaaaaatttcctgtaggatttcaattctatgaaattctttcataattcctttgattcaaaggggctcttacttctcgacgaaaaacaaagagttaggcctcctttgaattggaggaaaaatggaggaaaaacaaaggaattgaaatcctacactattcatgtctttgattcgtaggaacgagaaaaggaaaaacgtaggaaactttcctattcctacaattctagagcaaaaacgtaggaaagttaacatccactctaacctcggaaaactttccttgagtctatctctcatgtgattcctgcatttttcctgcggtctaatcaaacggtcattcctatatttttcctatgttttgtaatcctctgttttacacttgcaatcctaccaaaatctcgtgtttttcctattcctccgttttttcaatcctacaattcaaatgggcccttagtataaatcaaatccaaatctacccaaaattgtccgtgaaatctgctaaacctgtggtgttaaatctggctggttgcctgtcttccataagaggagagatctggagcgtcgctatctcatccaacggtcacttggtgcccctccctgtcctgttacgcttgactactctcgttgccacgtcactaagcacagcctcatcctcttcttccccgcgcggacgaaaaatcgcgccgctctccggcgcaaaactgcagcgaggcgagctcgccctcgcctccggctactccgagccgcgccgcaatggccgccgcgccggtggcctccccattcccggcgctctcctcctcctcctcctccaccaccatcgcggcctccaccgccgcgcgccggtgccacgacgcgctgctcccaccgccagccgccgcggggcgcgagccggctcgcaccaggggatcctcctcctccttggctggcgccgcgggggagaggaggaggcggc

SEQ ID NO: 14639 - DNA, 1501 bp, Oryza sativa
aacgtatacttaacttattacttcctccgtttcatattataagactttctagcattgctcacattcatatatatatgttaatgaatctagacactaacatctatatgaatgtggacaatactagaaagtcttataacctgaaacggagggagtacctatgtattattagcttattactgcaatgcataactcatgtatttcagcattgcatttctccttgcttttcaccaaataatgtatagttttcccttgaactgtgtagtttccccttcaagtcttgaatttgaaaagaatctatacttctatactaatataaaaaggaggagttgtacccctccaatcctacaggtgaaatcatcccctctaatctcatccgtctatccaccatctgatctaatctcatccgtccactatcctctacgccatttatgagcgattccaccgattcctctgcctcgcgatgactcggtcgcataaatccccgccgcgctgactcctccccgcgaatccccgccgccctcctcgctcctactcgattcgcgcgcatcctccctcctcgtgacaggccaacgaagccgcacagccggagacgagatcttccccatccgccatcgccgctgcagtccaccgctgcccccgaggtcgtcccttcccccgccgccaccgatttctccacccatccgctgcgaccaccgccctgccgatcgcgcccccatcactgtttcgcctgtatcttgccatccaccgctcctacagccatctccaccgcgccgccagttcctcatgcttgttgctgagtccgagacgatccggttggttccgccgtcgaggttgccgccaccagggaagcccagccgatccggcatctgctccatctgctgccccctccctgttctctgctcctgaaaccgtcagacatcaaccaccggccaaccagccctattccccctaaaccctaaggtaataccaatttctcctattttacatgtttttgtgatgtgtcaatttgtggatcaccatttgttttcttgatcattcacaattgccaatcagaaattggccatagagtttgaagattttaacatattgtctcctccttgcgtgatcatatatgtcttggatcaggagaagctcttccaggaattaggtagccaaagtcgattaataggctagccttaaggatggcagctttggaaggcgtctatccatattcttagttgatcctgtgcagcccctatcaatggatttgcatccattctttcttctgaactttacaaaggaaaattttgtctggttctattattattatttctttgtttggaggtaatgtgatgttttcagatcactggaggctctaaattttgcttgtaatacagatgattaccactaatcactgtgaagccatcctattgttcttgttagtagttattgagaaatatataacatttgtcttgatccctggagaatacccaacttcttgaagagaaaaaccatatatata

SEQ ID NO: 14640 - DNA, 1501 bp, Oryza sativa; identical to SEQ ID NO: 14538

SEQ ID NO: 14641 - DNA, 1501 bp, Oryza sativa
ataaccaaaggcttttatttactgcccttctggaaataccaaggactagagtcttcggagggggttatattattatagtaaaatagttattcttttgaaaggaggtatgatgcacaaataaaagcaaaaaataaaaccaataatgaaggggagttcattctaataaaggccttagcaaacttattaggcaaaattttagtttttaacctaattatcctatataaatgggaagttattcataaaggggttagacaacctatgggtttaagactataggaaaacatatactctgataccagttctgtcgggtcccaaaactaatgattctgaaaccgacatatttagactgtatcaagccctggattagtagattgatacaagttcaacaatctggatcgtctttgcatacatttaaacatagctttgaaggagattttaatacataaagtaatagggcgtttacaagcttgtggctaaccattacagcagaagctatagaatgacctaactctgctgttttgctatagacttaaaccatctaaataatctagacttgaggactaagttaaaagggaactaacttatgtgattgaactcccggcttcgataagaactccaaaaatgactctgaaaaaggggggttgaagcaagggtgagtacaacgtactcagtaagctattatattaatcaataatgaatgcatgaaatggtaatatctgtgtagagctaggtttacttgtggaaagcagaggatatagaggaagaaagcctgtaatgttttaaatgcaacagtatttaataaagtttggaattaagtttctaaccaaataccatatgagtcccgatgctcaaatccgtgagcacagctattcgaatagtttcatgaatattcatactgcagtagatgtacgctttacccacagcccatgacttgttgataatcatcaatttcgtcatggcctagtattagattactaacaattgtggcacctgtttcattaactctagtccccatgcgctctgaacgtacgttatcagcaacgtgagaagttctggcgtttccgaggtatttaagggggactgatcgtatgataccatgtcatctcgatcagggtttataaacactacaacgggatcgcttatctctaacgggcataatacctcatcactttcgggtaggccccccatcactgagcaaaggtcagtgatgtgagaacatatctcaatcgggcatccgaccatcacggatgacacacatctcaatcgggccaacactatagcccgtcacggatgactctcatctctaacgggccaacactatagcccgtcacagatgactctcatctctaacgggcctaaattatagcccccgtcacggatgactttcatctcaatcgggcctaaattatagcctgtcacggatgagtataatccacaaaaaaaataaattttgttttttggctagcctcggacctttgctagccatgctcccaagccgggc

SEQ ID NO: 14642 - DNA, 1501 bp, Oryza sativa
atcaaaaaactgtcacagctaattaaccagcatctgcagtttgctcataactcgtgttaatggctatgaagaaagaaaaaaaccgagcaactttcctctcggagtatcggtaatctttcgttacgttttcgtgtgatgagtagttctcgcaaacggttttaattggttaatggtcacctaaaatcaattaaattacgtgtgtatgctgcaagtaattaattggctagtggatggacaggacaacccaggaagcaatcaatcaagcagcaaagaacaatttagctcgtgtttagttactttccaatttttattaagtatacgaacacacatttaaagtattaaatatagactaataataaaataaattgcagattctgcctgcaaactatagaatgaatctattaaacctaattaatccattattaacaaatgtttactgtagcatcacattattaaatcatggcgcaattaggctcaaaagattcgtctcgcaatttacatgtaaactgtgtaattgttttttcgtccacatttagtgctccatgtatatatctaaacatttgatgtgacggaatttttagaagtttgatgggaactaaacacagcataattaagcaaaaaaaaaaagcaacaattacacaatgatacgataaggagaccccacctactagtacaaagcagtcatgacattccagagaattagtctcagcaaggcatattcttctcatcctctcatcaaataatatcttgcagcagtttgctgatgcatattccatgccaacttaattgcagttccaggtgtcattagcccattattacatttaacactgttgtgaacttatgatccaaatggcccatcagccgaagtgctcagatttaggcccaaacaaggaagaagcccagccgaagaaacatgggctcggcccaagccacgtcatacgagcacggatctcgaggtgggagaacgtacggacgcgatcccctccgagcggccgtaggctggccctcccgacccagcaaaatcttcttctcccgagacgaaccacccgaagccgcagcagcagcgatggcaatggagaggcttatctcttcgccgctcctcccgcgccggcctccccgcgccgccttctcccgcccgccgccctccctcgccgccgcgccaccccaccaccgcgccggcggtgcggcctccgggtacggctccaggccgcctctcgcctcgctcctcctctccaggcaccaccaccaccaccagcctccggtcctcgcggccaatcctgctgccgatgtggccgccggcgaggctgtccctcccgccaccgccaccgccagccggcgcttcctccagaaggtgagcgcctcgttgcccgccagttttccgtgtcgcgcctcactcgttcttgcatgtctcgtgtgatgattactgatgtgaatttcttcttcttcttccaagaattgcttctgttttgtgatgttgttgtggtcggaggagtccaagagt

SEQ ID NO: 14643 - DNA, 1501 bp, Oryza sativa
atggtgcaatgatgcatattagccataataattgatagtataagtttgtgcttgatacgatgaatcctagacgccgagttgggaatgtagtactcggaagcaccactgcctgaacatatgatacggagtactacgtactccctctgttaaaaaaaaaaaaaactcggcctagaaggggatatgactcctgctaggacaatgaatttggacaggagaggtcacatcccctcctagattaagttcttttttgggacggagggagtaccctgtctgtcagaaaaaaaaacgaatctggacagagtatgtaaggatgtatcgcatcctattacaaggttgacttttttctggaacggaaagagtataattgtagtgcttcattttaaatgcccatttgaattgcaggattgtaaaaagggtggaataagaaacacatgattctgatggaaatgtaagcatcaaacaaagagaaatacacggaggaccatttgattgtaccgcagaaaaaacatagaaatcggatgaaagaggtagactaacgaaaatttccaagaggttggagctcttgttaagtttcctcaaaatctatatacgatgaggcattccataggaatttcaatagatttggaaaacttcaattctttaaattaaattgtcacatagaaaaaattcatataggattctaaatcctttgattaaaggggctataaaggttcaatgcggcataaaactttatatgattttcatgagcttgttttttccaccaaaaatcgaaaatatatcatacattctaaaagagttccctagtagtactcgtctcctaccatacttcacatgagctataagcatggattaacttgtacccatcttgtttcaaaataaataaaactagacttatttatctagatttatagtatcagtgttatttttatattagatttatttattttttttaaaaaatttctctttacagtatacatttgtttattttaagatagatttttgggacgcactccctccatctagaaaaaaattccaatcctagcatcccaatgtggaattggtgaagagtgagaatgactaaaatacccttaatcactagaaaaaagtagtaagagtagtaggtatgtaaagggtattgaagagataaaacttctcattttacatgctgaaagcaggtagaatgatagaagttagttttctgtggaataaaattaaaactctaaaaattttaaaaaaattgacggagggagtaactcaacgtaggagcaagcaacaagatccactcactagtcaccgctgtcctaacagccctagataaggatgagtgcagttcatttcaggaaggggaaaactcgagattgcccctgcaagggtgggctgggcatgaggaggcaggcaaggcaactgaaccaaagggagggtacagcttacaagtaaagacaggcagccggccaatgtggggcaacccaacccagcaaccatattattatactaacagtag

SEQ ID NO: 14644 - DNA, 1501 bp, Oryza sativa
aaggttttttaattcaggtggcagctactcctgcctcgtgcgaaacaaaattcagggggcgcccagcaaaatttaattaggaggttcaaacattacaacagattactgtgtgtacagggtctaaactcaataacatagtattcagtagaattattgtctagaaaactcaatgaatgttagggattttatcttatcaccttatttgaataaaacaaatttatcggttattatatgtcttaccacagggataggcaggagctgtagcttagatgtaaattctttctattattaaaaaaactaacaaggtatattacttgttctgggaggtaacttgcagtgccattttactctgaaagcatctcaatatctcatgtgatcgtttcggagatttggagaaaggaacaattattgtgataaccacttacaaacatgcctagaaacatcagtacacagtgcgcttgatcaaccagactaacagagttcttccgataaacgaggaagtaggccaacgtagagctctcccgagttccgacagagacgacacctatatatcgaagttcataaccacgctatccatgtgaaaacaattctttttttttttctggcgatgacgctcgtcaaaacagataagaaatatatataaaaaaacataggcaatataagttatcctaaagtagtaataaagtatgaagaaatataggattaaatttacgtggacatatgaagaaaaatatttatttacagttgattttcttctttatatattcctctatatgtcggtaacattgcttgtttgtgaaagaatttgtcataggataaatttattcatttttaatatcttttataacgttgtggaccgcatacaataaacaacagatgctctagttgggggctttataatccatttctttgtccatacaagctatgcatgcatacacctgacatatgcatctacctatttatatgttggtatattagatatgggatatctcagatacataaagatacgtgatatgggacttctcctacatgatgtacacacatactttcatgtaaagtaaattacatcaccattccttaaagttgcaacgtgatatcactttgtccacgatcttgtaaatcgtatatcttggacttggttttgatgtatcatggtaggtccattgtacgtttcccacatggatgttcaccttggatgcaaatttgcattcagctccttcatgcacattcgctatgtgtctcctcgaaatatcctctcttctcttctgtatctattcagggtgggttgcagctgctgcagtagaggagggagacgcctagggtggtggcggcttgaatgaacactcaattgctccatggaaatccatcctccgtaagaccaacgaggccactgtttcatcttctctcgtctccccatctgtcttcgttctcattcggacgaggatcaatccatctaggcacgagaaaggcaaagagctagctagcaaataacaatcagtaa

SEQ ID NO: 14645 - DNA, 1501 bp, Oryza sativa
caaggcacaccgagtccatgttaactaagccaataaccctcatttttattattcctttttgctatctctaccagttattctaacactagttttgtagtatgacaaaataacatgtccaaaaggttttcaaatccttagtccccttaatgtcatatttaaacttttgaaaaaaaaaatcaaataatgtgcaacataataggatttgatagctctaacgatcaaatatttgtgtaaccggatagcctctagcattctttaacaactagatctatggatactaaatcaacttagtactgcctccctcccaaaatataacggataggagctagtacttcgtatttcatatgaatagataagacttcatgtaattcgtttctggctttatctgatgcactactgccctagcaaatggcgaaattcatcaaatctatagatagaatatttaagttactaccatacatacccaggctgggagctcggtgtatcaacatcatccacagcaaagggataatctgcatcatctatatcatcttgtcgaggggaatcacaggaggagagtgcagagaacctgccagattcgtccttagtgtccttgccctgcacatgggtcaaacggtgtcaacgcagacccaactcaaatacatatttttttcctggcttcaatagctagaggaagataaataagttatccatagctaatgcagaggataagattaagtcccataaaggcaatccactaaataaaaattaaaagtacaagagcagacatatattgcagcagacaagggtaatccaaatatccaaccatttgaagatcaaaagctgcttttgggtaagcctcagaaaataactaactcaacaaccattcttctgtttcaacaagtactatgaacgcatttcttttcaacaaataatatggtctcagcaagaaccaagagacaatcgaaacagttcacaactaataagagaccctgatatgtagtctattttttgccaaaaaaaaaaggagagatgagagctaaatggtgtatatgctaacaaacagtatttaggctgcttcaactccagtactaataatggcttacattccactatcaaacatggtttgttgcacaatatcatgaagctaaacttaacataacaacttaaacttgtgaatatgtactgctaaacattgacttgaaatagctcttggtagagtttgtttcctagtttccaaggtaaatgccagtaggctctactcagccacatgaaaacagaaaagtctacttcagatataccagatgaattgccttacactcactctcaaaagttatatgattcatgaaggatccagtattgagcagtgatgaagataaggcatacacaagtatcaaatataagttgaaagcatattggaggctttaaaaccatggatcaccttgcgtcctggcgacaagcttgcatagggatccattattcgaaatccatctgccctcccaaacgaggggcatctctctga

SEQ ID NO: 14646 - DNA, 1501 bp, Oryza sativa
cgggcaaatgatgatgaaatcaaggcttgtttctcataacattcgcagttgccgcctaagagctttcgccttgccgggcttgagagctaatgctgctagatccttccttggatgtctgatgcctgttgcctagtaaacttcacgtgattgatgttcaagcagtttcatgtttcatatttaattgttacatcttagtagagtgcttgttatgcctgcccagtgatgatgaaaacaaggcttgtttctcataacattcgcagttgccgcctaagagctttcgcctcgccaggcttgagagcttatgctgttaaatccttccttggatgtctgagggcccgccttgtattctgtttacaaaacttaattacatcatctccagtgtgcaattctttttgtttgctcatgttctcatttcaagatgcagcttctatcaacaggtttgcgaaagttctgcctggctgatcagactagctgaggacatgcttattcacaggttcgcagcatctacacactgtttacattttggcagtgatctaaacatcggcgatcatcacagtaagcgtgcaaccatttcatcaacacaacactgtttacatctgatacttagactgagaccactgtcctcaagctacctatgctgctccaataccagaaaacagtaacaagacataactgaggacccctgctccacggctcctccaataccagaaaacaggaacaaggcatggtatgcaattgtatcaaattggaacgaaattcccaagagctttgtatctctccgactcttgccaactccatagtgtggtttctaccaccaggtgcttatgtttccaaatgtaaaacttgggccccttctgaatgtcaaaactgagctttatttttgtttgtttgaattctttatgtttcgcacactgtctttccagtctgcgaagttacaagaatgctcgtggttttcaccttctgctgctggttcgcacttctgctcatctatctcttgtgacacaaaagtcctggcttgtttcggtttgattagtgatgaagcaattgaccaagctcactactagtcactggcagctcagttcagacttcagaacatagctgtcaaactggagatggagtatttaactattatcacttttgatatgacgtttaataatttagggtgggtttagttccacgctaaaattgaaagtttaaataaaaaagttaaaagtttatatgtgtagaaaagttttgatgtgatggaaaagttggaaactaaacctacataagcacataaaaattcatgtatcataaatatatatgagtataaattatgaaattatatgagtgaaattatgaaacgttatatctaaaagtgataaatatctaaattaccgcgctaaaaaccgtggacattcactgcccataagtacaaaactgacacaggtgtgaattgtgagaaatgcgaagccgaggcttgcataaattcagctgaccctcgcgacactcggccacaacc

SEQ ID NO: 14647 - DNA, 362 bp, Oryza sativa
gttaattcagaagtagttgattgtcaacttaattgacaatgtcaaaaacttcgaaaagaaaagaactaaaacgccatgtagatgcaaagttcagaaagctcgttaattaatgaaaaaaaaaggtccaatttctctctttgttaattcagaagtagttgattgtcaacttaattgacaatgtcaaaaacttcgaaaagaaaagaactaaaacgccatgtacatgcaaagttcagaaatatctagttcaacataatcagagtggcgaaaagaaaagaactaaaacaccatgtagatgcgaagttcagaaatatctagttcaacataatcagagtggccggatatatatgctatggacacaacga

SEQ ID NO: 14648 - DNA, 1501 bp, Oryza sativa
ttcaagacaatgatcctgcaacaaacatgctttgattattttaacaactttctgatgaacatcggagcgacatacagatagaatgtgcgtactagttttagaagatcgacgacagatatatactcctatgtagagagaatgagaatgtgtgaggtaggagtatatatacaacaccttctctctgtctcttactttctccctctacaatgtgtatatgaaactagtaaagtggatgtgtagcaaggtatggtggtaaataaacaaagggcggctggtgctgctgctgcatcgacgacgatattcccttgtcgtggactggatggacgcaaacggcatgcgtgcacctgcagcagaggagaggcctctctcctctcacacgtctccatcactcgctctcgcccgcttgcagcgcttgctctcctcgcttcgctgcatgcctcgcgcgtcgtcgtctacctctagcttcctctctgcaaagtgcatgcgagatgcaacgctcgctgctgcagagcggccgatcggtcgatcgatcggtgacgcccgttgggcttttgctgctccctaaagcgagcaccggccgctctctctctttctttctttcttttccgatggctttccggacttttgctcttttttttttctcatctcatgcatgctgcattgcctttaatttcctttttacgttttgttgttgttttctctggtggatatatatatatgtataatttttttgatccttctttcgcgggcgcagacactgtctccagtacaaacgctagaggacgacgagccaaaagaaaaagaaaaaggagcaagagagatgagaagcaaaatattaatggccggccggcctggccgtgtgttgtgttgtactgatcattgcacatcgccctgtctgccatgcattttactgcacctggcctatgtcactacacttaccagccgcttgctcgatcgatcctacgtgcgtacgtacgtacgcgtgctgcgctgtgcttgtaagacggacatgcatgactagcattgactaatgcatgcaaccgctttacatacgtgtccatcgctgtccagtaatcacaccagacattttttcttcaaaaatgtagctatcggtaaagagctttgttaactgctatatattcttgcttatagagttttagttcgtcacctgactgaacctgatacgggtctaggtatatatcaagcatttttgtgatgacatgtggtgaacattctttttctttttttaagacttggatgcattcaaacatagatgcagtatttgtagtaatagtatctccagcttagatgcagactacacaaatttctttatgcatgcacggatggttgcatattgaaattaaccaactaagcttactaattccattttaaaaaaaaaattccaacaatgttggcaaacatggacaacactagctagtagtttcttttttaatgagatctacctgcagggaaaaaatagctactagccctgaagccacat

SEQ ID NO: 14649 - DNA, 226 bp, Oryza sativa
gaagttggaaggcatcacaaagtggatgcacgagattgatcagcggctggattcccaaggtggcagtctcgagaaggtgactaccaaggtggatctcgccatggattccgtcggcaaggtgcaggttccgcgactcctccgccgttgaatccacctgttcctcctgtgttggatggggttgatttgggtcgtggttttggtgatgggatttatcggcgtcatcagc

SEQ ID NO: 14650 - DNA, 1501 bp, Oryza sativa
cctcatcaagaatacgtttgatgcgaatgatccattgtgcttcgtcgaattggagatttggacaaatccccattaattgttgaatcgtgttaaacggatcggaagattgatttaagatgatatgtagtaagaacgagatgagcatgcaaatcttgttcagttttgtcaccaaagaaaccaaacctagcggagacagcaacataaggggaaaaaaatatgttgactgttactgcatttttttcctgtagttaattaatagtgtaaccatgacaccagcagattaaagcttcaattatggctgaccggttaacgttacactagaagtaccatccgtgcgttgctatggatctaacaagtaatttatttgggaacaaagagaacatttttttaaaaaaaacactatacaagttggaactgattttccgaattagattccagatggttgtatattttctgtgaatacatatgcttctgcatacccaataagccattcttatatatttattttagtaagaggaagaaaattatgtctatatttatagctaataataaaaaaaatacataaagcttccggtttttgttggttcatccttttttttttttttgccttttttctgattttttttttgcacgtggaaggtttttttttcgcacacgcgttaagtccgttttttatctcgtctggtctgatccgcacatgtgcgcagcacgcctccagccaccggtgggccgaaccctatcgccatcgccacatcgatctacttcaccgtatgtttcctcctttaatttattgcaaatattaattctccactcctccatcattatttttccataattcccctttcaattcggctttaattcacggaatttaatctctatttaacagtttcgtgtttgcagctggatgagccaccgctccactcgtgaagccaccgtctcgccccaccttatgccaggtggagaggaacttcagtgagctacaatctgtgcccctagtgacgcagacgaggtgttcagggtgcgctgccgcggtgctagagatgaaacacatatcattgccgccaacgccacaatggaaaaagagaaaggaaaaaaaaaagagacaagagaaatgaaaagggagcggatgagaaggaaaaaaaacaaaagaagaaaaaaaaggaaaataaaatgttttaggtgggtcccacttgtcagtcaatgtaaagttagtgttggtgtcacatcagcatccaagtggcatgccatgtcagcaccaagtaacatcccagagggcttcgtagcaatatcagaccagaatgacacactttaacatgttttaagatctttttttttttgcattttgggagtttgacctacatgacaccgacgcacaagtttagagattaattgtgcactttacttttttattattgtaatacatgattttttttattaagataagtctttgactaataatggctttatctcatagtactagcgtgaccgtgcattgcaacgg

SEQ ID NO: 14651 - DNA, 1501 bp, Oryza sativa
cgtacatgtcgtctttcggccatggtccatgggccccttccaagaatgacatttgataacagatgacactgtcaagtgggctactaacgcagacaaatatgctgtggagtaccagtacaatcttttctttcactgtctggatctataatacttatgtacagtgtatattattatgtacattgtatactgaaatgtcacgtatactctctggcttcccaaatatagtaccacattcatcttaaaataaatttattttaggtttaattactctctgcaatttttggtttattttaggtcgaagttagtaatttacatggttttatctttatcttctatttttaaagttttaaagtgcaattttaggaaatatttcagatcaggagtatggcttttctgccctactcctgtttctttcgccacatgcagcaactaaactaaggctgtgtttgcatcccatgttcccaacccctctatctcgtttttcgcgcgcatgcttttcaaactactaaacagtgtgtttttttgtaaaaaatttctatacgaaagttgtttaaaaaaatcatattgatccacttttgaaaaaacaaatagctaatacttaattaatcacgcgctaatggactgctccgttttccgtgatggagggggagtgttcccatccaggaggagcgaacacagcctaaggcctgtttggatctagggactaaaatacatcggatgttaaaacactaattagaacttgtttagtgtctttatttatcacaaaactacagatttagtgtcttatagttctaggataaatggagatattaaatatgtagttttgaaaacaagttcttaaatctgtagttttgtgatatattatgcaaagtacctgtagtttaatttgtgataaatgaagccagtgaatttataatttgtgaaataaattcttaaatctgtagttttgtgaaagattgtgcaaagtatatatagttttatgaaatttactcttttttaaacaacttttttatagaattatttttaaaaacacattgttttatagtttgaggagcgtgtgcatttaaaccgagaaaataaatgatgggaaaagtgagaaacaaacgcaacataaatgccataaaactcctatattcaaaaagataccttgaattcgattccctatctatccagtctgtctcattgtggaatgattttccaacacaaacatgggcttcgatccaataaaggcaaagttgtaacttgacgccaacgcaagcaatttgcaattctcaagattatccgggacttcgcctctgcgatttgaaaacctaatcctgaatcccatcatgcatgtgttacatacgtacaccggggcatgcaatcacgcgtcgccccttttcgtaatcaaatcaaatcgatccgtgcatgaacacatatgaacaatatatattaatacttgcctggatcgagagaaattaagccgccgatcgagtcgatcttcttctcggcgtctcaacca

SEQ ID NO: 14652 - DNA, 1501 bp, Oryza sativa
ctctctgtccgacaacagcagtgtatctcgctgtccactaggtgacgtcgtacgttgtggccgatatctaccgccacattctagtcggctagttcttacttggtgtgcctaaatcctaaaaccccccattagctatcaagttgtgattcgacgtaatcccctccttactcaccaccacgtcacttgatatagctatgagtacaatatgtatgcaccacgtcactcgatatagctacgagtacaatatacatgcactagatgacccgggtcaatttttatcatgtgttcgccctgggtattagcttgccaaacagaaataaatataccctgaaagcaactaggcacagccacctgcaacttgcagaactagaagcttcctctgactctcgatctctgtcgaggaagtttccaaatacgccggcaattaaactcgccgtccgtccggccggcaggcaggcggcggcgacggcgaccgaactccaaatttcaattccggcacggtttcaatatttccatcggatttgaatcgcattccccctcgttttccttttcctacacagtagcatcttagtacattttgtactctagcccctctcgtttgactcgattcccctgttctacggggacgcaccattgtcgcacacgtagggggtagtactaagcactagtttttgacgaggacggtggttaacaagtcagggtccgtctaatagagccgaggccgtacttgctattcctttgcatgatttttgggttaacaagtcagggtctaatagtctttaggctatgttcttcccctcttttttcaactcacttctctcgttttccttgtacacgttttccaatttgttaaacaatatgtttttctaaaagtttatatacgaaaattgcataaaaatcatattgatcccttttttttaaaagaagctaatacttaattaatcacatattaatagattgctctgttttccgtgcgcagcacatgggttcctaacccaggttgccaaacatagcctaatcaattagcatagctctgtttctaattaagataaaccttttacctcggtattttgttgtcacgatatttgaactactacacggtatatttcatataaaaaatttatgtagaagttacttttcaaaatatcagttaaatctatttttaattttataataactagaagttaattagtcgtacattaacgattttctcgttttatgtgttcgtaaaaaaatctttatattcagtgaactcaaacgggaccataatgacgtggcaaaacaatcgaaatgccggctagattcgcgggcactggggcaacgactagcatctcctcctcttcatcctcctcttcctctgcctataaatatgctctgctatctccttctcctgcacgagccaaacacaagaattcagctgtacaacctgatcaatcttacacaagaattcagccatagctagccctgatcgatccaattctgagttcttgaccgacaacca

SEQ ID NO: 14653 - DNA, 1501 bp, Oryza sativa
tgaaatggactaaaatatagttagtttcaaactgttaatgctacaaagccatgggagaactaaaacgtgatgaaaggtcatcagaacagccaattaggggcggtttagatggggtaaaattgtttagtccctatcgcatcggttgtttggacactaatttggagtattaaatatagactaataattaataaaaaaactaatttcataaataagagctaatccgcgagacgaattttttaagcctaattaatccataattatcaaaagtttactgtagcatcacattgtcaaatcatgacgtaattaggctcaaaagattcgtctcacgaattagtctaaggttatggaatgggtttttgtaattagtctatgtttaatactctaaattagtgtccaaacatcctatgtgacagggacttagaataagtcgttgtttcccaaacagcctgtaataaagctaaatctacattttggtgcatggcagggaggagggagctcggctctacgtacggctcagctcaaacgacctcggctctacgacacatgcgcgcgcgaggagggagctgtggcagggtatggcgagcggtagagaaggtgtcggccgacgtgacccaagctctccggtgggcgcacgcgaggaggctgtgccccggccgacagcgaccccggctctctaatgggcgcacacgaggaagcgaggaggagcgaggaggtggtggggattcgcagggcggattcattgcggcggagtcatcgcttggggcggaatcggcagaatcactgatgaatgcgtactgcgagaaggacagtggacggatgagattagatgagacggtagatggacggatgagataagaggggatgatttcacctgtaggatttctaggcacaactcctccttttttatattagtatagattgtgctgatcttgtttattttttcttccggcatggactcgtatatccctagtggagaactgatctactcccgtgctacccaaaatcataattgtcccagttagattaagaactggtactaaagatgctccaagtccctcgaaatatttttagtctaggttggtgttatcaaccgggactaaaaaaaataatctttagtcccggttggtaacactaacacggactaaagatggaggatctttagtcctagttggtaactgatcaggacatcactccttcgaatatacacaacaatcctctaccggtcattcaaggagcaatcacaagagctcgctcctatgtccttctttatataattttgagaatagattgctatctaatgattatgattatattacaattaggaacaatggagaggacaaagagatatttagagagggacttagaggcgtggaggaccagcaagggcgtccaagtcaagatggaggtccaaatctagttgacttcgagtacgtttcaaagtccatgaccaatctgtactaaaacgggcgcccaggtcacatacgtgctcggattggggtgt

SEQ ID NO: 14654 - DNA, 1501 bp, Oryza sativa
atttcatttgcatcccctccgtgtgatggggcttgagcatttgcttagagggtgtgtatgatattctgatttgtcatgtggctttgttgattgtacgagcatctcattgcattactgatagtagtagtagtatctaatttgtggctgcatcaatgtgcagtggtagtaacaagatgtgaggtttggttgtattttattggagaagtgccctgtgctgtgttgggctagctttgtttggatgataaagacagactagtaactggaattcaaatgagtgactgctctgttgcctttttagtactcagtatatgaagttatattgcgtagcgtggatgtgaatatgtatgtgtgatgaggaggatatatatatatatactccctccgtttctaaatatttgacgccgttgacttttttaaatatatttgactgttcatcttattcaacaaaaaattgaagtaattattaattcttttcctatcatttgattcattgttaaatatacttaaatgtatacatatagttttacacatttcacaagagtttttgaataagacgatccgtcaaacatgtgctaaaaagtcaacggtgtcaaatatttagaaacggagggagtatatgtgaatgtgatgacaagtaaagcgagacaaatactagtgtacaccaccactaaaactaggccattctctctttgccatgacctcctggaggatgatcttggtgtgggcggcgctcgaagctgttcaagaggcgggtggcgctggtcgtcggcggcggcggagatgagcttgtcgatcgacgtcgaagtacgttgttgcccagcaggtagaacgccgtgctccgaagcctgtacctgtacgcgtgcgccgggtagctcggcccgatgtcggctacctatgtagatgccgttcctcatgaacgtccggctccccgtctcgcataatggtaatttacctgtctctttttaaaaattacttcctccatttctaaatatttaacaccattgactttttagcacatgtttgatcgtttatctttttcaaaaacttttgcgaaatatgtaaaactatatgtatacatataagtatatttaacaataaataaatgataggaaaataataattacttcaattttttttaataagacgaacggttgaacatattttcaaaagtcaatggcgtcaaatatttagaaacggatggggtatttggttttgtgttgctgtaattatcctctctttttttgctttcttttgtcaaataagtacgtgtgccacacgataggaggatcaaaagcaaaagcaagggttaagttcttgagttgcatgctatcattggaattaatttattgcaaatatatagttaatctctaacatgcatgtaccttttccgtcagatgaagattttaaacttttagtgtcattaagggcataaaaaaaactccggttcattgttgcttggagcagccttattttccgggaatcttctcatttttacatgtaa

SEQ ID NO: 14655 - DNA, 1501 bp, Oryza sativa
aatttgatttttctgtgaaactgacatatttcgtattgatcaattataccttttttttaaaaaaaacagctatttaaattacatgtaaaaatgagaagattcccggaaaataaggctgctccaagcaacaatgaaccggagttttttttatgcccttaatgacactaaaagtttaaaatcttcatctgacggaaaaggtacatgcatgttagagattaactatatatttgcaataaattaattccaatgatagcatgcaactcaagaacttaacccttgcttttgcttttgatcctcctatcgtgtggcacacgtacttatttgacaaaagaaagcaaaaaaagagaggataattacagcaacacaaaaccaaataccccatccgtttctaaatatttgacgccattgacttttgaaaatatgttcaaccgttcgtcttattaaaaaaaattgaagtaattattattttcctatcatttatttattgttaaatatacttatatgtatacatatagttttacatatttcgcaaaagtttttgaaaaagataaacgatcaaacatgtgctaaaaagtcaatggtgttaaatatttagaaatggaggaagtaatttttaaaaagagacaggtaaattaccattatgcgagacggggagccggacgttcatgaggaacggcatctacataggtagccgacatcgggccgagctacccggcgcacgcgtacaggtacaggcttcggagcacggcgttctacctgctgggcaacaacgtacttcgacgtcgatcgacaagctcatctccgccgccgccgacgaccagcgccacccgcctcttgaacagcttcgagcgccgcccacaccaagatcatcctccaggaggtcatggcaaagagagaatggcctagttttagtggtggtgtacactagtatttgtctcgctttacttgtcatcacattcacatatactccctccgtttctaaatatttgacaccgttgactttttagcacatgtttgacggatcgtcttattcaaaaactcttgtgaaatgtgtaaaactatatgtatacatttaagtatatttaacaatgaatcaaatgataggaaaagaattaataattacttcaattttttgttgaataagatgaacagtcaaatatatttaaaaaagtcaacggcgtcaaatatttagaaacggagggagtatatatatatatatcctcctcatcacacatacatattcacatccacgctacgcaatataacttcatatactgagtactaaaaaggcaacagagcagtcactcatttgaattccagttactagtctgtctttatcatccaaacaaagctagcccaacacagcacagggcacttctccaataaaatacaaccaaacctcacatcttgttactaccactgcacattgatgcagccacaaattagatactactactactatcagtaatgcaatgagatgctcgtacaatcaacaaagcca

SEQ ID NO: 14656 - DNA, 1501 bp, Oryza sativa
tagaatctgaagcccgacacggcaaaggatcacagattcaccagatcgatcatcgatggcccaatagaaactgacgaaaagaaacttcatgtgacgggttccagagagctcaccggtcaccaggccgagccggctgggagggatggacggcgcccaccgttgcgccgccgccgacgccgccacacccctgagaatcgaggatgcccacgccgtcgcctggtgaggtggggccctaacgtcgagcggctccgccggctcagggcgggtcgccgatcggagatggagtacggagcatggcggaggacggctccggcaagagggcaacgaggactggggagtgatgtggtattttggtgtggaataagtccatctaagttctctttaacttgtcaacgaatccaattttccttaaaccaggtacaaccggtccctcaactatcaaaaccgatacatataaggttccttggaggtttcgagggtggttttagctgacgtagtgcctacgtggctaatttgaatctgtcttcatctgacgtggcactgacgtggcgcttacgtggcaattcaatccggaattggtatgtttgcattggcttcgtgggcttggcccaaacacgagccttgtgtaatacgcgtaaattttgagcccgaataagtttattttgctttcttaaactattgcctttggttaaatcgcatccactacttaaaaaaccctcatagggaccggtcttatagaagttcatttaaaaccgacacctatagacattttcccacctccgcacgataaaaaaatagaacccgcacctttaaatactataggtgtcggttctattaaaaaaccggcacctatacgataggtgtcggtttttatttagaacatgtttacacccaaatttggcacctatggatgaaataggggaaaattgtcaaagtttggaaagtgtcgggtttccttcacagggccggtcagaccgcaggtatgtgtgcggtctgaccggctagtagggctagtctgaccgcaggtatgtgcgcggtcagaccgtcagggtccgaatccgggtctgttttcgtcgggtctcgggtttccttgctcgggaaggctatgtttcgtgtttcctttcgtttctattccgagttggacgtggagaagggcctgtagagggcaagaccaacccctatttaagggacaaggccggttcattgtaatccccctaatacaatctacttgaatcgttttttctttacttttcagttatgttttctattttaccctagtttagtccatctttgtcgatttgcaccgtcactgtaagagtgcaacacctctttgtaggtttgtcctaaaaaccttccgttttgcccacgatacgggtagttatctcaaatcggctccgctagccggtttagttatgaaaacccatcttggtttggccgtttggctagattgaggtcgttggtgactctaggatcaccgcaaagcttaaggtgctgcgatcgt

SEQ ID NO: 14657 - DNA, 1392 bp, Oryza sativa
aaatcgttcaaaggaggtcccatggcagtatcgactcaatttttgcccggttttactgacgtggcatcctagttaacaaaaaaataaaaataaataaatatgtgggacccacacgtaagtgaaaaaaatatggggtcgacaatcctaatcagcaatctcctttttctccctttttctcttctgtttcgttttttgggggagcggcagcgggtatactgcctcgggaccttttttaaaggggcaattttgtttctaaccctatttgatgtctaatattgattttacccctactttttaggattttcatttttaccctcacttttttgaactgaatgcttgttttgcccctactttggatggtgaagttaatagtgttaagtaattgacaaaatggcatttataccctctcatgtatgttcattaataatgtttttgtccccattttatacatgtagctttagaactttatttttgggagtatatttaaaattagatgacccgcattgactaatataacaatttggacaaattctgaatttgatggaattttgacaaaatttcagcattttgatagaacttaaacaacattttaacaacattttctaaaatgtaattatctgttcctttagatactagtcaatgtgcttcatttaattttaaatatactcacaaaaataaagttataaagctacatgcataaaatggggacaaaaacataattaatgaacatacatgagagggtataaatgtcattttgtcaattacttaacaccgttaacttcacctctaaagtaggggcaaaacaagcgttcagttcaaaaaagtaaaacgaaaaaagtaggggtaaaatcaatattagacatcaaaataggggcagaaacgaaattgtcccttttttaaatggttttacatagtttagggatacacatttctagttctatggttaagggacctcaaagaatgttggtgttaagttgaggtatctccgttgaacttattccctctaagaaaaaccgaacccatttccagacggaatgagctcatctcaggtcccttaacttgtcaacgaatccaattttcgtccttcaactaaaaaaaccatacaacgggtccctcaactgtcaaaaccagtgcagatgaggtccctcggcggttttgagagcggttttggctgacgtggcgtatacgtggcaaatttgacttggtcttcatatgatgtggcattgacgtggcaattatgtggcaaatcaatcccaaaaacaaaaaaaaacttcgtgggacccacatgtctgtctcacacacaaattaacaaaaaaaggtggggcccacgtgggccccacaagtccctcttctcacttcctctctcccctgtttctccctctccctgctagc

SEQ ID NO: 14658 - DNA, 1501 bp, Oryza sativa
ttgttcttccgggtgtgtctaatgtgttctttttagttaaggactaatttgatcgtgccattataaattgattatttattttcaaaataccattataatttgtaattttaatcgtgtcattggaacactttcaaaaatgaattataacacgtagtacgtgtggtacgcatgttgaagcgttttttaacttccgcatattcgaagtaccaaaacactctacctcacttccttatactccctatgttccaaaatataaggcacaaccaaccttaacccaaagactaagaaacaattattatcatctactagtttgaatcatcataataaatataatgcatgcatccaatagaattagagatcttgagggtggaggatttaaaaaagtaataatttaatagagaagaggttctaattaattgtatgcatgcatatatgtcttatattatgaaacatcaaaaaaagtagttgtgctttatattatgcaaccctaaccctattaaagcagcgatggcagcacataccattgcctgcatgtggtggcggggacgacgatgaggcacaagtctaacgatggtgcaagcagatttagacgtggtgaggtgggggacggtaattgggcgcggtctggtggtggcagcgacacggtgaagtcggggacgctaagactgggtacaatagcagactataagtcagctataaacacattttaaagagataaaaaaaagagagaagagcaacgggctacatatctgtagccagctgcagcatgaactccaagacacaatgtgtgtatgacaggtgggaccatgcattaataatgtagtaagcaactattgtatgaattggctattacattggctatagatgatttggagctagtagttgtgagagcgctacgcgtcggacgtacggcgcgagacgaaaaatcggacgcctcgcgcgaccgtccgatgcagcacgcgcgcgccagccgtccgattggagaaacaactcgcgcccgacgcccccgccgttgcaacacctggacacattaactgtttcattcaatgtgtctgcccgttgaccgctagctcgaggggagatttcggtggcgcgactggcgctgtgctgccaccggcgattctctccggcgccggcgaccctatcccccacgcccctatcctcctcgcgacgccgacgaagcctacaacaacgccgacatgccgccacaccacatgccgccaccgccgccatggctcatctgatacaccaagttgagagggattttccgccgagctcatctagtgcaaatggaggaacaaccccaattcataatgcaatgaatttggtgagtaaaaaatttctagggttttgcttgttttacttttttttttgacaaagtttcaataaaaaattgaagcatagatctgtgaaacaatgtcttccctcatgcaacatttatattcatgtcttatttttaattttaacttttgtataaatttggactggaatttgacttgaa

SEQ ID NO: 14659 - DNA, 1471 bp, Oryza sativa
gtgagctcctctactcacggtcggcctttggccactgttgccttcgccaagcccgtcctctcccttttctaatctccccttcgtcctcctcaggctcttccggtcgtcatccgccactcctcgctcgcggactgccattgaaccgccgtagccgtgcctccccgaggaagcgtcgtcgcctctcctcgtcgtcggtcgctctccggcgccgcctccgtgccttgtgcgctcggtgagctccccatctccttcctctgcctccctccgctgcctcccgcgcgtgccgtcgcgccggtggtcgtcgccggcgacctttgggctgctcgccgtcgctccccggccggtcggccggcgagttttgccgctcccgctagctgtggccgcccgatcccctttggggtgatccgggccgtctacgtggctctggcgccgccccgcgccggtgtcccatgtggcgccacctcggcgccatgcctttgccacctcgccccgccgtgccgtcgtggccgccacgtggtcttccacgtggtgtgcccgcgcgcctgtgctgcggtggaccgagtccaccatgagccaccccctttgacccgctgacgtgtggggcccacctgtcggcgcccttcctcttgctgacgttagcgcttatcatttcctttggaaaaatatttaataattgtgcaataaattggtattaattatagaaattcatttaaatggctcaaaacttctaaaattcatatctaattcattcgaactccaaattgggccattcaacttacaaaattcatctaaaattgagatctacatgtttgtttactttttatgtactgtttccttggtttttattagattttttcctcgttttgtgtgccagcgtgtagaatccgtcgtttcggaagatcgcggtcacgaggaaaagagttcagaagatccaagtgaagaagcaaggcaagtcacacattccccttgaacattttgatcctaatttacaaatgttttattgtttgcaaataaaattgcatgtcttgctaattacatgggatccgggtattacctatctgtttgcttgtgccatatttacttgatatctgtcatttgtcaaccttgggtaataaatagactagctcatgttacttatgtgacctagctagaactatatacttagtcatgcttaattaccactagctcagttgatgggataattacagtattagatctttttagtatcagaatgagctgcgtgctcaagacatctagccatacttcatggtcgtaattatccaactaaaatgcgactacatggtgggctgtgggtgcatggttttgctagtcgtgcccatggcgattaaggaccggttcgcgggaaaccctggaagaatttatcatgcttaccataagccagcgtgggcaacggctgggcttgtagtgtagctttcctctagctgacgcatccaggcaagggtgggcgtga

SEQ ID NO: 14660 - DNA, 1501 bp, Oryza sativa
ccgataacagccgatgccgatagcgatagggtttaagcaatcggctatatatccaatgtagataatgatataaaggcaatcggctgatgatgatataataaaataacaatatagtcctgtataaaccaatcggctagcaatgatatgataaataagcaccgatccgagggttaaagcacacatcagctggaggtccgatatcatgaaatccacaagattagattaaacaatgaaacctttattgtcatcggctaaatccaacttatatgtatatgcaatcattatgagccgatgcaacatccagataactcaccggctgaaaccccgatgaaacccttattggcaatcaagaagcaggctagagattatggttctaagcatgacttagtagatcaaacttaactgatgcaacactaagtatgaaaagaaacataatacctagacaatcaagccgttgactgagttttcagggtggtagatgtctaagctaatctaatctagcaacgtgatttagccgataccggcagaaaccctaaaacgagaagcagccgatagagctaaattgacatgctaagactagattaacataaacatatcataaataggtaggcaaatatatcatccaaaccagagcaatccaagaggtcgaatgtactgatgcagcctgaacgacgccgatgtagacgatacaattgcctggaccggcggaacattggacttatcccttcgccggagatcgaagacgatgcagccccgcgtcgggtgccaagtctcaccggaacgtaaaaacaaaagtagaagtaaaaagggtggcgatgcgccgaattgtattgatcgtgaagatagattacatagaccccgggtgtacatatttatacccatgggttgatacaagtccttattggacaagaaagaaactaacctaaagataaaaggaaaaatataaagtccttatcggacactaaacacactttcctaaagataaaaggaaactaacaaactatttctaattaatagataaactgccatgccgcatcctctttaaactcggtcacttagggataagttttctttagtagattgatttcattaaccgaatatagcaggaatccgactaattggcgacttaataactcccatcggctgattccgagatgctgcagccgataatgattctaagccgatgacgtctttgccgattactaaattaccaaatttcactgttaacacatgcccccccagttttggagtatgaggactcatgctccaaaattctcttctgtctgatcttgtaatcagctttcatgagctgatactgatgtgcttgccccccgagccaagattgaatgatcttggcattgacttcttcagacatgtggatataaaattcgtggtcccaccaggcgtgccaatcggtgggaccatgaattttatatccacgaattttataagaagagaaatgagaaggggaacgcagtgaacacaaatattcatactttta

SEQ ID NO: 14661 - DNA, 1501 bp, Oryza sativa
actggatacttgcgtctattgtcagggagctgaggtggataggaatgcatgggaggtgctggcccaccaatgactgctactgctcagatcctattggtggactttgacctcatccatgctcagatcttttttaatactccattagtgcttgttagtatctcatcatcatttgtttctgctatcagagattcagaggtggcatttatcatagtccatgcatatggcaaaacttatggatctgcaaattgcaagctgaagatgactattttgcatattctgaggtttggctgaaacttagtaattagattgagattagtgtattcaggatagtgatttgagagcagcagaatggtgcatgggtggttttaaccaaggtgtcactgacaaggcctgaaacaggatatggttatatggatatgtactactactaccaagtacgatgggttgcattcatcagtgaagaagtcaggttagtgtgagtaattctctcagatttctccaagtttggatgtggactgacgtggaattcggacatgattgtgtgttctacagggacagagcgggcgacgtggcgcgcggcgattggctggcgggattctcttgggcccaggtcacgtggcagtggataagccggatcatcctgacctttggtttggtactgagtaccgaccggccggccggtgagccgactcgccgtgcccgtggtttctttcgccgctggaaaacagatagctcgccgtgttaggtgggcgatcgatcttggatgcttcgatgctgtgtatgcatctgccaagttgcttgctgaacttgcagtcgagcttggccgtttgctgtagattcagtgctagatgcatcaagtgaaagctactactcctacaatggaacgggagaaaagaactgcatcataaggggaatatgatttgtgttagttgacttctaatttcttgagagatattttccgatttatattaattaactgtagcgtaaactcaaagttgcttgtgcatgggtccctgaacttccaagttcttaggataattctcagggtagaccccatcttgtcaccgccctgaatgtttgtgcttaattaattaattgttgaatagccgaatgatttgtgataactattaagggtataaacgaatgaattaactattgtaaagctggaaaatggattatacaagtaagttcatatatataaagtttttctttttctttttgcaaaaaaatgcacttgtttaggagcccaggaagtgtgcgctggcgttaatctattgttagaaaagtccatggcccgtgaatctattcatttccactcgtaaaaggacagatcttacgacaaaatcatgacaaacttgtgtgatttttgcatttgggatctcatcccataatacaggttgggcctccagttatagagcagcccatcttcgaatataaccaggccataaccaggccggcccatattgctttgctccaaaaacaaaaattaagcccaaccgat

SEQ ID NO: 14662 - DNA, 1501 bp, Oryza sativa
ttgcaaacttgagatgacaattatacaactttttgtcaattatggatggagatttacaaatagacttcaataatgtgttctccttattttagtttcgttacttattttgttcattgggcgttttcaatgatttgttgaactacactcttatttgagtgctatttcctctgtttcacaatgtaagtcattctaacatttcccacattcttattgatgttaatgaatctagatagatatatatgtctagattcattaacatcaatatgagtgtgggaaatgttaatgaatctagatagatatatatgtctagattcattaacatcaatatgagtgtgggaaatgttaaaatgacttacattgtatctatctagattcattatcatcaatatgagtgtggggaatgctaaaatgacttacattgtatctatctagattcattaacattaatatgaatgtgggaaatgttagaatgacttacattgtgaaacggagggagtactatgtaattattggctgtagctctcttgagtaaaggccgggatgttatattcaattattaaaaaaaggaaagcaatctgtctataagattattaagcataaaatgctcacagaactaacacaaaacaactacagccttgaacgatcacttgccagactttcatgataaagtacgcaatcaagcatgccctttatgggatgaggccaggtggatgacggtaaccatgggcccaatggataagagctggtttgggcctaatcctccaatgattgaaagcccaactgggcccaaaatgggcccgtatactcttgctcatggacaaagaccgaatttttttcggatttagatttttatttttaaatatttacagaaataatctatcgaccaaaaaaattgcagaaatagcccctgccgcccacctctggggcggcaagctgacgtggcaaacgggggaggaacgggcggtgacggagggagggttttttgcaagaaaacccttgccgccctctggtggggcggcaagaggcccgaatgcaaaaaagccagtcggggccggctattttgcaggcggccccttgccgccctctggccgggcggcaggcctcgctgcctataaaaggcctgctgcccagcccccagccctcattcttctctcctcaattccagtgaaaaaaaaaagaagagaggggaggagaagagaagaaggggcgaagccctgccggattcagacgccgatttcaggtaatattcatagatcctatatgtgactattgagttaaatagtgtgtattctttaaaaatttgtttgaataaatgcattatatttttagggttttagttgtactaatctagaagtgcgtattgtagatatcgataactacgtagatctgctagtttggaattaatacattaccgttgcattggcttacacaagaagatattacgttgtagatgtttattgcatgaaagagtaatatgatctagttatttcgttgacagata

SEQ ID NO: 14663 - DNA, 1501 bp, Oryza sativa
ttgccctcctcgggaatcttgacgtcgaggagcgtgtccacgtacgagtgctggaacgtcgtctccctcgccggcgggaggccctggctggcgagcctcttgtactcccggcgaggcctcgatcagcggcacgaagagctccttctggcgccggcgcagcgcgtgcgcggcctcgaggcggccgcggaagaggtgcttggtgatccacgggaagaagaagaagacgctcatcctcctcgagatgtagagcagccacgcgcgctcggcctcctcgacgtcgcgcacggcgggctcgtcgaggcgctcgccgaagcacatgagcacgaggaggcagaacatggtgtactggaacgcctccatgacgttgggcgcctcctcgccggagccccgcagcttctccatcagcacgcggcgcacccagacgcgcgccggcgcgaactggtcgacgcgcgactgctgcagcgtctgcgacacgaggttgcggcggagcagccgccacatggcgccgtagttggcgcgggtgatgatgttgtcgctgacgccgaggagcgtgctggtggcggcctgcggccggtcggccagcttcgcgccggcggcgatgagcgccgcgtgcgccaggtgccgatccgccacgaagatggacagcctcgacccgatccggagcgtcacgacggggccgtacttcttgaacagcgtcagcaggaggggctcgacgtcggcggccgagtgccgcagccagagcaggttgccgaacagcggcaccgccggcgggccgggcgggaggcggcgccgcctcgacgacgccgcattgcggagcaggaagaggagcgggaggaggaggacgccggcgaggatgaccaggttatccatctgcgtcgtcgtcgattggtgtcgttgttgtacgtcgggtgagacaaaacggctttacatttatagggagacgcatcaagtcaacgctgaatacgattgagtttggataattttatgagtttaagagtctgaacaaactacgggttgttcggatgtaattttcaaatcttaattcaaaattattatgtgttagagtcctgaagtctgaacaaactatgacttgttggattggatgcaattttctcgagagagaaatcgtattcagaattggttttcttttatctgctcttttcttgaacatgtcgttagaccttggatcatacgagtcatgtggaaacaaggtgtcgcataagaaaatattctagaattttttttcttcgtatttattcctgttcatcatcatccctgacgtcagcggaggtggacccttccgttcacttcgtccgcaagtcgaatcgagatcgcgacggtggcataaagcataataaaccgataaatacaaccgaatttacttaaacacaagcagttaaaaacctcctaataacgtgctaattacgacacgtgttaaccatataaaatgagtcccactgaagtagccacacggtacgcggtgctcgcgctcactcgaaga

SEQ ID NO: 14664 - DNA, 1501 bp, Oryza sativa
taatgttttatatgaaatacttactactcccgtacgtagaacaaaatggactgtactaccgttcaggagtctgcatcgcatgcatgtcacgtgttgtagtacttgtactccatccgtccccaaaaaaaaaggcaaaccctatgtttccgtgtccaattttgattgtccatcttatatgaattttttttataattcgtattttcattgttgttagatgataaaacatgattaatattttatacgtgacttgtcttttttaatttttttcatatttttttcaaataagacagacggtcaaacgttgggcacggaaattagggtctttttttgggatggcacactacagttgcacccgtagaacaaaatggactgttcccagatggaagcttcccggccttgaccattgttccatcgttcaaaaacccatgacatcattacgccgacgtatgcaagatcaaccaaccgggacaaggattttctacttttccacacctagtgtcatagcatagcaccatgtgactcaataattatataaaaaataaaaagtatagtaacatcaattataatgatataagtctatacacaaacgtgcaagactatattttatatagagtaaagtgtacggatggtccttaaatttgtagtggtgtgtcatctagattcataaactctcaaaatgcatatccaagtctcagaacttgtcatagtgtgtcacaacccctttaggatcctacgtgacgttgatgtggcatgccacacgaaatgacgtgtcatcattttgactaacaaatgggtctcgtttaagatttttcctttttctttttttcttatctttttttccctttctactcctttctctgtgacccgagcagaagaaagggaaaaaaaagaagaatgagaagaaaacgaagaagaaaaaaaaatggcacgtcacatccatgtggcatgccacatcatcgccacgtaggatactagaggtgatgtgtcaatttgggacctagatgatacactttgacaagttctgggacctgtatatatattttgagagtttagtgacctatacgacacaaccctacaagtttaaggaccgccaatgcactttactcttttatctataatataaaaaaattataaaaatcaaataataaatagtacccgtacaatgcagataaaatttattattattgtttcttcatgtgtagatcgaatttagacttgcatatttgtatagcgtcttatattattatagtctatattatcaaattttatgatttttttatataactgtctaaagtaggtgtcatacatagcagtatggcaggtaagtgtagaaaataatttctaaccgtccgtccgttctcttcgtctccgatcgatcggccagagatctctataaattggcgccgagagtgagagctagccatgacaaacaaacacacactcagtagctcgtagtgttcgtacgtggtgagctactagctagctaagctccggttcacca

SEQ ID NO: 14665 - DNA, 1501 bp, Oryza sativa
gtggtctcaggtcgacatgcatgtgatgtgctcctgtttagggtatcaaaaattaaggccataatcgtaagcaaggtgtaaagttgatcacattctcttcatgctaaggaaaggcgatccttgctatccacataaaaaatctcaccttccttggaaagacatcctgttcaaaaattctttatttgtcactgcttactaattgtgctaagaaagaagtcaatgcgaatttgtgagagaatttcgttgaaatgcacgagggattaaacaattcacaccacttgctggcttgctgcaaacgcaagaattgtaacatttcgaactggatataatgcatttgcattaacgggaatcgtcgcactggatatgagcagagagctcgtggctttgaattattgagagagatgaagagaggatttcttggcgagctaagctaaggagagcgcgcatgatccaaccaaacattccagccaagcagctcaagtcttttcttttcttttctgattccaaacaagagaagagaatgccttttactttagcatccacttgagttgtcgcgctccatgctctatctcatactactactcttccatccaactctacctagctagcttagctagctcttatcttgctactgtctcaactgctgcacaaataattcttcagtaaccaaccatttttttttatcgctgccattttgccgccatcctttcttcaggatcgcagcattttgctgtcattatttcttcgggattgaagttccatctacatgaaagatgagttgcaaatagtgtgatgatcaattatcagttgcacagctcatctggttggatttttttgttgattgttcagagtttcagcatttgagacatggtccatgatctgccgacatcacgtgaaacgagtgatttttttttaccacctgcaactgaggtaacatttgggagatgtaaagggccagatagattttgaccgaccaatctcgtcttaacatatagtactacattttttttactgcgattagatctgaaattattttactgcacctggtaaccacgcacagtaaaagcttcattttgactcagaacagtctgccatcccaaatctacagccgttgacagttaactgaactttcactagttcaatcactcaacttataaaactgccgtcagatatttttttccagtctcacacttaattaactgagtaactaatctgtcctaacccatggatgtacactggatcaagcagaggggaattaatggtctaaacaaaggatgaggctatgagcacccaccaaccatacaaatcctatccctgcacaaccccctctcattttccccctctcctcctgagccaaacaattccctatcccctcatctcactgcagctttccactatactaccaccaccactgagctgccactactcatccagctaactaggagaaggaaaaaagaagaacacagatactttggtaacaagcaagaaattggcacagaaa

SEQ ID NO: 14666 - DNA, 1501 bp, Oryza sativa
tatttactaatgacggattaattagacttaataaattcgtcttgtagtttacaggcggaatctataatttattttattattagattatatttaatactttaaatataaatatgtatccgaatatacttaaaaaaattagccaagaaactaaacatggccacagttaagcagagtataggagtacagttaagcagagtataggagtaatcacaacataggaacaatgattgatgggatggatcacagaatatgttctacaaggtcccaaaagaatgaaaatgaaattcctttgatcacaagttctaaacacatggcaggacattagtaagcatcctaatagcttaatgtatagatcgccacacaaagatattcttttttaaaaaagcatatgatgcacatacactacaagtcaaaactatttcgtagaacagtggtctaccactaaacactcaaagcccaccatcctcctccacgtgcaggtttcaaaccgctaacatgggtgagtgaatctgtattcaaattcaaataaatatatttaaaataccccacaccgaacgaagatttactcccatttacacctaattaggtggtggttggatccaggaacttaactttagtctctatagttagacactaatttagagtattaaatataggctacttacaaaactaattacataaatgaaagctaatttacgagacaatttttttaagcctaattaatccataattagggaatatttactgtagcatcacataggctaatcatagattaattaggcttaaatgattcgtctcgcgaattagtccaagattatggatgggttttattaatagtctacgtttaatatttataattagtgtccaaacattcgatgtgatagggacttaaaagttttagtcccatctaaacagggtcttattcttttaacggtagacgacacatccatcatcagcgaaacacccatgataactccgtcaatcataatatatgctggatcagtttttcataagtattcataggtgtagagtgtgcgtgtgtatgtttacatgggtaagtgtgcgtgtgttgtgaacctctgtttataccgtgtttttttttaaaaaaaatgaaaattcgaatgtggcttgttggtattacaaccgcaggtgagtgagaccacccaccggttcgtgtctccgcaccgcccatccctaaaacatcgccacgtccccgccaccccccttcaatgtccgtcgccaccggcggcggcgtcgtcctctcgcgtgcccaatgcgcaagccccaccacgccgcgcagcctccgccgccgccgccgctcccgctcccgctcccgctcccgccgcggaactgcccgctcgcgaccgcggtcctggcgctcctctccgtgctcctcgccacggcgctgtgggtcctcctcgtgctgtccccggcgtcccacgcgaggggcccagccgcggggctgtcggatgcggcggacgcggaggcgtttgcggtggcg

SEQ ID NO: 14667 - DNA, 1501 bp, Oryza sativa
tctgtagcccgctactcttctctctcttctttatctctttaaaatatatttatagctagtttatagcttgctattgtacctgctcttacatgagttttggcatctatcctatgtgaatggctagaattacagcctacagcccccaatgctccaagaatttgagtcacaattattttcccttttctcctctccatgtggtttgtgcaaaggcaactattttgtccttcttgtggtgatgtttggacacgtggcatacttgaatagaggaataaagtttatcaagatatggatgctatggtcctcaaataaaagataggaattcctcacaaaaaacaggagaacaaaaatagacatggttggctgacattaaacctccaaattgaaaaataccgccaaaaaagaagccatggatgaagcagattatactatcaaactgctcatacgccttttgcacatttgtttcagatgacacttgtatcaccattaaagcagtattgaccaaacaaaaacaggccttatttagattcaatttttttttccaaaaatgtcacatcgaatgtttgaacacatgcacagagcattaaatgtggacgaaaaaaaaccaattgcacagtttgcatgtaaattacgagacaaatcttttgagcctaattacgtcattatttgacaatgtaatgctacagtaaatatttactaatgacggattaattagacttaataaattcgtcttgtagtttacaggcggaatctataatttattttattattagattatatttaatactttaaatataaatatgtatccgaatatacttaaaaaaattagccaagaaactaaacatggccacagttaagcagagtataggagtacagttaagcagagtataggagtaatcacaacataggaacaatgattgatgggatggatcacagaatatgttctacaaggtcccaaaagaatgaaaatgaaattcctttgatcacaagttctaaacacatggcaggacattagtaagcatcctaatagcttaatgtatagatcgccacacaaagatattcttttttaaaaaagcatatgatgcacatacactacaagtcaaaactatttcgtagaacagtggtctaccactaaacactcaaagcccaccatcctcctccacgtgcaggtttcaaaccgctaacatgggtgagtgaatctgtattcaaattcaaataaatatatttaaaataccccacaccgaacgaagatttactcccatttacacctaattaggtggtggttggatccaggaacttaactttagtctctatagttagacactaatttagagtattaaatataggctacttacaaaactaattacataaatgaaagctaatttacgagacaatttttttaagcctaattaatccataattagggaatatttactgtagcatcacataggctaatcatagattaattaggcttaaatgattcgtctcgcgaattagtccaaga

SEQ ID NO: 14668 - DNA, 1501 bp, Oryza sativa
aagtaaacctctaatgatgcaattacaaaggagcaattttatgatctttggtgaggtaccacaatttccggtatgaaataaccatacccttttatactaaaatactaaaaatatacctaaaggagaccaaaatttacactataaatgtcatacgtctcgttacctttttcaaagtaaaaaaagatctcgttataataactatgtgctttatttatgtttggaaaaaatgtacaacaagctgtactctctccattcatgaataactagcactattgactatacaactgtcttaccttgaccataaattatttttaaatgatcatattgtaatgaatgaaaagttatatggttatatttacgatgcaacacagtccgataatataactcgttttcaagtatttattaagacaagatcagcgatccaaataaaacatgaatactaccggcgtcaaatatttaggaactggaggagtaaaagtagtaactatattaccatgagaaaacgtcagggtggagaaagcaaagtaggaagcagtgctgagctgcctcacacttgatccttggtactccgggtttcttggctgctcaatcatccacacgacgaagccggtgtagaagaagaagccgatggtggcaagccagagatccctggtcagtggcttcacgaaaatccattggattggcttggagtcgttctcctccggcaccagcagcgacacaccggacgacgtgtatggcatcgtgaattccacgaggttttctcggtcggctgtgatggtcacgtcgcccactgctgcgctgaacttctgaagataccataagacagaagatgtatgtcagcacaatttcttagaaatgtcgtcattcaaagggacttggcttaaattattaggccctttttgacaattgacacaaatataatttgtttaaaaaaactagctatttctagttccagaaatctttatatctaaatatgccaatgtatttgtagcaattgaatgagttattctgtttgtgttttataaaaaatatacaatttcaattcattataatttaactttacaaactctagttttaaactgatttgttttacatttttatggtcttattttgaggctgcgatattatacgatacttcttacttagatttcccaaggaacatacggactttactaattattttatataaaattttcggtaaaattcctcaattccaaatgatatataacactgctaaatctgatatctcccatataaaagtgaaaaatataaagtgctcttttcgtggtaaattggtgaagcttatgcctttgatttgttttagttttcttatatttaatataatcagccttgttaggaaaaaacaaatgttttcgaaacataaaaagtattttttactactatctcaattttaaattaattattgttttagttttgtcttaagtccaaatatgtttatctttgaacatcaactaatttatggaaaatcgtaataatttac

SEQ ID NO: 14669 - DNA, 1501 bp, Oryza sativa
atcaaaacttttctacacacataaactttcaacttttctatcacatcgttccaatttcaaccaaacttccaattttagcgtgaactataaacacaccccaagattcgaattgtcaaagaatagcaagaagcaatcagaattcagcagtctgtcttccctgaaacttttcttcataaccaagtcttggttttcataggtgactgactgaatgcatgacttcgcaggcactggacacgtgtatgcaatttctcagaatctctagacttctggtctagttccatggtcaggtctatagacttgttcttgcagttctgattctgactttctgaccagtttgtgatgcccccaggtacatatataagaaaaatctgggtattgatcaatcctacagttaaaatttcaagatatcattcatctggtaggctggaagcaaatcagtagtttttttatctgcagagaaattataatacaagagtagatatatatttttttaggaaaacaagaatatatatatttcctttggaaagtagaagtgatagttacatttttgttaaagaatatcaaatgcaaatgataaaacataagacgtgatcagttactaaactatgcatagaactatctaatccaacacggcctgcggtgaagcgtagctatagttgctgaatgggaacagcccagactaatctttgcagcagattattggttaatacctacaatagatgaagagatggagcattcttgattttacatttccagagcacgctcagcatgaccatgtaattcatactgtctgggtggaatttgcaggcacagagccattctgaattggtcgaggctctttgccatcagcacgttcagacactcccatggatatcctgggaactgtcgtcaattctaatttcacggagaggtctatcagccacaaagccattgcccatgctgttttgtgcttgattagatccttcatgagcaccgtttccatcatccacaccaggactttgcacatcagaaactctaatttttgtgtattgggcaagaactgacattgaaatgcttatcatcagcatgagagctgacataaatccatagatgataaaaagaccagagaaactctgcaaagtgagaggtgtcgaatctgtgttggggatcgcattacttggagagacagcctctgcaccaaaccaatttcacttccatacgtgagccctcatccccactcgttacatccaacatggcagttgaaagattatgcaccagtggaaaaccaggaggaaacacctgaagggaagaaaacatgatgcaatttaggccagattgtagcatagctcttaaaggaatatgagtgaattcgccaaagcaatggagtgagagacttacgaaaccaaatccaggcgtcttatatatacgtttaagcatctggaattcgttctcgtaatgagggtctgagacaatagcggttaaaaatgggatctcatcaacgatagcagacacacctccattc

SEQ ID NO: 14670 - DNA, 1501 bp, Oryza sativa
ctcttccttcttctaccttggtctcccttatagcttcgtgcttgataatatagagagtagtacaacacggttgtataatttaagagcaaagtggagatacaaaatttagaggtgagattattttctcttattccaatcctttcatcaagtatacaaatgagtaattcctctcctctttggacagtagtgcaaatccatatatgaaaagtttggtgatggacccaataaatatatttggttcatgtcttcattggtcaagctctaagtttcttaacacatatatcaagtaaaaaaactaagttcaacggttttataaatttgttctagcctccatcacattttgatgtgctaaaagagaggcactcggatgctcggaaacggcagactacacttttcagcgcatgacatgataataggtactacctccgtcccaaaaaaagacaaaccctggtttccgtgtccaacgtttgaccgtccgtcttatttgaaaaaattatgaaaaaaattaaaaagacaagtcacgcataaaatattaatcatgttttatcatctaacaacaatgaaaatacgaattataaaaaaatttcatataagacggatagtcaaagttggacacggaaacccagagtttgcctttttttgggacggatggagtacatcattgcattggcaccaagtctaaatatagtgggttttgtttaggttatactacaaaactgaaaccaactaatggcatatggtattggcctaatggcataaggaaaggattaaaatgctagacaaacctcgatacatatgttccctatttcttcgcaaatctcatgcataagggcatgtacaacggtgtttattagtggtctctctctattgccatgcaagtaagtttgatgacatggaagaaagagaaaggagtatggttgttatgcatgacaacagctcagagtcgactcttagcatttattagagcaaattttgttgcatggtggtgaaagaaagaaaataaaagtaagaaaaagttgagaccatattgtctctaactgttgtaggatgctagtctccagataacgtagagctcatatctgactctacctttgtagatgccctaatgcattcaatggatgatggtcctgccattttcaaaacatcctcaaatgttataccatatggcctaaaaataaacagtgctaaattacagggacccccaccatcatcgccgagcctccgaacacaaaaccaccgctatttatgcaacatccttcgcacgctccactaatccctcccgcccatttcccacggccaaaaaaattaaagaaaacaaaaaaaaatcatttctcagaacaacaaaaccaccaaaattcagcaagaactcaaaattctaattctttttcgagcaacggaactcaaaaatatttgatctcgttcgagctgaatcgatggtgtgttgtttggttgcgtgaggagaggaggaggaggaggaggaggaggatgcgggtggtggtgg

SEQ ID NO: 14671 - DNA, 1501 bp, Oryza sativa
tgtgtgtgtggtggcctgatactctgatttgttaaatgaattgcatcattaattaatttatcccgttgggacatgacactgttgtgtagattttctgttccaaaaaacagggtggcgccaacctatcctaaggagtctccaaaccaaacatgcttagggtgctactcagatcaatataaccactaggctatatgcactctcacggtttcttgtctttataggtaccagaaaacagaacttctttaatgtacgtgggcacgtggctacgtattattgcttcaagataatatatgatgaatctcgctcgcctagaacgtcattgcaaacattattacattgccgttcatcctaattagtatttgccgcttgaaataaaactacacgcgttgacgcaattaaaaagacattgacttgatcggtatacgcatcagagagcaagaatactacaggcgaactatctcgatccaatagagtaattcgctgctatatcgaattctatgcatacgttgttttccccaacgccatgattaataattttatcgtaaaaacaaacactcaccttctctcaatataacagtgttttaatagctggttagctaagacatttaaagatcaacgttctcaaatactcctctccatctacttttgataatcatatttccagatctaaaaaaaaatttttgataggcatatttcaattcaacaacttatcattttaatgactttctcggatttaatgcatgactattcattcttccacacatgattggctacatgggtattgagaaatataaatattaatgaatcgcttgtttacgaggaatgactagtagcatgtttaaatggataaatagaattaattatccttagtctgtgtgccaaaatgaaatataactatcaaaagtagatggagagagtactaactaatacgactaaataaaattatagtaggagatttgcgttcggaaaccctgtgtttccaacacaagctgtgtgcacggaaaacgaaacggctcattagctcatgaagtatttgctcattttttttttccaaaagtggatcaatatgatttttttaagcaacttcgtatagaaacttaaaaaaaaaaggtcccgtttagcagtttaaaaaacgtgcgcacgaaaaatgagaagggaaagttgggaacacaatgttccaaacacagccttaatagttcagagtttttttttttgacagttaatagttcagagttgagatcgagcatgttgatattctacaaaattaacccaccggccagcggaagaatactccgcgaaatttcctgcgacttgcattgtacaagtcgcacaagaccaaccgcgtgtctccagttaaggtactcctacgtgtatatgtatgccattcataacacgatcatcgatcgagtaaactaacttaattacacccgatcatcgagcgaattgaaagaacaagctagctagctaaacacgatcgagttatcggttatggagaggtggc

SEQ ID NO: 14672 - DNA, 1501 bp, Oryza sativa
cataaaaatcgccgccgccacggacacggacgccacgcacacgccgcgcgcgctcttttcgccttcgcgccatggcgatctgcgctgctgcagctgaccactcccgcgcatccccaagctccgcggcaacgcaaccaacaaccatctgctggagacccagcaaggtcaaggaggaagtagaagaagacggaatggttgtcgatcccccggacgacgccagcgaggcgtccgataatctgcgcgcgacaggtttccaggacacgccgacggtgggcgagctcgtcctgcgccacctccgcccgcgtctccgcggcttccactgcgccgacggcgacgtccccgtcatcggcgtcagggacgaccccgccgccgcggcgccgctggacctcgtcgcgcggcacgggggcgccgccgacaggcgccgcggcgaggcgttctacttcgtgcggcggaggcgctgccgccggccgaacgtgcggcggaccgtcgccgagggaggcggaggcggtggcggtgcgggcgggctgtggaagaagagctggaccgggtccggcaagtcggtgaccgacctcggcgtcgtcgtgccgtggagcaagacgtgctactgcttctaccggcgcgacgagggcggccggctgagcaccttcgggggagggtgggtcttggcggagtacgagatcacggaacccggtacgtaccggcgcgccgacgaggaggaagacgacgacgactactgggtactttgccacgtcaggaagacggcaagcaagaagaggaagcggaatcgctgcgatgaggccgtggctgcacgggctgtagccggtacggagtctaagtcgtatctcctatgtgggctgacagcgaattgatttgggaagcattaccagtccgaggcaagagtctcaaagaccctgcgggcaccgagattgtgacatactccgtcctctagcgttccaaaaatatttgttgaataaagtcttcatttctggggttataacccatcaaactaagatattgtctctccccgtcatactataagatatttttaaatttttcaagacaactttctttttttgagtttgatcaaatttatataagaatatagcaacatttttcaaaaaaaaaaactagtgaaatataaggccgaaccttaaacttgtgtgataatatcacttagctcggtacactttatttattgtaccaactaccaccctcgattcaatcgtcttttgattatggctgaccgtcaacatggagtgctatgtaggcaatttttatgcacttggcttcatccgcatcacaacatttcacaaatatttgatatacccccttgcatccacttggagaagccatggggatcccgagcgtgtaagccgcattgtgccaccaattgtcacgaaccttgccgcactgtgccgcctctcgccgttaaccactacctcgccgcctctcattgtcttgcagttgaaaccctagccgatttggttttttttttttggat

SEQ ID NO: 14673 - DNA, 1501 bp, Oryza sativa
gacaataattgcaaagcgacaccgtaactttcggcggcgcatgctgcataactgtttgctttattaatcacaaagcgacgaatttacattcggcgcagtgcagcataatcttgaaagtttaattgtgaatgatttgatgctctggcgcatgtcccgtgattggaaagagaggatgccatttcaggtgtgtcggtgacatggggccgggggtatcgtgactagaggcttgggtagccgcgatcactcacgtggcccgaccccctcgggggggtcgggcccaacggtgacatggccacccctccctctgtttccccgaggggtcgggccgctcccgtttcgtccccgagggctggggcgccccgaccccctgagggtttggcgccacgtgtgtgggttaggtgagcacagcggcgctcacctaaccgcgtttattgcgggttggacgagcgccccacgccgcatttaatgtagcgcagcacactcatccggtccgtgatcggtcacagtgtgtgaccggtcacagaccggtcagatcgcgggtagggggcaacaggcggcctgacacacgcctcgccccgtcccgtcggaatgatgagagcctccaggcactcgtccctagccggagccggcgtgggaactcctggagttggcacgtcagccccggccagatacattccaggcttcatcgcaaccattgcaaggaagtcattgtatgaagaagggcagacgtgtagcatgctaaactgacacgtggtagacaagaatgactggtttgtgactggtctgacgccggtcacgtcatcagcaaacaaccgtgctcccacgttgcacctgcttccggcggagtggaggttggtatgacccatcccatcggagggtcattcggacagcaaccattgcaaatctccacccattaatgaaggaaggacagggttatcccggtgtcaggcgaaggtacgagccaagttatggtcaaagtaggatgggtccccacccaaaagaagggtaggtagaaatggtgtatgtggtatccccttgagatataaaaggaggaccatgcctaccgagagaggggactgggggggggggaagaaagggagaagaaaagaaggagagctcgaaaaaggaagagcggagctcatagaggagagaaagagggagagggtctctagagtttgaactctcttgctctccagctctttgtaactccttcatacacagatccaccagaacacaggagtagggtattacgcttctcagcggcccgaacctgtctacatcgcccgtgtcttgcgcatttgctctctcgcgaaacattccacagatcgagggcttaaaacctcacctagcgtccccggccgaaccggcaaaggggggaccgcgcggtctcccggtgaggagccccacgctccgtcatctggcgcgccaggtaggggacgcgtgtgtttttctaagctctcgtcctctttcgtgtgcgccaagcttttcccgctcagcccaa

SEQ ID NO: 14674 - DNA, 1501 bp, Oryza sativa
cgtacgtctcgagcaccttcttcagcttctccaggctctcgtgaaccacctgctggttggtcgggaccccgcgcatgatggggaagatgatgcactcgaacacgatgggcgacagtgcagggtagtactggtgcgcctcgacctccgtccatacgtccaccaacgcggcctccctgatgtcgctctcccggaggagatcgactttgctcgacttgtacttgcgaagaatgtactttgcgattgcgcgcgactctgaaaaaagaggactagtaagtttgtatttgctgcaggagaagctgataagattgccgcaagtatttaacaattaacatggtcgttaattatttgggttttggtagagagctgcaggttggccatggtggccactcaccgaacaagacgaggtccccgtcctgcagagcagggatcttcccaaatggctgcagaaaaggagaggtggcatccactgtgtatcacggtggaagctgatacatacatatgaaaaattactgaaaaaaacagctggagaaattcagttacgtttcgctcgacgtgctctgggctgttctgctcgccggcgaggaagtcgacggtcactagctcgtagtcggcgccgacctcctccaggcagaccagcacccgcgacacgttcgtcgagatggcccggccaaacaccttcaccggcgacatgccttctttcttttttttcctttgtcctcactgcagcttgaagatgacactgcaagtgcagtgaagacgatgacccactgtagcgcggatgcaaggccttggcagagtgcccttcacttatataaagcgtagcgtcagaagaagcccaactgcccaagtagtcatcttcaagtcttcgttgaaattgtaaaaatcactcgacaattttcgtgcaaagagggaaaaaatgtcagtggcgtgcatggaggagggaaaaaaagagggaaaattttggaacaaatttatatgcaatttatataagatcaatgtgtgttttgattcttattctgtgatgaacaattggcatttgtgattattggttttgatatttgaagattatcgtcgaagtggttttgtagataatcaattttcaggtgatgatcggattcactgttattttatgtgaccggtccgaccgggcggaggttgccggtcagaccggtgctatgtgtgcggtcagaccggccaggcccgcggtctgaccggccgacgctgtgtcggtttcggtttcgggttgtttctttggatatccgtgattatttcatggttatggcttctagatggatactatacgtatgtaatactgatgtttgctaacaatgagtcaagttggggatagcttggtctcggaatatggtttctctgtttgtttcatatgtaggtgactcgatgtctcgggagagtattgcggtgatggaccgggagtcagcttggtggtaagacgatgtccgtggtggtcagatatcatgcgggatactaaggctagagttga

SEQ ID NO: 14675 - DNA, 1501 bp, Oryza sativa
gatgatgatcctgtggcaccaggccattggagggttcatgacgcactgcgggtggaactcgacactagagggcatctccgcgggtgtgccgatgatcacatggccacactgttcagagcagtttgtgaatgagaaattggtggtggatcacctgaaaattggggtggaggttggagtgaaaggagtgacacagtggggaactgaacaaaaagaggttaaggtgacaaggactgctgtggagacagcggtatccatgttgatggatgaaggggaagttgcacaggagattaggatgagagcaaaagattttggcatgaaggcaagaagggctttggaagagggaggttcttcctataacaacataaaactattaattcaagaaatgggaaacaagcaaaatgcatctggttgatacatatggaaataagctttattttttcttaattgtaaatctgtaagcaagaactggaggatcctattgtgcttaccctgattttcatccctcaaactataaagaactgtactctccctctgattccaaatataaatctttttatacttgtgcaatttgtataagaattaataaaaacaactctaatgaatttgttgcccttcatctacagtatactatatcaagaaagataaattatttatttttaagagggatatagcatttatttagcaaccacaaacattgaacaatagtaaaaaaaaattgctaagaagctctgaaacgatatatatttgggtaagaattgagaaagactcaaatgacttacatttggagcccaacagtcccaccagcttctgcagtggacgaggttcccaggaccccttgcggatgagaagagtattctacaaatgatcagtgtatagagtggattagacctggtcttacatcactttcgtaattgctgcttcgattcctctgaatatatgaatgcaaattttgtggtcaaagtcaggcatagacttataaagatcacaaaaggaatttccttgtaccagataatgcagaggccagggagtatctttcgattttaagtacgtactgtattgatagcaactgtggcctctgtggttgcataaagaatggaagaagcttcatgtacgagggatctagccacgagtccatgactagcatgcgtcactgaaactgaagttgccaaagtctagcaatactgttctttttcagcacgagctcgaactggccgagttgatagtagtacaaactgttggcgctgcaatactttcaacccgtcactttcctctgatccgaagtggcaggcaccacatatgcactcctcggttgctgtcaagtgtcaagcttctcatcaactcgagcaggcaagcagcacacgacttctcggttaatgcatacctccaaggctccaactgttcttgtcacactctcactgtccacgcttgtcttggccgcttgactagatacaaccacacagccatgtcttttgccagccacgccggcgccggcgccggcgac

SEQ ID NO: 14676 - DNA, 1501 bp, Oryza sativa; identical to SEQ ID NO: 14675

SEQ ID NO: 14677 - DNA, 1501 bp, Oryza sativa
ggagacagtgttctggaatggtgggtcgatgaggttgtaggtggctgggtccctgcgctcgtcgaaggttccggaccctcgtcccacgacgtagaaggtgaagccgtgcaggtgcatagggtggttctcgatggacaagtcctggaacaccacctccaccacagtgccatattccagcaccttcaccttggtgccacgcttcgttagcaagggcccgccgccgttgatgtcgccggtggggttgacgatgaccgtcagcttgttggggaagttctcctcgtacacgccgcggccggagccgtagtagtaggcgtcgaggacgtcgatagccgggttctggaagctaacattattgaggctcgccgcgaaccggttgccttggggtccctcgcacaatttatttgtcgcattgttagcgtcgcaagggagaaagttgatgtcaatgtcgatgagcatgtgctcgtccacctgctttggtacgtgcaccgggtggtcctggttgcctaatgacctgagctgcttgacgaacgccatcgccgcgtcctcgtccttgatggccggcagcaggacggggaattctggtggcccgaccggcctcgccacggcactgtccgtgtactccacgatggccgtggcggtgctattgttgaaacggatggtatcaaccggtaacgtgataaacgtcctcgcggccatgtaataccggctgttggatcccaaggtgcggttggccttgaggagcacgtccatggtctggcctggcgcgatcatgatgtagtcgacggtgatcggcttggtgtagcgggcgtcgatgccgaccacggtgagacggtgccccgcgatggcgaagaacatgtcgttggtgagccccgcgttgatgaccctaagcaggtacgtgttgccctgctgcacggccaccttgaacgtgtcgtccctggagcagagggggaacatgtccccgggctggccgttgatggtgttcgtgtcggacggctccacgtctccgccgatgcgcttcgccttgtcgagcacgtgctcaacgtcgtcattccaccactcacatgcacaacatcatatcatcataaacgattaaacgatggttcagatcaaaacacgtacttacgaagcattgcatcgcatcgcattgcaggatggaactaacattgttaaacaaaattgattaccgaggatgacgggtatctccttgtctagcttcctgaagaggaaggtggtgccgcgcttggggtggatgacgatggcgccgtggacggttgcgcggtcgaagtcgctgtgagcgtgccaccatagcgtgccttcctcctcgaacaggatcacctggtaggtgaagttgccgcccggccggatcgggcactgtgtgatgaactccggcccgtcagaccacgggttccgaggctggtccacaccgtgcctgcgccacagtaaaatcatccagaacgtacatcgtaagtttaatttcgagccaaggatcgatatataatgc

SEQ ID NO: 14678 - DNA, 1501 bp, Oryza sativa
tgaatttatggtgaaaaaattgaagggggtgttcctaaggatatccatgggtcttgtgggtgcaggagggactgatcagcccctgcgcacgggcacaactaagcaacaataaaaaaaaaagcggaataacaatggatcgataaaaaaagtttaaaaacaataacagacagttaagaaataagaatcgtccacataatgcctcaagtcctcaaccgagggtccaaatcacgggttacaagtgcaacatgttaaactgtacggaccagcggcaacccctaattggtgcgaaattcgcccaaaaaatcgctgataaatcagaataaaccgaaaacccccttcggcaataattcatcatcgcactaagaacctaaacgtgcagcggcgaaatcgagcagccgggtcgcagaaaaaacacccaaaacaaaaaggatgggagattaagagcagcacacgtacgacggattcgatgtgatcgtccagggcctgcttgtagcgatcgtagagcacctgcgagtagtcgttcggcggcttctgcgtgcacatgttgtaaaccgtcctgccacggatcagccgtaccagatcagatcaaatcagattggaaccaacaacgaacgaacaaaaaaacccccgcgaatccgagagaacccaagcggagaagacgagcgagcagattggggaacgtacgtgtagaggtgcatgtactcgtcggggacgaagtgcacgacgttggagccatcgaggatgcacttgagcttggcgacgccggcgagcacgtcgcgccacccgtcctcgaggtccaccaccggaatgcgcggcgacatattcatcacgcctacgccgccgccgccgccaccgccgccgcgcgcgaggcttgtggacgaaggaggcgtggggcgagggttttggtggggtttggggtttcttcgattcgatcaatcgatctcgcgggggagacggcggaaataaataggggaggaaacgggggtcgtgtggggcccttctgtttctggaatgtgcggaggcagtttggatcgttcgtctgcttcgattgagtttggaggaaatccacggcctgccttttttttttttacagaatcataccaaagccattcctgataagttgcaatgtgggcaataagaatatgaactatgccttagacggaatacaacagaaaataaggagaaggatatgtgagattacaattataaccatattaaattgtgaaatcttaacagagagcgttctcgttctttattaagcaatgacgccttccatggttgtccgatctactagcaattgtgtagccgtccgatcgagctaacgggttcgatgcaaatgtgtgggtgagtcaagaagcatccaagatgagtcgttctaccatgttcctgtgcgagacggacactcagtggtttctccccaaatccatgattttcgtgtgtgtgtatgcgagagagttgtggttttgagtttgtataagtgcttggtgttaactcaaaactt

SEQ ID NO: 14679 - DNA, 1501 bp, Oryza sativa
gagctccgcccagaaatcggcaagcaccctccagggcaactcctcgtcgccgccgagctcctccgccagctgccgcccgagcttggccgccttcctcagcgtcgcgttcgtgctcccgccgaggcacgtcgccgcgcgctcgtaccgcaccaccgcccctgcgaaccgcgcgagcaccctcgacacctcctccaccacgccctcgtacagctcctccgtccaggccgggtggtccggcaggagctccggcttcagcgccaccaggtaggcgcagtaccgcgacagccgtgtcgcgacgaccaccgtgtcgctgtctccgccgccgtcgccgtctccgtcgtcgtgtctcccgtgagcgccttctgatcgcatgatctcgagaagcctggtcgccacatgccataccaggatctgctcggagacgcttctctcgtcgccggcgtggtggcacgcccaggcgagcttgtcggcgacgccgttccgctgcaacgagagcacgccgtttcccaggtttccttggttcgtccttagcgtgtccacgacggccgtcttcaccgccgccggcacagtggccgacgacttggcgatccggtcaacctgccgggagacgcagccacagtagcacggacggagctgcaggatggacgtctgcccgaaccgatcgtcccagcgctgcattggcttgagcgggagaactcggccgacgttgcggcgagtccatggcgacttgcgccatgacggccggcgcgcgtactcgcagatggcggacaccttgatccagtcggagcggacgtaggtagcgatctcccacccctccgtgaacacgatggcgacgatgaaggagacggtgacgagcacgtcgaggccgacgatgatgtggaacacggtgtcgtggttctgcaggtactccctcaggttgtcgtagttgctggcgagcgtcgtgccgtggcacgtcatgtcgtgcacgatggcgccgccggcggcgaggcagctgacccacgtggcgaacacgagcatcgagttgagcaccgggaaccaccacccgctcgcgtagaagacggtgagcttggagtagaggaagtcggcgaggaaggacagctcggtctcgatcacccggaacacccgctcgtggctctcgccgaggaggccgtcgagcacgaacgccaccgaacggcgagagcccgcctcggcgatggggcacccgacgaaccgccggagctgcagcttgaacagggcgaacgagaggcatgtgtccttgatctgcgggttagaagcgacgagtggatcgccggaggagaacagccggcatatccggtccatggtgaccacatgcccggcgtcgacgcacaatggcggcggcgatgtccggccaatgcggtacccctgtggcctcgcctcgatttgcagcttctcctcgcccatcaccaacaacggaggagcttgcacgtcgtggtctccttggtcttgcccgtacagctgcttcatgtagtcggagatgagg

SEQ ID NO: 14680 - DNA, 1501 bp, Oryza sativa; identical to SEQ ID NO: 14250

SEQ ID NO: 14681 - DNA, 1501 bp, Oryza sativa
cggtttagggatgtcaattaaactccacgaaaactgagaggcgatatgtggacttgtttctttctcgttttctcccggaataagttcatctgaggtcccttaacttatcgacgaatccgattttcgtctttcaaccagaaaatcagatataataggtcccttaattatcaaaaccggtgcaatataggtcataaggaggtttggacggcggttttagctgacgtggtgcctacgtggctaatttgactcggtcttcatctaacgcggcattgacgtggcccttacgtggcaatttgatccgaaaaaatagtaaaacccgtgggaaccatatgttagcttcacatacacaataataaaaaatggtgggacccatgtgggccctgcatgttattctcaatcccctcctcttcttcctcctgacctcctctctcccccatctcacctatcttcacctctctcccctctcctccctcctctcaccgacggagatgcggacggcgtggaggcgcgacctcctccactcccgtccccatgggcttaccgccgacagccaccgtgcctgcttcctctgccgctggtcgcaggtgcatctgagcaagaggagccacatgcgggaccagactgtcagcgccatggatgcagctacatggctagggaatggctctaagctgctgccgacgtgcagctcatgggcgatacccttgcagtcacgtggcgcgtgtgttggaggaagcaacggagacggggaggtggccgcgtgtcactgaggaggacgggggcccggcgaaggcaagagcggcaaccgtttctgaggaaggcgcgggggcaaaaggcggtgctggagaacggccaccggaggtcgaggcgagggggaagcggcggcgacggcaggaacatccggaggcggtggaggcaggcgtggcgggcgacgaggagaggggtggcggatgcctgtagtaggcccatggggggcgagagtggaggaggctgcgtcttcaagccgtccgtttctccgccggcaagaggagggatgagaggggagagagatgaagacatgggagatggggagagaggaggaagaagaggaagggattgagaccaggggtttatgtgggccccactattcttttttattattgtgtgtgtgaagctgacatgtgggttttataggttttttttttcagatcaaattgccacgtaaataccacgttatatgaaaaaccagtcaaataaaccacgcaagctaaaaccaaaccaccggttttgacaattaaacgacgcattggttgacaagttaagagacaccagatgaacttattcctttttctcccgtagcgcgcgcggcccacagcctacacggcccacctcccgcgctaccccccagtgggcagtggcgacgctatcctctccatccgctcgcggctcgcgctcgcccatccaatccaccgcaagccgaagcgtgagcaaagtgccctcgagccatggccatgtccctctccct

SEQ ID NO: 14682 - DNA, 1501 bp, Oryza sativa
aactttttctaaaaattttgcacaatagtagataggtaatgaactgaacaaccataaaaaaatatatagagaatccattgtgtgttactgattttgtccttgttctacaatatgtcactaggtttgccaagttctagtatgccatcgcactatgcttaacttctataacataccatcgtcgtctagcttccgttagaattgtacaattttgacataatgaccgaaatacccctaggacgaaaaattacaaatatcagattgtaacaaagtttgagatgcgcaattctctgccttgtttataatgacatttcggattttttgccaaattttagaatttccgtcccatggatatttcggtcattatgacaaaattataccgaactaacggagtctaaatggacggcgacggtatattatagaggataagcaaagtacaatggcatattgtataacttgacaaactcagtggcatattatagaacagggacaaagtcaacggcacacaatggattctctctaaaaaacaatctagtcaaattgtttgtttatctcattcaaaacaaaacattttttttatcaaacacgttaggagaacttcaaaagaaggtaagaaaaagaggaggttagtcactagctcaaacacacgtggggaaaagttactcacatccatggtatggtatatgctcacattaatcgataatatactaatattattaaaattgttcttcgtcgtaatacggtgtgaaactaaaactttaaccttatattcttatgttgttccatcttcttcttgttttctcattcttattcttttataataatattgccacaaccaacactattatttgcacatgaatattagtagctaactcatgtgtgtgcgctccgtaatatatattattgttgacgcgaaaaacacgcactggcctgagagatctgcttaactctagtgcaggtccaaagcgattaccttcgggttctgagtgtgccagttggtttgatcctgcaaccaacaagaaataaaaagggacaaagttaaatccgtcaacgatagccgatcggctggattgacaatgacatatcgtttggagccaagtcgatgtaacttgcatcagatcggcaagggaagataaagcgtagagattattagatctactcgatcggttgaagatgtcaacgatacacagtctatctaatgaaatacatttaaaccaagtgattggaatagatcggacgatgtgccgagataatataaatcacttaatatctaaatgtgcctcaaagtaaagattgtgtatgctcgcagcatagccgatacagcaaacctagcatgtatcggctagtactccagtacgactctatactaagataacagggtaaatgaaatatataaaacgcagatcaatctagcaagtaagatggactggcagactgataaagagcaagatatgcttcaaataaacgagatcttaatataaagggcagatttagaagatcgaga

SEQ ID NO: 14683 - DNA, 1501 bp, Oryza sativa
aacaactatatacagacgaagaaagtgattcgaaccttctagctggacaaggactgcagatcactcaagaagagatcctaacctcaattaaaggtatgaattcaactagtgcgccaggaccagatggatttggacctagtttctaccgtgctgcttggagctggatcaaagaggatgtaatgaggttggctaggatctttacaactttggggctaaccttgagaggattatagagccttcattgttctaacacgaaagccgggaaaagaaaacactgtcgattgctacagacctatctccctgcaaaatttctcactaaagtttatctccaaagttcttgcgactaggctccaaaaagctctaatgaagatgattcacttggaccaaactggtttcctccatggaagatgcatctcggaaaatctaatctatacgactgaattgattcaagcttgctataaaaggaagtgcccaactgtaattataaagcttgattttgcaaaggcatttgacttggtcaagtctcttccaaatacttgctgtcacaggattcccagaaatctggattcaatggattcagagtttactctgctcctcaaaatcttgtcttgatcaatggagtgcctgggagatggatctcatgtaaaaaggggctccggtaaggagatcctttgtcgccatacctgttttttggttgccgatgtgctacaaagaatgctcgagcataaccaggcaatcagacacgccgtctaccaggatcgcccttgcgccactatacggtacacggatgatacttaatcatctgtgtaccgagtggaagaggaggatgtacaagcacttgttggatattttgtaatcttgagcattttatatttctgttttgcatgaacgtagtggctggctgaaggttgttttggccggtcggtagaatagctgtttccttctgcatgttgtcagttttgtttagctgccgaatgacctggtttcagatcgtgggatggcgcggtcagtagccgatccgggttgctcgttccgttcagttgtgcatgtaacaaactccgttttggtggaggagaatatagagtgaaaacagaaaagcagcagaggttgcgctgcacaaaaattctactttgttcttcagttcttgacgtttcccgaacttcttgaggttactatcgttgtccggcaattttcagagtgagcgagtgtgagcgatttcagagtttgctctttccgttttgctgacaattggtatcagagcggtaccacgacggtcctgagacgatgtctgatgatggcgggcgatacacaccgcccggacgccgtggtggcggtggcggcggcggaagcggcagcgggcgcggaggcgcaagtggcagcggcgcgggggatggcgcagacggcgcgaaccttcctctcgtgccacaggggagagatgctgggcacactgctcgcctcccggtgctgtcgaggaccaattatccggattgggcattgttga

SEQ ID NO: 14684 - DNA, 1501 bp, Oryza sativa
ttgtcaggtaataactctacatcctgttggccgaagccggtattgctcttattcatgataatcacaccagtacaatgtttggggtagcctatctaactgttgttgacatggcggtctgacgatctgactcgtagtcaacaacaaggtagcctcccacctcgaatccgtgcccggcgagatcagagatagcgcttttgtctctcctgacagtatccggagacaccgcagggtattagccgtgcttatccctgaagtcgatatccggcggcttgtcttggcgtatgtaggcttctatgttgtggcttctatgtcgattgtgttggatgttgatcccttcatggtggatgtctgtccccctgtcctcctaggggggcttgtatttatacccataggtgtccccttgtccaagtagaactagggaaaccaatatggatacaatccgagtaatccttatcgtttccatggagaactctggttgtctttccttatccataactctctcgaggtcagtttccgtataagacatggtatgtggtggatcctgccgagatttagtcaactactattaggtatgtggtatccataaccctgacagtagcccccgacttcgatgcaaatgaacgaattcatattctcaaccgcgcgcagacattggagtaactgttatcgagctcatgtgacatttctcggtgagtttagagataacgttggacttcctttgtcagccttgtgcgggcaccgaaagggtttgtctaagtcaatctctgatgtcgaccgagaaagtacagagcatacgactaagtttcccgtcttgctgtaatcgagaatttggattgaagtcaagaaattttatctcggcgggtacaccatctcttcattccgtattccttgtcgagatccagcaaccgttctcgagcgatcgagaaggcgtagagtctgcgacggaactttgtcaatatttgtcatactcgccttagtcgatcttggtgtagaaccatagagacatgcgatcttcgataatgtcaaatagaattttcctgaaatcaatactcagaaaagaatattagacagaaatagcccccgagcgaacgctctaagggtgacatgttataatatgtatggtaaattgaaaatgaattaaatttaccgaccaatattttgagtatgagcgtcttctctcttaccgacttcgatcagtcagtttgtagagtcatacactctccctagcccccagccttgtcgtcggagaatcgttcttggaggataaggctcttggacccttgacctgctgtcacgcccagaaattcccgaatagaattccaagcagaatgtgcattaaaatccccgtccaggaccagccggggtacacaaacgacaatgttgacattcagatccacgtcttacaaacatcataaaagtcttacaaaaatgcagcggaaaacaaaagaaactggagctaagccttgactaaactacagcggtacagcgggaacaccactcc

SEQ ID NO: 14685 - DNA, 1501 bp, Oryza sativa
gcgatgggtggcgggacgtcgtcgctgctctccgcggcggtgcaggagatgctgatggtgcagaagagcaataaggccatcaagaagccgccgcgggcgacgccgcgcctcccgcccgtcaccggcgagcgccgcggcggaagcggcggaagcgtggacaggggggaggccacggcgccagcgccgaagcgcgcggcgcgggcgtggcagccgccggcgaagagggtcgccaggagcatgctgaggcggggcgcgccaccgtcgccggaggagaagaggaaggtcctgacctgctgctgcgcgcgcctcccgccggggctacgctgcgcgctgcaccagtgcgctcccggccaatcgtggatgcggtcgcattgcggcggcggcggcgccattgccgccaccagcgaggccgtggcgccccgggcgtgcgggcgcggcgggtggctgttcagcgagtacgcccggtggcgcaggagcgtgtggatgccgagccggttctacctagagcgcatcgacgggcaaccccgtccgccgcccggcgagctcgacgctggccgccggccgccggcgagctaaccgcgcgtagatatgtaggaatgtagcaattgttcttagcttcgtagcaatctgatgcaaatatatatcaaatacagtatgtgaaatggtgcatggatgaaatgaaacaccgtgcactgctcctattgtatttgcaacaaaaagaacaaaataagctaaaaatagttatagtacatttgcagctatatttgttgtttttttacaatttgtagaagttgaatttagtcttacatatttgtggagtgatatattttatattaatctatcttaccatttttgtcaaaaaattttataactatttaggtggcataaatgaaacgagggatatcccctcgagggatgaaatcactttcccatgtacaatgtgtcatagttatggataccacatacctaatagtagtcgactaaactcggcagggcccatcacataccatatcttatacggaaacaaacctcgtatatagaaggagttccggataaggaatgacgagtagagttctatatgaaaacgacaaggactactcagatcgtatccatatttatctacttagttctacttggacaaaggggctgggtataaatacaagcccccctaggaggagaggggacacgccacaaagccacaagccaatacaaaccaatacgctgtcagatctcgacatcagagtttagcctagacaaacccaatccggtgcctacagaagccggcaagagggatctagtgccatctctgatctcaccgagtacggattcgaggaggaagactaccctgttgtcgtctacgagttggttatctagccgccaagtcgacgacagttagatatgttatcccaaatattgtacttgtgtgattcagatgaataagagcaacgccggctccggtcaacaggatgtagggctattacctgtaagataaggggctcga

SEQ ID NO: 14686 - DNA, 1501 bp, Oryza sativa
ttcctggccattctcctgcatagtacaccatagaagtctttgattgtgataacaggaagtgttcttggaataaagtaaagagcgacaattgctgaaaataactgaaatttttgatgagaatggaatgaaaaacacatgatttacaacaaacataatcaacattgcttagatcggaatcgtttatttatcacagctaatcactaaatctcactacagtttagacaatgcctttatattaccaacaccaaggctagtaggctacattagcaggtatgaggattgttcagatcttgctagcttcggttctaaaagatgtacacatgatcaccgagtgtgcagaatttgtgacaactaaataaagctgattattcctgtaactgtaaaacagaggaaaatttagcaaaaacttactggattaaatggcgcatcgacaggatggaactcaacatggtacctcggctcacgcgaattccgcccaaacggcgcacctgacatcggcaacaattcagtgcaattctgctttgtttttcctcttgcagcaattagagatcgaaaagtaagaaaataaatagatcatggccaaatggagttaggtccagcaaatcatcagttattagcaatttcagatcatacaagcacacaaagaacagccttcaactacagaattctagatctaggcagtaaatgaacatggccaccgtgaagcaagcagcaggcaatcataatcgaacaaaatgaataatgaaatcgacaagtattccatcaatatacgccgagaaatcgcatcgagcaagtggtgaatttggatcgagaatgacatgaagagagggacagtccatggggggcgcacgacggatcttgatttcttgccgagactccgacgcgattacctgaactggtgaagatctgatcggcggcggcagtcagagccgcagccgccgccgccgccacgacgaagagcaccacgcgcgccccgccggcgagccccatcgtcggcgacggcgcagggttctctcgacttatctcttcagcgttcgcgtgttgttggtggtggcgtttttcagtcttagacctcgaagacgtattcgctgtttccgccttctcaccccgtatacacgccgtataggaaagccgttttccctacagggaagcgctacacgatggaagcccaacttaattaacgcggatggattagttcgatgaaaaaaactgtaattagcgcgcaaactaaccaccccgcccgcgccgcgctaattctgcccgtggcggaatgcgacggttttgctgttcgggcgacgcgacgcgacgcgccacgccgcgcgcgtgcgttcgttcgtccgcagccaacttccggcgcgcctccgcgtgagcgcgcgcgcgccaccggccgcaacgccgcgcgtcctcatccatccgtggcgccaagcgggctggcgggcgggcgcggcgccgcgtgcgacagccgatggccgcgggcgcgcgcgcgcgggcggagggagcg

SEQ ID NO: 14687 - DNA, 1501 bp, Oryza sativa
gccgcggcacgtctccgccgtgccgtgcgcgccgcggcagcagaacgcgtccgtcccgaacgccacgcacgcgctcttgcacgccaccaccgccgccgccgccgtcacctgcagctccggcgggcacaccgcgttgacgttcttggcgcagccggggatgacgcacttgcgatcggcggcggcggcgccgggggtggggggcttcgtccacacggccaccggcaggttgtagccgtcgacgaggctgacgtcgtaggagctccccttgctctggtcctcgtggaggtccacctcgacgagggtggccggaggggcgccggcggtgccgttgcacgcgaggcggccgccgcagtcgccggtgaggcaggacgcggcggcgttgccgtggtggttggtggcggtggaggtgaagttgcagccggtgcggccccagaagcggccgttccaggtgggcggcgcgctgacgcgcctggactggcccggcgggaggaggaagccgccgccggcgagcaccgggtggccggcgttgggcgccgccgccggccacaccgggaacgggcacttgttcaccacgcggaaggtgacgccgcgcacgagcgccaccggtcctgatcatcatccacagcagcacaacaaaattcatggaaattaccaatgctgaaaagtaaattttgccaaaagaaaaagaacgtaggtgggtgtgatttacggtatccatttcatattaaaagaacgtaggttttattctctctctttaacagagtttataaaaatagctagcaatttcagtttcaaataaatcagacatattttattgtagattttaatggaactaatttaatatacaaaagccatggatgtgatctacttcctccgttttacaataagttcaattttcctattctccacatatcaattaaaacctaaaagactaaaatatcttcactttatcaaatcctgatacaattattttttgctttatctactcttaatgtatccatctcctaattttacaaactccaatataataatgactaaaaataaatttatttatgataaatcggagggttgaaaagtaaacttattctagaacgaaggagtacctaagagagtaatgagcaggagtagtggtaggggatgaacgccggagagcaaggataagcacgccatctgtgtctaaatctatatagcaaaccagagaaactaactaagctgtcatggagatggtgcagtcgcagagagtaaacaagggtttttataccctgcaagagtctgcaaatacaatgatgccatggctaaggagatagctaagatcaatgagcaatgtgccatgtgtgtgtgtgtgtgtgtgacttgcattgcaatggaagcaaaggaagacatgatttggggtagcaggccagcagccacacctggtgcaggcctgagggcaaaaaggttgagtggtgaggtaggtaaaaaaaaaggatttaaaatggatgtgccacaccacaacttgaaa

SEQ ID NO: 14688 - DNA, 1501 bp, Oryza sativa
ccgacgccgccccgactgctgccatcgctcgccgtgtgctcgccgccgtcgccgcccgagctcgaaagcgcctctcgtcgccggcctccctcgatgcgattcctcctaatccggcgcaaggggtgggttcccgtagccgcgtagatgctctcgccgccgggaatcggcccatcgtaacctcatcgccgtttccccctcctcccgccgccagttgccgccgccgcaatccgccgccgtcgagcgtcccccggcgaatccgagccattggctcgtctcccctcgtcctgtgcaacatcccggtgtgctcgtcttcgcctgtattgccatggttcgctccgccgctcgccgccgtcgtccgccgtccgttccggccggcgtcatcgtctacctcccgccggcccgcgtggcagccacgtaggcgccacgtcggcgccacctcggccgcgaccgggtcaagcagaccccggtccgctgcttccctccgccccctcgcgcgcgcggtccaccgcgagccgtgaggctgcgcgtgggcccgccgcaccgtgtcctccgcgaaccgcgcgcatgcgccgcgcctccctccccaaaccctagcatgccccgcgtgcacctcgctcacggtgagccgagtcgccgacaagcgggtcccacccgggaccacgcgggatggacccggcccaccggctttctctctcccctccccgcccgcgcgcgcgccttgggccgccttcttgggccggccggcccattaagctcagccgagccgcccctttctctcgggccgtgccctagccgcccgagggaagtctaatttccctccctccttcttttcttttcttttctttttcaaaaaggatttaaataaatccttttcctttagaccaaaaatccaataatcttagaaattcaatatcttcccaaccgtaagtccgtttgactccgttcaacttccaaaatttctcaaatctcgagatctatctaatggcacgcttagaggtcaataatagggctttattttcgccgtttgctgagttgtcccgtttcgcgtgtagtttcggagctcgaagacccgcagtgcgaggatttcgaggatcaaactcaagatctcgagcgaggcaagccacctttgaacatcttgagcctatatttgaacttaattatgttgcttgaaaaatattatgcattgataggatcgcacttaatctgcttgtcctgtctgcaaggcagattggtggacctacctaatttgttgcatttgacccttccattgtaattgttataccatgttcccttgtacccacctagttgcgcctcggtaatcgtgcactctgcacgggtatcgacggtcgccttcaaacttaaaatctgagaaacatcttgggtaaaacttgggttttacaaaagacttggaaaacccgacacctgagtcggtgcttgcgaactaaatgaatttccaaaatcgcggaccggggaacgtatcgggtgtacggtttcccgctct

SEQ ID NO: 14689 - DNA, 1501 bp, Oryza sativa
tttcatcttagctaaaccgtacaataataataagattaaaatagccttcacccgttgcaacacatatgcattttttctataatagattatatatacttattccatcaggtcaagaacatgtgaaatgcacaccactaactcaatgataaataataaagtatgtttctgcatggtatagagccaagccagaaacaaaagtctccttaaattatcagtactgaagctacaaaccagaagtgataggccatatgagaatggtaggttttcactcgacagtgaattactttagtaggaaggagagacacctggaaatcaagcatgtcgacacaaggttcttgcaatccatgagattacaagaagcaacagagatgatgtagagatagttgtacgatcagttgatactatcggtagcacaacttgatggcgtcctgcagctgttatctgaaaacgtagctgacaccacagatatcgatcatggtgtgtgtggttctcccctcttgttctatgcgacattcaaaatctgtacaggagaagaaggtaatgcagtggtagttcgttcttgttgtaatatacaacatttcttcccaatacaacaactaaaagtaactaccaaattatgtggtgcttccaatgtaacattagccagacattaaaaaaatgttcaccgtgtatgttattcatcaacttatcaagaatgttgctcttgtcatttgtggggtgtttgtaagagtgcacattatagtagagcccagatttctatccattatcttaagaaaaatcagaaccaaatgcccccatcgaaaaagttgtaagatcaaagtgtgttttgattcttattttgtgatgaacaattggtatttgtgattataggttttgagatttggagattatcgtcgaagtggttttggagataatcaattttctgaccggccgacgctatgtcggtttcggtttcgggttgtttctttggatatccgtgattgtttcatggttatggcttctagatggatactatacgtatgtaatactgttgtttgctaacaatgagtcaagttggagatagcttgtgtcggtgacatggggccgggggtatcgtgactagaggcttgggtagccgcggtcacccacgtggcctgaccccctcgggggggtcgggcccgagggtgacgtggccacccctccctctgtcttcctgaggggtcgggccgctcctgtttcggccccgagggctggggcgcccccgtttcggccccgagggctgaggcgccccgaccccctgtggttttggcgccacatgtgtgggttaggtgagcacagcggggctcacctaaccgcatttatagcaggttggacgaacgcgccacgccgcatttaatgcggcgcagcgcacgcttatccggtccgtgaccggtcgcggcgtgtgcctggtcacagaccagtcagatcgcgggttaggtggcaacaggcggcctgtcacacgcctcgccccgtcccgtcggaa

SEQ ID NO: 14690 - DNA, 1501 bp, Oryza sativa
catctaaagtttaaagacctaaagtttataaatcaaaaatttatatatccgattcaaatttaaatttgaattcaaatattttttatatatagtatttctatacatctaaagtttatacacctaaagtttatagacccaaagtttataagtcaaaagtttacatacccgattcaaatttgaatttgaattatatccgattcaaatttgaatttgaattcaaatattttttatatatagtatttctatacatctaaagtttatacacctaaaagttttagatccaaagtttataaatcaaaagtttacatatccaattcaaatttgaatttgaattcaaatattagtttatagacccaaagtttacatacctgtttttaatttgaatttgaattcaaatttttttatatagtatttctatacataagttttttcaactttgtgttttttattttttttaaatttatggtgtattaggaagagaagaaggggtggaggaaggaagagagcagtgtatagggggatggggggggctcccattaggcggcccctcgttagggtgcttcaaaaggtccaactatctgtaggcctgccaagttgaccctttttttaggcaattcaaatttaccactagaaaattgcaaaaatgccactagaactgtcattcgagtggcatctttacaatattaaaaaaccggtggtaaatttgcaaatgcccatttttttctgacagaagttatactgggcctaacttgctaaaggcccatttgctaggttaggccgaaaaatgaggcccacatcagatcaaacagacaagaaatggactgatattctcccaaaaattcttcgccatatgttttagcaaaatcgttttgtaaaatagatataaacctgggcgctcgctatagtataaaaagtaatcatacttgctgcatggaacgaatgagtgggttttctttctgttcgcatcaaacaccacctttcttacagggaagaacttgatagaatgatagtgtttgaaaaacacaatcttaacatttatttttgcaagaacaatcttaacataagctcatacctcatattcacgcccatttgatcatcttaagcctttctacattagataaaagtggtgtggaaagactcttgtgcaatattaacaaaaatttaggagtttttttttttgtgaaacacctttaggagtattttattaaaacatcatatcgagaagatgggtggctttcaataattcgttgtgacgttagaagtttgccattggcctcttcaacatcttgagagacacactcggctagtaatgtgcatcttccgtgtaatcggaaaaaaaaataatcacgaccaccactgccactagttttttttttaacgagaaaaggctttcatatgaagcatttctaactaccacaatgcaacatcagttaactaaagaaaaaagaccacacgtcaaagttatagaaaagccaacaattagatgagataatccgttagt

SEQ ID NO: 14691 - DNA, 1501 bp, Oryza sativa
cacccccgcgcgcggacggccggcgggctcctcccccgagtgtggacggccggcgagctcctcccccgtgcgtcgtcgccgtcgccgccgccccgcttctactattggaaggtgagaggagtggaaaagatgaaagagagagaggggggagaggtgaggatgacatgtgggcccacatgtccgtgggtcccactattttatttttgtgtgaatgacatgtcggtcccacaagtttttttattacatgtagataagcgacacgtcgacgacacgcgagacgaagactgggtcaacactgccacgtgggtgccacgtcagctaaaaccgctttcaaaaccacccaaggatatagtttgcatcggttttgatagttggaggagtcaatatacacagttttgtggttggaggccatgaatcatactcggatcatagttgagggagtcaaagacctccgaaataagttcactttgggtccctctttgggttcctctatttgttgcccagtccgattttcatcccttgctcgcaaaatcgggtacaacaggtcccccaacttatgaaaaccaggtaaacgaggtccctcggtggttttggctgaggtggcactagggatgaaaacggagcggatacggacggataatgctcataccatattcgttttcatattttttgccggatacggaaacaaatacggatagctcgaatacggaaacaaatacggactatctcgaatacgaataagaatcgaatatgatcggacacgaatacgaaaacaaatttttctcggaatacgaaaaccaattcaacttctaatagaaacaaatatcaacatatataattagatcattttatataaaatatagtataatttataaatatttttaaaattttaaataatattaataatgtggactagtgttaagagatgaactattattaaaatctaaaaaggtatattgaaggtcatagagttataaagaaatggggtatgtctggtggcttctgcggatatccgaatagcactgttcaccggatatccgaattattatccgtatccgacctgataccatattcgtattcgtatccgagagaaaatatccgtattcgtatccgtatccgaactatccgagaattatccgatccgagaggtatccgtattcgtttttatccggagcggacggaaactatccgctccggttttatccctaggtggcacctacgtggctcattttgactaggtctttgtccaacgtgtcattgacgtggcgcttatgtagcaattagaaccgcaaaaaataatataacccatgggacccacgtgtcagttgcacacacataataataaatggtgggcccatgtggacctctacttctaggggaaggacccctgggcggcgagtccaccgacgccggctaccgcggctcgttccacggcacgtgggagttcgccagcgccggcaagctcggcctcgaccgcccgtgcgtcaactcgttggcgtgc

SEQ ID NO: 14692 - DNA, 371 bp, Oryza sativa
gccgccgccagatctcccttcatgcatctcgatctctccgatctcgatctctctctgtcgcgccgcccgccacgagacgccgcgccacgacgacgacgcgccacgccgccgccttcgacgccgcgcaacgccgccgccgcatgccaacgccacgccgccgccgccgtcgccacgccgccgccgccttcgccgccgtgcgcgcaatgccgccgccgccacgccacgccgccgccgccacgccacaccacgccaccgccgccacgccacgccgccgccgccacggccccacaacgccacgccgccgccgccgtcgccacgccgccgcgccaaccgccgccccgatgccgccacaccgccgttaacgaacgaga

SEQ ID NO: 14693 - DNA, 1501 bp, Oryza sativa
acttagaattaaattttacaatagacttagaactgaatcaaatactaggttaatgacctatccattaaatacttagaactgaattttttagaaactatttggatggatgccgcatctcatgttagttacgtcataactgcttagccccctttttgttttgcttctatagtttagcgtgtcaaagaggcagctctttgctgctttgccacatatttttgagctaaaagatatggtgagaattttgtttaccacacttttgatagatgcctaacttaaggtgtggcaacttgaaacacccaatcaaccatgcccttagtcttcgtgtttccggcatgtcgaaatggtgatgggcctaatccacacgctgaaagtcccaaaggttaagacttaggcccatcagacccaataccggtgtgcttctctcgaaaagcccaaatcgcccagttccgttcccccgatcacgtgacgccacgtgccgcgtcgcgttggcatccgatggccgcgatgccacatctcctcttctcttctcctctctcttcggtttctcttctctctgatttctccacggctttcttctacctctctcgccgtccttactcctctccctgctctgatccagccgcggcggcctcgccgcgcctcgcctcgcctcggcgcgctgccgccggcgagaagggcgcccgcaggcaccccctcctcgtcccccgagcggcggggcatcctcgtcgtcgcgtgcgcggtcggcgaggaggtgggaggcgacgcggcgggccttcgtgttctgcttgcgttatccgtctcgggttcggatcgaatcggaggtatgttcctcgttgttctctcgtactcgtagccctagctgactcggtccctcccgcgcgcgtggattccaggacttgatgagtggataatttggttgatttccatccctccaattaacctatccactttcttctgggtttcgttgatgcgtagtgtagtgctagtagcagcttgtgtttccataaatgtttgggggttctgcttatgccccatatgtgacgctcctgccaagctggattgcgttctgttttattactgtaattgtcaatggccgaatcatttttagggctgtgtgtttagttggcgagtatatgcaatagtggctagtagctattccattttatctgcaataagtaaggtcggaatatgcagtagcaagctatacaatttcctgtgcattgtagcggctagtgagctataccattttatctgcaataagtaatgtcggaatatgcagtagcaagctatacaatttcctgtgcattgtagcggctagttagctataccattttatctgcaataagtaatgtcggaatatgcagtagcacgcgatacaatttcctgtgcattgtgcagtctttctgtattatgtcaactaaagttttttttgtatgtttttattcaagcaatgttgcttggtaccattagcaggtgaacgggtgcctaccaacaatgtcta

SEQ ID NO: 14694 - DNA, 1501 bp, Oryza sativa
atatattttgataatatgttttttttgtgttgaaaatacttctatatttttctataaacttagtcaaacttggaagaaatttcagtaagaaaaaagtcaaacggcttataatatgaaacggagggagtaaatttttttttgcattaattaaaattcatgtattttcctccttttttggtttttgttgtgcgatatattacagtgtagagactctgaagctcatatggttggcattggttgatatgataacgtgtcacgttgtgagatgcagacccccgttatgggggttgattgaatgaagtggatagcactcttataactttcttgctcgaagtttcttgataccaaggcaagtagcttataagaagatttggactttggtggcataaatggatgaactaactggcggcttcaacgtggtgttgattacaggtgcttttattgctaactggagcagtttgtgtagtttctttctttctctttgagaattctctcagtttcttgggcaggctcttgagctaccaagtatgtcagcttcaaatgagaagtggattgatgggctccagttctcatcactgttctggcccccaccacaggattcacaacaaaaacaggtaacattattcctatttgattcttgttagaaattctatatgttgaacatacttgcctcaatgggaaacttggttgcgtctcctctctgaaggcacaaattctggcctatgttgagtactttggccagtttacagctgacagtgagcaattccctgaagatatagctcaggtactgtatctctaagcatgtttagtatcttctgtgataaaatctttctccagtgtgttaacttttgcattctttttcttgcatgcttgcagctaattcaaagttgctatccatcaaaagaaaagcgccttgtagatgaagtattaggtaatttgatccagtgatcaatacatgttccacaaacaattgaagaaagagtttgacatatttttctcatatttccagcaacttttgttcttcatcatcctgagcatggccatgcagttgtgcatccgattctgtcacgcatcatagatgggacactcagttatgatagaaatggtttcccgttcatgtccttcatctctttatttagccatacttctgaggtaaggcccctactctaatggttagttccaatttattggttcatttctctgtgtttgataagattttgcctctgctgtgcatttcaatattatatctaaactgtgctgcttatagcttatcaaactactcttgctcataaagatgcaacttttatgcagaaagagtactcggagcagtgggccttggcctgtggagaaattcttagagttctaactcactacaacaggccaatcttcaaagttgatcaccaacatagtgaagcggaatgtagcagcacatctgatcaggcctcatcatgtgagtctatggagaaaagggctaacggttctccaagaaatgaacctgacc

SEQ ID NO: 14695 - DNA, 1501 bp, Oryza sativa
caggttgagaatcgattctcacctggctcgggttgcaagggaaacgtaacatttgaggcagtgatgtatcagtgtagtactcgacacaaaccctttttttaaccgccactaaaacacaagcaaaaagatgagcccggaatggaccagggaaaaagacaggttatgcgcaggaccttttccttcggctatgaatgcgacctcaaatcgtacacacatagtacaggcgatacaacgggtaggccaaaaaagtttttccacaagacgtcctgttagaaaaaagaggaagatccaatgaacgacgccgctgtagtctgtactctgtacatgatgaacagtggcccaattctcggccaatgcagtgcttgctggaaaaaaactcgaaagatggatttcaatcaagtccaaccaggtatataggccggagaaatcaaaataagaataaatataagatgggctaagattaatatccatatctaaacgagccctttggaaaggaataagttcatttgaggtcccttaattttacaccgaatccgattttcatccttaaaccctaaaaccagatataactggtcccagaactgttaaaaccggtgcaaaggaggcccctaagtggttttgaaggcggttttggttgacgtggcgcctacatggctggtttgactaggtctccgtctcacgtgacattgacgtggtgatgacgtggcaattatatctcgaaaaaataataaaaattatgggcccacatgtcagccacacaaaaaatttaaaaacggtgggtcccacatgttagcaaaaaaaattaaaaatggtgggtccacgtgtcagccaaaaaatatggtgggccccacatggctgcgcctcaagcttctcctcaccttcttccgcgccgacctatctgtccgccccgtcgacgagtggcagctagagatggcaatggggacccatgacccgatgcccgacgggtttttactctattaggagttattcacgttctaactcttatacccatgggtctattgatgggtgaaaactcttacccattaggtacgtgggtatgggtatgttctttacccacccgtggtaaaaaaacctgtagattgagcctaaaactataagtaacataagtcaaaacgactactaaatcataacataaaactcctttcacatcttaatcattgttctagtctagttatatgaaattattatttgatttcttgatcatataatgtagttgtagaatttttttactcgcctttgaacgctaatgttaatagcattgttacaagagaaaatattgagggtttacagttctaatatagctaattgtggtacaaaactataaatgatacaagtcaattatatgggtatgggtacacgttacccgcgtgggtgtgggtatggggatgattttgtacccgtgataggtgtgggtatttatttaaccatcatgggtgtgagtatggggcaaggaaacccaatgggtatgcacttgttgcca

SEQ ID NO: 14696 - DNA, 1501 bp, Oryza sativa
ctgcaggttgcgaatcgacttgggcaatgtcccggagagcatgttgccgctgaggatgagcttgttgaggtagctgaagttgccgaagctcgccggtatctcgccggtgagcttgttcatgctcaggtcaagctgctccaggttcatgagctcgccgaactgcggcgggatggcacccgtgaagctgttgttgtggacgtcgagcagctcgagcaccgtgatgttggcgagctcgccggggagcgcgccggtgaacttgttggagtagaggtccaggaacaccaggttcggcagcttgccgatctccctgggtatctcgccggcgagctggttctcgccgagccggaggcgcaccagcgacgagcagtcggcgacgctcggcgggagcctcccggagagcgcgttcccgaggaggagcagcttgctgagcttctgcagcgcgaacacctcgtcggggatgccgccggcgaggcggttcctggacaggtcgagcgcgtacagctcggtgcagttgccgagcgacggcggtatcgcgccggagagcgcgttgccccagaggaacagcacctgcagcgccctgagctcgccgagctgcggcgggatggcgccggtcaggccgttcttgtcgagctggagcgccgtgaggctgctgcagttgctcagctccgccgggatgcgccccgcgagctggttgtccgacaggtgcagctgctcgagcgcggcgaggcggccgagcgccccgggcacctcgccggcgagccggttgccggagaggtcgagcacgacgagcgccgagcagttggagagctccggcgggatcctcccggacagggcgttgccccagagcagcaggctggtgagcttttgcagccgcccgagctccggaggtatcgggccggtgagcttgttcatgtggaggtacaggttgcgcagctcggcgcagccgccgagcgcggcggggatcgggccggacacgccggtgtcgtacaatgccagcgtctggaggttggcgaggttgccgagctcctccgggatggcgccggacagcgcggtggcggcggcgccgaagacggtgaggttggagagcgcgccaagggaggccgggatggggcccgacagccccgggttgccgccgacgcggaactgctggagcgcggtgagcgcgccgagcgacgctgggatggtgccgttgaggaggttgtcctggacgcagagcacctggagcgcggcgaggctggcgagggagcgcgggatggcgccggtgaggcggttggagttgaggagcaggtactggagccccgacagcgcgccgagcgacgccgggatgtcgccgtagagcgcgttcgacgagaggtccagcacgcggagcgcggcgagcgacgcgtacgccggcgggatggcgccggagatgttgcaggtggagaggttgagcagctggagcgacgacagcgacgcgagctgcggcggcagcgacgacaggttgaggaaggtgttcggcagc

SEQ ID NO: 14697 - DNA, 1501 bp, Oryza sativa
tctctccctcccctctatgtataattcatttttcctatattagttaatgggggaaattcgatataaaaatttcaacatttgtaacatctaaatcatatatataaaaaaataaacatctaccctttaattttttattaaatttagtggacataacacttcaagccattagattagatttattttttctcatccttaaaaaaagacatccatcctcctctccgttttctcttaggaaatcctctatgtttttttcctcccattctctctttatgaaagcttttgcaataataaattttaaataagaatacttctaaatatatattatttgcaacagtaaattttaaataatactaaatttttatcttttaaattatacgttcaatttttgatctatttgtaccattgtattatttatgattaaaatcacaattagaatttaagacacatgttgactatattttaacttgtaaaattatattcatttaagttttgttgagaccctttacatgttattcaaacatatatgaacaattattaaagaaagtgacattatgtactatttcatcatatatcacttcaccggcatgcataactaaaacagatttctgaactttaaaaagttctaaaaattctgaattatgagaaaaacaaaatataggttataccataatttgatgcatcacaaaatatgcataactaaataatatttacttaaaaaaatatttgagtcatatcctagctgtttgtccacctatatatcattccaaccttaagatagaaatgacctattctgcaccgaattctacttgataaggcaatataaattatatggaactaaagataaagctattttttttctgtataacatgataatataacggtaatgttcagcttcagaacaagcaagcaaaagctgcatgtgtattgccctatgtatctatatagtatatatgaaaaatccattaaacttcctaaaaactctcacaccgtcaggtgagactcctaccaatgctcctaagttgccacgtgtcactctaataaattagataaaaccttacaaattttgcgaaaaaacaaaaaaaacccaaccctcgattttcatttaattcagcggatccactatttttaaacaattagattagattcatttaaaatacatctcatataattatatatatatatatatatatatatatagagagagagagagacgcacacacacgtacttttgtactatactactcacggcaaaaaaaggaaaaaaataattaccaatgaaaagaaagaagggttaacgctgccacgatcccacctaattgctacgagagaaatgtatatacgtacggttcacccaaaaaaattgaaaaaaatttctcacatgtacaatacgtactactatccatcgaattgagaaaaaaaaaccccagacatgtacatactacgcaccatccacccgtccctaataaacttatcaataatgttggatattttcttgagaaac

SEQ ID NO: 14698 - DNA, 1501 bp, Oryza sativa
ctgggggcgagcggcggcgtcgggcgcagcgggcgggcggcgacgtcgagcgctgaggccgtcgggcgctgcaggcgggcggcgacgtcgagcgctggttccgtcgggcgttgcgggcggacggcgacgtcgagactcgagcgctggggagagcggcgcgagcggctggagcatcccacgcgaaacgcgacgcgaacgcgatgtttgtggcggcggagcgatggagtgaggagagaatagatcaaagactcgagagacatcatcagtattagggtttgctctaatctgatgggcctactgggcttgtgggctttgtagggtgcctgctgctgctggttacaaaagctcgttacggctcgcgagcgtctcgttatctcagcgtctcgttatctctaatgagctgaaaggctagctcggctcgttagaaaaataaaatgagccgaaccaagtcaagccgagcttgtcacgagtcgagcaagctaacgagtcatgagcttttcgtccacccctagttgcaataggtaaaggctatttcaatcatattattattagttttttaatgtaaaaaatagtatattggatttttattttgatagtattgatatctaatttgaattttttatggggatgatggccatatcctatacattgttttcttatgatttggcaagaattctaaaggaaataggagtccgactctcgtcccaaattaacatgaaagttttttaaaaagatttcttatatgacttcttacgtattttcaaaaggtgaacaaacttaaaaactgactcaaatacgaacaacgtatcaaaatatcagcgaaaacattttcaacttttataatagtagagattaatactccattaatcatatgctagttttgcatatcttttctttttctcctctcaaacgtatgataggatatggtgtaccctgttctttctacttggttacgtcaatttcttttttgatggatggagtacagctcaataatccgtagttcctccaatttcaccagttcgactatccacgccatatcctcttccagtaaaaaaaaaaaaaacaatcttcttccagtaaagctgggcgcaatgcttttttcttaaaaaaaaaagagaaaaaaaaaagaagtggctgatgcaagtatgcaacccaagtcgcgaaaccgcgtgctactcttgctaaacggtttcagcccggattccgtgggcaccaccaccactcgccggcagatgccgtcacccatggcaaaatcgtgtcgacatatatgacctgggcacccccacttgccgacagatgggccccactccactgcggggcccgcaccctcgcatgcccgcctcacgattggccggcgggtataaaaggcggtgaagtgagtggcgtgtgcgctctctctctctctctctcctactgtaggccaccaccaccgcgaccgcacgagtcaacctcacggcagccaagcgtttggttggggggatcggagcggcggcggcggcga

SEQ ID NO: 14699 - DNA, 1501 bp, Oryza sativa
atgcaattagttattattttaatctatgtttaatatctcatataggtgtttaaacgtttgatgtgatagagtaaaaaaatttgaaataggatctagacaggtccataaacatataaaggtttttgcgcaatcagagaagtatattcgctttgatgctcctagattactttgggtacaggtcatggctcacacggttacactagtcaaggtcactttaggaagaagctcccagatgcatctccgattctccgtgctttattcaacggtcgattccggctcaatgcaaacatcttcggaagcttcccttagttttttctttactcgtagaaaaatatgagtagcagtagtaacaaattaaggtcatatactctcctacattgaacattagtgtttcgattttaaccattaatacatttaaaatgattaactaaaattcttgaaagttttatttatgctataatttatattgttaatgcatatcccctcttttttgcataacgttcaaacagtcatgaaaaattgcaaaaagaaacaaaatagattaatatataatatatcactttataaacatgcaaggtaaaaatataaaaaaaattgtatatactgtttacatataaatttgttctttttattacaactcaaatattgtaaatctgaacttatatatttatgaaatgatatatttaatatttatttatcatgttaattttaaatttttaaaattgtttgaataatgcgaaaaagaacggtggatatcacattaagaaatatttttttctcaatctaagtatatagtactataaaacttctacatagaagatgagtgataaatggcctgttcactttgatgccaaaaacttggtaacttgccaaattttggcaagatttcttatatagttattaaaatttggcagcaaattaaatgtagccattctttttagcaactataccaaaacttggtaaggttgaaaatgtcattaaagtgaacatgtcccaaatgttaaaaactggatagtaacgagtgacaagtatatgaaaggcaatgcttcccttttgtaagaacatgcactttatatttttgtgtaaaatttgccgaccccgtgacttttgtgtgttcccatttcgctggctgactccacctcgtgcactcgtgctcgtggcacgtactcctatatcccagcacgaatcttgacgctgatgcctatataaaggaagcgtccgatctgccgaccagctcaccccctgttgttccattcctcctcgtctcccacacgggcaaagagattctccatttctcccggcttcctcttctcctcctcctatacataggcgtcgccgcgtacgccattgccagcctcgtcccaatcccaccacctgcgccacgcgcgcgcgcgtccttcgggcaccctcgcaccgcaccgtccgttggcgcgcggttggtggggcggtggtggtggtggtgccttggctagtttggccggcgcgcgcggggagggaggga

SEQ ID NO: 14700 - DNA, 1501 bp, Oryza sativa
gacggaaggcgcacaggggcggcgacggagctgagacttgagaggcggcaggtagcttgtggagcggcggctggaggacgacgagcgcggcgtagaggcactcggcgatgccgtcccggtgcgcggagggtgtctgggtggtcggcggcggcgacacggatagtggcgaagcgacggagaagaaggtggcggagaagaggagagagagagagaggaaggagagaggatatagagagagagggtagtgaggatgacaggtggggtccacgtgggccccaccattttttttaattattgtgtgtgaaactgtcatgtggatcccatagtttttaatatttttcggatcaaattgccacataagcgtcacgtcaatgccacgtcagatgaagaccgagtcaaattagccacgtaggtgccacctcagccaaaaccggggtcaaattcttccgagggaacttatttaaacggtttcgtaagttgggggacctgttgtacccggttttgcgatcaagggacgaaaatcagactgggtgacaaatagagggacccaaagtgaacttatccgacatgcctaggcgtcattcgggtgtcatttcttaaaataggcgtaactttctcatacggactcggaatcaggcaaatgatatatccacggacatctacagaaaatgttacatccgattctcctcagctctctcccaaggggcgacacaacacgagggacgcagtggcgtgagtcaaaagagagagagagagacaaaaagagattccttcctttccacggtctaaaatccttggcccagttaggcagaccatccagccaacccactgaacagcccatgccatgacggagctgagacttgtcggtgactcgcgacacgaacgttctggctagatcgctggacctgaccaaaccaagaccaagaccaccccgctacgtgtccacccacgattggacccctcacgtggaccgttttcacggtgccttgtgatgtggagctcgtacagggccagaacactccggcgagtcctactccgatctcctcaccataatccagaacctatttaagccccccgcatgtacagcaagcatcgaccgatcacgatcattctccaagcctaaggctgtgttcgctatgggttgttcccaatagcacggaaaacggagcgatccattagcacgtgattaattaaatattagctatttttttcaaaaatggattaatttgatttttttaagcaacttttgtatagaaactttttgcaaaaaaaacaccgtttagcagtttaaaaagcgtgcgcgcggaaaacgagggagataagttgggaaaatggacgtccgaacacagaccgactagatactccattacacagcttcaccaaatcgcacatcgtagagacaagtgttgcatgagcagagcaagaaacatggcgagagataagcaatctgctttaatcgtcgcagcgttcgtactcctctgttcaggtaagcaccatggaa

SEQ ID NO: 14701 - DNA, 1501 bp, Oryza sativa
tttttgtgctttgttcctacttgttatatggagtttattagagtaaaagacttttttttttctgttagtcgtgtagacgctgcagcttcgaaagatccgctcttcgtggaggttgaagccgacgtttgggaaagcgagcaaggcaagtcacatcatccttgaacatattgaatcccagtttataaaattattttgatttaaaattattacattaccgttttacttaaattcccgcgttatcactgttttgtttagctatgcccatttacctttgtatgaccttattattgttgttattgttattattaccttgttcaccctagaataaacaaaaccccaactagtgggtactcaatttatggtaccactagtatgaatttaggtagatgcttcgctggttaattaggcaacattaggtggttttacaactctagactttgggaatattctcatcacctggacattatggaatggttgaattattgtggaattggattcacacctccccctctattcaaaaccctcaaaatggttttaggctgggctcggggtgcatggttttgatagtagcacttcggccatataaggaccggtcttcgggcctctgttgcaaagcactaccgtacttccacatgtctagtgggtaaggcttagtttgtggctcagtctggttataaacaaaagtacacggatggagatggacgaagttgggggtcgatggacatctctagggcaaatgaaggctacacgagctgcggctcggtagtcgagatgtcatggtacagggctggtgtcctgctgctaggggctcagtcctgcctacctgtcccgggggttccggccgtaggtggggttgggtcggtactcttgtttatggctaggatgggttggaaactatgtcacgtcttccatccgtataccgtggtggtatgtggcacgtggttacacgtgagaaagatgtgtcttgtgggtaaagatgtacacctctgatcagagtataacctattcgaatagccgcgccctcggttatgggcaagccgagcaatgtacccaagttagtgttttaattcttaatacctgcttaacaactaaaatgtagaatggttggtctgggttggcttgggacgagctgggacccagggtcgggttgccagttcggtctgaattatcgtaggccttgggttaaggcaggttcgtgtgggttcacggccttgattaataacctcgtatagctctaggatcgtgcttacaaaatagctttgagcaactaagtgtcttttaatgctgttgtcacgcccagaaattcccgaatagaattccaagcagaatgtgcatcaaaatccccgtccaggaccggccggggtacacaaacgacaatgttgacattcagatccacgtcttataaacatcataaaagtcttacataaatgcagcagaagaaaagaaaggcaacaggagctaagccttaactagaactgcagcgggaacaccactccacagg

SEQ ID NO: 14702 - DNA, 1501 bp, Oryza sativa
gcggaacaaaaggggcctatcacacggacggctgctgaagactgcctcctctactcctcgtcggcctggctgcctcctgtagtcggctcctcagttgaagaaacgtcgatcggctggcgcgaagggaccggcgggacctgtcgagggccggcagcagcacgggccgctggcggtgggggagctgggtggcggaaacggaacacggtggaagaaccaacaacacgcttccgcgcagtgcggataaagcgtgggccacggcgggaggaagcaactggggtgtgtccgggggtgtaggaagggctaactgggtgtgggtagggggagtacactggtgagtacggcgcacgcgagctgggggagcgcgggccactgggagtgcgagcagagccgcgggagctgtgggaggacaggtggctagcgtggcagagacggcctgagtcccaagagatagtgtcaactgaggtgacaccctcctcggccagacgggcctccaaagcggcgtagcggcgggcaagggagcggtaagcctcaaggagtaggtcgtgctgagtggcctgagcctccgaaagctcgaccatgcgagtcagcactggctgagactcgctgtacggacaagggtacctggcgtctgagtggccagagggaagacgtggaagctgccggaaggcggagcctccgagacggtggctgtagtcgtgggccaggcgacgaagcgcagtccaggagaggtcctggtacgcgatctggagagtgggcctggccacagtgaagtggtgggggcgaaggccagctccgtgtatacctccacgagggtaaaggtacacagagagcttacagtgagggggaacacggtccacggagtaccccgtgtactcgggacacgagaagccaaggaaacgggagaggtcacgaagctgagcgacgtggtgaccctcaccaaaaccgtgggaactgaagctggcgttcactgccatctacaattttgaaagagggagaaagatcagtaaccattttagaaacaaactattgaaaataaagaaaacaaaagaaaccttagcttttcgcaagtagttttgaacttagtatccttagggtcatcctaagcgtcgggtttcgccctagggccaagcctgtgctctgataccatctcttgtcacgccccgaattagtcccgaccggaactaacccgtgacgctccaaattaacctgttaatcgataccagtcccaggaaacagtgctggtatcacagggagacagaatatcacagcaacagaagcctctttattatagagtagaagtacagtcatgttgggctgcggacagatcccgagctcacaactgcattacaaaaggaaagcggaagccaggacttggaccaaacaatcacaggcgcgacttgggaactaggccgaaaccctaaaactcatcatagccgacttgctcctggaagaacttctcatcagcaggatccgcttcatcttcttcagcaactggggggga

SEQ ID NO: 14703 - DNA, 1501 bp, Oryza sativa
ggcgtctttttcctgggacgtaggcgacgtcgttggcgcaatggctcggccggagatggttcgagtcgacgggaatgacgaagtggggcgatggcggcgctatggacaccgggaacgccgacgagcatatcaccaactgttcgatctatgccaaaatagaaacaaagaaaatggattgattaggtagagaaggaacttcacgttcccatggttggagtgcggtgaagctcaccagagaatatgtgcgatggatgaaactccttcgggtgaaaagagtaagtggaagttcttggagattccgaggtagtttttggtggtttgcatagtggaacactgtgagaaatagatgaggttcacagtggcgagttggctagattaatcactactacagggacccttttagattccgtgcaggcggcaactcgtcgcttctgggaaaatcggctcattttcacgtgcggtccttttaagaggatggcacggaaaaatcgatgtaaaaggcaacgagtaacaatgttttaagtgtactattgagtagtccttcataaggtaacttagttgtgtttgtagcgtactatagtactcgcaatatctattcacaagcagagatcgccatatctattcacaagcagagaacacagagcacactcgtcctctgtgaacactgcacatccgttttaaattttattactgttccactgctgcagttcagctagcaagcacacactgttcgaagatctcaaggagagtcctgtcgtggtcgagatgccctgcgcgtggcattttatattttattactgctccactccactccgcatttccactgcatgggtccatttactgaaactttttaagctcatctccctccatcgaggagcgcctaccgataagtcgtcaactcttcttggcttttttaatagaaaaaaacaaaactatcaatatttcagagctccacgcatataaaaaaaagaaaacatttcacagctccagtttttctccggtttgaggtgtcaaacgtcgaatatttcactaccatagacactaaaattggagacgtcactacaaacgtacgcactctttgctcgtccggcgtatataaggcgcaccccctcagttctactataaacgtacgcactcttgctcgtcgttgcaccgcaccagagagcacttacatgcatataataggtcaggaggaactggcaatatgcaattaatctctttggaggattcatctgtactaatataaaaaggaggagttcacccctagcaatcctacaagtgaaatcaaccactcttatcccatccgtccatccaccctctcatccaatctgagccgtccgctgtacaccgtagatctatatccaccagcgatttggcccgatctcatcccaccagcgatttcgcccccacggcccgacgcggtaactgcgacgcgcaaatccccggtgcgatgactcctccgcctggtcgctccgcgcctctctccccgcccgcatcctcg

SEQ ID NO: 14704 - DNA, 1501 bp, Oryza sativa
tttgccattttagcactaaagagagagagaaagagagagggtgtggtcccggagcactttttggcaaaatttgctaccatggactagctgttggcaacttttttgataaagttgacaagcacagtcacagcacctaacgctttgcggtaatcttagagtcgccaaccacctcaatctagcaaaagttaaactaagatggattttgataaactaaaccggctagcggagccgatctagatagaacgatagataactacccgtctcgtgggaaaaacagaaggttttcaggacaaacctacaaagaggtgtcgcactcacagcggcggcggaccggcgcaaatcgacaaagatggacaaactaaactagaactagaagcaaaagtaaaagaacgattcgattgattgatagttgattgatctcttacaattgaaccggccttgtcccttatataggggttggtcttgccctttacatgccctcctccacgttcaactcgggctagaaacagatggaaacacgaaacatgacttcccaagcaaggaaacccgagactcgatgaaaacagtctgactcggactctaccggtcagaccggcccactagcggcggtctgaccagccgacatacggcggtcagaccggccctctcagaggaaaaccggcagatcgtccaaactttggcaatttccctattttaatcctaggtgccaaatttgggtgtaaacactagcaaatgccaaatgccaaattgccaacttttgctactagtgtttatatctaaaatggcaaaaagtgctccaaaacggcatagcttttgccattttggaggatctaaacaggcccttaaaaataggaccaccactaaatatgaaaaaaaaaactaactctttaaaattgtcagggttatggataacacatacctaatagtagttgactaaatttcggcaggatccaccacataccatgtcttatacggaaactgacctcgagggagttccggataaggaaagacaaccagagttatacatggaaacgacaaggactactcggattgtatccatattggtttccttagttctacttggacaaggggatacctatgggtataaatacaagcccccctaggaggagagggtgaggagaccatggaagacacccatgacaatcaacacacgcccaccagaagccacaacacacaagcctacatacgccaagacacgctgccggatatcgacttcagggataggcatggctattcccctacggtgtctccggataccgtcaggagatacgaaagcgctatctctgatcttgccggacacggatttgaggaggaaggctaccctgttgtcgactacgagtcagaccttcagaccgccatgtcgacaacagttagatagactacctcacatattgtactggtgtgattatggtgaataaaaagcaactccggctccggccaacaggatgtagggttattacctgataattcatgggcccga

SEQ ID NO: 14705 - DNA, 1501 bp, Oryza sativa
atttcaacgagttcaacaatagaagctgaactcacagcattagacactgtcacggttgaggtcgagtggcttcgtgagctcctaatggatttgccgatggttgaaaaaccagtaccagctatcctgatgatctgtgataatcaaacattgaatattaagatgaacaattcaaatgacaacatgaagtcatccaggcatgtaaagagaagactgaaatctgtcagaaagcagaaaaactccggagtgatagcattggactatgtccagactgctaaaaatctagcagatcaatttactaaaggactatcacgtaatgtgatagataatgcatcgagggagggcttgagacccacttgaattacaaaacagtggtaacttgtcctatgtgatcggagatcgtgtgaatcaggacggcgaaacaaactattgaatgactaggaggagagtctctaaaataggtccatctctttgatgtacttcactcattttctataaggcaggatggtttataacttaatgtgatatgtatggctttcttaagcagagatgttgtcctacagaacatcttataaggaacacgcctatatgagtttgattactagtaacactctatgagatttgggtgatctctaaatactcataaaaaggtatggagtatgaagtataccctccaaacagaggggatgcaaacgacagcctagtttgagctaaggaattgagtacaaactaattgcacaagactgacaattcaaggtttagtccatttttcagttgtagccaagagttgcctcttttcaaggtggaagttcaacttaacaatctcaagcgaaacactgatataacaaacagattcagaacagagaacattttttttgtgctcttaaatttggtggagattgttggaataaatgggctagcccaatttattcctaataaattccattggcccataattaacgttaagagattaatacaatcatggatattgatgtggagagatcacaacctaaataggtagctattagagagcacatgttggccggttgaggtggtggtgggactgccacacgggggctggggcccggggctggggggttgtgggcctgggctggggcagcgaggtgaggctaggcgaggcacttgctctctctctctcgttttgcaacggatgggaaatgaatgggtttgagtcaaagcaattcaacgccattgaatcaacatcattaccattgtaacattcgagagaatcaatcccgatttgattatcagattgattctgttgattactccggtaacggacgaagatattccactccctctcgcgcactacataagaccaccaccgggacaaacagataggcatgtgtgctctctctattcatcctcactctcgcacatctcattctacttgggaaactctttgtttttctattcctactattctgcaacgtcgtctcctttgcaacggctgtttactacgtctacttcctctacatcacga

SEQ ID NO: 14706 - DNA, 1501 bp, Oryza sativa
ggcggcggtagaggtggtgctcacccgagtgcgagggaacgagggctccggcgacgaacctcgacggaggagaggtggacggggtggatctcggccacgcgaacccgacggcggcgatggcgcggcctggcggcgaccctaacggcggctagcggcggctggagtagcggaaacggcggctgcggatgggcgcacggcgcgagagcgatgggaggctcgagagagtacggcggaatggggaaaaagtgagaggggacgacggcgatgcttaaatagggggagagaggaccggacgtggccgggagaggcgggaatcgccggccgacgtgggggagtgggggaagagagagaggcgggattcgaaaatcgaatcccggccatctcgggcgcgggcgcgagcgggagagagaggagagtgggcgcgggagacgcggcgcacgcgcgggcgtggccgacgtggcccggaggaggcggagacgtggacgcggcggcggtttcgggtgcggcggttgcgggcgcggcgtcggccggaggaaggggaaagacccgacaggtgggccccacctgtcggcgaccccgggagaggtgggaggcgggcggcctggctgggcctcggcctgcggccggcccagcaagggggagggggaaggaaaggggagaatgggccggcggcccattcgaaaaaaggaggaaaaagggagggaaaagaaaaagaaaaaggaaaaaggattttccctggaattacaatattgcttgcccaattttaactggttaaaattatttctagagctctgaaaattccactaaaaatcctgttaatgaattttgacatgtagaacttaagaaaaattccacatgtcaaatccgattattatttgcattactttcttagggttttctcctgatttgcacctgcattttcttggggtcatttataaattacaattttggcttgggaggaaaacttcggggtgtgacaaacctaccccccttaaacggaatctcagccccgagattcggaggagctggtgaagaggtgcggatgggcggctttcaactcatcttccctttcccaggttgcttcctcttctgaatgatgactccactgaactcggcaaaacctggtgaccttatttctagttcttctttcgctggtatcaagtatacgaaccggcttctccacatatgttaggtcctcctggatatcaatgtgcttcgaatcagcctgttcttcaggtacccttaagcacttctttaattgggacacatggaacacgtcatggatgccgatcatattggatggaagttctaactgataagcaacttctccccttcgttccaagattttgtatggtcccacgaagcgtggtgccaacttgcctttcgtctgaaaccggtgtactccccggagcggagtgacacgaagatacacgtaatctcctgcctcaaaagtgagctcccttcgacggttatccgcgtagctcttctgtcgagactgagc

SEQ ID NO: 14707 - DNA, 1501 bp, Oryza sativa
aagaattttgggtaattgagatattatagaggtttagcaatttgagtcaagtgtcttgggatgtgtaatacatttggttgcctgtttatgtggtatgatgagcacgtttcaggctatagttggcatgctaaagactcaacaatgtctcccttgcccaatgttcggcattcgcagactttataccgaatggtgttaatttgtgatcatatgtaaatattaagaattcagtggctttttatccatgcatggattccactaatccaaaatcatgtgatggtcacaaatggcaccggacgatgtaaattcgacaatgctcgatatatctttagtcggataagctgtttatatggatatatgtctatatggatatatggtacccataatctccataatatgcaactttaattataatgttttgtaataattgattttcttctctgttttttttttcgttctgtgtagatgcttggcaaatcaagcataacccgccacaattttacacatgcggtgggatttttttttccgtctatctgacctttatggttcagtggctggtaatagcggctcaattttggagcaatatttttgtttttgacaaacatcgcaggagactatactttagatttatttttagcagcctctgcccttcagatagttctgctctttgaactatcgtatatgtagcaaagttcacatatttaccatctcataaatcatattcacaaagctactaaatcagattcacaagtctttggacaacccttcatacagaatgacacatttataattgatgcaagttccagtatattgaatatacaacttattttttcttgcacttatcggaggtttatacactaagtgactttttgaggtacatatttgtatatattgctttcacactgaacaataatcttctgatattaatattttggttccaaatggagcaagcgcatatgccatttacagagcattagatagagcatgcaactgcacatgtgtggcgacgaattttccaaatatgacagcaaaggcaggaaagccgtacagaagtgtatgaatttgcataagcaaagcagccggagtgctgaaccaagcgagtttgatgccctttgtgccgcaagtttgcagtttgatgcaccttttgattagtgcatttcctatgttttatactttatttatatgttgcatgcacatatcataagttgaaattgcacaaagttagtgcaagtttcacgtaattatagtgcaaatctgaatattttttcggttcggattatattatatgcaagacaacgacaacattaacttctgtaacagtttcatcgaatttgcccagtaagaacattaacccacggcccaacaaagattcacatctttgattctagatcggatgacacagatcgactgatggattgcaatttttttagcgactgacaattattctgtcccttaatatatgtatactccttgtgaaaaacaaaaccaatcaacatacatcgaa

SEQ ID NO: 14708 - DNA, 1501 bp, Oryza sativa
aacaatgcttttttttaaaaaaaattccatagaaaaattgttttaaaaatcatatcaatccatttttatgtttttttgctaatacgcaattaatcctatgctaataaggtatcttgttttccgtgtgaaaggaattactccatccattctaaaatataggacacaactactttttaaaggtgtttcataatataatgtgtgcatgcatgcatggtaattaattagcatatcttctcttctaaattattattttttaaatcatacactcacatgatgtttaattctattgggtgcatgtattgtattaattggattgattcaaacaaagagatgataataattgtttcttggttattagattataggtggttatgccttatattttggaatggagggagtagttcccaatacaaggaaacgaacacagcctaagtggagtaggcaagcaagttttttttttatgtccgcttatcatcattcctgttaacttttttttataattttgtagtaatatttactaatcagatttattatccacttacatgagtattcatacggccaaaaaagagcaactgaaaactaagtccttgtttagttcccaaataattttgcccaaaaaggttacatcgaatctttggacacatgtatggagtattaaatatagataaaaaaaactaattgcacagtttgcatggaaatcgcgagacgaatattttgagcctaattagtttatgattagtcataagtactacagtaacccacatgcgctaataatagattaattatgctcaaaagattcatctcgcggttcacaggcgagttatgaaattagttttttcgttcgtgtccgaaaacctcttccgatatctggttaaacatccgatgtaacacctaaaaattttcatttcgtgaactaaacaggcccttagtgcgatgcgcttatctgagacagagggaatattacaattttacgtactccctccgtcccataatatagcaacctagtaccagacgagacacttcatactacaataaatccggacatacttcctgtccagattcattgtaatataaaatgttccatccagttctaggttactataatatgagacacagagggagtacttgcttacagtaacatatcaagagccatactactccacagtttacactcgctgtcatgcgatgaagggggttccacctaagcctgccaatgggtctaaatccaatccaaaaccaatccaacccaacacctgccgaggcagcccaccaaaccaatccacaccattttcccatttataagatccaacccaaaccaacccccaagcacttccaggccaaactaacccaaaccattccagcctaatgggttcaacccattttatatccatgggttcagtccacgtacagtccaatcttcatcaatcgtcaccactcaccatcgggaggaaaggtccaggacgccgccgcgttcgtaaagatcgagcagctcgttcccctt

SEQ ID NO: 14709 - DNA, 1501 bp, Oryza sativa
ggtagggatgtaacatgttgtgacatgcaaactggaactgagaaatgtactctctccattttaaaatgtttgacaccattgactttttagcacatgtttgaccgttcgtcttattcaaaaaattttgtgaaatatgtaaaactatatgtgtacacaaaagtatatttaacaatgaatcaaatgatatgaaaagaataaataattacttaaattttttaaataagatgaatggtcaaacatgtactaaaaagtcaacggtgtcaaacattttgaaacggagggagtattttaccataacaacgatacttgtagtttcaacccatgtatcccagctgtagatgtctcgtgctagctgctagatgtgctatgtgtaggacagtaggagtacaactctgaacatgctatgctaattcgatctaggcctgcctagttcttaattttttcttcaaacttataacttttccatcacattaaaacttttctacacacaaattttcaacttttctgtcacatcgttctaatttcaatcaaactttcaattttagcgtgaactaaacacaccactagtaagtcggatctggtcttgccaccccaccagtttccaccagggtttgtatttcggacgacaaccgatcaaaaaccacgaaagtagatacccagtgaaatttcaagtggtttttgataattcaattttgaaacagtaaattttagctaaattttcgatcaatactgggtgttagagatctcacctggttaccacaaagtatcataaagcacacaagattacaggcagtttttgcaatggtataaacaagagtacaagacaagattacaagcaggcagtttttgcaaggttttttgcaatggtataaacgagacaagattacaagcagtttttgcaaagatttaaacaaggggatcatgatccccaatcttcaaagtcatgtaactttatcattgacatgtggatccgatgaaccattgactcatatgtcaataactttaaatatagaggatcttaatccattggatccacatgtcataacaaaagcatagtaactttaaatgtagaggatctaaattcatcggatccacatgcaaaagcatagtaactttaaacgtagaggatctaaattcatcggatccacatgcagtaacaaaagcgatctaaatccatcggatccacatgtcagtaacaaaagcacagtgactttaaacgtacaggatcttaatccggaacaaagtggcacagctattttgtctgctctgatccggagcttctgacctgtgctcaccaccagagttttaaaatggaaagcttgcatcaggccacgtggcgttgacaaagaaccaatcccaatgtggccacgagccccggccacgccgccgccgccgccatggccatcaaaacctagtgccgcctcgcgcagcgcgctgcgtcgtttggatctcgacgacggccggcgccaaggcacggagggagaagaaaaccacgcgcctc

SEQ ID NO: 14710 - DNA, 1501 bp, Oryza sativa
taaatacttagtacttaataatgtttatcaacaatagtttgccagctggctaacatatgcatgtgaaagaaagtctttttgtctgtttgatcctgtgcttgcactaattacgtgccaaacacacatgatcatgttcagaagcacatgataaatttctgcttataattaaaatgccatataaggtcaattaaagttttatgcgaataacattgttggcaggtatattagcccattaagcactagtgctagtgctactgccaactgcagaagcaaagctacatgtatttaaatcagcaataaataactcatgtcgctgtaagaaaaagcaccggcagcagcaatattgcatggacattgcttagaagctgcatccatcgttcaaatcaagaaataaaatcattgtgatgcgtatagattacattaaacttgtttataccagtaatattgcagagtgtccaatggacacgagagttaacaaaggttgaatgaattagagaactaattgtgcttcctgtaacatgtctgcgggataacagcatgatcacatattctttggaagactggaacaatgtagtaatagtgtaatactaggtaactgcagagtgctcaacgcaaatataattaagcaatgtttttggattcttgagcattcaaaaggtatcctgctttactgtagtgccagacaatctgacgcgagatgttcctatggatcgatgggaacaatagctagcaaatttgtatgtatattcgtgaaagagaatactagcaccacctaacaaaactactccttcagtttggagtaccaaatatcaagcctgcacagctaaacagctccttagtccttccgaaaaccacgagctccttcagtaaaagttaatttttccacaatgtttcaaaagttcaatttcccgaccacattgttaaaacgcaagtaaaaacgataattaatcacatctgcccactcgaaaactaattaagcacacaacaacaacaacaacaacaacaacaacaacaacaacaacaacaacaacacatgctacttttcacgcatcatcaaaacgatcatccctcataggccagaaatttctcaataaatccccaaattagttaacgtaacatgtaaaaaaaacaaaaaaaaactcaaggatcagtgatcgacatatttcgacaaaaaaattccgaatatatatactgcaatagtacaaaaatatcaccctaagtcttcaaattttccatcggcagaggcacaggatcaatgattctgacaccaaatgaagcagaagtccgaatcgaaatttcagtaaatttccatctacactgctcaaaatgatccgagcagtgaaggcaccctcaacgatttcgctagaaaagcattcgaaatccaaaataacccagcacgacaaccaaagggaagctcgatatcttaaggcgcgcgaagctttgaggcggattgggggtgaaaaactgacctgcggctgcggggcagcgcctgctggagcgc

SEQ ID NO: 14711 - DNA, 1501 bp, Oryza sativa
caaattcaaaatacataatcattaattttgacgctaaaatacaaatttgcaatgaattttgaaaaatacaagggccactttagaagattctatgcggtagagggttagaaatggtgttatcctaaatttaaggttttacgtgcgcaccaaaaatctcaatacagggagctgtgctcatatgttccagaaagctcaggcccattatgcaaaaatcacatgattcctttccctttttccattttcattacttttgtatctttcttcttcctttccttctttcctcgttccatggccgacgctcacaacggcatggccagtacatggcgatgcgaccacttatctataaggcagttcggtgacccgacatgctggcatggtccatcactctgtactctgtagcacggcggcgctgcttgatcgtgacatgggcgactctaaggatataagtggttaacccacgaatccacttacatgtcaaaataagtggtagccacttacaccgtaaggcggccatggcacaatcaacgcgcagttagggtttgcacacaacgatgcaccgtcgagggcgcgcggctgtcgagtaggcgtggtcgttgggcctgctctagcatggcatcctgctgggtacgaccgttgggtggcgtggctggtcaagcgcacacctgctcagtgtggtcggctctgcggcacgtggtcgactggtgcggcggccagtggctgacctgcacgatgcatgcatcaggcatgcagtggccgattgcaggccggacaagcatccattatattttgttgacgaagctgatctgacggcggctggccagctactactccggccgcctacctccgccgtgcgtggcctcctgtgcttcacgaatcacgatgcagcctgctggtgcctggtggtgccctggaggaacgggtacctggcatctctacgtggcatctcccgacgccccgcattcgcaacataagccgccgtaccgcgtacgcgtatgtatacctcgcgtctttacagtctacaactacaggctgcaaagctatatacagtacacgttcttgccctcattgccacatagtacaatgtacacaaaaccccagatcgaatctcacccttccttcttactccacctactattgctaattaattctcaacatgtatatggatatatacattgatctgatcaactagactagagtcactattaattaataatcatcgattaattaagtcctgttaattcccgattctgccctccgccataccaagttaccaacccacggcttcatgcagcaaccacaggtgcaatcctgtacttccattcgactccctttatatatatcatcagtagctccatacttgagcatccttgatgcttccctttcctccagcagcgccattgctactgaatctgaaacaccaccactccatctccattgctgcaaactacaagccgccactaattaattagcaaaatggagaagccgggtgatgatgagaagc

SEQ ID NO: 14712 - DNA, 1501 bp, Oryza sativa
aattgtgatcgtttatcataagtgaagactaaaaattgaccacactgaatggagttatctgtaacgaattatttccaccaatgcaaaaaaaaaagtaatccctcgaaattccaaagtgtcagctccacaatccatgtattactaatttgattagccagggaaaccattctagtaggttgactctaaagtaactggttgaatgatgatggaattttctacattgtgccaaagtataaaacttatctaaaaccaataaagtagtcctggcatcatagcctcaatgatgcaaaatatagatcttatatgatacatgactaaaaacactagatatgtagaaaccaacaaaggtgaaaaaccttcctctgattaatgaaattcatccctttcatgattaataaaactaatagtcaaacccttcgaaggtgggccatgttgtttaagaaatgctattagaacatacctaatcactaaacaaggtaaaatcaagatgtttttgttgatcatgaaattcagacgatgcggtgcaaatcatgagctacatatcaaaacgaagaacctcaattccttactcttgagaacaatcgtagtgtataaggctaccaacaaatctaagcgaggcactcacactcaagaatatgcataaaccacaacataatctcacacatctatttttgaaatgtatatcccacttttttgtgtaattaattaatacaccacattttttaggttgggtagaaattattcaatatcaagagatattggatcaagttggtatatttattccaacatatacaaaaacaaaagagaatcgatttcattagaattgttcaacaatccataacaagatttcagtatggaatcaaacatccatgttggggctgaaacgcatcaccaaaataaatcctactaagttgtgaattgagcacaatcaacaattatggaattcacacaaacaaacaaatggatatgtctatgctacaaggaaatagtcactttagtgcttaaacacatatcaaaaattaaatactactgaatagtgaaccaaacacaattgacatctccaagattcacaaaaaggaacaaattaaaaatatagctacccttcaaccaaaacaagcactttaagcaagtaataaaaatgtatactcctacatcattaatcaaacaaacataattagcatatgcaagattttttttttaaaaaacaaatgcatataactgtcagggttatggataccacatacctaatagtagttgactaaatctcggcaggacccaccacataccatgtcttatacggaaacaaccttcagatataggaggagttccgcataaggaaggatgaccagagttctacatagaaacgataaggactactcggattgtatccatattggtttccctagttctacttggacaaggggacacctatgggtataaatacaaggcccctaggaggagagggaagaatcaacatacacaaaacaacagaaaccacaac

SEQ ID NO: 14713 - DNA, 1501 bp, Oryza sativa
atgttccatatgccatctactatggaagtccaagaatgttagaatgattgacaggagctagaaccaacttggaagttaagcctgacgaatggctgatcaaatctgtggacttatgtggattgaagagaggagttggtggtggctgaactttgctagtcaaaaaacgaaaaaacaaaaaagatagtatcgctcattacatttgaatttggtatatttaatcatatttaaaacattgacaatagttgctacctcattgtcaaagttcgcggtacacagttgcctgtgggaaaatgtgaaactatgaaaactgcaatgacataataataatagtcatgtactcaagctgtcttcagattcaggtatttggtatgcattgatgttcctgtaatatgaagaaatgcgttatccatgtgattccatatttccatctacaattacggtcaagtagaagtggccatgaacttcgcaatgattgaagggctcagcatttcacttggcaattagtttatggtcaaacatgtttacttaggagacagatggtccatggccagcctcttccatgtggacaggcatttttatgtagtactggatgcatcatggtatttccacttggtatgattaaccagggcatcccattagtaagaattattcttaacatagtattcaacattgtttcagttttgcaaatatagacctacaattcgaatgtttcagacaaaaatgtaggttcattactgaattggataattttcttctgaaataagcattgaactgaatatatatactgtccaaaatcaaaattaagagaggaaggaaggaatgaattctgaatttctgatgttattgttaggcttgcccgggtctaaaaacttgattctgaaaccgtggacagtgctatctgtgtacgatatgtttgcggccgatcagccgtactctgcacgatgagctgctacccgatctgaatctgaagcatacaacattattgagattcttttatatcctgagtgtactcttgaaagaaaaacgaatgtctgatctgatcacatgaccgaacgtgttgtatttagttgttcgtatactgccggcctgacggcaagagatgctattagtcaaatagaagcatctttcacatggtcggcactcacgcatatatccctagaaagaattatggatcatatgcttaatgtgaagcacttttatggactagattatctgagaatctcaaggaaaaggagttttttcagtcaaagagaaacagcactactatttgaggtctgcaaaacaaaagtgaggtctcagggtggcatgttccagacccacttgatgcatgactcctttcttcttaacaaaatattccacagaagctaaaatttacagggaaatgtgtggcatgttctctgcatgttcccaagtagtggaagcagcgcgcctgcacattgcatctgcatgttactgctactgcaatcaagctagtctgtatctgtaacacaagttaaaagaa

SEQ ID NO: 14714 - DNA, 1501 bp, Oryza sativa
gtgggttgggaagtggtttatgctaacgtggcaggttgaataaatatggttgtctcactaagttagcaagtgagacctacgtgggcggcggtggacatcacagcgatggaatccaaatattcatcacgcacctccatgccttgttcgagcgactcggaccaagttatcccgacaactagtcacatgcgcactacacaacacatcaatgtggctgcgtggcagagacacattcaactctgacttcgacaacatgagctcctcctccccttgcccacactacccttactccgttgtgtcggtgtcgtggccccgtgcaccgctcctcagtagccttgtggtcaagctgctgccacaaccgcaaaacatcgccgcattggctagaggaggaccacaacgtcacccacgggctgaagcatcagcgcgatccctcgcccgccgctcacggtaaccctggcctccagggttcacgtggccaggagttgcgccagacgtcgtcgctgccacacacgacaccaaggtgcatgtggtgacagaacatccccttattgccctcgccttcatcctccccacccctctcccttgcctctcctctcctcctcgtcaaccacgaattgttgttgccttgctctaccactgctcgtagtcgtctggccctctctctgtctctcgtcggtaagatagatggagaagaaaaacgggaagagagtaaggggagggaagtagagagaatgacatgttgaccctactaatttttttcccaagagatttgcatgtgagtctccaacatgtgggtccccctgctgactcaacgagttaaccatggtcaacctttcacgtcagcaaaaaccaaccatagaatgattcgttttgcaccgagcttcaaagatggacgttataaccaaattttacggttgagggcttgaaagagaggagggaggcaatatagacttatttactactacttagtatgtatgtttgtctctgaaagctgtctctcagatttatgcaggccttacggccagtttagagaaggccatgctcagcaatccaaagcatgctggcaggcaggcatgcccacatattaaagcctaagatgattcacgttgggccggattggactttcactgggttaggccatttatggaattctcaccacatacttcgccacacagtacttctctagaaggaaagaagtctattccatatcccccaactgtgatccgagttttattaacattccttaacctcgtgggtggttttctatggtgatttcgtgctatatggtgcttacatggctctttgactcagtttttcataatatacatattttaaaaaagatagaaatagacgtgacacacatgtaagccagagaaaaaaaaactgaaaaaacagtgagacctatatatcatcttccctctcctcttttctcttcctctccatggaacccatgtgtcatgctcgccaaggtaatttgttagggtcatctaagagcatcttcaac

SEQ ID NO: 14715 - DNA, 1501 bp, Oryza sativa
acatcacaaatttcatgtgaatcattctcagagaagaactattagtttttatagaatgattagaaaaatataagataaaattttctgtaatgcgatacataatttgaaatgaactcaaagaacagaatcaaagacaagaacaagatggcataccagacagatttgagtttctctaggttgttgcacatataaaataaaaccttatgcatcaagatgcatattaaagctttgatcatctacaatcatctgcacgaactaaggctaaaatgagcactctattctacaggataacaacctgaaaatatggactaaacaagacacatctaataattttaacatggtgattattaatcgttccttttccttaataatttcaacatggtaagtatgtaaggttctaaaagtaattcaaaattggtactccaaaagattgatactttcaagttgctgcaagatagccaaaaatctcacagacaactctagtgttgtagtcattccaatcagcagaatctatgggcattttaacacccttcaaagacacattttgagccatgcctgtcatccactcactcacaccaatcctttttcaataccaacatacatcataggttgaaaattgagatgattgattctgaacagagtctacaagttgacatttatatgtacagaaaagaacaacatccacacagccatagtgaaccatacagaaaagaacaacataactaatagcagtgatacaaagggactagtttctcgagagcaaatgtgaaacatacaggcagttggaacggaaggtgtcatgaaaacatttctgatgtgatgtgcatctcatgtaaactataactacagatcgataatacaagtatccaatctaagttagtactaaattttgctgaccaaatctttcaagaaatctaagggtgtgtttggttgctcgtatccctctagcctggctcatctccctcatccaggctaagctgagcctggtttaggggatacacatgcaggcatttggttgcttggatgagatgaacctggatatgatgagatgttgtttggttggttgcagcaaggggcggatggaatggtagcatgcaggagatgttgtttggttggatagatacatattgtgtgtaaaatacctattcttgtgggtggtgaggttacccccataaagtttgtgaaacaagattttttccaagtccctaatctatttatgtgtgataagtttaatccgtcgtagaggttatagattaaattatgttactctgggtgtgtgcacacctactaatattcctaagctcatttttgtcttagagaatcgatgtactgtgcatgtatgttttactgatgtcattttttaaaaccaatgagcagcactgatgataattttttttttaacaaatgtaacgaaatggcctggatgaacacgcaagagtgattattctagcaaaaatcaactacataattttattgacgacactggtacatttgacaattc

SEQ ID NO: 14716 - DNA, 1501 bp, Oryza sativa
gcaaggatgcccaggaacaagagaccatatgcctgagagttatccccctccatgtgacctgtgaatataaaatatgacaggaagagaagcgaacatcctaggaggaggaggaatagtgccagggcaattgacttccacgggattttcctgagggattttggggtgtaagtgaaccgaaggtcaacatcatcagtaagattgctgtcatccctgtcctctgtaggaaggggagcatacccccgaacattgcgtctagacgccatagtgcagtgtctgcatttgaaacacatactgtaaaatacatgtagaaaatgacatggtaatacacagtaagatctaagagttcaattgacaaagaaaagttgaaatccacagttgctgctaatgataataaaaaattacaagctttgaaaaaataaggtgcaccaaacagtaacagagatgatatgacaaacaaaactaaggttgtggttgccgtcgcatgtgccatgccaagggccttaatggactgcatgtgacatgggcatcacaaatttcatgtgaatcattctcagaaaagaactaatagtttttatagaatgattagcaaaatataagaaaaaattttctgtaatgcgacatgtaatttgaagccaactcaaagaacagaatcaaagacaagaacaggatggcataccagacagattttttctctaggttgttgcatatatcaaataaaaccttatgcaacaagatgcgtattaaaagctttgatcatctacaatcatctgcacgaactaaggctaaaatgagcaatctattctacaggataacaatcagaaaatatgggctaaacaagacacatctaccctgacctccgaacacaagtactaacaaaatatggagtacattagtaccttgatgtgcaaattagttagaatctgaaatagtactaacaaaacatgaatacctcagatttttatatctgaaaaaacacctcaaaatatactagtctttagaacctttccaaaactgtatcttagttctgtatactcctacattatagccaagaaaatcataccagcagcctactgttagtaagaatcaccaatctgagcctttatatgtctcctagctctgaaccagatctatagaagagggaaaacgaattacaggcaagtcagcaaaactggtccgagtggtaaacaaatcacagaaagaaatcagaagagacaggggtggcaacaccaacgcttgtctcaggaaaggattgaaggaacgaggaggtctgggggaaatagaagaggaacaggcgaggacgagagcacgtctggagactggagtgacgtgtcctctcccttgatcctgatttccttcggtagccatactgttggcccgattggacctttattatcatgcatatagaggtaccatctatgggcttggagcccctaactaatgggggtccagatcggtcgtccttactgacctgcctcagggccagccctgtgaacttcacaag

SEQ ID NO: 14717 - DNA, 1501 bp, Oryza sativa
ttgcaataccaatacttcaaaagctaacaacatgtctaatttttccaataaataagtacattactcaaatactacacattattgataaaaaaaaactctactcctacaaattacctacccttcaccacacatcaacccctttcaaaccctctcaatcaccacaaatccatcccacatcctaggccatcaccacacatccatctcccatcaaaccctagtgcatcaccaaacatccatcccaaatatattttgtcaaatgtatcaataacaaccaaatggataaagatatgccacctccacacttcatccccacccatattatccatctaataatccatccttagccaactattatcaaaccacgtctacaaccaaaacaatgcaaaatatccaataaaactttggggaacttagggtttatagaggggtttatcttctcttccgatcccaaactcaatgccgcacaaatcaccttcgattagagaggtttttgggggagattgggcgaggagaacgcggtggcgaccgaaccctaggcgggcggctggggaaaaaacggaggaataactggctggggcggcctcggccgggctctaagtagccaaggtcagcgccaacttacttggcgctgaggttgggcacctcagcgccgaagcggttggcgctgagttagctgccacgtcagctaggggatcggcccggccaccacggtggcacaatgtcagcgccagtcccgttggcgctgacacggccaacctcagcgccaatgcgcttggcgctgagccgacggcctagttttggttgaagtttttggcaggggttagtttcgaattaagtttttgaaaagggtcaatttgtcaaaaaaacggcgcaatctgtgtaattagttattttttcgtctatatttaatactccgtatatgtgtctaaatatttgatgtgataggatgtaaaattttaccaaggaatctaaacacggcctaagttagtcatatccatgggtggtttgcatgggagaagtcagtgccttttaaattagacacagtgagaccaagcagtagtacgtacaggttggagctagctatacagacatacaacagtctttcttgctagctttaaggtgtggccgtgtcattgtcactgattcatgtgatgctgttgacagaaagagaaagcatcctacatacagacagatcgatcgatcgatcgataaccagatcaactgacttgctagaaagtgaaagtaaatcatctcatcgatcgatcagaaagtggcttacatcagagatagcaagtgaaaaggagctcactcactcccaaagtccccagtctcctagctatatatatctctacactcaagcacactgtcggaagctcaggtagcacagagagagacgaccgatcgatcgatcagctagctgcagcttccagaaagagtagttagctcgatcgatcgatccgggaaggatcagagttaattagtgagtgaggaattgtagcca

SEQ ID NO: 14718 - DNA, 1501 bp, Oryza sativa; identical to SEQ ID NO: 14712

SEQ ID NO: 14719 - DNA, 1501 bp, Oryza sativa
agctagggattaccggcggctaggcttctctctctattttatctcgtgagtacgcgttccgacttccgaatcagaaacatattagaacacacgttcataattatgttgggccgcacaagggccgagcaagataacattggtagcccatatcaattagtattactctctattaacttctttttttttattttggtcggatcaaattaatcgccacttgaatcaccgtaattttgacaatttgatccttttaaaaacttatttgaaaattagtccgtgtcaaaaaattattgaaaaataggtcaaaacctcagcgccataaattttggcgctaaagcctatctgagttggacaccacgtcattggtggggcgctgagctcccatccatctaaaatgttacataagtgagcaccttaacagtattgtttgcttgctgtagtggatggattgttaggtttgtactcaataggtgacgggttctagcccttctacctgcaccgttttttccttcgtaatttaatttcctttttatttttgaattgaaatatcgagaagaagtgtatattagaaaactcaaatcatctctcttaagaagatatcctcttatttaaaaataaaaggatatcttctcgagggacaaaaatccatttccatatattagcatatatgcttgcaaatgaagagatccctgtgtgtatagtgtaaagtgttatgtcacgtatccaaactcaaatcatctctcttaagaagatatcctcttatttaaatttaagaggatatcttctcgaaggataaaaatccacttccatatattagcatgtatgcttgcaaatgaagaggcctctgtgtgtatagtgtaaagtgttatgtaacgtatccaaccatgcaggtaattaagcaaaaggattgattaatttatccaaatgtacaagcgtcctcgttccctactactacctctatattttaatgtatgacgccgttcatttttttccaacatttgaccattcgtcttattaaaaaaaatttatgtaattatcatttattttattgtaatttgatttatcatcaaatgttctttaagcatgacataaatattttcatatttaaaaaaaaattaaataaaataaataattaaacattggtcgaaaaattaactgcgtcatacattaaaaatacatacggagggagtacttaatttcctagctagcggcggggagatctcgcatccccggccggccccgtagagagtgttaatttcctactacgtacgtgtgccccttgttaatttacgtacatgaaacacgagaaattcgctcttaatttctggattactacaatatatatacgggatcctaatctcactggtgtaaattaagaaagccttttaattatttggagcgacatatatcaaatccctcgtttacgcatacatgcatggatacatgctatatatatttcctaagttaattccttgattgcatgcatgtgcatcactcgatctgt

SEQ ID NO: 14720 - DNA, 1501 bp, Oryza sativa
ggaagaaaaaaaaattccatgtcattgtccacgtggcgtgccacgtagacaagaccacagtcaaacgcggctttggatcgggataatacaataaaccaagtttagagaccttgatatgcactttgcaagttcgtggacctaagtgaaacctcctgacaagtttaaggaccgctggtgtattttactcttgtggttttatccatacgtgcttgtgctgcagtccattttgctggtgtagtgatattaggggggccatgcattagagttttggcttttaatttgtacgaaatatggtgaagaactttagatctctctctgtggagtattgtattagctgcaataatttcaaactttagggatctcaattcttgttttggcattagaaatttgaactgtgcacctgtcattttgctggtttcttttcctctcagggcaggaggatcatccccactgacaaccagaacacggcgtcagtatgcctgaccaatcaattaatgatggatgccactgacaaccggaccacggcgtcttcgacaccaccatgatttctgactggttattgggttaagcttcgttatgtcatctcctaatttttttatgtccatgtttgcttagagcaagtttaatagtatagccgactactaactctaattcatctatagctaatctaataactcattcatacaatagttacatactacactattaatacctggtcccacttatcatacacacagcgtgtcttagagtccgtgctacaactggctataaatttgtagtccgctgctcttctctctttttatttatctccttaaaatatgtttgcagctggcttatagtttgctattgtacctgctcttacgatggtttatcattctccagatctatgaactggttcttgatcatttgatcatcatgtgcttgaaattttacacatttggtcctgagtctgtattaaatgtgtaaaatttcaagtgataaggtcttctccagtgtcatgatcagtttgctgatcgtcacattatcaattagtcccctttaattaatccaagcgtgaagcatgcatgcttacgtggaacaattaattatatataagccttgcggacttgcacaaacaaagatgtatatagaggcataagtacatagtactccctccgtcaaaaaaaaaaaataaaccctggatttccgtgtccaacgtttgactgtccgtcttatttaaaaaaaaatatgaaaaaaaaattaaaaaatacaagtcacgcataaagtattaatcatgttttatcatctaacaacaatgaaaatactaattataaaaaaattcatataaaacggacaatcaaaagttggatacgaaaacccagggtttatcttttttttggtcggagggagtatatagtaggagtagaggagcaagactaatttgagaggacacaactctgaactgtcttactcaagctcagcaagatagatatcgatggcaaaggagtgcggcagcagcagt

SEQ ID NO: 14721 - DNA, 1501 bp, Oryza sativa
tcgggcaccgatcctgcaggtctgccagcgtggttccagctatagctctatgatgtatccgaacgtggaggatcactgggatagaattcagggctgtcaccacctgccgcctacctctgacaaaaccgtgggatacacaacaaacaaaggtaacctctaacctagacaccgcgtctaagttattaattatgtcggtgacatgggatcgggggtatcatgactagaggcttgggcagccgcggtcacccacgtggcctgaccccctcgggggggtcgggcccgagggagaggtggccaccccctcctttgtctccccgaggggtcgggccgctcttgtttcggccccgagggctggggcgccccgaccccctgtggtattggcgccacgtgtgtgggttaggtgggcacagcggcgctcacctaaccgcatttattgcgggatggacaagcgcgccacgccgcatttaatgcagcacggcgcacgcatatccggtccgtgaccggtcgcagtgtgtgaccggtcacagaccggtcagatcgcgggttaggtggcagcaggcggcctgtcacacgcctcgccccgtcctgtcggaatgatgagagcctcttggcactcgtccctagctggagccggcgtggtaactcctggagttagcacgtcagtcccggctcgattcatgccaggcttcatcgcaaccattgcaaggaagtcactgtttgaagaagggcagatgtgcggcatgctaaactgacgtgtggtggagaagaatgaccggtctgtgactggactgacgccggtcacgtcatcggcagacaaccgtgctcccacgttgcatctgtttccggcggagtggaggtaggtatgacccatcccatcggagggtcattcagacagcagccattgcagatctccgcccattaatgaagagatgacagggtgatcccctgtgtccgacgagtgacggcgctgggcatcactcaaggacaagcggtgatttagcttccaggcggaggcgcgagtcaagatttggtcaagatagggtgggtccccacccaaaagaagagtaggtagaagtggtgcatgtggtatccccttgaaatataaaaggaggaccttgcccacaaaggaagggggacgactctgagaagagaaggaaaaaagaggggttctagagcttgaactctcttgctctccggctctctgtaactctttctcacacatatccaccagaacacaggagtagggtattacgcttctcagcgacccgaacctgtctacatcgcccgtgtctcgtgcgtttgctctctcgcgtacattccacagatcgagggtgaagaacctcactcagcgcccccggccgaaccggcaaaggggggcctgcgcggtctcccggtgaggagccccacgctccgtcatctggcgcgcctggtagggggcgcgtgtgcttttctaagccctcgtcctctttcgtgtgcgccaagtttctcccgctcagcccaa

SEQ ID NO: 14722 - DNA, 1501 bp, Oryza sativa
tagattttcatctttacgggttcattgtttagtatttatactaagtgctctagtactaggactctagataaagaaggaagttcttgtacaagtattagagtagtaatttgacggagcgtggggctcctcaccgggagacagcgcaggcccccctttgccggttcggccgggggcgctgagtgaggttcttcaccctcgatctgtggaatgtacgcgagagagcaaacgcacgagacacgggcgatgtagacaggttcgggccgctgagaagcgtaataccctactcctgtgttctggtggatatgtgtgagaaagagttacagagagccggagagcaagagagttcaagctctagaacccctcttttttccttctcttctcagagtcgtcccccttcctttgtgggcaaggtcctccttttatatttcaaggggataccacatgcaccacttctacctactcttcttttgggtggggacccaccctatcttgaccaaatcttgactcgcgcctccgcctggaagctaaatcaccgcttgtccttgagtgatgcccagcgccgtcactcgtcggacacaggggatcaccctgtcatctcttcattaatgggcggagatctgcaatggctgctgtctgaatgaccctccgatgggatgggtcatacctacctccactccgccggaaacagatgcaacgtgggagcacggttgtctgccgatgacgtgaccggcgtcagtccagtcacagaccggtcattcttctccaccacacgtcagtttagcatgccgcacatctgcccttcttcaaacagtgacttccttgcaatggttgcgatgaagcctggcatgaatcgagccgggactgacgtgctaactccaggagttaccacgccggctccagctagggacgagtgccaagaggctctcatcattccgacgggacggggcgaggcgtgtgacaggccgcctgttgccacctaacccgcgatctgaccggtctgtgaccggtcacacactgcgaccggtcacggaccggatatgcgtgcgccgtgctgcattaaatgcggcgtggcgcgcttgtccatcccgcaataaatgcggttaggtgagcgccgctgtgcccacctaacccacacacgtggcgccaataccacagggggtcggggcgccccagccctcggggccgaaacaggagcggcccgacccctcggggagacagaggagggggtggccacgtctccctcgggcccgacccccccgagggggtcaggccacgtgggtgaccgcggctgcccaagcctctagtcatgatacccccgatcccatgtcaccgacagtagcccccggcgttatgccagggcgatcgcccccctcgagggaagcgctcgggcgtgacgccactccttaggtctggtgacaggtgggaccggtctctacaggcgggcaggaacccagcggtcgcaaatcgtgcgcatcggctaggaaaaaacgaccgataataa

SEQ ID NO: 14723 - DNA, 1501 bp, Oryza sativa
agcggcgcaatccggcgacgaaggtagtcgccgtacaccatggcccccgtgagcccctgggatcgcagacccgccaggcggtcaagaacggcgtcgtagccgtctcccagatctaccggcgcccgccagctggagacctgcgctgggggctggctcggaagtcggaggcgcgcttcgtcggcgaggggggtgtagaaccagtcgctcttccagtcgtcccacttcttgcggaggacgcagggaatgtagcggctcagcaccggcccccgcggctggaagtagcagccaccgactaccgacggcggcgacactggctgtacggtgaagaaccaccggaacagccgaagagatgggcgcaccccgataaacatctcgcacaggtgcgcgaagatggccaacgtcattactgcgttgggggtaaggtgtgccatctggagatcataaaactccagaacatccatgaagaaagaagagaatggcgggaccagccctgccattgcgaaagggaggaagaagacggaccgccccgggtagtgtggtgccgggcgtccctcgcccagctcgaccacctcccggccggcggcagatgccggcatgaatcggcacggcagcccggcctgcctctcgctcacgatgcaggaaggcggcagcacgctaccgtcgagcggtgcggagccccgtgccatgacgccggcggaggaggagcttgagaacgagtgagtgcggcgagggtagggcacaggaaacaaggagttagggcgcaagcggcgaaggcaaggggaataatggcgagaggaaggaaacgaatctcttccttggcgcctttatacccttgccaacgctattcccggctcctcgtttcccgcgcccactatctcgccccctcgtttctcgcgcccacgcctccactaatcccactcgcccgtttgcggcgcacgaggcggatgtgcggccgtggcagtcgagatagggcatatcgtgcgtgcgttaactacgctcgccgaccgaagcgccatcatcatatctccaggcgaaatgaaccggctcttcccgattcgcgcgctactcgagaaatgtagcggtcttgaagaggccactcattattatcggtcgttttttcctagccgatgcgcacgatttgcgaccgctgggttcctgcccgcctgtagagaccggtcccacctgtcaccagacctaaggagtggcgtcacgcccgagcgcttccctcgaggggggcgatcgccctggcataacgccgggggctactgtcggtgacatgggatcgggggtatcatgactagaggcttgggcagccgcggtcacccacgtggcctgaccccctcgggggggtcgggcccgagggagacgtggccaccccctcctctgtctccccgaggggtcgggccgctcctgtttcggccccgagggctggggcgccccgaccccctgtggtattggcgccacgtgtgtgggttaggtgggcacagcggcgctcacctaa

SEQ ID NO: 14724 - DNA, 1501 bp, Oryza sativa
gtctcgcggcgccgcctccgtcgtcggcatcgtagcggcgtgttccacgtcgtccccatctccgtgcagctgactgccggctgtcctcgtcgcctcctcgccggtcccggtcgtcgtcgtcgtcgtcgtcctctcgtcgttcccggtcgtcgtggcgttcgtccctccgtcgagccgttctcgtccgtcgtccgcgttcgtcaagcgcgccgctgcagccccgtcctcgtcttcgtcctcggctccgcgtcgtcaagccccgtgccggccgcgtctcgccttcgtccaaggatcgccgccgaagccgtcccctcgccgttcgtctccgttgtgcccgtctgtctccgccgcgcccgttcgtcgttgtcgttcccacgcctcgtcgcgtggtggtaaggatccgtcctctcgcttccccgccctcgtcctttcggtgtcgccccgtacccgttgtgcggtcgtcgaccccggtacccgtgtaccggtgtcggtagtcgttcgcttgtgcgtgtggtgaccgtgttagtgtgcccgctcggtagccgcgtggtttccacgtgtgcagcccgtgtggtgtctagtggactccgtttgttggccactcgcctcggttgacacacggggtccgcttccgtcgacccgtggaccgtctctgtgtacccggtctaccgtggtcctttaggttgacatgtggggtccgcatgtcaacggcgcagccttcctgtcttttccaggctagcgcttacacatgttttataattgcaaagcttaattataataattcgcaaatctccatataacagcattaaacttcggatgatcatatcttggtcatacgagctctgaatcgacccgttcaagtctcctaatgtttgtataacctaaagaaccgtgtgctttctttttatgtattgttattgcttctttttaggcttgtagctttgcttgtgtgcttcgcgtagtcttcgtcgttccggaggttccagaagcgtggttcgtggtcgtcgccgaaggttcggaaggccgttctctctgagcaaggcaagtcacatcatctttgaacatattgaatcccagtttgtaaaattatgttgatttaaattattgcattatcgctttatttaaattcccgcgttatcactgttttatttagccatgcctatttacctttgttatgaccatattattattgttattgttattattattaccttgttcaccctagattaaacaaaacctcaactagtggacactctactcgtggtatccctagtttaaatttaggtagatgcttcgcaatttaattaggtaacattaggcggttttacaactctagactttgggatattctcatatcatttggacactttggaatggttggcttatgttggaattggacacacacctccccctcttttcaaaacccccaaaatggtttaggctgggctcgaggtgcgtggttgggttttgttagtcgtacctcgggtactataaggattaa

SEQ ID NO: 14725 - DNA, 1501 bp, Oryza sativa
tttctatcgtacgttttccatgtgaactttacgaacatacatattttatctcttacgcggctggggattaggaaggatatattacttttttattttttaaagtatgataatctaatggtctaaaatattgggtcggtcaatttaactaaaaataaatacatttttcttagaatatctatgattttctctaattcattggtgtgtcatgtagtgatataggtgcgtttatggaataccgcgtgacggattggtggcgtttgtagaaggtttaataaacttttaatttataatagatagatagattataagctgttagttatttaatgtttgattttatttaatcttaaacttataatataatatgttagttatataatgtttgattttatttaatcttaaattttgctgggtagaaacaaaaagatggaaagagtaatcgatgataggagataggagacagagggagggacggacgcacgaatgttaagtaggtgatgacggggagaggatgccaaggaggtggtgggttaggggtgggattggatttatggatgggttgatagatctaatgatgaaaatttcttcgacttctctatttagtagaacatttgtaaaaagtataatggatttttttatataatagatttaaaaaatacaacaggatcacaaattagatactctctctatcccataatataaatcgtggtgaaagttggcatggtcatcaaaactaagttttagcttataatttttcatatactataaggttaatagtaacaaaattataaccatatgaaagtaattttaaatttcaatctaatgatatatttttaacaaataaaatttattttatattatacaaagtgttagtcttaaaatatgtgcgcgccttatattgtgggatagtgggagtatattttcttttacaaaattaaaagatggtttaaagaatgttgattggatattttaaatttttttattatatatcttaattttactacatatttatatttgtgaagtaatatattttatttttatattataaaaaataaaatggaccgttaatttttttcctccgggcagcagaaggaaagcttcgttttaaacagtaatgtacgtactcaaatttttgtttccaatcatacgtacgtacctacgtaggggacagcagtcatgtttgtatcatatatacggtcggaggaagttattattttttaataataaatttaatctaatggtgtaaaataatgggtccacaaattaagcgaaaatcaacggtacggttaggacgggtccaccaatttaagtgaaaatcaacggtgagattagatagtgccatgtgacggcttaagaacgtttataggagtgacacatggcagcgttagagcgtttgtaagaagtttaatggacttttagtatataatagaagatagatagatatagttgcttactgtattattaatatctagtcctacctatcatatgcacattatgttttgga

SEQ ID NO: 14726 - DNA, 1501 bp, Oryza sativa
ggcgggctccgcgtgtcagcggctcaagagagagggagggggcgccggcaagtgggccccatgggtcagcggcacaaggcggccggtccaccgtggaccgggaccacgcggggtgtccaccgccggtccacgagaccgatgatccagatcggtcgggaggccgatcggacggtgcgggcggtggctaggcatagctcggcccggcacaaagccggccggccggccatggcgagcggcaacggcacacgaccaccaacggtgactggcggcgcgggtagacggcggcggacggcgcacaaggcggcggcggacggccggagcggcggcacggccaaaggcggcggcgcacgcgtgaaggggagaaaagggaggggggaggcgtcagccgggctcggctcggccccaaggccgaccggccgaccgaggcgaggcggcggcgaggcacggccaccgacggcggtgaccggcggcgcgcgaagcggcggcgacggccgaatggtggcggcgcatggccgaagcgcggcgacgcacgtgcggagggcggcggcgtgcacgggagagagaggaaaggaaggaggagagagaggtagtcctcaccggcgatgcgagggaatcggggttcggcggcggcggacggaaagcgagcggcggccgaggtagctctcgcggcggcgaagctaaaggcggtgattgcgcggcgaagcgacggctctagtgacggcagcgtgcggcgcgggctcggtaggaggcacgggagggggcggcgagagtgggaaacgagagagggggctcaggggaaggattttataggcgagggaggggaggacgtggccgggaaccctctcgatttggccggcgacgtgggggagtagggaggaagagagagagagaggagagacaggattcaaaccgaatcacggcctctaatcgggcgcgctgatgcgggagaggtggaggaggtggtcgacgaggtgggcgcggtaggagcgacgtggccacgacggcgtggggagcgacggtttcgacggtggggcgtgggcggctggaggagtaagacggggccgacaggtgggccccacctgtcggtgacccagggagaggagggaggggcgcatgggccggcccaacaagaggaaggccgagcgcgtgcgggaggaaggggaggcggactgagccgttggcccaagaagagggaaaaagaggaaaagaaaagggaaaaaggggaaaaaggggaaaggatttttcgtgggatttaaaattgcactttggtgatttttaattggttaaaattatttccaaggctctgaaaattccactaaaaatcctgttaatatattgtgacatgtggaactcaagaaaaatcccacaatgccaattccaattattaattgcattcattaattaaggaactcatctctaggttaattaaaacaatttctccagacgatttatttaacaaaattttaaagcatgaaaaagggggaaacttccgggcgtgaca

SEQ ID NO: 14727 - DNA, 1501 bp, Oryza sativa
gatagggacatcgaaaggggacagagcagcactggttatcaatattgctctcattgctcaggaacgccgttgactacatcaagctacaactgatagtggtggcatctatgtaatttttcaacagtaatctagtttgtttctgtagtattgttccacttttaagttttagcccttatgatgatgcattcttggctatttggttgcaagtcaggaggctctttctgatgtaagctgtattatacttgactagtggctagtggagctttgcaggtttgtccaatagaatctggtaaaaatttctgatgaaagttgatggaatctgttagtgcagtttataagcagtttttctctaagtcatcttgaacttgaactgctgtttcaaaccccactatcagtagtttgttcaactgttatctatagtttgttagagtaatcttgttcccgcttttagccttatgacgtactactattcttgaactatttggttgcaagtcaagtcaatgaggccctttcaaacgaactctctccgtcccaaaataaaccaactcgtacgagattgatttattttgagacggagggagtatgctattaaatcatatggaggacatattccagccataaaagacacgtcccaaacagataggcgatgcaaaataggcttattctagcacgatgggctggtcgtggtttcgggccggcacggcaaggcccacatcttattgggtcgtgcctaggccgtaggtacaacctgtgggctggcccagcacagcacgaagagtatccgggccatgctgggtgtcccatttagctatctataccaaaggatggaatttttttcggttttagattttttttaaaaaatatttacagaaataatctatcggccaaaaaaaattacaaaaatagaccctgccgcccacctctggggcggcaagctgacgtggcaaacgggggaggaacgggcggtgacggagggagggttttttgcaggaaaacccttgccgccctctggtggggcggcaaggggcccgaatgcaaaaaagccagtcggggccggctattttgcaggcggccccttgccgccctctggccgggcgacaggcctcgctgcctataaaaggcctgctgctcagcccccagccctcattcttctctcctcaattccagtgaaaaaaaagaagagaggggaggagaagagaagaaggggcgaagccctgccggattcagacgccgatttcaggtaatattcatagatcctatatgtgactattgagttaaatagtgtgtattctttaaaaatttgtttgaataaatgcattatatttttagggttttagttgtactaatctagaagtgtgtattgtagatatcggtaactacatagatctgctagtttggaatcaatacattaccgttgcattggcttacacaagaagatattacgttgtagatgtttattgcatgaaagagtaatatgatctagttatttcgttgacagata

SEQ ID NO: 14728 - DNA, 1501 bp, Oryza sativa
cgccgcccggcacggcctcgccgccattgccgcccgctcccaaagaccgtctctcgtcgccagccaatctcggtgccgctccgtccaatccgacgccggaaacggattccttgaaccccggagatgctcccacccctttgaatcgaaccctcgtcgtctcgtcatgttttccccttttgctctccagtgattgccgccgccgcaatccaccgtcgtcggctcctctcgcgtcgattcctctcgccgccacgctcccggggatccccatgacctccccctggctgccccaaggccgtcggccttctcctttgtctccggccgtgtcgccgcttccgccgctgcctaacgccgccgcgcgtgcgtcgccggtgaccatcgggtcccgcgtccccgcgtgcgcatcgcggtcgcgtaccgtttcggctaggcccgagtccgcgcccccttgtcccttccctcgcgtgaccacatccccgatccgacgagcttggtcgccgtcgccagccaccgtcgtacctctcctctcaaatccgtgccgttaaacggattccccctgacctcctctagctgccggcggtggccgctcgctccggttcgccgccgctcgccggaacgcctcgcgcgtcgtcggccgtgcgatcccgggcgcctccttctacttcttctcctcccctttggctcctgcccgcgtggccgaccacatggcagccacctcagccccgggcccgcttgactgggtcaagtcgcgcccagtcagcctcctccctccgtcttccctcccgtgcgcgcggtccacgacaagccgtgcggctgcacgtgggcccgccgccatcagtccacccggcgcgccgcgcccgaaccgcgcgcaaccgaaaccctagcgcccgcccccgcgtgcgcccttcccaccgtgaacctaaccaccgccatgtgggtcccgcgcggtggaccgcgcccaccccgtcgtgcctccctctctccccgcgcgccctaatgggctgcctccccgtggccgcgctcggcccaatggccggccaagccttgtgaatccctcgggccgcgcctaagtcgcccgaggaagtctaaatccgatccctccttccttttcttttccaagggaattaataattccttttccttgtccagaaaatccatttagacctccaaaattcatatccctcgatccgtagctccgatcgcctccgttccacttccagtaattccgtaaaattgagatctatttaatggcactactaataggtctaaataggatctttcttttggtctcttgtttaggttttcgattgtttgtgtatagttgcggttatcggattttcgtcgatcgcgggttttctcgaagattcgtgaagcttcgagaagaccttgagcaaggcaagtcaccctttgatcaatcgcccctataattgaaaagtcattattattttgtttgcaacttgcattattagaatcacacacttaacttgcttggcctcggtttgcg

SEQ ID NO: 14729 - DNA, 1501 bp, Oryza sativa
ccatgaaggcatggcctaggttatctactaatgggccatcactaaatatggaaagttcatgaggctatgcctatcaatagatgggaggaggtgatgtattgtacactagtgatatgcaatggaaaagtctcacccctacatcttgtgtcaacactttttctagaattatgcaatccctcttagactactatgtagcaggaggggttgcataataatgacgaatagtgattgacgctcatgtatatacacacactcacactttgtctccaggaaggatcacatcaacaccctaccctacctgtcagataaatgggaaccagggttctcattacaggctgctacagacgtccatggacatgtcatcaagatcatatgacacatgttgtcgtcaaccagattcaagcgacaattgagatacatcctgtcggtgacatggggccgggggtatcgtgactagaggcttgggtagccgtgatcacccacgtggcccgaccccctcgggggggtcgggcccgagggtgacgtggccacccctccctctgtctccccgaggggtcgggccgctcccgtttcggccccgagggctgggacgccccgaccccctgtggttttggcgccacgtgtgtgggataggtgagcccagcggggctcacctaaccgcatttatagcgggttggacgagcgcgccacgccgcatttaatgcggcgcagcgcacgcttatccggtccgtgaccagtcgcggtatgtgaccggtcacagaccggtcagatcgcgggttaggtggcaacaggcgtcctgtcgcacgcctcgcctcgtcccgtcggaatgatgagagtttcctggctctcgtctctagccggagctggcgtgctgactcctggagttggtatgtcagtcccggtcagatccattctaggcttcagcgcaagcatggcaagaaagtcgctggccattgaatgaaggttgaaacgggcgtccaccgggagagctgacgagcggagcagaaggcgtgtgcagtgcttgtcagaggtcacttccggctgtagactagccctcattgtaaaaagcatgtttcctttcttaggcagctagaggcccatgtggtgacccctgaccacataaaaaggaggcccaggcctaggagagggggctggactctggccacttggttctagagcctgagctctctctggttctctcgagctgtattccttcacacacagatccaccagaacacaggagtagggtattacgcttctcagcggcccgaacctgtctacgtcgcccgtgtcttgtgcgattcttctcgctgacattcctcagatcgagggcgaagaacctcacttagcgcccccggccgaaccggcaaaggggggcctgcgcggtctcccggtgaggagccccaagctccgtcatctggcgcgccaggtagggggcgcgcgtgtctttctaagccctcgtcctctttcgtgtgcgccaagcttctcccgctcagcccaa

SEQ ID NO: 14730 - DNA, 1501 bp, Oryza sativa
cccctaattaattttggaattaaccgagtgaatcaagcggatttgagggaggattggcgctagggttcgcacggggagagggaagccgggcggcggctggaggaagaaggcgacggcggcctgacgcgtgggccccacgcggggcgcgcggtcagcgcgcgcacgtgcgcgctcgggcgggagggcgccgctcgagttgggccgggcggccggcccaggaggggggggggaggggtaggcggcttgggctgggcggctgggccgaggcaggccgggaggaaggagggggggaagggagctgggccgagaggggaggaggcccaagaggagggagagaaggagagggagagaaagagagggaggagggaaggacttcgggctgggcttggcccaaaggaggaagaggagggatttttagtttttctttttaataaactttgatcaaggttgttgttgcttaataattatttccggtgctctgaaaattcaagtaaaatttgagggctctttttagaccaaggagaatttaacaaaaattctccgggccacattggaatttttcttgcacgtattttagtgtttgccaatttcttttcgaattttaattaattctattattccttttagcgaatgaattttatttcgggatgaatttatcaggacgtgacaatctgaaggattgagcttgttctggttaagatgcctgtggagtggagtcgccatagctgttccgtagtttgttatagttttatttttttttccgctgcgtagaaggttattctttgagaggaactatctacctctgtaataatttgtttgcaaatattaaatagttatttatttgtactctattatcaatttgttattgtgtgcctcggttgattcctggacgagggtttaacacacatgtaagcgcttggaattttggatagaaattccgggcgtgacaagttggtatcagagccaccttgaccttaggataagccaaatggtaaaccttaagtagccttcaaaatattttgaaaaaaatagaactgttcttctctattctcttataaattaattaagttggcagcacatgcaaggttatgcacaaaattaatttaattcattttcttttcttttaaaagcaaaaagttgttcttttcaaaatgtttcttatttcactttattaaatttcgttgattagtcggcactgtacatctattatggtattgatacaatcatgatagcactagtactactcatcctttttatggtgacactgtaccgtgcttataatagatcataagtattttagttttactttagttatttgtcaaaaaaaaaattatttgtctctgtccaaaaagttaaatgctaaaaatatatttatataatggcttagtacgtgtcttttcttttatttttcttcctctttggtcaaatcagttaagtctagatggtgcagctaacttaaaaaaaaatatgcattaattcctctcttctatgtttctttaga

SEQ ID NO: 14731 - DNA, 1501 bp, Oryza sativa
ctgcaccatctagacttaactgatttgaccaaagaggaagaaaaataaaagaaaagacacgtactaagccattatataaatatatttttagcatttaactttttggacagagacaaataattttttttttgacaaataactaaagtaaaactaaaatacttatgatctattataagcacggtacagtgtcaccataaaaaggatgagtagtactagtgctatcatgattgtatcaataccataatagatgtacagtgccgactaatcaacgaaatttaataaagtgaaataagaaacattttgaaaagaacaactttttgcttttaaaagaaaagaaaatgaattaaattaattttgtgcataaccttgcatgtgctgccaacttaattaatttataagagaatagagaagaacagttctatttttttcaaaatattttgaaggctacttaaggtttaccatttggcttatcctaaggtcaaggtggctctgataccaacttgtcacgcccggaatttctatccaaaattccaagcgcttacatgtgtgttaaaccctcgtccaggaatcaaccgaggcacacaataacaaattgataatagagtacaaataaataactatttaatatttgcaaacaaattattacagaggtagatagttcctctcaaagaataaccttctacgcagcggaaaaaaaaataaaactataacaaactacggaacagctatggcgactccactccacaggcatcttaaccagaacaagctcaatccttcagattgtcacgtcctgataaattcatcccgaaataaaattcattcgctaaaaggaataatagaattaattaaaattcgaaaagaaattggcaaacactaaaatacgtgcaagaaaaattccaatgtggcccggagaatttttgttaaattctccttggtctaaaaagagccctcaaattttacttgaattttcagagcaccggaaataattattaagcaacaacaaccttgatcaaagtttattaaaaagaaaaactaaaaatccctcctcttcctcctttgggccaagcccagcccgaagtccttccctcctccctctctttctctccctctccttctctccctcctcttgggcctcctcccctctcggcccagctcccttccccccctccttcctcccggcctgcctcggcccagccgcccagcccaagccgcctacccctcccccccccctcctgggccggccgcccggcccaactcgagcggcgccctcccgcccgagcgcgcacgtgcgcgcgctgaccgcgcgccccgcgtggggcccacgcgtcaggccgccgtcgccttcttcctccagccgccgcccggcttccctctccccgtgcgaaccctagcgccaatcctccctcaaatccgcttgattcactcggttaattccaaaattaattagggggaattaatcccctttccctcctcttcaattcccccttaatttccccttgaa

SEQ ID NO: 14732 - DNA, 1501 bp, Oryza sativa
ccgctttatttaaattcccgcgttatcactgttttatctagccatgcccaattacctttgttatgaccttattattgttattgttattattattaccttgttcaccctagaataaataaaaccctaactagtgggtactctattcatggttccactagtataaatttaggtagatgcttcgctgtttaattaggcaacattaggtggttttataattttagactttgggaattctcatatcatttggacactatggaattgttggattatggtggaattggacatacacctctctttctctttcaaaacccctaaaacctgttttcggtggggtttgggtgcatgccagttaggggaagtagcaccccggccactataaggactaaagctcgggcctctgttgcaaagcactaccgtacttccacatgtctaatgggtaaggcttagtttgtggctcagtctagtcataaacaaaagtacacggattggagatggatgaagtcgggcgtcgatggacattctccagggcaaatgaaggctacacgagctgcggcccggtagtcgagatgtcatacggcggagggttggtgcccaatgctaggggctcagttctgcctgcctgtcccgggtatcccggccgtaggtaggattgggtcggtactcttgtctaaggctaggatgggttggaaactatgtcacatctttacgacgggttccaaggccatggaatgcggagtaaagatgtgtcttgtgggtaaagatgtacacctctgatcagagtaaatctattcgaatagccgagccctcggatatgggcaagccgagcaatgtacccaagtcagtgttttaattcttaaaatttgctcaacaactaaaatatggaatggttggcctgggttggcttgggacgagctgggacccagggtcgggttgccagttcggtccaaatcatcgtaggccttgggttaaggcaggttcgtgagggttcacggccttgtttaataacactgtgtagctctaggatcgtctttacaaaatggctttgggcaactaagtgatttttaaatgcggtttactgcaaaacttaatccctatattattattcccttgtacttcccttgcattaatcatgcacctccggtgtggcttgctgagtactgtggttgtactcattcttgctctatctttctccccccttcagtaagagaagctttggagaagaagtcttaggtggagtcttggcttataccccagttgagcgcctgtgaagatggagccgtaggccgctagtccgctgctgtttatttttgcttgtcaggcctgaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataa

SEQ ID NO: 14733 - DNA, 1501 bp, Oryza sativa
agctgcggcccggtagtcgagatgtcatacggcggagggttggtgcccaatgctaggggctcagttctgcctgcctgtcccgggtatcccggccgtaggtaggattgggtcggtactcttgtctaaggctaggatgggttggaaactatgtcacatctttacgacgggttccaaggccatggaatgcggagtaaagatgtgtcttgtgggtaaagatgtacacctctgatcagagtaaatctattcgaatagccgagccctcggatatgggcaagccgagcaatgtacccaagtcagtgttttaattcttaaaatttgctcaacaactaaaatatggaatggttggcctgggttggcttgggacgagctgggacccagggtcgggttgccagttcggtccaaatcatcgtaggccttgggttaaggcaggttcgtgagggttcacggccttgtttaataacactgtgtagctctaggatcgtctttacaaaatggctttgggcaactaagtgatttttaaatgcggtttactgcaaaacttaatccctatattattattcccttgtacttcccttgcattaatcatgcacctccggtgtggcttgctgagtactgtggttgtactcattcttgctctatctttctccccccttcagtaagagaagctttggagaagaagtcttaggtggagtcttggcttataccccagttgagcgcctgtgaagatggagccgtaggccgctagtccgctgctgtttatttttgcttgtcaggcctgaagtgcctttgtaataatgtaaatattatcgatataataaagatgtgtcttttatatcatgtttgtatggtgtaccccggcttttcctgggacggggattaatacactagcgttcgggaaaaggcaattttcccggtcgcgacaagctggtatcagagccatctcgactgtaggataagccaagtggataaaacccaaggacatattttataaataaaaattatttgcgaaagttcctttttctccttcccctaatgctatttgcaaaaggtttactcccttcttccttcttcggatttcaactagtactagatggtcaggtcagtgaagaagaggacatcgccagttgtttgccgaagctccggaagactgcaggatccgctagcgaagtggaggaagcagtgaagccagatgtgaagcaggagtgaagatcttcgagaacccgtcgcagaacctaagccaccctctagtgtttcgtttgtcgtgtgtttccttgcttgtgtgtgtagcgcgtggtttgcatcagtgggttgtgatgtaaccatgctaggttgtttgcttaatcaacttgcagaataagtgaaacaaacaacacatcattgaaaagagttagttcctttaaggtcttgtccctagttctggtctattctttccttgtatgcttcccctctcaacctctaccttgtgacagatggataatcctggtaaccaaggctatgggaa

SEQ ID NO: 14734 - DNA, 1501 bp, Oryza sativa
tttaggttgtgtaggctcaggaactaaagttgtggctctagttgtgcctgtggtggagcaggcccaatgtgacctgagtggcccacggttggtgggccgggctgcgtactctcacaagtggtattaaagcccaaggtttagaacacggaacaatttctatgggtcacatggtggggaggccggtaacgagtcttcggggtcacatgggttgttgtgacgggagagattgttaggcccgaggcccaggtaagaagtcttcgggtcacatgggtgatgtgacagggagattgttgggcctgatgttgtgacgggggagattgttgggtttagtcccacatcggtaattgatgatggggaagcacgacttaaaaggtggggtcgatcctcacccatcaaactagtcttttgggttgtgtaggcctatgacctaaagttgtggctccggttgggcctgtggttgagcagacccaatgtgacttaggtggcccacggttggtgggccgggctgcgcactctcacaagttcatttctggccttggatttggttagaataggtgtcgaatatactagttctatttgattacagttggacttgaagttgtaataggtgttaggaggtagagttagagtcggactctgtaacacgacatctctcttaaatagagagggggggcaccacaatgtaaccatggcgactacaatgtagcgtagacacgcagggagaggatggcggcgaggccatggactcgtagcggctaggagctatattggttggggaggagcgcccataatcagagccccggggatgtaggcttcggctgaacctcgttaacaaatatcgtgtgttcctgtgtcgtcatctggcgtgtcttgagtgatctatgactgaagcgatcaggaaggttagtcgtcattccgctatatcgactagcttttataacagtatgcatcctagaagtataggaatatgatctttctatattctttccacttagcttagattatcatgagtaagagtatgaatgcttctgcttagtgtcactcgaccagatgaattatattaacccctgcttagactttggttgatacaagtaatatataaattattagtacggttctctctattataatcttcccatgggattaaacaaataaactacccatcgaatactctcgtgtgaaatcctacaatggtatatccgtacgcttgcggataaactctataaccataatataccagaagtatttctgcgtcactgttgggaattatgtttctagtaatgtcattaagacataccaacaagcatttctggcatcgttgctggggaagattcataaacgagattaccgttactaatattttatatttaccacttgtagaatcactgtcctttgctggctaaccttagttgttttcacttttattgtggaaacagggtagtgcatgactagtttcaacttgccaaaaaatttaaaggagaatccagaagttttctttcgg

SEQ ID NO: 14735 - DNA, 1501 bp, Oryza sativa
ggatttgtgattgcttgtacagattttgttttttctgttcgaattttaccattatatggatgccaacacgtagttctgcttctgcaaaaagtacagaccaaaatgtattgttatcacctgtatactcgcaaagagaaaatacaatagaatgatcaatctattaacatgaccaaagagaccaaaatctatgaaattcgatcgacgagaatcgtccgctaatttcagggattttgattttctgatttgagaaagataaaaactgtatataacttataagttgttggtacagagattatatatacgccggccaaccataaatgaaaatatctaccttaggtggttgattgccacgggatgcctgatcttctgtcaagtgaggacaactatcgatttggcgaaaacttggcgcacacgattcggtttccaatcgacacgatccaaactatgcaatcatagtatcatgtctcatctggttatgccaaaacccgatcagccttgctagaaaagctaatccctgcgtgcagattcgaataacacaagcaataacaagaaagacaacaactcaattgcagatgaatgattaatcaaaaacttgaaattggaattccataaaccgatgaacggtgaaactgcaatggtagaaatactaaacaaaactcaaccttcactcaatgatcactacttaatatatttgtcagggttatggataccacatacctaatagtagttgactaaatctcggcatgacccaccacataccatatactatacggaaacaacctgcggatatatgaggagtttcggataagggaagacaaccagagttctacatggaaacgacaaggactactcggattgtatccatattggtttccctagttctacttggacaagggacacctataggtataaatacaaggccccctaggaggagaagagacaatccacatacccaccatagaagagacaatcaacacacccaccatagaagacacgggcaacatagacgccacaaagccaatacaagccaacatacgccaagacaagacgccggatatcgatttcagggataagcacggctagtcccctacggtgtctccggatactgtcaggagagacgaaagcgctatctctgatctcgccgggcatggattcgaggaggaagactaccctgttgtcgactacgagtcagaccttcagaccgccatgtcgacaacagttagataggctacctcaaatattgtactggtgtgattatggtgaataagagcaataccggcttcggccaacaggatgtagggttattacctgacaattcaggggcccgaacctatataaaaatcatcatccccatctcttttacctcagtctcgcgtataccctagtaccaacgatccccatactgtccaaataccgtagtcgcaacattaaacgtcgacagtggcgcgccaggtagtgggattttggtgcttcaggttttcgacgagatgggtttaagaga

SEQ ID NO: 14736 - DNA, 1501 bp, Oryza sativa
ccatttttttcctcctgaattggggagttgaattgcattaattttctttattttttttctcttactagaaaaaatacttgtgcgttgcaacggacgaatgctattttaatcttattattgttatataatttagatatggtaaaattcactgtggaaattcgcttggatttttctttttttgaaaatcatgagctgcaattaggagtctggcattcatctcaagttagcatgcaagttttttaaaaaagatttcttatacgacttcttttgtatttacaaaaacaaacaaacttaaaatccgactcaaacacggatgacattccaaaatactagaaaaacatcttcaatttttataatggtaaataattgcattacgtgctaagctagaattaactacttattactagttccttttctcctggaattgtttttaaaaatttcttaactcctttttctgaactgtgaagttgaattgcattatcagttaagctggtatgcctttaacagttaaaagtaaatttcacaaaacatagattttagaacactcgtaacacaaaacccatgtattatgatttgttttgaaaaccccaaggttttagggaaaatttttaagaaaaccttatgtttaagtttatatcatttttttgttaacccatatatttgtgcataataattggaaaaaataatatgagatatttctaagtatatatacatgttagtcttattttaacgagcgtcatttattggtaatatgattaatgtttatatgtataagttaccagttaatatgttattgttagtggggttatgttgtgttttttcaatcttccaatgtaagaggaaaatgttaaagtacatgggagggatatgtattttgtgcctactaatgcagacatatactactaaaaatatcatatacaatgatgaaattatgagtatttgagataaacataagttttttaaaaacatttttaaaccagggttccttgaaacaaaccataatatctggaattatgcactacatgtgtctcaaattattttgtgaaattactctttaattaccttattactagttttcaaaaaattatataatctgtctttaattcaattaattagactgcttataatttatagggactagttttttttcacacgcaccaaactctatctaacccattccactttgatatatataaaaaaataaattctacaaaactattcgatcaaaactatcgctttactatactttaactaggcgcttcacaatactagaaacaacaacaaaaaatataaaacaaaacaacaattttattccctacatgtctatgatatgtgaacctaatttggatagcacaagtatctcatatgcgtatgacagatggacccaatgacgttggagatataaaattgtagttttatgataaaatcatatactattgttgtattgttgcagtagcccagctaaagttaaacataccggcagttttagctttatacaatt

SEQ ID NO: 14737 - DNA, 1376 bp, Oryza sativa
taagtcaacttgtgctcaaattatggtggtgtattggaggtacagtaatatattgcttgatttcccttgggctttgagaatctctactattataaaaattgaagatgttttcgctagtactttggtatgtcatccgtgtatgagtcggtttttaatttcgttcgcttttggaaatacatattcgtatttgagttaggaagttcgttggttttttgaaaatataggagtcgtacaagaaatatctttgaaaaactcgcatgctaacttgagataatcggactcctaattgcagctcatgattttctatcttttctctactattataaaaattgaagatgtttttgccagtacgttggtacatcatccgtatatgagtcggtttttaagttcgttcgcttttggaaatacatatttctatcttttctctactattataaaaattgaagatgtttttgccagtatgttggtacatcatccgtatatgagtcggtttttaagttcgttcggttttggaaatataggagtcatataagaaatctctttaaaaaactcgcatgctaacttgagatgatcggacttctaattgcagctcatggtttttctagaaaaatatatatccaagtgaattcccacagtgaatttcaccttaactaactcctataacaataataagattaaaataaccttcacccgttgcaatgcacgagcattgtttatagtgaaagaagaaacatgttttcatagttatggataccacatacccaatagtaatcgattaagcttggtggggccaccatataccaagtcttatacggaatcataccttgtatatagaaggagttccagattaataaggacaagtagagttctatatggaaactataaggactactcggatcgtatccatacttgtctccctagttctacttggacatggggacatctatgggtataaatacatgacccctaggaggagagggaacagaacaacacacagatcgacatacaagtcagaatagacaccacatgccgccaaacatcgacatcagagataagcctagacaacccaatatggtgcatacagaggccgacaaaagggatctagcgccatctctgatctcaatgagttcctactcgggaaggaagattaccctatcgtcgactatgtgttggttatctatgccaccaagtcgacaacagctagataggttatcccaaatattgtacttgtgtgattctgatgaacatagagcaacaccggctttggccaacaggagtagggctattacctgtcacataagggggcccaaacctgtataaaatccttgtatctatctcttttatctcaatctcgcatattccctggtaccgacagt

SEQ ID NO: 14738 - DNA, 1501 bp, Oryza sativa
ctgtaacagcaataaaatgaaacaacacaatagatattattattctggcaaattggcaataaaagtagacaacaacatagcaatcatatgcccatggcatgagaattattcatatgaacagtttgtagtatgtaccttcattgtaacttttgtgcagcaagtcagtttcttccattgcccttttaacagagagattcatttgattgcatctgcattccagttccaccaaatacttgctcttagctgtaatctggtgtgacaagttagctatgagagtctcagtcttgcgagacaggtcattttccagaccagacacggtcttcagatcaccatttgctgacaaaaacctaccaactgggtcactagatttgtagtcctcttcttttgccatccatccacagatgtacttctcttgtccaagtgctgcccaatcctttttacccagacgttgtgatttgaagtagttgtggaatgccaaggcgttcgtgaacccaatccaatctttgctgaaaccgacaactgcataaccagtatacctaccctcggagcagagcacagcagtaaactgcaagggattgaaattagctagctgctgcatcagactagctccatcctcctttgttttctcagctggaacatttgcaaggatgcccatccatggccaaacatacgcttcctgatcttgcaatggccttggaggattacttggtccaatggcctgtcgtgatggcaatgagcctgctgcatcagcatagtcgttcttgagaagattggccaaggccatgtggtttgccttcacctttggagcgcgattggatgcgccaaccccaatggcatgctgaagtagctcgttgtaacggtagtcctgcttcttcttccccagacagaatgggcatctgaacttttcattgcctagactcaccaccggcttcccagacttgaggtccatgtagcacttgtcagcatagtcatcaatatctgcatcacttagctctgactcgtcggaggtgaaatccatggcagacctgagtgacacggaaatattcaggtgagaacattgcattgagctcgaaaacagcactggatgcacctttgttacaaccacagttaaaaaaaaatcaagcaaggatgtagtaagtgtgcatatggcattgttcagaacatcagaggaccacacagaacaacagggcaatggtcattcatgattagaataggaattacgattgcatttcaatttgcatttgcatgacacaacattagacagtgttacagattctctaacactaaatgtgcttcagtagaagaattgaaataagtcagcagcaaaataattatgaaacaagcaacacaaaatcctacagttttgaaataactcactgatgtgtgttcattttgcaatctacttcttttttttagcaagaagggcagatcccctcccatttccattaaagaaaccagcacagaacatttcaggaaccactacactcagaacaagtacagg

SEQ ID NO: 14739 - DNA, 1501 bp, Oryza sativa
cgcttccttgctttttctccattttgcttcgattgattgaatgatttccacttggtttggttggtcgatctccatggaatctctcacccatccatacggaaatgccaagtctgcgtacgtctgcgtgctccttttcttgttgttgttgtaggttcatctcgcttctttgcctgctcataacacatttctgcacctgcatccaagccaagcagaagcagagctctcggcatggcggcgccggcggtcttcaccatctccggccgccgtcgcccgctctgccgacgagagagagatgctgccttgatgctttgatgcttgctgggctgtgtagtcactcactagtcaggcccatggcccgttaggagcctttcactggcccacgagagagagagagagagagaggggagaggggagagcaaccgcttgagcaacggagggaggcggcgccggatttttggtcgatttgagaattgagattgagaagatggattaaaaaggaaaaaagaagggggaagggaaaggcataaacatctcagttgcttgagagcactggttgtccatgggagagggacatttaattatttgcaacttttaagatgtgtcaattaagaatttatcactcgctgtatttgacatgtgggtccttatgtgtctatgacatgtgagtttaatggcaaatcctttagaactactcggaagagtggcaaatagttattattcccatgggggaagttatcatgggctgcggtgcgactaagtccgactgaactgatctttgatagttagtgagggtgcctaaaaggtttcttgattatacatttatacttggactgtgtagatatttcgagtttcgcttctatagggctgtttctgatgcaattgcaatagattgcatcacctctgttcattggcagtagttttgtttgctggaactttactggattgttgcttaggctagttcaggggtgcaaatggggatggcattgcctatcaggtcttctcaggttatatacttttcctgtacttgttctgagtgtagtggttcctgaaatgttctgtgctggtttctttaatggaaatgggaggggatctgcccttcttgctaaaaaaaagaagtagattgcaaaatgaacacacatcagtgagttatttcaaaactgtaggattttgtgttgcttgtttcataattattttgctgctgacttatttcaattcttctactgaagcacatttagtgttagagaatctgtaacactgtctaatgttgtgtcatgcaaatgcaaattgaaatgcaatcgtaattcctattctaatcatgaatgaccattgccctgttgttctgtgtggtcctctgatgttctgaacaatgccatatgcacacttactacatccttgcttgatttttttttaactgtggttgtaacaaaggtgcatccagtgctgttttcgagctcaatgcaatgttctcacctgaatatttccgtgtcactcaggtctgcca

SEQ ID NO: 14740 - DNA, 1501 bp, Oryza sativa
cagcggcgcggagctcgtggcgacggtggtggcagcggccggacaacggcgaggtggctggccattggcagcagcggctactgtggctgcggagggaggaggcacgatggtggtgaccgtgactacggtgggaggaggcatggcggtctcggacagctagctggaggcgtggcagacgaccgcacctagctagcacgacaatgattggaggaggagtcggaggccgacttgccgcagagaggcacaggcgatggcagtggaggctggcacggcgcgagaggcacgaccggcggtggtggaggccggcttggcgcgagaggcacggcgatagcgggaggccggactggcgcgagagacgcgtccgggggtggaggaggctgacgcggcgcgatgaggcccggccggcggtaaaggagacgaccacggtgcaaggagaagctaccggtgggtgtggcgcggtcttcgatgcacaaaggccgcccggtgggggcgccagtgcagtggtcccacatgtcggcagaggttgagcggtgatggagcatcgatgcgtcagccgtggactcgcaggtgatgagctgcgggtgaaaacccagcccggacttggccggaccgacaacgatggttcattccccctcctgagggcgttgtcgtgccgtcttatccctcaagggtggttgccaagcgaaagcccaatcttggctcttttgagtccctgccgaacggcggtgacggttttctgtcgcttatttcgttggagacgtcgtttaggcatcctcttgccgaaaccactcgaatgattggtgcgagcaagctctaggatagagttgggctttgtgttggttgtaaggactttttttgggcgatctcgtctgtgttcctttgttggcctagcggtggtcggtcacacttagcggcgaccggtccagtgctagccttctcccggacctgtgtgttggcaatgtcggtgtgtgggtggtggtatatttttttccttttttctagctacgaccttccaatattgtaatcttgtaattttttttctgctctgtaaatagaacttcgtaccatctcgtgcgagtcgttaaaaaaacattttatcgatttctcccaaactggtaaaattttctcataattactgcattctatttttcttaggacaattgcttatttgaccccgttttgagccctaactactaatttgaccctactttttaaagtttgcttatttgaccctccttttcaaaaagaagctcgcgtatgaccctgttctgttaagggcatctaacggtgttaactaaagcacaaaatgtctcttttgcccttactgatttgaccctattacgtgtgggacccacccgcagttccctcttctcctctcctctcctctcttctcttctcctctcctctcctctcttctcttctcttctcctctcctccacggggcggcgactgatgggccggtggcggcggcgctctgagggggctgagggagagggggcat

SEQ ID NO: 14741 - DNA, 1501 bp, Oryza sativa
ggtgacaagtgaaatgccattgtatctgcaataattagttcatttgagtcctctccatgagggttatacttaacattgtatctgcaaggtattgtggtctattggaccttggtactcccgtcactgactgtcctgtttgtaggtgtgtctacatttttgcatagcattggatgttagcattattggggcatctgaatctgaatacagtaatgttttgtcattattggggcatctgaatctgtacagttcattgattatagcattggatgttagcttacatatattgatgatagtagttctgaagtctatcaatatagtattcccttattctgaagtcgaccacctgttttttttccaattcacctttccctatttcagctgcaaacatatatatgttgtttcgttgtggttaccacaagtgaggctgacactgaatcttggctatcatgtttcacatggtgttttgttgggctatcatgtgctgcttctatgaaaaaaatagtccatggaactgttagatgaaaaaaattgggctttcacatatggtggcagtatcttctatactgtttacattttttatttcagcaaagagaatgtgatattgtggactgaagcatagctttccttattttgcaggcaaccataaaaagggctagcagaggtgctgtaaaagaaaaccaagaacctacaagaaccataaaagagatgatttgtattgtttttggaacctcgatacacctacaagaaccttagttgcatctaagttatgtaattattgctatgtacttgaagaactccattatatctaagttggacatttatgtaatagctatttgagctgatggacaactgctatttgtatcagaatactgctattgtgatactggtacttgaaggctacttgatggatgaacaatagttatgaatagtttaatattgtgttatgcatgtgtgtaacttactaaaaatgataatctgtgttgcaaaatttggagtggtattcatccatgtatgttgcaaatttaatttgaggtatggttcataaaatggatgctaataggtaattagtatatttttttgtgtggattaccgactgattgcttgtaagttattgtgctagccatctatacattaattgtcggcaaatctataacacaatgatatgctatctgttgggaatcttcttaagtgtcggtaaatgcccatctgttggtaaaactatctgtcggtaaatatgtagcaacactatcagtctatctgtcagcacatatttatctgtcgggaaagacttttgccggcagcacttggcctgacagaccctatctgtcgggaaaagttttgctgacaaataatttgacagcatataggtcctgtcctgacagatatgtagtaagcaaactaggggcatggtgtagtgtacatcatcatcagccgattgactttatatcattatccacattggacatataaccgattgcttaaaccctatcactatcggctg

SEQ ID NO: 14742 - DNA, 1501 bp, Oryza sativa
aaggtttggagagggagagagggaaaacaaaggggagagacagattagaaactaaggataggaccttaacagatctaagtcttttgctgttatgatgtatgttaggcttattctgcaagttgattaagcaaacaacctagcatggtcacatcacaacccaccgatgcaaaccacacactacacacacaagcaaggaaacacacgactaacgactctaccctagagggtggcttaggttctgtgacgggttctcaagatcttcactcctgctttacagctggcttcactgcttcctccacttcgctagcggatcctgcagtcttccggagcttcggcaaacaactgacgatgtcttcttcttcactgacctgaccatctagtactagttgaaatccgaagaaggaagaagggagtaaaccttttgcaaatagcattaggggaaggagaaaaaaggaactttcgcaaatagttttatttataaaatatgtccttaggttttatccacttggcttatcctacagtcgagatggctctgataccagcttgtcgcgaccgagaaaattgccttttcccgaacgctagtgtattaatccccgtcccaggaaaagccggggtacaccatacaaacatgatataaaagacacatctttattatatcgataatatttacattattacaaaggcacttaaggcctgacaatcaaaataaacagcagcggactagcgggcctacggctccatcttcacaggcgctcaactggggtataagccaagactccacctaagacttcttctccaaagcttctcttgctgaaggggggagaaagatagagcaagaatgagtacaaccacagtactcagcaagccacaccggcagatgcacgactaatgcaagggggtacaaggggtaatgatataggggttaagttttgcagaaaacagcatttaaaagtcacttagttgcccaaagccattttaaaaagacgatcctagagctacacagtattattaatcaaggccgtgaaccctcacgaacctgccttaacccaaggcctacgatgattcagaccgaactggcaacccgaccctgggtcccagctcgtcccaagccaacccaggccaaccattccacattttagttgttgagcaaattttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaacctccgggacaggtaggcaggattgagcccctagcagcaggacaccagccctgtgccatgacatctcgtctaccgggccgcagctcgtgtagccttcatttgtcctaga

SEQ ID NO: 14743 - DNA, 1501 bp, Oryza sativa
tcgccgccgtcgccgcccgagctcggaagcgtatctcgtcgccggtctccctcggtgtgtttcctcctaatccggcgcaagggatggattcccgtagccgcgtagatgctctcaccgccggaaatcagcccctcgtgacctcgtcgccgtttcccccttttctcgccgccggttgccgccgccgcaatccgccgccgacgaactccctccggcgaatccaagccgttggctcgctccctctcgttctccctcgtcattccggtgtacaccccgtcgcccctcgtcgtcgcacggcgtcccggagaaaccgccgccgcccgccgtccattcgcggccgacgcctttgtcttcctctcgccggcccacgtggctaccacgaaggcgccacgtcggtgccacctcggccgcgaccgggtcgagccgaccccggtcggccgctccctccggccctgctcgcgcgcgcggtccaccgcgagccgtgaggctgcgcgtgggcccgccgcaccgcgtcctacgcaaaccgcgcgcatgcgccgcgcctcccctccccaaaccctagcacgccccgtgtgcacctcgctcacggtgagccgagccgccgacaagcgggtcccacccgggaccacgcgagatggacccggcccaccggcttcctctctcctccccgcccgcgcgcgcgctttgggccgccttctctggccggccggcccgttaagtttggccgagcagcccctttctctcgggctgcgccctagccgcccgaggaaagtctaatttccctccctccttcttttcttttcttttctttttcaaaaaggaatttaaataaatccttttcctttagaccaaaaatccaataaacttggaaattcaatatcttcccaaccgaaagaccgtttgactccgtttaacttccaaaactcctcaaatctcgagatctatctaatggcacgcctagaggtcaataatagggctttattttcgccgtttgttgagttgtcccgtttcgcgtgtagtttcggagcccgaagacccgcagtgcgaggatttcgaggatcaagctcaagatctcgagcaaggcaagccacctttgaacatattgagcctatatttgaacttaattatattgcttgcaaaatattatgcattgataggattacacttaatctgtttgccccgtctgcaaggcagaccggtgggcctacctaacttgttgcatctgatccatccattgttaattgttataccatattcccctgtaaccacctagttgagcctcggtattcatgcactctgcacgagtatcgacggtcgccttcaaacttaaaatctaaggaacatcttcggtaaaacttgggttttacaaaagtcttggaaaacccaacacctgggtcggtgcttgcgaactaaatgaatttccaaaatcgccgaccggggaacgtaccgggtgtacgatttcccgctcttgcacttaaggaccgtttccttggaatttcatccg

SEQ ID NO: 14744 - DNA, 1501 bp, Oryza sativa
aaaagaggggtggaggccggcacggcacatggtacgagattcaccgccgccgccaactccaccctacaaaccctaatccgatcgagagggggcgcagccagtgacgggaagcgccaccgccgcgccagacctcatcgccgggacatctacgaccgtcactcccgcagccgtcatcgccgtcgacctcaccggcgccgcatccacgacaaccgagcgccaacgacgacgatggccggcacttcttcatcctccaacacctcaaccggtcggtctatctaaaccctctcccgttttcaatctctatagttcaaacatcaaacccaaatagaaccacccgactagatctaacctaggtgatcctagtgcaaagtttaacaatggtatcagagcaaccctagtgtttagatcgtttcggggaaagaaatccaaagaaagaaaagcacaagatccgcacggatcaaaagaaccaaaaaccctaaccctaattcttacctcgtcgccggccgtcgttgacgccggcaacggagggggggaggggcaaagaggcgccgcctaggagccactcgacggccgcgcgcgcacctgcacgcgcgtgccggcgagggggcccgcggcggcgccgccatcttcgtagtcgccatctctctctcacacggtgggggttagagacggtggggggagcggagaagagaaaagaaaggagcgccggccatggctcggcggcgcgaaggtcccgggcgatgccaacgcagtcacatgcggtcgcgtgagagagagaagagaggagaagctagggtttcggcggccgcccggggcacgaggggttttgatccccgttttcggcgcccggccgtccgatcgcaaaccctaagatcggacgtccggcggcggccggaccgaaatcggcccaagtggggagcgcgcggcggcggctttcccggcccaggcccaggttgcggcctgggggaggggagggggcgctcgcccgcgcgcaaggtggccatgggccgaccggcaaaggccggaacaaagtccatattaggtccctccggggccgaaaatgaataaaagagaacagtagcaatttttccattttattttgtcaattttcatgcaaatttcaatagaattttgaatagatttttgcatgttttacctctgtttaaatttgaaccaacgggagaattttcacagagagagaattacagagatttagctactgttcatatgattttatatagtcttccgctgcaaatagatgaaattgatgaaaattagtgtttctaaaattaaatttcgaaccaacgggagaatttaattttaggaacattaattatgtgctatgatgttgtaattttctgaccaacgttgttaattgcaatattatagttatggttatatgtgttatgtctaattctgcccaacggtgatgtaggcttaatgcataatattttaatgttaattttgttctcaccgcacatgattatttcaggtggctact

SEQ ID NO: 14745 - DNA, 1501 bp, Oryza sativa
tttggcttatgtggcgctgacgtggcggtgctaacccggttttcattccacgtggcgcttatgtggcattaaaattaaaaaattatttgtgggacccatctgtcattcatacacaagaatatattatgggacccaccgacatgtgggacccacgtatcatcctttctcctccccttcttcctcctccctctctctccctcctctctcttttctctcccccttttctctgatctgatctccttcccttattcggtctccgccggatctcctccgccctctgcgccgaggtccacggccggcgtcgtcgggccccctccgccgcgttgctcccacggcgtcctcggctccgagcgcatcgcctcgtctcaacgccgccatcgacccctccgctccctgctccgccatggcctgaccaggcgaccagctcccgtgacgtccatggccggatgacgacgtgctgcgctgctgccatatatacgatcgaggaaggttggagaggggaataacaacgcgtttgtcagattgctgtacgcgtaatatcggccgtgtgcccgtgtctatgtcgtcgagctgcaaatggcgtggaatctccccggtgatacaatgttgctttctagtttgactcgatccggccatcttgtgaaaagatggtgctgattgatctgagagaaagacgccattcgccggagaccagggggatgagcgcccgtcgccgaccggcgcccgccctggagggcctcgccgccagagccgggtgtttgcgcccgttgccgaccggccgccggccatcctccgcgagccaggacggttcgggctccgccccgcttccaccaccaccagagatccacgccgcgtcgccgccgactccatctgcgccgcccggcctgctctcatggatgccgccgcccgtcggtcaccacgcacgccggtctcgccgagttgctgtcgagggaggccgaagaggcgcccccgggagcctgctctcatggatgccgccgcccgtcggtcaccacgctcgccgatctcgccgagttgctgtcgagtgaggccgaagaggcgcccccgggagatcagatcagagaagggggagagaaaagagagagaagggagacagagggaggaggaagaagggaaggagaaaggatgacatgtgggccccacatgtcggtgggtcccataatattcttgtgtgtgacaaatgggtcccacaaacaattttttaattctaatgacacgaaagcgccacgtagaatgaaaatcgggttagcaccgccacgtcagcaaaaccgtcctgtaaaaccgttggaggagtcaaattgcactagtttcaataattcggggagtcatcctatccggtgtttcagttaatggtcaccaattagatttggtaaacaattaagggagtctaagtggactttttccaaaaaaaaaaaaaagaagggaactccgggtcgtgttcaggcccaaccccgtgcgcttcttgggcccggaaggggagcag

SEQ ID NO: 14746 - DNA, 1501 bp, Oryza sativa
ttctcgactacgtcatgtctctacggtcctcgcaccaggaacgacaacaatctcgacacaggaagtcgcgaatggttacacgagctcatttaagcagaagtcgggggctactgtcagggttacgggttaggtataccctttactctttgatatacgtctcatatcggtatggtatacccacgcgtatacggatactctccgcatatattaaggaaacccctcacggagtttacaaatggaaggagtcatactcggacaagactgggtcatcaatgtatcgtgtaaagttcgatgtttccgagttctacttggaaaccgcctaacctgtgatataaaagggaccccccggggagggcctgaggcatcgaatctcagagccaacacaaccctcacagcatatgaagtcggagcctacaaggagccaaaccgctagggatctagtcgaaccaactcgactacgatctcgccggatccgtcgatttccattgttccctttgtaacctgtgttttccatcatataatcccacatcaactggattagagctattacctatcaaggggcctgaaccagtataatctttgtcttttgtctgcttgatgtcgtattacgtagatccttgtaccagcgtaccccaataacctctatatccggcctacgggtatcacccatcgacaacatgcaagatcaaattcaacttctacatgttacaacaaaaataacaaattaaactgaaaatagttatcgcatattcgcaactatatttgttatttttgttacaacttgtagaaattaaatttaaagttgtttgtttgtggagtgatatatctttccccctgtaactataagtggattaatcgaactgtaccgctagcatcctgtagtgtagcaaagttagctagcagttctacgcgggaaggaatcgctggttttcttcactgacccgttatctgacctcatcgacatggcaaaatgaagagccaagccaagcgtgttgacctcaaattattgaccttaatcacttactttaaccatttatctgtggtatttttatctcaacgatcatgcatgaacgcaaaaaacaaacccaaaatatattgtacgtgtaggtgcggctaggtgcacactcctgcacaagttgtaacttactccctccgtttcacaatgtaagtcattctagcatttcccatattcatattgatgttaatgaatctagacatatatatctatctagattcattaacatcactatgaatgtgagaaatataaaaatgacttacattgttaaacggatgaagtaattccttggatgcaaacgctactaatacaaaatgtttgtgctctctaatcgatgaacatattcgttcaaaaaaaaatgatgaacagatgacaaagtcagaactttaatttgactttaccttaccaggctgtacatacttgcgttgtaacctctgtagtaaactgcactagattagccttgataactgataagcattgcagatc

SEQ ID NO: 14747 - DNA, 1501 bp, Oryza sativa
taacattaggatgactgacaatatcatcttggacaatatttgccaaaaccttctgttacctgatgtgttacagagtgatttctctgctggattaatgagctagttttggaataggtggcaatgaaggaagctctctgttccttttcagaaaaatggaagtaagctcgcttgccaagccagcgaaaaattccttggctaccacctactagtcagtaccactaccactgtataagcaaggataccttccttctctccctttccctccaaaattctcatttcttctccttttccctccaaaattctcgcttcttcctcgtcccataaattcaaggacactgactagctactccgtttcgtgctcctttcacgtacgtgtgtggccttgccgagccatgggcaaccgcccgttggcgccacatgcgggcggcggcggcgagccgagacaccaagacgaatgcttccggcatggcgtcgcgccccgcgacgaagccgtggcagaagcacgcgccgccgcgacggccgtcctatgtgcctttgtggcagagaagggtggaggaggaggaggagaagaagaagcagcgtcacgccgcggcgccaccgcgcgcagccgcgccggaagaacagcagcaggcagagaagacgccggtagtggtgctagccggagaacggccagccaggactatcaccatcccgaagacaaccgtgcgcaccggcggcgcacccgggcgacggcgacggcgcagcacggccgctgacaccgagtctccactatcagatcaaaatgaagaggaagccgctggcgttctgccacatcctgttctacatccacgtattgcttctgatcatcgccgtctgcctggccaccgtcgccgtctccctcgcctaccaccccaagtcaccccggctgagagtgacctccgccaccctgaacgcagcggcgcacatcgacaaagcgcggcgacagcgcgcggcgggcgatcagcgccaacctcaccgtcctcgccgccatctccaaccccaacaccaagatcggcatcgtgctgcgctacgtgcggttcgacctctacttcgaggacagcgtggtcgccgcgcaggcggtgtggccggcgccagtgcaggtggcgcccggcggcagcgtgccccggagagtgcacctggtggtcagcagtgtgtccgtgacgcggcaggacgcggccttgtggcggaacgcgacggccaagggcggcaggccggtggcgctgcggctcgccggccggttccgcacgcagctcaacttcgaccggtggttcttcaggtacagatactgggtcaagccgcagtgcacgctctggctcgacccgccgccgagcggcgcactgcgacgctcgcggtgctgacccttttgctgctcatcgattgcatttcacgggtatattagaacgaattagggatatctggtagaatattggttgctctacttgacaaaatgtgtaaatatgaagtaaaacagagtatttgtatg

SEQ ID NO: 14748 - DNA, 1501 bp, Oryza sativa; identical to SEQ ID NO: 14745

SEQ ID NO: 14749 - DNA, 1501 bp, Oryza sativa
ctaatacaacataagcgacacgtcgacacacgtgggacaaagaccgggtcaacaccgccacgtaggcaccacttgaaccaaaaccgcttccaaaaccaccaaaagatatagtttgtatcggttttgatagttagagtccatatacccagttttgtggttgaaggtcatgaatcatactcgggccatacttgagggagtcaaagtatactttttccctgctatcctcattatgcctatccggcccgtagatcatagcccaaaagaagcccaacagggcagcagcaagcagacacagactcaccctataaagacacacacatatcctactctagatgtacattcggaagattggaccaaattggagtggcatataatatagttatatgctatagcgcatgattcggatatgatatttctaaaactgtgaatgatgcaatttttaggtggattgtttgacaaagttctatttggacaatatgatttgatattctaatctatttattttatattataagtcgttttgatttttttagttaaaagtaaatttatagaaaaatatagtagtatttccaacacaaaataagcatattactccctcccccgcattcaattagacacggtcaaatttagcacggtttccaaaattaatttttaactctaaatttatcatatattacaatgtttgtagcaacaaaatcataatcatataaaatatattcaatgttaaattcaataaaattaattgttttagatattgctaaatttttctatgatactgatctaacttaaaaaatagtttgaccaagaaaaattcaaaacaacttataatataaaataaaactgagggagtacaaattagtacggaaaacaatcacggacacagggacgcttgacggcttgagtaaagcaatcttgctaattaattcatcgtatgcggaaatacactggctgatatccaaggcaacgaaagaacaaggatcacatactgcaacaaaagaactggagtagtagaaggctagaagctagccctaccaggtgacacgcaactttcagtttatactgtacgtacggtgctttgccaccggcagtacagtagcctccaggtagcagagatgcgttgcttctctgtaacgagcattagctgttatgtcactcttcctaagcttgctttcatccatctcaagaaaacggcgttcctgcacctaatgcactaattaccctatactcagtagcagaccagagtgagaggccgagagcaatgccaggtgcaaaaaccatcttaaatcacacgcaaaaatcttgacttgacaggcagaatcattcatcatttcgtcaaaggaaaactcagctaccaccactgcactgtaaccaccgagacattcagaattaagcaacgaattcgatctgaaagtgcatgtctaggacaattaatcattagctcaaaggaattgatcagctggtgtgtttcaggcaaacaagtaaacaacagaattcagtagta

SEQ ID NO: 14750 - DNA, 1501 bp, Oryza sativa
tcaattagcatcagatcaacaacaatggaggaatgcagtggattatattacgtaccttgtcgagctcgagctgctccttgagggggacctgggggccgagcacgacggcgcgcttgttgccctcctcgtcctcctcctcctcctcgacgtcgttcacgtcggggttcctgcccgacgcggtctgctcatgctccttctccttgtccttactgtccatgggcgcgcgcgcgcggccggccggttggtggtggctcgcggacggacgacggcggacggagctagcgaggtagcagcctacagattaaccgatcgatcgcgcgctgcggtgggtggcgctccgtatgtatgggtgagggggagggagcggctgggcgcgaggggtggagggccgcgggatcgatcgagcgcgcggtggtggtggtaagtacgtggtgtgcgtcgcggggggcgaggaaagggtcgtggcgtgcaggagaaacgcgcggccgcggcgggacgggagagggtgccaagtgtgcgcgcggccggcgcctccgcggcgcgcgcgcgcgggatgtccgctcgatcgatcgctcgctctctcgtcgatcttagcagcttgctcgatcgttggctcctggctgctattgtggttggcgggccttttgcgttcgagttcttcctccctctctctctctctctctctctctctctctctctctctctctctctctctctctctctctctcgtattttcccatgttacatgctctctcttgcgctccatatcctcgctcctcttcatgcaacgaacgacttcattaacgaactttaaatgatattttatcttaaattatacttatctaatatgtaatccgaatacagcgccctatttgttacaattaaatctctactagtacaaaatatcatgtaattatattctaataaaaaatgtttagatggttaaaatattgtgttttataccggacagtgaaatatttcaacagatattttattgtgacgttgcaattactaaaacgattttgctatacatcttacaagtgattttttcactagagagaaatcacccgacaaaatggatagacagtttcctttgatcatgtgacgtttgattatttttttttcgccactagtcagacgcccgatacctagctgcgtccaatgttttagaaaggttttcttcatggaaactgtagtcatcagatttattgtaggaaagcaattgattttttggaaggcatattatctccagggattcaaatcgattttacattagggggaggtgttaacagactggactctggagtttggacggtattaaggcctactcaggctctcggtccatattacaactgggcccaccaagttcgtgtacaatattgtactaggtgggctgagcaaagtcgagtcagctaccagattgggccgggccgagtagcacgaaaaccatcgcgtgcacgaccactccaaagttgctggaagtccgggacggcgatggtcg

SEQ ID NO: 14751 - DNA, 1501 bp, Oryza sativa
gcacgcatgagagggtggcaccgcacaacgccgggagacgaagctggcggatcagacgagcgagcgaggggcctcccgcgggaggcacggtggaagtagcagcgtcgcgtcgcgtatgcaacgttttcaccgggcactggccacgcgactgcacgaggggaagcggggtgggaattgggatggggtgtggcagaaacggccgggggacgggcgcgcggcctgtggccagaggaagctagcgcacagcggggaggagcgcgaatgcacgatcggttgggcagcacgcaccgtgacgcccgcgcggatcggtagatgtcgcgcgcgcggtcagcgtcccgcggacgaggggcgaaccgtgcgctgcgccgtgcgcggctcgggccccggccactttgatggtggtggcggctgggagagcaggttgccctgcttgtcacgctctcggtccctcggggtgggatgggcaaagcagatggacgggcgagcggccgctggagaggaggcagtttggatttctcacgttgctgcaaccacgtcactgccgagtaccgactgaactcgggtacaccagaacaaattaatcaaggtcccgaacgcgcgatcaagcaaggtccaacgcaataatggcgagtgaacatataatgtagtactactactgtagcatttggaagatgatgctgttaagggtttcgtattaacagttatacgtaattcgtacagattctgtaatctgtagatacgatccttgggatcaaatcctgattagttacttgcttatttccgagagtactgctacacgtactaaaattttcttacaaaacttttactaacaaatttctcaaccgtttgatttaactagatgaaagttgtaagaaatctagatttactcacagtttgacatatcagagtttgtaaacattttgtaagaaaaatttagtacgtatagactttttctatttccgatagcttaactttcacagcatgtctgatcccgatcatagataacatgtcttctatatactactagtatatactaagagattgtaccgtaaaagttctctttacaccaaatacatcggttgaaaccggtaatcctgcccgtttagccaaaaactgacaaactcctgctctaacatgtggcagcgttgtatcgggtagcatgatcgtctctgttttatcgaccggttcccatccgccaaaacttcctcgcaaaatttagcgctcaggccattgatggagagccgtttcaatccagctttggtgagcatcacattccaaaaaaaaaagtatttttggttttctaaactgaaaataaaaagtgaaagactcatccctccaaccgcctaaattcaaccgtctaaaacttaaaaatgggcccttctgtcaaactactaatagaatattccatttttttctttcacacatgtaaggatcgctatctcccacgcggtaactggagagagagaggcggagtgcaagattgggagtgagtttcacaccc

SEQ ID NO: 14752 - DNA, 1501 bp, Oryza sativa
aagaaggcaaaggctagtttagattaagggaacagaacctgcggttgtgatttctctgtactgctccatatggcattggacggttggaattgattgatgtaatcactgttgctgtaatctcttttcttaaatactgaggtgtcagcatttatgtctgaggctttgacgaatcggttgccggatctgaagctggatgcactagttgcatttacaagtgtgtatggcaccttgtagaagctttgtagaactgtacttaaagtaaactccatattttgtgaactatgatgttcagtgttcgctccacatgatttgtgttcgctccacatgatgttgcggttgaaaaaaatttcacatgatgtttgtgttcgctccacatgatgttgcgattgaagaaaatttagtttagtgttcgctccacatgatatgttgcggttgaagaaaatttgtgttcgctcacataatgttgcggttgaagaaaatttagtttgatgtttgtgttcgctccacatagtttgatgtttgtgttcgctccacatgatgttgcggttgaagaaattttagtttagtgttagctccacatgatatgttgtgattgaagaaaatttgtgttcgctccacatgatgttgcggttgaagaaaatttagtttagtgttagctacacatgatatgttgtggttgaagaaaaatttgtgttgcggttgaagaaaatttagtttgtagtttctcttattataagatgctccacgctttgctgcgaatatatgatagatatgggagaaataatgaaatactctctccgtttcaaaatgtttgacaccgttgactttttaagcacgtgtttgaccattcaaatttaaataattatttattattttcatatcattttattcattgttaaatatactttcatgtacacatatagttttatatatttcataattttttttaataagacgaacggtcaaacacgtgctaaaaagtcaacggtgtcaaacattttgaaacggagggagtaatttggattaaaatattatgaaaataatttgagaatgatgatttagcatgtgtatgcttacttttagaatgaaataaattatagatataattaatatatgtttgcatgttgaactttgtgtgttaaatgagttgatgtgacatgtttgcatgtagattttaggagtgttaataaatattatgtttgcatgttgagttttagatatttagtggacattagttttatagaaaaaatggatgaaccgtttagcatccagaaacccttactttagatgtactactcttgcgtgtgttatcagaggaaaactttacccaaattataagatttattataatgaaccgtttagcatctagaaaccttactttagatgtactacaaactgcttaggaagagaggataaagagaaaaaatctctcagtttttttattgagattgacttatgcacaacaaacaagagagaaaaatgaaaactcaaaacgtttgga

SEQ ID NO: 14753 - DNA, 1501 bp, Oryza sativa
aaaagaggggtggaggccggcacggcacatggtacgagattcaccgccgccgccaactccaccctacaaaccctaatccgatcgagagggggcgcagccagtgacgggaagcgccaccgccgcgccagacctcatcgccgggacatctacgaccgtcactcccgcagccgtcatcgccgtcgacctcaccggcgccgcatccacgacaaccgagcgccaacgacgacgatggccggcacttcttcatcctccaacacctcaaccggtcggtctatctaaaccctctcccgttttcaatctctatagttcaaacatcaaacccaaatagaaccacccgactagatctaacctaggtgatcctagtgcaaagtttaacaatggtatcagagcaaccctagtgtttagatcgtttcggggaaagaaatccaaagaaagaaaagcacaagatccgcacggatcaaaagaaccaaaaaccctaaccctaattcttacctcgtcgccggccgtcgttgacgccggcaacggagggggggaggggcaaagaggcgccgcctaggagccactcgacggccgcgcgcgcacctgcacgcgcgtgccggcgagggggcccgcggcggcgccgccatctccgtcgtcgccatctctctctcacacggtgggggttagagacggtggggggagcggagaagagaaaagaaaggagcgccggccatggcgcggcggcgcgaaggtcgccggcgatggcgacgccgtccacgcggtcgcgtgagagagagaagagaagagaagctagggttttcggcggccggccgggagaggggggtttttgatcctccgatctcggcgcccggccgtccgatcgaaaccctagctgatcggacggccggcggcggccggaccgaaatcggcccaagtggggagcgcgcggcggcggctttcccggcccaggcccaggttgcggcctgggggaggggagggggcgcttgcccgcgcgcaaagtggccataggccgaccggcaaaggccggaaaagttcaatttaggtccctcggggccgaaaatgaataaaagagaacagtagcaatttttccattttattttgtcgatttttcatgcaaatttcaatagaattttgaatagatttttgcatgttttacctctgtttaaatttgaaccaacgggagaattttcacagagagagaattacagagattttgctactgttcatatgattttatatagtcttccgctgcaaatagatgaaattgatgaaaattagtgtttctaaaattaaatttcgaaccaacgggagaatttaattttaggaacattaattatgtgctatgatgttgtaattttctgaccaacgttgttaattgcaatattatagttatggttatatgtgttatgtctaattctgcccaacggtgatgtaggcttaatgcataatattttaatgttaattttgttctcaccgcacatgattatttcaggtggctact

SEQ ID NO: 14754 - DNA, 1501 bp, Oryza sativa
tgcgttcaaacgggcggatttgcccccgcaaatctcgccggcgccatcgatggcggccgaccccccgcgccggtttccttcccttccggccgctctctcccccttccaaccctatttaaaccctccccgcacctcctccgtccgtttccgcctctcgccgcccatcctcctcgccggattcgagctcgcgacgtcgctctctctctctccgccatcgccgccgagctccggtccgccgccgtcgtcgccccggaccgcctccgacctcggcgccgcctccttcgggttcgccgcatcctcgccaacctcgtccacctctccgtttcggtcgccaaccgccagaacgccgtcgaccccgtcgactcgagccacgccaccgcctccctccgctccggccgcctcctccgtcgccaccattgccccggggtgagccatggaccgtcgcctcctttcccccttccctcccctctctcggccgctgctccgccgcgccggtggtcgccggcggcggccatcggggcgcgggcgcgccgtctcccgccgaccgtgccggcacggccaccctcgggcgcgccgagtggctgccgcgtggggcccggccgtcagccgcccgcgcccttgggtgcggctgacgcgtgggacccacggcgccggccggtgtgagcccgggtgcacccggtccaccgtggaccgtgaggctgccgcgtgggccccactctcgtggacccggtccgcgcgccccctcccctcggctgacgcaataaaccctttttaaattaaattttaaatgaagaaattcgcaaatattcatttaaagagcatataaacttcaaatggccgtaacttggccatttgaactcggaattggaccgttcatgtctctaatttttccttaagaagtcaagaacccatttttgtgctttgttcctgctttttatatggagtttattatagtaaaagccttttcttttccattggtcgtgtagacgctgcagcttcggaagatccgctcttcgtggaggttgaagccgacgtttggaaaagcgagcaaggcaagtcacatcatccttgaacatattgaatcccagtttataaaattattttgatttaaattattgcattatcgctttatttaaattcccgcgttatcactgttttatctagccatgcctatttacctttgttatgaccttattattgttattgttattattaccttgttcaccctagaataaacaaaaccccaactagtggacactctactcatggtaccactagtatgattttaggtagatgcttcgctggttaattaggcaacattaggtggttttacaactctagactttgggaatattctcaacacctggacactatgggatggttggattattatggaattggattcacacctccccctctattcaaaaccctcaaaatggttttagggtgggctcggggtgcatggttttgatagtagcacctcggccatataaggaccggt

SEQ ID NO: 14755 - DNA, 1501 bp, Oryza sativa
tttggccattatgttctgagattttcagttaaaacctctactgattcatgcgaactcttccccctacctttaggctttagtcctctcatggttcctgaaatcagaatcgatatttgagttcattcctgtattcctcactcctcgcagttcgtttttttttttccgaataagaactcctagcagttcggcagttcgttgcttagcctcatctggaagactggaatgaccgcaaaataggttttctgttttaacagatcgtacggctttgaacaggtttaatttgcgtctgatcaaaataatgaacgaagaaaaaaaattcagaacgttaactgaaaagaaggagaccaaaggatgtcggtctgtcggagtttgaaactccaacccctttcccatcacaaactccgtctcctcgctcgctccggtcgctccactcctagctagtggtggaaaaaaaaaaagcttaggctcatgagctcagctcgggcttggctcaaccttggttggcttagctcggctcgtaagcaaaacgagccaagccaagccttcttttcatctcattgctgaaatgagccgagcccgagctggcttgcgagcaacttcttttggctcgcgagcctagaccatcatgtgtttatatcgattattttattttttttatggagatattatttgtcaacttgaaatttaccattaagattttgaagaattgaaacttatttaaattttacatgttgatgattgttcttgcttttttttaataattataaaatatatatgaagaggtgtttcaacatgaatgctagccaggaaacgagccgagccgagccgtgctcaagttttacttgtttccctaactgagtcgagccaagccaagccttgtttgttgcgagccactgcgagccgagccggctcgtttccaccctttcgttgttccttactccttagaccttaatcatcctgcagagaagttcagattggaggtgttgtccaagtgcaaagcagcgaaatccatttgaaaaggaatcatcaaatatttttttccttccgtttgttgaaataactgcaaattgcaatttattaaattcttttattagatcatttcacccgtatcagacgaattttaacaggttcaatttgcgtctgatcacatgaacgatgaaaaaaaattgtagaaaattaccttgaggaaaaaaaaaaggagaccaaagaggttcggagtttaaactccggaccccactcctatcgcatactgcgtctcctttgcaggggtaccaagtgctaagcagtttagagaagcgttgattcatagcagcagctgatatcctctcgtttgttggtctgtagtgttcaaagaattaaaatttcaaatcatggcaagaccaaaagtgtaaatggcagacgatgtttgatggtttcataactgcctagtgccactgcttgggaaatgttaattctcttcgcaatgaatcaataggagcactctcaatataatgaatcaggc

SEQ ID NO: 14756 - DNA, 1501 bp, Oryza sativa
ccaccatcgccggcgggaacgcctccgccagctcggcgttctcgtcggtgacgtgcgccgccgggtggtcgcggtcggcgcccaccggcaggaacgccttccacgagaagtccgaccgccggaggttcaccaccggcgccacgccgtcgagcgccagctcggagggcgtcctctcctcgccgccgaagtacggctgcacggggatcatcccagcgaggcggaggttcttggccgtgggctgccacgtggccgcccagcggttggccacttggtgcacgatgttgccgccggcgctctccccggcgaggaagcagctggcgaggtcgacggggacgacgtcgccgtcgaggcccgggatgccgttcccgtcgaggaagcggagcgcgtccacgccgtcgtcgtaggcggcggggtagcggtgctcgggcgcgaggcggtagttgacggagacgacgacgacgccaacgtcgccgcacagcctgcggcacacgccgtcgaacggcgccaccgccggcgagaacagcgcgaacccgccgccgtggtagtacaccatcaccggcatcggcgccgccgcctgcgccgccgccgcgggcgcgaacacgcgcgcccagaggccgcgcgcggcgtcgatggtgaagtcgaaggagcggacggcgccggtggcggcgtccggggacgggtcggcgcggacgctcatcaggtgttcgacgaggacggagtagagcgcgcggttgaccgtcccgtcgcgccgctccaccgcgtcgatcgccgccgagagcccgatcagctggagcctcaggcccagcggcataggcggcggcggcggcgggcggcggttgctctcgccgccggcggccacgtccttgcccatcttccctcccattcgcgagcttgacgaacactctcgttttcttctctcgctttttcggtgtggatttgtgagtcgtgatcacgcaacgctgtttccgaaatgggcacgttatcgccgtcccgtaaatgaggagtacagtgattgtactaacgtgtcgctgtcggcgatgggacacgttccaaaaaaaaaatatttttccatccatttcacatgtatcaatacaaaaccaaaaccaaaagaaaatttaaaataatcatcgcttcatcaaatcctaatacagttatttatctactcctaatacatttattctttacttcctccgtcccattttcagtgtagccatgattttttacgtccaactttgatcgtccgtattatttaaattttcttaaaaaaaattgaaaacataagtcacgagtaaagtgctattcatattttatcatcttataactacaaaaatattaattataaaaatttttcaaataaaacggacgatcaaagttaagcgcgaaaacttatggttgcacttaaaatgggacagagggagtatttttcacaaatttcggtgtgctaacggtaaacgggaaagttgaagtttggaattgagaaaaaagaactgaggccttattt

SEQ ID NO: 14757 - DNA, 1501 bp, Oryza sativa; identical to SEQ ID NO: 14755

SEQ ID NO: 14758 - DNA, 1501 bp, Oryza sativa; identical to SEQ ID NO: 14756

SEQ ID NO: 14759 - DNA, 1501 bp, Oryza sativa
actattttcttgctcgattaagccatccaaagtatttcagaaggtacgcacttcaccaaaattagtcttatttgtttagctgcaactttgtgaaacttttgtgcaagacttacaaaaaggttcagttagcctcacatgctgttcatttacattagtgtacttcccttttagtctgtattagatcattactgctattctggttatgtttttaacatataccttgggatttatgagactagctattgagccctgctgttattatttttgatgcatactgtagtataagtggcacactagcttgctcttcttgttctgtaaagttatactttaatgaacatgtgaacacccagatctacacatgtccagagactgattatacttcccttttaaaatttcaggttcatgtacataatctgctctgatactggggagttaagggaccagcttgcaaaatcgcctcaaaaaatacttgctagcgccttttcacagttctattcacaaactgaagctgctggtaatcaatcttcctcagtgaaggatgagggacttactggtgccataactgaaggttttacaggccaatcatcatcaaacatggctactggttctgacagttactttaatggactggaacttatttcaacccttgtaaaattgatgcctgaatggctctgtaacaaccgggttgtctttgacactttgttgcttgcttggaaatcaccctcaagaattgatcgcctgcaaaatgagcaggaattgagtttaccgcaggtagtcattgatgttcctacttaccttttatttttctcattttgcattttctctttgggtgcctttgtaaattgcccgtttatttgtgtttttgtattgtctcttgttgctgctcttcaattgctagtgacctttatccgggtaacaaattatagtagttctcaagctgaataacttacttgatcggtgatcgatttctgggttccatagttaacctaattggttacttccaattacgtagatttacgtatttctattgctaccctgttccgattacgtaatttttatcttctttcacctgtttaattgccatgttaaattcatgatgcgatatttagagttgatggacaagttgcatacttggttctttatatagaattatttcggggaatcatgatatttaaattttggcatctttgtttactactgctactatctgttatatactgttatctctgccatgctagtaggattatcattctggattttatgatgttctgttcaatgggcaaacactgtccggtagtatgggtgcttattttctcttatgcgcttgatttctttgaattcaatgatttaggttttgctgacatgatgcgtacatgttatctgtgctttacatctcaataaattgctttattaaagtttcttagcatccttgcatctttccatactgcactaatcaagtgtctagacctttggatcttaacaatcttactttctgaacagg

SEQ ID NO: 14760 - DNA, 1501 bp, Oryza sativa
ctcctgaacttctttattccaaacgtcttgcatagattctccacccaaatcgggaactgaagacttcacttgccacttgtcttgccagcttggctcccaacattaagcttctttgtcttgcctccgatttctgcaagttagcccaattttcaataaaatgacatgtaagatatatcagctcaattggatcattgggccattttttatcaaaacacactttgtttctggacttccaaatggcccataatacagctgccaccccccaccatcacaagttgcttagagtgtttgtcaaaattagataaccattatccaaacatatggtttttatctctagcaggtgttatattcaaggcacacaacatcacattccagatcaatttagcaacagagcattcaaaaaataaatgctgtatggactcctccttatcacagaattggcacaatttatcacattttctccaacctctcttaaaaaggttatctttagtaaggattctgttttttaacaccagccataggaaaatcttgattttcagaggtattttaaacttccagattttttttatatgggaatgccacttgctcccttttaagagctttaataaaaggatttgacagtgaagcaaccatgcttttctagattccaccacattttatcttttattccttcttgcaaattcagaagcatccatctctgtttaatccagtctctaagtttatctccatgcaaagtccttctgaatttgataatctcccatcctttctccttcagttttgcaagggtgatatgtctagtatgggtaatgttgtataaagcaaggagctgcaaattcagaggtctgccaccataccaattatcctcccaaaacagattgtttttgccatctccaacctaagttgaacaaaatttcaggaattcttcctgacttccatcaaaccatgctagaaatgaaaattacccgctttataagtcacccatgacaaagttttttgactcaaatatttttccctgagaatggaaattatagaaacgagcgctcgtcaattcgtcattgataaatcatagaatgtcacatatgtatgttggtatgaataatctagagttgagctcctaattggcacagtccgtaaaaagacattcggccttcatggtaactatagtcctcttaatttttatatgtgtacaccgatctcaagtgaggccaaaagatggacagcgcttgaaatgaagaacgaaattaccggtgggcggtggtacaatcaaggaatgatctgcggaaaaataaaaacggccaccactttactgttctcgattaccggcatatgtagtacaccgatcttaagcgaggccaaaaggtggacagcgcttgaaatgaagaacgaaattaccggtggtacaatcaaggaatgatctgcggaaaaataaaaacggccaccacctactgttcaagatttaatttatatgtatatcatgatttgggatagatgcaattggatg

SEQ ID NO: 14761 - DNA, 1501 bp, Oryza sativa
ttttgggacaaagtaatgtgctagaaatagctactcccttcgtcccataatataagggattttgagtttttgcttgcaacggttgcacactcgtcttattaaaaaaatttaaaaatattatttattttatttgtgacttactttattatctacaacactttaagcataacttttcgttttttatatttgcaaaaggaatttgaataagacgagtgatcaaacgttgtaagaaaaacttaaaatcgcttatattgtgggacggagggaatacattttagtacggagataatatcgcggtatcggtgtatatgcatccgtttcggatactgcaattgcgtacccctacagtatgtgccgtgtcctattgtatctgtatgcaccgattgctgaaaccgatgttgttcaaatcggagggagaacgagaattcatgcagggcggtgtcaaatcactggtctaatgacaaggggatgatgcggaaggagtgaggcagtaagcaaagagattttggagcctgtactccacgttaacccaagctatctggtgctccctgacgcacgtcaatcagatgctactactactaccgctgcgtcggctagctccagaggaggccgacgtagaagtacttcacgtaatctaggagtaggggtaggagcagctagcgtctgatactctgatctgagagggttcagacttgggagtcgctttgtgctttgaatgccagtagtcccagctgactgagagccacgccatccaccgtatccggagatactacagtacactccaattacatacaggtacgtggagtactcctaaattcctaatcctatactcttaacatggatgagactgaggggtgtttaaattcatatgtaaagttttagcgtgtaatatcgaatattatatagggtgtcgtatagagtgtacgtatactaataaaaaaactaattacagaattcgttagcaaaatacgagacaaatttattaagactaattaatccatcattagcaaatgtttactgtagcactgtcaaatcatggagcaagcaattaaggttgtgtttagttcacactgaagtttgaaagtttaattgaaattggttgaagtttggagacctgttccaaagctttttttctcaaacttacaactttccatcacatcaaacctttcatatacacaacttttctatcacatcgtaccaatttcaaccaaacttctaaacttcagtgtgaactaaacacagcctaaacagggcctaagctcataagatttgtctcgcaaattagtcactgtcagggttatggataccacatacataatagttgttaactaaatctcggcaggactcaccatataccatgttctatacggaaataacctgcggatacagaaggagttccggataaggaaagataaccagagttctatatgaaaacgacaatgactactcggattgtatccatattggtttccctatttctacttggacaaggagacaccta

SEQ ID NO: 14762 - DNA, 1501 bp, Oryza sativa
tttaggtgtattaaaaatatgccttcaaaattgacgatcgatcgcagcgagtcgtgcttctatgcttctaaagaaaagaacgcacgaaaattgaagtgcataaatggctcggattaaaagttactccagtttacatgacaaacatcattagagaggggcattttcgtccatggaaaattttttcgcgaacacaaatgagaccaatctagaaaggactagattgattttgaattaagaagggggtgaggctcaaacccggaccggctagctcgcagcttgtgttgctagtcgggaagaccccggacctttctccatgggaaaattcagtccatctccagccatgcccgtcctggcgccgggagctcgcgctgctcgaggcgacgcgagcggcggtgggagctcgaggcgaggcgaggcggcagtggcggcgaaggaggaggcgagcgcggcgggcgacgccatgcgcgacaaccagccccagcccgcggccgcgcccgcgatgaagcggaggaacagatgggaccaatcgcgtcgcttgtcgtcgtcgctcgcgccgcgcgccgtcgccatctcccctcgagccctgcccgtgccgcgcgccgtcgttcgtcgcccgtcgccgtcgtcgcctcgagcctcgttcgcgcgccgtcaccccgcgccgccgcctcgcctcacctcgagcagcgcgaactcccgctgccgctcgcctcctccactgccttgccccgccgccctaccacctagtcctcgcgcgccgccgaccaccgcgcgcccacgacgaggaggagcccgcggtggcggtggtgtcccaccacgtgtccccatgcgcccacgatgaggaggcacccgccgcgtgtccccgcgcgcccggtcagcctccgcctctgtcgccactcccctccgtcgcctctgccgcctccgcctccgcgtcgacattcgagccgtcctcgctaaccatcctcgctgtgcacgctgcatgagccgcgagagagaaaagagcaagagagagaatagaaagagagaggaagaagagtatggcaggcgggtctcacaattttttattaaaaaaacgctgactggattgtcacgtgtgcgccacgttggacaaaaccgctctgaattggtttgagggggataattcgcccggtttgcatagttaggggtgaagaatatccatttttttggtttaggggtaattcggatgactgcaaaagtttaggaaggtaattcgtgctttttttccctacaaactatgccccgtccactcgacacaacctgccaccataacggtgaacctgaagcctcccgtagtctcgtggccgcgccggactgccgggacaacctagccgagcgctcccgctggccgctgcctacagtaaagcagcgcgctgcgcccgcctcgccgccgcctccgcagggtccccgtgccttctcgcaccggcggcaccgctcgatctctgcgtgacggcgtgtgaggctgtggggtggtagtaggggc

SEQ ID NO: 14763 - DNA, 1501 bp, Oryza sativa
tccctatagagtctagatcaccacaacgaaggcatgccaagaaaagggtcagcgcttccactttcggagatcatgagagttacacaagaatctgcaagaaaaagcagaccgaaaggaatctaactttatcctccatctgaaatgttctacaccatgttggggttcctaagcttttcctagatcctactggttaatcatactccactttgcccttacctctcacatcacactctatccttcatatccctacctaaataaagcaaaaacaaggaacatttcgtactaaaagatccatccagttacagtagccaaatattttcattcgagtttgtgcatagtattagcagattaaatcatcagaagtgaagtgtggaattagcagcagctgagagatattacctgtttcccctgatcttgaaccaggtctcggcgcactgcttatgggcgcaggagaggtcgtccttgcaggagcagccgaggaacatgccggagccggactcggcggcggcgctctcgaggccgaggtggcagatgcggcaattcctctcggccgtgtccgggctggccttgctgatctcggccagcccggcctcgaggtccacgtcgcccagcgagcactccgacacgcacgacttcctcctgccgccgccgtccgcgtccgcgtccccggcgccggagcggacggacgcgcacgtcgagatgaagtcctcgagggcaacggagccctggcgcgagtgcgaccgccatgagtggtcctccgcgtcggagaagcgctggctccccttatcctcatccgagctctcctccgcaagcccgcctcctcctcctccgccgccgccgacgtggcgggccggctccgcgctagaatccgcggcggcggcgggagcgatcgtcaacgcctgctcgccgtcgttcaccattgctcacgccaaacaaacctaccaaaaaaaaaaagcaattcgagaaaaaaaggaaaagaatcactcgaaattgcttctataccaaatccggacaagagcagagaagggagcaagcaaacaagaatcgccgaaagcgagcactaaatactcactcttgcagttacaggttactccaaagctgacggtgtgccaccacgcaagcaatgcggccgatcactgggagcaaccacccaagaaaaatccaagctgccagtagattctaagctctaaaaaaataacgaattgaaaatatactgctaccgacgaggcatcaggtgcctaaaaaagattggattttaaagctgtttcttgatccacagtggcgcagagagagaagcgagaaagcgaggaagagtcgcgtagctgggaagaatcgattgaacaaggagtaggcgaaagagagaaggggaaaaaagaaaagagaaaacttgcggagttgtggtgctttgtcggggacgaaggggaagagaagaggagaagaaatgaagcatatgagacggtctcttgggtcagcaatgaagtagagaagaccgtgtcatgtg

SEQ ID NO: 14764 - DNA, 1501 bp, Oryza sativa
cgcggctggaagtagcagccaccgactaccgtcggcggcgacaccggctgtacggtgaagaaccaccggaacagtcggagagatgggcgcaccccgataaacatctcgcacaggtgcgcgaagatggccaacgtcattatcgcgttgggggtgaggtgcgccatctgcagatcataaaactccagaatatccatgaaaaaaatagagaatggcgggaccagccccgccattgcgaaagagaggaagaagacggaccgccccgggtagtgtggcgccgggcgtccctcgcccagcgcgaccacctcccggccggtggcagattccggcatgaatcggcgcggcagcccggcctgcctctcgcttacgatgcgggaaggcggcagcacgctaccgtcgagcggtgcggagccccgtgccatgacgccggcggaggaggagcttgagagcgagcgagtgcggcaagggtagggcacaggaaacgaagagttagagcgcaagtggcgaaggcaaggggaagagtagcgagaggaaggaaacgaatcccttcctcggcgtctttacacccttgccaacgctatgcccggctcctcgcttcccgcgcccactacctcgccccctcgtttctcgcgcccacgcctccactaaccccactcgcccgtttgcggcgcacgcggcagatgtgcggccgtggcggttgagatggggcagatcgtgcgcgcattaactacgctcgccaaccgtgaaaagcgccatcatcatgtctccaggcgaaacgagccggctcgttccgattcgcgcgctgctcgagtaatgtagcggtcttaaagaggccgctcattattgtcggtcggttttcccttgccgatgcgcgcgatttgcgaccgctgggtttctgcccacctgtagggaccggccccacctgtcaccgggcctaaggagtggcgtcacgcccgagcgcttccctcgaggggggcgatcaccatggcgtaacgccgggggctactgtcggtgacatggggccgggggtatcgtgactagaggcttgggtagccgcggtcacccacgtggcctgaccccgtcggggggggggggggtcgggcccgagggtgacgtggccacccctccctctgtctccccgaggggtcgggccgctcccgtttcggccccgagggctggggcgcccccgtttcggccccgagggctggggcgccccgaccccctgtggttttggcgccacgtgtgtgggttaggtgagcacagcggggctcacctaaccgcatttatagcaggatggacgaacgcgccacgccgcatttaatgcggcgcagcgcacgcttatccggtccgtgaccggtcgcggtgtgtgaccggtcacagaccagtcagatcgcgggttaggtggcaacaggcggcctgtcacacgcctcgccccgtcccgtcggaatgatgagagcttcctggctctcgtccctagccggagccggcgtgctaactcctggag

SEQ ID NO: 14765 - DNA, 1501 bp, Oryza sativa
gaggagttgcatatacatatttactagtcgtctcttatcctaagccattcgattatggtagtataaaacagtcaaccatttgattaaggagttatttattcgtactcattagtcatctctacccctcttatctacctttaactaatacacatcatgagtaacctgtcatttgatcatgttagtataaaataatcaaggagttacttatctgtatttcttagtcatctcatcctctcctctctacctttaataataactatatggtaacacctcctcatgacctatataataccaccttctcgtgaccaatatagttctgaccaaaataatttagacctctttatgggtggtgtcggtgacatggggccgggggtatcgtgactagaggcttgggtagccgcggtcacccacgtggcctgaccccctcggggggggggggggggggggtcgggcccgagggtgacgtggccacccctccctctgtctccccgaggggtcgggccgctcccgtttcggccccgagggctggggcgcccccgtttcggccccgagggctggggcgccccgaccccctgtggttttggcgccacgtgtgtgggttaggtgagcacagcggggctcacctaaccgcatttatagcaggatggacgaacgcgccacgccgcatttaatgcggcgcagcgcacgcttatccggtccgtgaccggtcgcggtgtgtgaccggtcacagaccagtcagatcgcgggttaggtggcaacaggcggcctgtcacacgcctcgccccgtcccgtcggaatgatgagagcttcctggctctcgtccctagccggagccggcgtgctaactcctggagttggtatgtcagtcccggtcagatccattccaggcttcagtgcaagcatggcaaggaagtcgctggccattgaatgaaggttgaaatgggcgtccaccgggaaagctggcaagcggggcaggaggcgtgtgctctgcttgtcagaggtcacttccggctgtagactagccctcattgtaaaaagcatgtttcctttcttagacagctagaggcccatgtggtgacccctgaccagatcaaaaggaggcccaggcctaggaggggaaaaaaagagaaaaaagagaaagaggggttgggactctggcgaaggggttctagagcctgaactctctctcgctctccggctctctgtattccttcacacacagatccaccagaacacaggagtagggtgttacgcttctcagcggcccgaacctgtctacgtcgcccgtgtcttgtgcacttcctctctcgctgacgttcctcagatcgagggcgaagaacctcacttagcgcccccggccgaaccggcaaaggggggcctgcgcggtctcccggtgaggagccccacgctccgtcatctggcgcgccaggtagggggtgcgcgtgtctttctaagccctcgtcctctttcgtgtgcgccaagcttctcccgctcagcccaa

SEQ ID NO: 14766 - DNA, 1501 bp, Oryza sativa
cacttgcaaaaatcaattttttataggtggcacacttaatttacccacatacaaaaagaatttctagtgtaaaaaatgaaaatctagattttaatatcctccaatttgaaaatcagaatgcaattccaccatcacaaatttaaaaaagaattgacatatcaaatgcaattccgccaagaacttcgtcggtggcatcccagtggcagagtcatcctttgcgcagtggcagagtcatcctttgcagtgtctttttcagggagaagccgatgcagcacaccatcactggcgttgacggtggaaggcgaatgccagccgcaatgaggtctgcattattttggtcaaaacaatatatgtcacggggaggtggaactataaaggtcatgagaagatgctactatcaaggtattattaaggaaaaagcccaaattagccccctaaactattgtggcagttgaaattaccccctcaattcaaaaactgcaccctcaactttttatatggacgaattacccctgacaaacttcggaacagttttggtcttacgtgtcgcacacgtggcagtccagtcagcataaaaaaattaaaaatatagggcccacatgtggtgactaagagaagaggcaaaattgacaagtgggctcctctatttttttattcttttatgctaactggactgccacatttgtgccacgtaggaccaaaaccactctggagtcgatcagggggtaattcgtccgatatgaaaagttgagggtgaagaatgtctggtttttgaattgagggggtaattcgtaccgccacaatagttcgtggggggctaattcggactttttcctattattaaaggtagagaggagaggaagaaacaactaagaaatacagacaagtaactccttgatctaacagatgattattttatactaacatgatcaaatgacttaggttactcatgatgtgtatatgttaaaggtagagaacagtagaagagatgactaatgagcacatataagtaactccttaatcaaatggttgactgttttatactaacatattcaaatggcttagataagagacgaccggtaaatatagatatgcaactcctctatccaacggttcataatatcatactgacataatcaaatatgtttcgatttacttgtgatgtgtatctaattgaaggtggagagaaggggtagaaattactaaaaattaatgtggataagtaactgccttatccaatgattgatgattttatactaacatgataaaatggcatagtatgattcatgatgtgtatttggataatggtgtcgaggaggggtaaggatgactaatgaatggggataagtatctccttgatccatcggttgatatatttgtattaacataatgaaatggttcggcataagaggcaacttataattacggataagtaactccttgatctaacaactagttttatgctaacatgatcaattggataaggattactcatgatgtg

SEQ ID NO: 14767 - DNA, 1501 bp, Oryza sativa
ttttcacaggcgacatgcttaattcacccacatgcaaaaataatttctagtgtaaaaaaaaagaaaatccagatttgaatatcctctaataagaaaattcacagttcaattccaccatcacaaatttaaaaaacatttggcatgtcaaatgcaattccaaaaagggctttgtcgtcgtatcccagcgtcggagtcatcctctgcagcgtcttcttcagggagaagccgacacagcacaccatcattggcattggcgaggcagggcgaatgccacctgacggagcgtggggctcctcaccgggagaccgcgcaggtccccctttgccggttcggccgggggcgctaagtgaggttcttcgccctcgatctgaggaacgtcagcgagagaggaagtgcacaagacacgagcgacgtagacaggttcgggccgctgagaagcgtaacacccaactcctgtgttctggtggatctgtgtgtgaaggaatacaaagagccagagagcgagagagagttcaggctctagaaccccttcgctagagtcccaacccctctttctcttttttctctttttttcccctcctaggcctgggcctccttttgatctggtcaggggtcaccacatgggcctctagctgtctaagaaaggaaacatgctttttacaatgagggctagtctacagccggaagtgacctctgacaagcagagcacacgcctcctgccccgcttgccagctttcccggtggacgcccatttcaaccttcattcaatggccagcgacttccttgccatgcttgcactgaagcctggaatggatctgaccgggactgacataccaactccaggagttagcacgccggctccggctagggacgagagccaggaagctctcatcattccgacgggacggggcgaggcgtgtgacaggccgcctgttgccacctaacccgcgatctgactggtctgtgaccggtcacacaccgcgaccggtcacggaccggataagcgtgcgctgcgccgcattaaatgcggcgtggcgcgttcgtccatcctgctataaatgcggttaggtgagccccgctgtgctcacctaacccacacacgtggcgccaaaaccacagggggtcggggcgccccagccctcggggccgaaacgggggcgccccagccctcggggccgaaacgggagcggcccgacccctcggggagacagagggaggggtggccacgtcaccctcgggcccgaccccccccccccccgacggggtcaggccacgtgggtgaccgcggctacccaagcctctagtcacgatacccccggccccatgtcaccgacagtagcccccggcgttacgccatggtgatcgcccccctcgagggaagcgctcgggcgtgacgccactccttaggcccggtgacaggtggggccggtccctacaggtgggcagaaacccagcggtcgcaaatcgcgcgcatcggcaagggaaaaccgaccgacaataa

SEQ ID NO: 14768 - DNA, 1501 bp, Oryza sativa
acagacctacaaatttagtgtcaaatttatcttagaattacaaattaaagtatcgtatcacaaaactacagatttaatgattaaattataaaagaactatatattttagagtttatatccataacatattaaagtttcaaaagttatagttttgtaataaaactgattttaattctgtagttttctaatataatatctaaaatctatagttttgtgatacatattttcaagaaaaaaaagtacgaattacccctctcaacaatagcagtcgtccgatttttaaccctaaacttcaatactaatttttttatcctgaactttacaaaccggacgaattaccctcctagatcgatccagggtggtttcggtcctacgtggatgcacacgtggcagtctgatcagccaaaacaaaagaaaaatatatgggacccacttgtcagccataacaaataaatatggtggggcccactatcagccaatcctcttcttctcccccctcctctttgcccctcccccctctccatctctggcgcatcaaggcaagtagtggagctcgtcgtcgatctcgccgcctccacggcgagctcgcaacggcgggcgatccgcgcacacgctcgccatataggaggagcacgagcgcgcccagcatggaggcggaaacgagagaggcgtcgccgctcacacgctcgtcgggggaggagtgcggtggtcgttcacggcgccggcagggagagtcgtgggagggtcgccgagggatctcgagacggcggcgagcagaaccgcctcgacttctccgccgtcacgctcgcctcacctcctccactacgcttgcagagccaacctcgccgccacctcgcctcgcctcctccaccgcctgttaggatccgccgcctcctccttgctcggctctcccgacggcaccacagagaaagagagagggaacgaggtggagagagaacctcgccgccacctcgcctcctgcgccgcgaccctgcccgctgcccgttcacgcacgcccgagagagaagagaggggagggggaagaggggtactaacaggtgggtcctatattttcttttatttctttttgctgattgtattttcacgtcggtgcaacgtgtagaagaaaaaccgctcaggattgagtcaaggggtaatttatccggtatcaatagtttgaggtgtaatatgtccgattttgtggttcggggggtaattcgtgttgtcgcaatagtttagggaggtaattcatactttttcctatttttaaatctgtagttttatgatatattgatcaaaatacatgtagttttgtgaaattactcaataaaattcaatgattgtgactgttttgcgtgcaaattaggagtaccgaaccaactaccacaagtgtagcgcagtgtagcacagtagcgaagccaactagccaagccacccccaaagtccaagctggcttcagtcaagcaggcgcatgagcagataaggcgcgcgccacgtccac

SEQ ID NO: 14769 - DNA, 1432 bp, Oryza sativa
ataggggaggggaggcgggatcgaggccggacgtggcggaatcggccggcgaagtggggcgccgacgtggggtggtggaggggttaaccggcgccgattttcgcggggagagtgggggaaatggtggagggacgtggaggggatcgtgcccacgtcgttggatgcgagctcgggtgcgggagggcgccggattttgcggcgacgtggacggctatggcggttggcgtcggccggcgagaggtaggaggaggagctgacgggtgggaccgccggtcccacctgtcggcgaagggagagaaggagggacgcaaaacagacttttgcgagcgggccaaggaagaagggagccggcccgagagagggaggaggcgcgcgggccgcgggagaggaaggagggggaggaatttgggccgaaaatggcccaaagagatgaaggaggattttatttgttctctttttattttaattgattaaatgatcttcgtgactttaaaactatttctcgagctccgaaaattcacggaaaattccggagagtacattagggcacaaagaatattacaaaatattcccggccaatgatttttaagggaaaattttaattctcccattattttacttgattaaattgatttaacttttatttaatttctagaaaatgcattatttaatgatttttaaacccgaacgaaaatcggggcgttacatgcgacagggcacattgttggtgcaggttggatagcgggagaacatggggttacgatgttagggtggtcgcaatgccttaatttgggtgcctcatttcccccatggggcattgctgagaaacatccatctctcccttcatggtgggatcctccaggtaaaaatcttgtctaggtcttgggtgggcgggtgggcgggcgggcgggcgacgtggcgacgtcacgaccttcatggaagcatatattgtctaggagatcacattttctatctttctagtctccaatcgatttggtctacgatggtactctaggatgtcttcaggttatgcgagggatgagttgattctcttctttctgactctctcccataactacctttttcttggggatgttcagaagcttgaagatgatattttgtttagagaagagtagggcgatgcgtttgtcccccctttgaagggttgacaacaacagatcgtgcacaacggtggctagctggtattaataatttgtgtgtataagttgccagcatggggggtggtgtgtttttcttttttattttcttagattatagcctcacaggatataatcttaggatctcatcttttcgcttatgcttatacttatcagccacaattttaatttttaaccttaaatttgaagttgatttttgaggtttttttcatcgaagtttatttttcagcctttgctttcagatcgctaagaac

SEQ ID NO: 14770 - DNA, 1501 bp, Oryza sativa
gaaacaacaacaggagtaaccttgccgccggcgccgccggagagatacaccgtgagcaacctgacggcctggagcggcgtggccgcgcccggcccgatctcgtcgatcaccagctgcatttcacacgagaaaccaaccgctcgacgagtcgatcagctaggtcatccaacacgagaaaattgtcattttaccattgtcaaaaaggattttcgcccaaataccactatgcagttgagattcgccgaaataccattatcaattgaggggcttcgctcatgtcattttcttcgaattctctctttcctctcataattacttaaaaaaaatacccctagtaaaattaattaattcaactaggggtattttggtcagaaaaaataagaggaaagagagaattggaagaaaatggtgtttcagcgacgaattccaactgcttagtagtatttgagcgaaaccctgtttgacgatgatattacgccaattttctcatccaacacacagggcgtgatcaatcgatcgatggacacgtgcacgcgatgcgtacgtacctggtgggagccgatggcgatgtaggagcggtagaggagggagtcgcgctcggcgagggcgtcgggggagagggcagcgcgcgcggggatggcctggacgccggtgatgacggcctggtacgcgccgacgtagaagctgttgcgaaggccgaacaggtggtccggcgacgccgcacccgccatgcttgctgctgctgctgcctcacgtacctcactacgtgccttcgcgcggccgtacgtggagacgatggatcgatcggcgagcgagctagcacgcgcgcgtccgggagcccgggaggtatggatctcgtcgaggcgaagcagtggtggccagggagtgggggtaccgtgccgtgtacgtgcgcgcgttacgtggttacgcaaagcgcatccccgctatccgagaccgagagagatgatgactgatggtgcctggcccagtttggggctcgggctgatgcctgatggtccatcaaaagttctcttttttgtgaaaaaggctcgtcaaaattctagcccaaaaccaactaggccttgttctctatcccagcccagtctatgcggatacgccacatatttctagctaagagagtactgcatgttcggtaaaactccatctcttataaatttaattaacttcaggagttgagtatagaatagagctatgaagtagcttaaactttacttcatttctttaatttattttgtgatagaactctaatcagttcatccacttcctttttaagtgaagcataaccgtttgatagagctgaagctgtggcaaatatactctaaatattgtaccgattccaacgcttatcctctcaagtttgttcaaaagtgtgttttgattagtaccaaaataaaaccattatggtagcatcaattaaggaggttattaaatgaatcatgtagatgtaactaggatggccctgatgtggatcgatgctaga

SEQ ID NO: 14771 - DNA, 1501 bp, Oryza sativa
cggattctggcatgaatcggcgcggcagcccggcctgcctctcgctcacgatgcgggaaggcggcagcacgctaccgtcgagcggtgcggagctccgtgccatgacgccggcggaggaggagcttgagagcgagcgagtgcggcaagggtagggcacaggaaacgaagagttagagcacaagtggcgaaggcaagggggagagtggcgagaggaaaggaacgaatcccttcctcgacgtctttacacccttgccaatgctatacccggcttctcgcgcccacgcctccactaacccactcgctcgtttgcggcgcacgcggcagatgtgcggccgtggcggttgagatggggcagatcgtgcgcgcattaactacgctcgccaaccgtgaaaagcgccatcatcatgtctccaggcgaaacgaaccggctcgtcccgattcgcgcgctgctcgagtaatgtagcagtcttaaagaagccgctcattattgtcggtcggttttcccttgctgatgcgcgcgatttgcgaccgctgggtttctgcccgcctgtagggaccggccccacctgtcaccgggcctaaggagtggcgtcacgcccgagcgcttccctcgaggggggcgatcgccctggcgtaacgccgggggctactgtcggtgacatggggccaggggtatcgtgactagaggcttgggtagccgcggtcacccacgtggcctgaccccctcggggggggggggggtcgggcccgagggtgacgtggccacccctccctctgtctccccgaggggtcgggccgctcccgtttcggccctgagggctggggcgcccccgtttcggccccgagggctgcgacgccccgaccccctgtggttttggcgccacgtgtgtgagttaggtgagcactgcggggctcacctaaccgcatttataacaggttggacgagcgcgccacgccgcatttaatgcgacgcagcgcacgcttatccggtccgtgaccagtcgcggtgtgtgaccggtcacagaccggtcagatcacgggttaggtggcaacaggcggcctgtcacacgcctcgccccgtcccgtcggaatgatgagagcttcctggctctcgtccctagccggagccggcgtgctaactcctggagttggtatgtcagtcccggtcagaaccattccaggcttcagcgcaagtatggcaaggaagtcgctggccattaaatgaaggttgaaatgggcgtccaccggaaaagcgggcgagcggggcaggaggcgtgtgctctgcttgtcagaggtcacttccggctgtagactagccctcattgtaaaaagcatgtttcctttcttaggcagctggaggcccttgtggtgacccctgaccagataaaaaggaggcccaggcctaggaaagggggggactctggagagaaaagagaaaagaaaaaaagaaaggggactctggagggaggagaaaaaaggggaatgggtgctagaccctgaa

SEQ ID NO: 14772 - DNA, 1501 bp, Oryza sativa
gaatggttctgaccgggactgacataccaactccaggagttagcacgccggctccggctagggacgagagccaggaagctctcatcattccgacgggacggggcgaggcgtgtgacaggccgcctgttgccacctaacccgcgatctgaccggtctgtgaccggtcacacaccgcgactggtcacagaccggataagcgtgcgctgcgccgcattaaatgcggcgtggcgcgctcgtccaacctgttataaatgcggttaggtgagccccgctgtgctcacctaactcacacacgtggcgccaaaaccacagggggtcggggcgtcgcagccctcggggccgaaacgggggcgccccagccctcggggccgaaacgggagcggcccgaccccttggggagacagagggaggggtggccacgtcaccctcgggcccgaccccccccccccccccgagggggtcaggccacgtgggtgaccgcggctacccaagcctctagtcacgatacccccggccccatgtcaccgacacctgcatatacatatacacgaacacttgtggaatatgtgagattaagcacctatcactatattggatgttttattatctgaactttatgcagatgttgtcggtatagaatctgcatttaacatccgccaacattcactaaggtttagggtaaaggaaataattagggtaggttaaaagagttctaaagaaataatacttgaaccaaaattaagaataaaaagagttcaaataacaatgattttaattttgctaatatagtcaaaagccagcatgatgcagtcaaattttagtttaaaatttgaggatgttacaaacctacccaccttaaataaatctcatcccgagatttgcttaggagtcttcaaaaagatacgggaattccaattgtaaataatcttcccgtttccaggttgcttggtcctctgtatggtgattccattggactttaaacaactttattaccttagtgcgagttgttctttgtgcttcatccaaaatagtagcatacaacataaagagtctcatgaaagaatcacatattcattaaccaataatgagttatctatttcaaggaacaatatcggataaatatgtaaatatagtatgtgatacaatcatctctatgattgcctctagggcttatcaccaacaggtatgatggttatggaacgcgaaaagacacttctgccctccaaccgtcatttaggagctcatctagaccatccacgcgaagccccagttcgaacggctgtggtagtggttggccgaaccatgggttcgaccaaacccaggtctggctcgacagagcccatcttcggcctgttgctccttctctgcgtcctctatccatttctgtgagtggaaagcccatttgaagatgttttctggtagtttttggcccactcttggtatggataggaattattcttcactcaagtctatttttggtccaactttggtggtttattac

SEQ ID NO: 14773 - DNA, 1501 bp, Oryza sativa
aaggtgggtaggtttgtaacatcctcaaattttaaactaaaatttgactgcatcatgctggcttttgactatattagcaaaattaaaatcattgttatttgaactctttttattcttaattttggttcaagtattatttctttagaactcttttaacctaccctaattatttcctttaccctaaaccttagtgaatgttggcggatgttaaatgcagattctataccgacaacatctgcataaagttcagataataaaacatccaatatagtgataggtgcttaatctcacatattccacaagtgttcgtgtatatgtatatgcaggtgtcggtgacatggggccgggggtatcgtgactagaggcttgggtagccgcggtcacccacgtggcctgaccccctcggggggggggggggggtcgggcccgagggtgacgtggccacccctccctctgtctccccaaggggtcgggccgctcccgtttcggccccgagggctggggcgcccccgtttcggccccgagggctgcgacgccccgaccccctgtggttttggcgccacgtgtgtgagttaggtgagcacagcggggctcacctaaccgcatttataacaggttggacgagcgcgccacgccgcatttaatgcggcgcagcgcacgcttatccggtctgtgaccagtcgcggtgtgtgaccggtcacagaccggtcagatcgcgggttaggtggcaacaggcggcctgtcacacgcctcgccccgtcccgtcggaatgatgagagcttcctggctctcgtccctagccggagccggcgtgctaactcctggagttggtatgtcagtcccggtcagaaccattccaggcttcagcgcaagtatggcaaggaagtcgctggccattaaatgaaggttgaaatgggcgtccaccggaaaagcgggcgagcggggcaggaggcgtgtgctctgcttgtcagaggtcacttccggctgtagactagccctcattgtaaaaagcatgtttcctttcttaggcagctggaggcccttgtggtgacccctgaccagataaaaaggaggcccaggcctaggaaagggggggactctggagagaaaagagaaaagaaaaaaagaaaggggactctggagggaggagaaaaaaggggaatgggtgctagaccctgaactctggctcgctctccagctctctgtattccttcacgcacagatccactagaacacaggagtagggtgttacacttcccagcggcccgaacctatctacgtcgcccgtgtcttgtgcacttcctctctcgcggacgttcctcagatcgagggcaaagaacctcacttagcgcccccggccgaaccggcaaaggggggcctgcgcggtctcccggtgaggagccccacgctccgtcatctggcgcgccaggtagggggcgcgcgtgtctttttaagccctcgtcctctttcgtgtgcaccaagcttctcccgctcagcctaa

SEQ ID NO: 14774 - DNA, 1501 bp, Oryza sativa
ttcgtcggcgaggggggtgtagaaccaatcgctcttccagtcatcccactttttgcggaggacgcagagaatgtagcggttcagcacctgcccccgcggctggaagtagcagccaccgactaccgtcggcggcgacaccggctgtacggtgaagaaccaccggaacagccggagagatgggcgcaccccaataaacatctcgcacaggtgcgcgaagatggccaacgtcattatcgcgttgggggtgaggtgcgccatctggagatcataaaactccagaatatccatgaaaaaaatagagaatggcgggaccagccccgccattgcgaaagagaggaagaagacggaccgccccgggtagtgtggtgtcgggcgtccctcgcccagcgcgaccacctcccggccggtggcggattctggcatgaatcggcgcggcagcccggcctgcctctcgctcacgatgcgggaaggcggcagcacgctaccgtcgagcggtgcggagctccgtgccatgacgccggcggaggaggagcttgagagcgagcgagtgcggcaagggtagggcacaggaaacgaagagttagagcacaagtggcgaaggcaagggggagagtggcgagaggaaaggaacgaatcccttcctcgacgtctttacacccttgccaatgctatacccggcttctcgcgcccacgcctccactaacccactcgctcgtttgcggcgcacgcggcagatgtgcggccgtggcggttgagatggggcagatcgtgcgcgcattaactacgctcgccaaccgtgaaaagcgccatcatcatgtctccaggcgaaacgaaccggctcgtcccgattcgcgcgctgctcgagtaatgtagcagtcttaaagaagccgctcattattgtcggtcggttttcccttgctgatgcgcgcgatttgcgaccgctgggtttctgcccgcctgtagggaccggccccacctgtcaccgggcctaaggagtggcgtcacgcccgagcgcttccctcgaggggggcgatcgccctggcgtaacgccgggggctactgtcggtgacatggggccaggggtatcgtgactagaggcttgggtagccgcggtcacccacgtggcctgaccccctcggggggggggggggtcgggcccgagggtgacgtggccacccctccctctgtctccccgaggggtcgggccgctcccgtttcggccctgagggctggggcgcccccgtttcggccccgagggctgcgacgccccgaccccctgtggttttggcgccacgtgtgtgagttaggtgagcactgcggggctcacctaaccgcatttataacaggttggacgagcgcgccacgccgcatttaatgcgacgcagcgcacgcttatccggtccgtgaccagtcgcggtgtgtgaccggtcacagaccggtcagatcacgggttaggtggcaacaggcggcctgtcacacgcctcgccccgtcccgtcggaa

SEQ ID NO: 14775 - DNA, 1501 bp, Oryza sativa
atctaccagtcaatacccagtaccaaaggtaccaggtaccagctggtactcaaagtactaggtgctagtggaacgcacctggaagctcacggaaagaaagtaaaatatcccgttctaacgggatcccgttctgtagtctccctctttttaaactatgtgctttacctaaaattaaagttatcttttttttaaggcgaagtgagtattccacaaacaaatattttttttccattctctcactgtaggttattatgggcttatggcagtttgtacccctactatagacagccaacaatccagccagccacgtcgccacgtccgtgttcgtgcctgtgcgtggtagcgcagcggatggattggtggatgatggggccgtggggtgatggaccagcggtcaataagtgcggtcggtggggtacgcttcggatgcgatgaagaaaaccacacatggcgatccacgacgacgacgacggtcggcacggaccaaacccgcccgactgattggtgatttggtggaccggggctccagcctccatcaccttggagtagctgtagctagcagcggctacagcagccaaacggccggcgtacgtttccagcgcaagaaaaaccgagagagcagcgtgggacgggacgggacgggagctgggggagaaacggaggacaccgagaggcggaggagaacgaaaacgagaggcgcgggcgcccccccgttttgtttttgtctagctcgctcgctcgcgcacgcagcacgtacgcagccaagccaacgactggtgccacacgggcgcgcgacacgcgctcacccccacccacttggcctgttggccatcgccattcgccgcactcgcgacacgacgaggggatccgtcctgaccgggagtgaaaaggagggctgaaagttttttttcgcttgcaatgtagcgagcccggcagtacataggacggtaggagtatatacacgtccgttttttttttgttttataatggaacgaatctcggctctttgctttaaaagaagttacattcatttattacattctctcaatgagtaaacattcagttaacttcataatgactgattgaaaaacatcaacactaaaaatggaaaaaaaattattgaaatcttttgtaaatcttcatccgaaattaatgaaaatctacttgtaacttgtaagcttcaacatgcagcatatattagctccatattctcttcatatttttgaagttgtgtctaaagtcggaacagtgcattgctcggaaatgagatgaaattcgatgatatgtatgaatcctcctcgcgcactgaaatgttggatggtaatacacaacttgaactagagaaatcgtgtacaacttgcttattttgtatgttaataattattcttttggagcatagccgatgtttttccggtgcttgaaaggtactagaggtccgagtgtcaatagttggaaaatacccctatggcaatgtttggctaatgggaaatggaaatgattt

SEQ ID NO: 14776 - DNA, 1501 bp, Oryza sativa
ggcctgtcacacgcctcgccccgtcccgtcggaatgatgagagcttcctggctctcgtccctagccggagccggcgtgctaactcctggagttggtatgtcagtcccggtcagatccattccaggcttcagcgcgagcatggcaaggaagtcgctggccattgaatgaaggttgaaatgggcgtccaccgggaaagctggcgagcggggcaggaggcgtgtgctctgcttgtcagaggtcacttcctgctgtagactagccctcattgtaaaaagcatgtttcctttcttaggcagctgaaggcccatgtggtgacccctgaccagataaaaaggaggcccaggcctaggagaggaggaaaaggggagaaaaggaggaaggggttctagagcctgaactttctctcgctctccgcctctctgtattccttcacacacagatccaccagaacacaggagtagggtgttacgcttctcagcggcccgaacctgtctacgtagcccgtgtctcgtgcacttcctctctcgctgacgttcctcggatcgagggcgaagaacctcacttagcgcccccggccgaaccggcaaaggggggcctgcgcggtctcccggtgaggagccccacgctccatcaatgtatttttgtgtcggggccctaacttatgcaagttggccacgtctgagggcctagggggagagcggttccattctactctctcaccctcaattctaaagaggtcgctagagtggggcttggtgtcgggtttttaggattaagttttgggtgatcttggctgtagttcctttgttggcctagcggtggccggttcggtgttggccttctcccgagtatgtatattggtgttgtcagtgcgtgggtggtgttttcttcattttcctatttaagtcctcctaggattgtgattttgtaattttttttactgctctatcaatattaacttcgcatgtttggtgcgagtcatttcaaaaaaaatggatgagctagcgtggtgtgcggatatcgtcattacaaattcttttaggactatctatacatttgtcaataaatgttctcctaaaaagttgtcaaattaaatatgaatatatgataaattagtagtgtaattacattacaacttacatgtaatttgtatgtaactttcaaattcaatcgaagtaatacaccacacaaacttcttcacataaacaagatatgctcacgcatagtactcgattaaatttaaactgcacaaaaaacaatacacaaatgtaatcaaaatgcaacacacatctttttccaagaagtatttattggtgctctttgttagggaaaaaaaagagcttaatttaaatttatttaaacatgactactcgattgccatgcaccatgcgtaaaaccatttaaaaccccttcgatcaccgtgcaattactgcgtcaaccgaaaggttcagcactgagattacacagatcgatggctaattaaaccatgctcacactggca

SEQ ID NO: 14777 - DNA, 1501 bp, Oryza sativa
caagtctttactactccaaaaaacttacagaatttaccaagtggaaaacattacaattagtttatcgaggttcataatagatttctgatcatatacatggaggtgatatttttcactctgttcagtcagtaggtacctctgggaaggcggaaaaaaatgtgaaatgttaattgtgatcgcaactagatactctatccgtcccaaataagttaatctagtacgtgatgtggcatatcgtagtccgatccagattcgcaatattagaatatgtcacatttcgtattatattaatttattttggaacgaaaaggagtatgtttggattgttttttttcctctcaaaagaaaaaggattttgcatttgaattgtttagcttgtataggagtgtcggtgacatggggccgggggtatcgtgactagaggcttgggtagccgcggtcacccacgtggcctgcccccctcgggggggggggggggtcgggcccgagggtgacgtggccacccctccctctgtctccccgaggggtcgggccgctcctgtttcggccccgagggctggggcaccccgaccccctgtggttttggcgccacgtgtgtgggttaggtgagcccagcgggctcacctaaccgcatttatagcaggttggacgagcgcgccacgccgcatttaatgcagcgcagcgcacgcttatccggtccgtgaccggtcgcggtgtgtgaccggtcacagaccggtcagatcgcgggttaggtggcaacaggcggcctgtcacacgcctcgccccgtcccgtcggaatgatgagagcttcctggctctcgtccctagccggagccggcgtgctaactcctggagttggtatgtcagtcccggtcagatccattccaggcttcagcgcaagtatggcaaggaagtcgctggccattaaatgaaggttgaaatgggcgtccaccggaaaagcgggcgagcggggcaggaggcgtgtgctctgcttgtcagaggtcacttccggctgtagactagccctgattgtaaaaagcatgtttcccttcttaggcagcaggaggcccatgtggtgaccccggaccagataaaaaggaggcccaggcctagaaaaagaaaggagaggaggagaaaggaggggagtggggactctggcgaatgggttctagagcctgaactctgtctcgctctccggctctctgtattccttcacgcacagatccaccagaacacaggagtagggtgttacgcttctcagcggcccgaacctgtctacgtcgcccgtgtcttgtgcatttcctctctcgctgacgttcctcagatcgagggcgaagaacctcacttagcgcccccggccgaaccagcaaaggggggcctgcgcggtctcccggtgaggagccccacgctccgtcatctggcgcgccaggtagggggcgcgcgtgtctttctaagccctcgtcctctttcgtgtgcgccaagcttctcccgctcagcccaa

SEQ ID NO: 14778 - DNA, 1501 bp, Oryza sativa
atatgccaacacatgtaaaatattaaaggcatattcccaacacattatctagggttggctagcctacactgtagtgctagcttgctggtagtatcgaaattgatcccagtgagtccatcgttttcctatttgtgtactttacgttttcaagcgcacgcatagtgtttagctataaccggaattctcacaaccaagataatttactcagactcccaagccctgactgatgaatgccgccattggaaattcatttggcacaaccgtgcccctccccgagtccaattctttctctggctcctcatcaaagaacgcctccctactaaggctcacaagaagcagattgttcaatccccgcgatgcgccctctgtgatgctgcggatgaaacaacgatgcatctgttatttggctgtcagtttgctcaacatttttgggggtccattgatgtcacccctgccgtcgcttcagtgcaagatatttcagccctccgccctccaagccgtctacctcagcagcatttccaaattttttacattctttgcttatggggtctgtggaatcatcgtcatgatgttgtattccgttctctctctgtttcttttccccgtgtagttaagaaatgtattgaagatgcttctctatgggccgagcgtattcgtagagacgataggccggttgtttatgcctggaagtctctcctatcctccgctgtaaggtctcacaatatgtaatgactgtacctcccccctattttgcttaatgaaattcaggtggggaagctctccccccggtgaaatttctaaaaaaaactaatcaaccgtgtagtctatttggcatgttcattttactatcattttcaacgctaccaaattctaacaattagtaaatttcagcacaatttggtaatacccaggaattggcaaggtaaaaaaattcaggtgctgtttagttcgttactttcttaaatatgttttatggcatggtgggatgtgattggtatgataataaactgtacatgccctatataattttcaaaagcatgtttacatttatagccatgacacctgcttaaaacaatttatggaaacttctttaaatcgcaaaagaaggtgacaaaaaacggcggctccatttgccgttactccaaacgtcaagttcatgtggcagcctggcaagagcgtccatggccgtttcgctcacgagggctcaccgtgaaccgggtccagagagcgccggtccacgtaaaaaagcaaaccgctcagccagcccagcccagcccacgggccgtggtcccggtccaccactcctcccaccctccccctctctctttctctctcctccgcccttttatctcccgatctctcacattttggaaagaagagagagagaaagagagagagagagaggccgcttctctagtctagaccaaaggaaggaaaccaaccgagaggcgaggcgaggagaggagaggagaggagaggaggaggaggagggaggagaaga

SEQ ID NO: 14779 - DNA, 1501 bp, Oryza sativa
aaactgtacaattagtttttcattttatctatatttaatgctacatgtatgtgtctaaagattcgatatgatgtttttgggaaaaaaatttgggactggattttgttggtgtaattattttccatcgaatccaaccaaaagaaaagcaggggcccctgtgtggcatgtgaaggcagcttgttttctttctatagcccttttgagacagcttggtgagtgctcgtgagctactacggccatggctgtgctgtactgtactactgtcgagctaaacgctggagaggagatgttgcccggattacatggtaaataaaaaagcctcatgctgctttggttactttctggtgtggtttgttttcttaaccatctttcctcgcacaatcatgcagctcacatgtttcagaagctcatttggtggtattccctcagtcagcaagtttgccgtttggacctttgatacaacttatttcagaactaggcactaaaaaaactatttgaccctcgactcggcgctaaccttgaaagccattaacaatagcactgagctcgtgttcagtgtcggttgtggagcagaagatccattcctgcgatttactagttcttagaggtttatctttactactttaaaaacctcccctcccctcatttagtaagcttcgctagagtaaccaccgaatccaatgttatattcctaattattctcctatcccatcccacttatattggtctgcccattaaaacatacaagcataaccaccgatccagtatttttttctcaccatccacccaaccaattctcaattatatgactttggcccttggacatgttactagtttgtaaaatagttttataaaaggactaaaatatcaaaattgcagccgtcaacggatctggttagtactcctatttttatccagacatgctctgcattccaccgttatttggcatgaaacatatcaaatgaccagccagaaaatcaatcgtcccgaattccatctcaccttgtgcgttatagctggacagaatcaaaccttacatcttgaagacttgaacaagtgatttgtgaactggatgccacaactagagcactgaaatccaaaagccttacactagaagcagtagtcagaatcaaaccgtagaccagtaaaaatgtcaattcagttaggcagctcacaaccaaatcaatcagtggccaccaatagtcaggagcttgaagattgctgaagcaatggtgcggtgcttgcactgttgcttgcaatgtgaactccacctgccttcacagaatgcaagtcccaggtctaaccatatgcttaaccaactttaatgccgctttccagaagacccaagtgtggccaccaaacgtagcacacaaaaagttggcatctttgcacatattccaatagctaagcacttgattagcaacttttttcaggatagaaaaacccatactggtacaggtattaaccaaaggccacacacatgcaccaacagcttaattaa

SEQ ID NO: 14780 - DNA, 1501 bp, Oryza sativa
agtaattattgcccatgtgtctagcactctactccagtgattcctcaacttttacatctatagctggattgctgttcattgaaaacacttgcttgtaaccattgttgtgctgctgatcactccacagaatgatatatattttacaggagatcgagcaaaaacatcagacaaaatattaatggctctcaatacgacatatatatcatgctctgttcacagcagacaaaaattaagtcaaaagctccattcaacgatagatcatgccctgtaaacagcataccaaaaaacggacgacagatgagcttaaaattttccattcaaagattaaagtctccagcaaaagcttgtgcttttctcacaaattcattacaagaaacatggcagattgaattgttaattacaaaataactagaccatatagtggagtagtgtttgagccgtaatgggggcctaggctgcgccatggcagcgggggaggttaggtacttgcttgagctgtcgagggagggggataggggacacagaataccatgacatcttcgctcgtgaatgcggcggcgttgttggtgacactgtcgcggacagcagatggatgggaaaaaatcggcaccggcagaggcatggatgcggggcgagcgcgccgtttctccagtaccgcgaccacggacggcagatggatgggaaaaaaccgttcggcggggcgtggatgcggcgcaactgctccgtttctgcgctcagatggaggaatagatgagaaagaaccgatgcggggagggaggaaagaaagagcgcagcgagggaggaaagcggcggcgtgtgactccggaattgttccgcttctatttgttgttttccaatcgtatcctttcaagttggacggccagatttaatctggtacctcctagtaccagtactggctggtacagactgccggacgggagtaaaactcttcatagatagatgaatctagatagataatcaatatgaatatagaaaatgctataatgacttacattgtgaaatggagagagtagttcgaaagcatgcgcatagaaaagaaagaaataggtcggaaaagtgaaggaaaaaaaaactcagcctataagtagggtgcacgtttatagtttcactaagtgtttatactgtgtttcttgatagaaaataatacgggctttaaatttcccgtgacgctatcgatgcaattcatgcaaccaaccaggcgtgctgcgtgcaacacctggaacaaatcctttcggcgttcgttgcacctggacacacacctgcacatgacgtggccccctatccatccatcccttaccgccttcctctccacgcgtcgccttccgcctccgccacctcctccccctctccacacactcttcttctccactcctccgccgctcgcctcgccgcgcgccgcttatatacccgcgtctctgcgctcatcgattcatcacccagatcgcaatccaaccaccgcaaccaattcgccggagaaagt

SEQ ID NO: 14781 - DNA, 1501 bp, Oryza sativa
aaggagtccgacctgatgtgatcgaaccaaagaaaacaatccatattaaaattacccctaaacgatattaggagattacttaattgccctttatatattagaagattacttacctgccctttatttaaacaatccatatcaaaattacccctaaacgatattaggagattacttacctgtcctttatatattagaagattacttacctgccctttaaaataaataaagggtccctattaggatttatacccatcaggtttgctttatggtttaaaacatgagaccagcatcctaaaaaataaaaaggggatgctcgagtaagatgatagagcttcagaatgctattgagttacaccgacatttgctacagagcaacattctattattacaatctacagtctattattacaatctagcactctataaaatctatcactctataaaataagtgtatttaaaaataattgaatgaaatcagcacacaaaaataaatttaaccaaatacaagatcgggagaacacattatttcggcaatgagttgaacaatccctaaatccagataccacagttcatccaagttcagtttgatgctcgattattattcatacagaggcataaataacacgcatacaaaaccgtaaataaacactcaaacaaagtaacaaacacacttcgaaaacaccactcaaatggcggctgggcgcccctactgcggctgcagctgcagtttctcgtgcagctgcggcggcgcgacgacgtcgaccctggcgacaccatccctggcgtcgccggcgaccttggcgacctccacctcgccgacgacgtcggcctcgcgctcgtggtcgccttcctcctcctcgtagttggggtcgttgcggtcgatggcggccgggaggggatcgagctggctgtcgacgatgctgtcggggccctcccaggtgaacttgccgccgcggccggacttgggcggcggcgcgccgatgccgcgggagccgttcgccgggtggcgctccatgcggtggagcccctgctggtccagcttccgctcgaagtgcctggccgtgtccgggtgccgcgtctccggcaccgccaccttctccgtcaccttcttcccctcctcgtcccggtgcgtcgcgcgcatgtacatcatcgatcttcgccgccggtaggtcggtattcacaactttctccggcgaattggttgcggtggttggattgcgatctgggtgatgaatcgatgagcgcagagacgcgggtatataagcggcgcgcggcgaggcgagcggcggaggagtggagaagaagagtgtgtggagagggggaggaggtggcggaggcggaaggcgacgcgtggagaggaaggcggtaagggatggatggatagggggccacgtcatgtgcaggtgtgtgtccaggtgcaacgaacgccgaaaggatttgttccaggtgttgcacgcagcacgcctggttggttgcatgaattgcatcgatagcgtcacgg

SEQ ID NO: 14782 - DNA, 1501 bp, Oryza sativa
agtcacaatatttctcaaacggttcctcgtcctcaatgaatggctcaaaatccacacggtgctcctgtaagatgcatacaagaaagattatgaagtgtaaataggccaatgcttgcttgcagcatgtcttttagataaaagaacaacccagcctggcagcctgtactctacgcccagatcagatgtacacagccaaagtttgcagcatgtgcaataccttattgattcaatggcaccctaattacagttcttaagtcacagtgttacaagatgtttcttggtcatagccaaagcttgcagtatttctaataccttattgattcaatggcaccctaactacagttattaagtcacagtgttacaagatgtttgttttggtcatctcatctgatgcataccttaatgtattgcacaatcattgcacggtacttcatgtgctcttcctcgttgccttcgagctggtcgcccattgccctgcagactacgatgagtaaccatataacacaagactgcataatgcatatactattcctcctttcataaactaacagtactctaacatatcgtacaacatcgattagcctcttcttgtaaaaagtggcaagaatttgagtaatggaatcgaaaagaagacctaaagaagcagttgccatccgcactaacttcgataatcttcaaccccagcgagtccagctgcgcccggaactccgtcatgtcggccttcttcgcgaacttcttctcctcctaacaaatcaatcaccaaaaggaaaaaaaaacgagaaaatatattagctaaagctcaattccccttccaccaaaaacgatccaatctccagctgactgaggcgcggggtattactgcatcacgcttcggcttccgggctttgggcgccgccacggctaccttcttcttgttccgagccattacgacacgtgcggtagtagtggagtctcgcctagatttccccgcggcggcggcggcggcgagggggaggggaggcggaatcgcagatagtatcaaatcgtactctaccagaagcccggagaagaaatcggatgggaaaaggaagaggagaagagaagagaagtcgtcaggtgatatttcgtgggccaaatgggccgggccgtaacacctcaatccccaatctgctacggcccgtgtgtgaacgtgacacgtcatcctatttagaatcgaataccgaacctgaacgtgacacgtcagatttaggagtagaaacgagtacactctacacgatacagatccaatacgagaccgacacgtcgtcagcgaccaagtaaaattcggtcacgaaccgtacgccaccaacctgtataaattcatcgaccgccaagcctctccagaacatagcacaagccaaccaaacaccgcacgatttcgtatccacacatacttctacgtgatttcgtttcgacgatctcgaggcgccgcggcgtgacgtgacgtcgacgacaaccatggcaggcggtggcggcaagtccg

SEQ ID NO: 14783 - DNA, 1501 bp, Oryza sativa; identical to SEQ ID NO: 14782

SEQ ID NO: 14784 - DNA, 1501 bp, Oryza sativa
cataagccgtacagttgtccaaaaaaaaaagggtaaaaagagagaagaagaaatgaccccactaagatatggactagcaataattgaccccacagggccacaggatatattttctggctctgctacttggctatctcatgggcacctgaaagaccagatatagatatgtgcacctgaaattttgaattctgcttggttagggaaacaaaattatcagagagatacatctacgaaatattagacacgagctattacatatgagattgatgactaagagataacatatttgaagtaacctatagtgatcgagaattagatgaggaaggtcatatactaattagtggagtagtacataacagggtgttgaaaggaacatttaagtactgagcaccaaggtcctttaataggcatgctgcatgcagctgaatgcttcgtttgacacctatagcaaagttgattattatttcgtctcttcagagcgttagagcactacctcagttttctttttaatggaagaaccggctattgatttttgccagcctcattgccaaactttattaacgatctgatcagctttgtttaacatcatggagacgtgatgcattatatctatatgactatatctacatatatcttcattcataggatgtactgtgtttcccttttttgctgaatttttgttcttatttgatagaattatagaatgtttgatgtttaggcatatctgttgggtatcttttatatagcgaagtacctggtgcttgctgggtataagggtattactgcggtagtcaaatttgttgagctcagcagctcaatgcagcttttctatgtttggtgcactaccgttgaaaagaatcttatcaaacttcattgctctcaggatctcaatttaccttatttgcagtcagtcacattgttcacaaactgaactgacacttaccttgcagtcagtcacattgttcacaaactgaactgacacttaccaacgtccgttttgcaggtacaagatggtggtttagatagagctgggtctgggtacatatatctgcaatgccttttgtattggctggtcgaagcattgtactcggttgatgattgacgaggccagggtacatatatctgcaatgccttttgtattggctggtcgaagcattgtactcggttgatgattgacgaggccagggtacatatatctgcaatgccttttgtattggctggtcgaagcattgtactcggttgatgattgacgaggccaagaatcaagtggaactcattttcgactgtatcaaataatttaggttcataacggttgctttggccgttctcccgtcagatttagatgtgaaaatgatttagtggcttaacctgtttgtaaatcgtatgctaacttctgtatctgtcatattagtgcattttcaagtgtaaggggtcagcatttcgatatttactacatggtgtggtaaaaaacaattaggccatcttggttaatgattacaat

SEQ ID NO: 14785 - DNA, 1501 bp, Oryza sativa
atgtacttgagggcgtcgtcggatgggcagggcatgatgcggccgccgaagctgcagagtatcttgatgcggctgccgccatcgacgcaggctccacgtccgccgccgctgcagatgctggtcgggtggcgtacgtgggcggccgtcgccgtacagctcgcgtggcggcggtacaagcaccgcaagacgctcgcgttgctctccttcatccgcgcgcaggccgctgtcaggcggccgcccatctacgcctgtcggtggcgcgcacgtagccgctgctggcgcgcgcgtagaagcctgcgcccggcgttgaggccctcctgctctcgcgtcgtcgtcgccgccgcctcgtcgcccgtcgtcggccgctggactcccgcctcccccaccggcctcctcccaccggccagctgcccctgcccaactgatgaggagaaaagtgagaaaagaagagagagatagaggaagataggtggagaggggaggggaagaagaggctgacatctgggtcccatgtgggtttcatgttgacttagccgtcacgtaggataaaaccggtgttaaaaccatcgaaggatctggagtgcatgatttttgtaagttggaggatgccatgtatctggttttggttttgcggttgagagacgattttgtaactcgatgacaagttgagggacctgtggtgtactttttccttatccaaaaggcctaatgcaaagcagttaggcccttcccaccaaggccacactatccagcccaatgctaggtgctccctctcacgcggcccgcgtcacggctgattgcctggttggtggtggttccaccacgatccgcaccgtccacctgtcccctcccgcccgcacagatgctcccacctcgcgtcctcccatagggcagtccgtcgcgtcgccacccgtcagcatcgtgcggatgccgccacgtttcgcgtcccccgcgcacaatcctcccccccgtgtggtccccaccacgttgagtccagcatcccaaccaattgaaccaaacacgattaaaataccttatcccactcgacccaccccaccccaccccgcagatcccccacaccactgacaccccggccccactgcgaagcccccgcgagatctgatgaccggagtacgagtggtggaccaatcgctgtgtgcgcggtgcgaaaaggggaggaaggagtatactaaaactttattacccggcacgcactaatcgagattggagggtgtcacttcgtcgctctcgaggccggcgttttaaacgccccccccacacggctcctcgctgccgacacctgtccggtttcctctcctcgcctcgccgcggcgcccgcgtcctcctcaccaacgccagagctccacatcccacctctcctcaggttcccgtctctgatccctcgttgcgttacggggaagcaggcgtggtggttgctccccgtgcggagttttcgattggtttggttgggtgagtttggtgctggggtgttggggattgg

SEQ ID NO: 14786 - DNA, 1501 bp, Oryza sativa
gcacgaacacacgctattccctcccccacttggccggatcagttccaccacaagctattgccaccccactcgatcccccggtgggcgccaccgcccgggtcatcggcgattcgtgtaggcgccaaacaggctcacatgttatattttggatttttttttagacttgtgtacttttttccttctaaattctatgcaaatagttatgaaaaagatttaaagaaaataacaatatagactacagtgaaatctagcgcttaaccgaaaatcaacatcaaattcgacctacgtattaaagaagaaaaagagacaaatttggatataaatatatagtgccactactatttaccaactgaaactttttatatcttagtaatatatatgatgagttttaacgacctaagattttgtggagcgatatatatatacgctgcataaatatcatctatttttttcagaattttttgtaactgattgaattgtttttagatggaggaggagacaactgagggagggttcaaaacagtttcccgtttttgagcataacaatctctctctcgttcactgcagcggttcacctgaaccctgatattccccgaggcccgcgtgtcagcgacacgggagccggaaggaacgcgagcacgccatgacagtggcggccggcttccgtagcaaaggacgtacgtacgccactgccactagctaagctaaagccaaactcctcgcccgcacgggccgcgtcctataaaagacacaccacgcgtggcagagcacaccacgccccaattcgagatcgatcagctccagctcgtggagtgtgcgtagcttgattgcacttgcgcagcgaggttaatcagctgcaacggcggcgaggtcgtcgtcgcggaggagaggacggcgtctgtttcggtggttggtgcttccgccatgctgcagggggaggagaagaaggccgggaaggtgaagaaagggtggctggcggtgagggtcggggtggagggcgccgacggcggcgacggcggcgggttccggcggttcgtcatcccgatcgcctacctctaccaccccttgttccgccgcctgcttgaggcggcgcgcgacgcctacggctacgactcggccggcccgctccggctcccctgctccgtcgacgagttcctccgcctccgctcgctcgtggagcgggagacccacgcggccggcggcggcggcggcggctcgtcgtcgccgcaccgcgtccacgccggcggcggatcgcaccaccaccaccactactccttctccccgtgcacccgcgccaaagtcagctcctgatcgatcgagctcgcttccgtgcgccatggcggagtcgatctgccggcgaggacgccccgcgtacgtgtacagtagcgattagctatagctagcagagacagtacacgacgagaggagagtggagtggcatacagtagctaggtgattagtgatttgctccgggttttcgatctcatgattttggtctctt

SEQ ID NO: 14787 - DNA, 1501 bp, Oryza sativa
agaaggaagagagtcgccggcctaactgataagagcaagtttaatagtatagcccactactagctccaaatcatctatagccaatgtaatagctaattcatacaatagttgcttactatactattaatatctggtctcacttgtcatagacaaattacgtcttggagtccattctgcagctggctacatatctgtagtttgctgctcttctctctcttactttatcttttgctcttctctctcttactttatctttttaaaatatatttataactagcttatagcccgctattgtatctgctctaatacgaacaaagaggagggttttatgaaaaacaagtcctactctctccaatgggattgatatcgaccgtcagatgataatcggacgatgaagagtgatccaagatggtcgcgatccaaactctcgggagtattctcaacgaaaacgtcctacctgcactcgagtccaaccaatctgaactgcagagtttgatcgaacggcgaagaggtattctagtcagatcgctaccattaatcgcgacccaattctcaggggttgtgaaagataattcgacgaaaacgagggtttcctgtgtaaatatacctccaccccctcaactcctctctctgacaggtgggctcactcgctgacccgcagtcaacggcggctttcacggtgagctaccgccgccgctgccgcgactcctcgccgtgccggcgttggtgagaggtgggcctcgccggcaggcggcagaagcaatcgcctcgacctcgagctcatgcctaatccgtcttgatcaatcagcggctaattaattcgtctggcttagcaatggacagagaagcaaatcgagctataaaatgtgtgaagagaatataatagctatgaactgtgagttcaactgataattatacatacataagtcgacctgtcaattctatcatacatgcgtctatacaagatcgatcaaaaagatcaagaagaagaaggggaaatcaagagaccaaaatcatgagatcgaaaacccggagcaaatcactaatcacctagctactgtatgccactccactctcctctcgtcgtgtactgtctctgctagctatagctaatcgctactgtacacgtacgcggggcgtcctcgccggcagatcgactccgccatggcgcacggaagcgagctcgatcgatcaggagctgactttggcgcgggtgcacggggagaaggagtagtggtggtggtggtgcgatccgccgccggcgtggacgcggtgcggcgacgacgagccgccgccgccgccgccggccgcgtgggtctcccgctccacgagcgagcggaggcggaggaactcgtcgacggagcaggggagccggagcgggccggccgagtcgtagccgtaggcgtcgcgcgccgcctcaagcaggcggcggaacaaggggtggtagaggtaggcgatcgggatgacgaaccgccggaacccgccgccgtcgccgccgtcg

SEQ ID NO: 14788 - DNA, 1501 bp, Oryza sativa
gacaggtgggctcactcgctgacccgcagtcaacggcggctttcacggtgagctaccgccgccgctgccgcgactcctcgccgtgccggcgttggtgagaggtgggcctcgccggcaggcggcagaagcaatcgcctcgacctcgagctcatgcctaatccgtcttgatcaatcagcggctaattaattcgtctggcttagcaatggacagagaagcaaatcgagctataaaatgtgtgaagagaatataatagctatgaactgtgagttcaactgataattatacatacataagtcgacctgtcaattctatcatacatgcgtctatacaagatcgatcaaaaagatcaagaagaagaaggggaaatcaagagaccaaaatcatgagatcgaaaacccggagcaaatcactaatcacctagctactgtatgccactccactctcctctcgtcgtgtactgtctctgctagctatagctaatcgctactgtacacgtacgcggggcgtcctcgccggcagatcgactccgccatggcgcacggaagcgagctcgatcgatcaggagctgactttggcgcgggtgcacggggagaaggagtagtggtggtggtggtgcgatccgccgccggcgtggacgcggtgcggcgacgacgagccgccgccgccgccgccggccgcgtgggtctcccgctccacgagcgagcggaggcggaggaactcgtcgacggagcaggggagccggagcgggccggccgagtcgtagccgtaggcgtcgcgcgccgcctcaagcaggcggcggaacaaggggtggtagaggtaggcgatcgggatgacgaaccgccggaacccgccgccgtcgccgccgtcggcgccctccaccccgaccctcaccgccagccaccctttcttcaccttcccggccttcttctcctccccctgcagcatggcggaagcaccaaccaccgaaacagacgccgtcctctcctccgcgacgacgacctcgccgccgttgcagctgattaacctcgctgcgcaagtgcaatcaagctacgcacactccacgagctggagctgatcgatctcgaattggggcgtggtgtgctctgccacgcgtggtgtgtcttttataggacgcggcccgtgcgggcgaggagtttggctttagcttagctagtggcagtggcgtacgtacgtcctttgctacggaagccggccgccactgtcatggcgtgctcgcgttccttccggctcccgtgtcgctgacacgcgggcctcggggaatatcagggttcaggtgaaccgctgcagtgaacgagagagagattgttatgctcaaaaacgggaaactgttttgaaccctccctcagttgtctcctcctccatctaaaaacaattcaatcagttacaaaaaattctgaaaaaaatagatgatatttatgcagcgtatatatatatcgctccacaaaatcttaggtcgttaaaactcatcatatatattac

SEQ ID NO: 14789 - DNA, 1501 bp, Oryza sativa
atgtggtgtcacattcccatttaaattagacctcttcggcaagcaggtgcagcagccgaccacagcctgcccgctgtttttcttcttctttttttttcttgcttcactgttcctatcaggccatggagtgaacggaaattctagaggcccgaaatgaaaacgatactagcatgatcatacagctcccatgtgatcaagatagtcagatatataccactgccggccatatcggcaatagaccgtttcttgtttttcccttaattccaattctccgttaacgtttgactaagcgtaggccacctgagaagatggaaacgaaagagaaatgaaaaaggggaccagtgtgtgctgctggggtcacaggtcaatgcaggtttacatccagacacacaaggtagttggaggaggagaaggtttcaaccaaaacttttcaacgcgacaggtgagaagtttcgacgctgagaatccgctcggatacgtggttgacgcaagcaagcgcacagatacggccttcctgcaaaagcacacggaattcgcagctcctgacgtgccgaatcggcggcaatggcatcaagccatgaacttttctgtcgtgaagaaaatattatccaaaaaggagagagggagggagcatgtgccccagctgatgggaccacgatacggggctaataatttcctgaaacttttgtcgtgtagaatatcaatggagatcttctagcaactggtcaatggagtcaagtgtacatataacacatcgcaattaataggcatgggcggagtcagaaaatctctaaaagtaggcacaacttgcttattctctactactatgcatttatatgggtaaataactttttttataaactatgcatttatgcgggtaaataacttcatgttcaaatagaacttggcagaaaagaccttaccttattcagatcggggtctgacatcttctattctcactaaacaagttagagaaattaaacgagtaatatgcaagtttaggtactgggatgacacagtcgaataagtttgaggatctaaacagtcgatttgcgagtttagggaccgggatgacacaacggtacaagtttagggaccggtgatggactttactcttgaaggagtttccattcttaaatagtatattttcatatttgaatataccttttgtataatatcagatatgtggtattcctggtagttagaaatataagtataggatgtattcataacctgtaaaactgacacacatatatatcaacctttaggaaactttatattctacagttattgtgaatccaacaggtgagaatacagagaagccgagaatctaaacaaaatgttaatttttttggggggctttaattctgtaagaagttattacgggtagtagaaatactattataggccctgttctaatgtaatgaaaaggatggattaaattttgtattaaagtggcacgttttttaaattgctaaatagtgtgtttcgtgcgaaaact

SEQ ID NO: 14790 - DNA, 1501 bp, Oryza sativa
tgcccttcttggtgtcctgcttgatgggggtgaatgactcgtcggtggcgacctccatcttggcgctgctctccttggggatctccacgacgaagtggaacaccccgtcgcctgcgcgcaggggcacgtcgtgccacggcgacaccttgcggcccccgccgtcgacgaggaacacgcggtagtcgagcgtctcgggcaggccctgctccttgggccggagctcggcggtcctgaggagcgcggtggtggcgagcacccggcgctggaaccgcacggccgtggggaggcgggccgtgcgccggagcccgacccccgccagccgcgtgaagcgggtggccgccgtagccgacgccgtcgccgccgtcgccatcgtcgagagctcgccgggggatcgtcggagttggtgcggagtgaacagcggcggcggcggcgggagactggaaagtgggagctagtctctccggatgacgaggcgatgggtacttgcggctcgcgtggtagctagcctgaccaggtgggcccacccccgtgatgtggtcgcagtcgcagacaagtgcggatagatcgcgagtggtgtttgggccgggccagatcacccggttctcttcgtgaaggataaggcccggaccatgtgtgaattactccggcccacctcttgacacgatcactaccaattctggcgatccaaatggggctcccggtggcgatgtacaccgttcgatcgaaaataaacgaccagatggagggtttccctcgggccattgtggagtttttgcagaaaagccctcgtatgatctcgtattaccgttgtgttggcggacggtacagatcggcttggaaggagaaaaagataactctttgcatattagtcctcgtactttgtagaatttaccgttccaactgggaatatgggagaaatttcagtatttatcatccaatacgatgacctttaaggagctgccactcaatacgttggcctttcaaaatttaccaccaggcacgcgaaattctttatttggagccactccgtccgcctgccccgccgtccatccgcgcgactgtctccgagctaggtggcgtcgtcgcccaggcacggtcatcgtcacctcgcatcccgcccccgccgccgtccccatccccaagctcgttcggcaccgtcgccaccgccgttcccaacctccatcgccaccattcccatccccaagctcgttcagcgctgttgctatgctcgcgccctatcgccgccgtccctgagctcgtctgccactgtcgtcgagctcgcattccgttccgccgttgccgccatgcctgagctcgcgtccggtcgccgccgtagtcacccccaagctcgcgttctgttgccgccgtcgtcgccccagagctcacgttccgctgtcgccgccgtcgcccccgagctttccgctgttgccgccatgcccaagctctcatccgatcattgtcgccgtcgcccctgagttcgtgttctgctgttgaaccgcca

SEQ ID NO: 14791 - DNA, 1501 bp, Oryza sativa
catgatagtacctgtagcacgggagatgcagcttccttgacgccattttcaagagaaaagaaaaaacaaattggcaagcacactttgcttggtaagaatggggtgaatcctctgcagagacctcagtcaggagggcttccgcttcggcggcgccacccttctcgagggcggcctccgccttctcacgcgccgcgagcgcggcgagccccgccgccgcgtcgaatccggagtcgccgagcaggtgctccaggagctgcgcggcgcgcgcggcggtgcccacgtggccgaacaccgcggcgccgccgccggagacggaggcgccgaagtttgggcccgccccgcagcggccgaggcaaccgcaggaggccacgtcgacgcgcggcggcgcgagcccctcgagcgccgccaggacctcgcgcccgccctggcgcgcgcacgtgcggttggtgcagacccgaatctccaccgccgcccccgaagctctcgccgtcgtgggactccggcggtggcgcggggaggcgaaggagcaggagaaggcggttgcagccgctgccgccatcgccgccgacgaactctgatgaggcggggggacacggaggtggagtaaagtaataatacgttttttaaagggtttctttgcaaatttccgcggacattttccgggtccacgagccaaaccggatattctgatctcaataccgacccatgtttttggtgggccttacgaaagcctgtctctagcgagcccaactttagtgggcctaaatacggttagggaggatgtgcggcccatgaaggctcggcccattatactgcaactaggcccaatacctagccattcagagtttcggacctgtggctatcgcggaagggagcggcggcgaacccagctcggtgagtcgtcgtcggcggcggcggcgacggcgacggctaggaccacgtgacgcggatcagctcggaggcagcgacgacccatctctgatctccctcacgttcagaggcgcgaccaagcgtcgagggggagcgctcgacggcgaggtacgcgtgtgcagatccccttcaactctaggtcgcaacgaagcctcgacagtgttcccaaattttcttgatttttctgtcacctgctagtttgttgatctgcttgatttgtttgtcgcctgctagtatgttgcaactatcggtgctaatcgatttaggcgattcttgcacatctttctgtgttgactcgctggtgttagcctgttaggagtgatgctctctagctgttcgatgaaatgcctgataaaagcatctttccacgccaatatatctatacatttattcgcacgatttgttcccctttgctaatgtacctatcaccatcgatttgcatgcgataggatcattggatcattagattactggtgaatgtcgtataatgatttttaccatacaaagtattgaacaagaatgcaagtggcttaatggttcattgttctttctgatttctttttggtttgta

SEQ ID NO: 14792 - DNA, 1501 bp, Oryza sativa
aaatacactctgcggtagagaatccacatgtagattggccaaacaaaatcagcccctgttgtgtcagtaacctgctgcatatctaacaatggtgacaagcctatcacaatcaagtgttcacctgattaggtccccaacttacagaaccaattacatctgtaggagtcccccaaagaacagagaacctgaaatgagataaagacattttgcacttgttatagaagggaaacctatagcattactgaatacggactgctgaattggaactaagaagtgcaaaccaataaagacagcaaatacagctgcaacaactttaagactagttgtgtccaatactccaatgtatgagatgaacgaagagagaaaataactaataaatagtttaatataaaaaggggtatatatcacttgaacttgcacattgtgatatataccaatagaaagcctttggttctctcaaaataccactgaaatagtgtgctcttcctcaatctgaatctaccgttctcctctgatggaggttcgattgacccttgaagattgaagccaagcagccagggcaggcgtgtggtagcctccagggcatcgtcagtgccctccttaagcagcttgagcaatggcggcacctggctgcagcgagcaagctacactaggttggcggtggagtcatctaatcaagggaaaaacattggttcattcatcctcgccgccgccactcatttgctacacccccattgcttcagtggaatcatctatcttatcatcaaaatcaccaaacaccagcaaaacattgcacttcaccaaatctaacacccagattcgcatacaaaaaaaacaattcaattacttccaggaaaaccacgaactcatcggcttccaaatcaaagtaggactcgaagcaacgaggcggcgacctcagggaagacagacggcggcgggaggtggctaccctggctgaacgcgagggcacgcaccgccgccaacaaaaaaaaatcccataaaaatcgcctctccgactcctctggaagcatcaaacccctactcccccactctaccacatcgccgcggaaaagcgcagaaaaaaatgaacaaaaaaatgaagagaaatcgaactaacccgacgtgttcttcttcttcctcctcgagacgtcgggagattgcaccgatcaacagcggccaaccacaatcgctttcagaacttgtgcgcgatttggacactggagcgagatagcgaactatttttttttccacttctcctttcctttttcttttctttttgatttttaatcccttcctcttgtggcttccacgccaaggaccaggaggagagaaagcgagtggacacgggggcaaagagtcaaaacgacgtctccttttctctcactgacacggggcacgtgaggaggggcccgctgctcagtagatggcgcgtggggcccaccaggcaccaggtgggttttggactgtagctgctgccccgacgcgctgctcgctgccccac

SEQ ID NO: 14793 - DNA, 1501 bp, Oryza sativa; identical to SEQ ID NO: 14782

SEQ ID NO: 14794 - DNA, 1501 bp, Oryza sativa
taaagtgcaattgttaattccagggaaaatcctttttccttttctttttctttttcctctcttttccctcctttttgtcaagtgggccgtcggcccacttctcccttccttcccctcccttactgggccggccgcaggccgaggcccagcccgacagccggccgcccgcctccctcctctcggggtcgccgacaggtggggcccacctgtcggacccgtctccctcctcccgccgatcccgctcgcgccgccaccgccgcaaccgacgccgcgcccacgcctccgtctctcccgggccacgtcgaccacgcccgcgcgtgcgccgcattccccgcgcccgttcccctccctctcccgctcgcgcccgcgcccgagatggccgggattcgaaaaccgaatcccgcctctctctcctccccactcccccacgtcggccgtcgaatcccgccgctcccggccacgtccggttcccccatcccctatttaagcatcaccggcaccccctctcgctttttccccattgcgccgacctctcccgagctccccaacgcctccgcgccgtgcaaccacccgccgccgccgcttttgctactccggccgccgctagccgccgctaggctcgccgccgtctcacgccgtcgccgccgttagcttcgcgcggccgaggtccacctcgtccacccctcctccgtcgaggttcgtcgccggagccctcatctccacgcgcacgggtgagcgccacctctaccgccgccttcggccatagatcccgatcgccatggtccatctctctctctctaatctctatcttctccttccttagggcacgccgaagctcgtccgctagccgacgccgtcctcccgtggcttgccgtcgccgtccgccatcgccttcctccgcgccggccaccctcggtgaggcatcccctcccttcttttccccttcctctcctctagccgccgctctccgccgccgtcggtcgtcgctttgcgccgctgccgcatgtgcgccgccgccgtgtgagcgccgcgccgccggcgccatggtcgccgccgtctcgcgccgcgcccgcgcgccccggccgcgaggtcccgcgccgccgtccgatctacccttgggtagatcggggccgtcggtccggtcgccacgtggcgccgccgcccaaccttttcccgtgccgctgaccggtgggccgcgcgccgccaccctctttctctctctcccggtcgctgaccggtgggccccgcctgtcggcgccgcgccccctcgctgacgtcagccctggttaatattgcgcaataaattatttaaggatttcttttatagtaataaacacagtgaatcttctaaaattcatatctaattcatccgagctccgtttaatcccattcaagtctcagtaaatcaagaaaaatgtgtagaatccattaaaaatggttttgttctctgtttcagtagtcttatagcctgtttgcaatgtttgctttgtatgtcgctaga

SEQ ID NO: 14795 - DNA, 1501 bp, Oryza sativa
gcaatggggaaaaagcgagagggggtgccggtgatgcttaaataggggatggggaaaccggacgtggccgggagcggcgggattcgacggccgacgtgggggagtggggaggagagagaggcgggattcggttttcgaatcccggccatctcgggcgcgggcgcgagcgggagagggaggggaacgggcgcggggaatgcggcgcacgcgcgggcgtggtcgacgtggcccgggagagacggaggcgtgggcgcggcgtcggttgcggcggtggcggcgcgagcgggatcggcgggaggagggagacgggtccgacaggtgggccccacctgtcggcgaccccgagaggagggaggcgggcggccggctgtcgggctgggcctcggcctgcggccggcccagtaagggaggggaaggaagggagaagtgggccgacggcccacttgacaaaaaggagggaaaagagaggaaaaagaaaaagaaaaggaaaaaggattttccctggaattaacaattgcactttagtgatttttaattggttaaaattatttctagagctctgaaaattccactaaaaatcctgttaatgaatttcgacatgtagaattcaagaaaaattccacatgtcaaatccgattattatttgcattactttcttagggttttctcctgatttcaccagcattttcttagggtcaattataaattacaattttgactagggaggaaaacttcggggtgtgacagggcgcctcaaccctcggggccgaaacgggagcggtccgacccctcggggagacaaagaggggggcggccacatcaccctcgggcccgacccccccgagggggtcaggcctcgtgggtgattgctcctgcccaagcctctagtcatgatactcccggtcccatgtcaccgacagtagcccccggcgttatgccagggcgattgccctccttaagggaagcggtcgggcgtgacgccacttccaaaagcctggtgacaggtgggaccggtctccacagttgggcagaaacccaatggtcacaaatcacgcactccggcaacggtaactcgactgtcaataatgagcggcctcttcaagactgccacattactcaggtagcacgcgaatcgggacgagccggttcgttttgcctggagatatggtgatggcgcttcggtcggcgagcgtaattaacgcgggcacgatatgttccatctcgactgccacaaccgcatatccacctcatgcgccgcaagcgggcgaatgggattagtggaagcgtgggcgcgagaaacgagggagcgagatagtgggcgcgagaagtgaggagccgggcacagcgttggcaagggtatgaagacaccgaggaagagatttgcttccttcctctcgtcattattccccttgtcttcgccgcttgcgccctaactccttgtttcctgtgccctaccttcgccacacgcgctcgttctcaaacatctcctcttccggcgcca

SEQ ID NO: 14796 - DNA, 1501 bp, Oryza sativa
caggcaggggatgagcagcaggagctcgccgcggagatcctccgctgctgcgaccgcgtcatcgccaagctgaaccggggaggagccactggtgctactaccggcaagaagcggaaggcggcggagtccgccgccgccgccgccgtgacctccccttctctccccgtcacgccgaccaaaagaaggtgaggttccccttattgttttttggcgcggctaccgcgagacatatcgtggtatcaaaaatcgaaaaaaccgtgtggtaaccgtaagatatatcgtggtattaaaaatcgaaaaggttaccgtgcatgataaccgcgataatcgtgtggtaacggtacggttttgtactctatcatgcaaggtagtaacaggtgatttcttggtttggcgcagggcgcgtggcgcggaggcggtgagggaggtgaggagcggcacgacgacggacgggttcatctggaggaagtacgggcagaaggagatcaatggctgcaagcacccgaggctctactaccgctgcgcgttcaggggccagggctgcctcgccacgcggcgggtgcagcagtcgcagtcgcaggacgacccggccgcggcgttcgtgatcgcctactacggcgagcacacctgcggaggcgacgccgccgccgccgccgcgtgccgggacggggaactaatgccacctgccgtcatcaactccggcgcgtcgagcttcgccgccgcttggaacatggcctcgcgtgagccggcgtcgtcgctcgccgtcgagcggaggagctgcgacggcgacgctcccagcgagacgtcgcaggggtggtctccctccttctcgtcggaggtggagctggacgtggtgggattcgacctcgccggagccgactcgtcggcgtcgccggtgtgggagttcttgaatggcagcttcgactgggaattcgtcatcaactccctctgaattttcgatgcttcgtgatcagtagcacaccagctgccccaagagtgcagtagtctttgcaaaacgcacaaaatttcgcgggaactatcgaatttcccgcgtttgcgcttaagttaatagcctcagtagttcgtcagataatcgcacgcactattttaattcaggaagggatttagattgacaaagtatattaggtgagagttaatatgggagaattcgtaatgaagagttgaatgtgttgacgttgacgtacaggggaaaaacacatgctaagaagaaaaatggcaggtgaaaggggcaagaaatggcaaagctgagcaacagagcaggtaataatagagaattgctactcctactacttgcaagcatatatgtccagaagagcagccaaagagaacacaagaccgtcagcttgacgcataactgacgcacttctgatggtaacaaaaaaccggccaccatgtcccatgtgaacgaatggattcattagttgtaataatggtaatagtagtgacactcaattgcaatatcatgcttggtacagggtta

SEQ ID NO: 14797 - DNA, 1501 bp, Oryza sativa
acagtcaaatagaactacctgaaatgaaccaaagaaacagtgttactatgcaattgctaaaggagccatccgtatgataaaaaactaacttctaaagataaacttggacaagcattggttcaaatttatatctataagttatcctttttgggatagaaggtgtacaagtataaaagtgggagtaatatacacctgttcctctgtaattgataaagcttgatggaagtttaataatttttaaaaatggtttatgttaaaaaagagggtttatttttttacgtggaagtgtgttttttctccttgtttctacataaagattaaactgtactaaagaatatcacattttaatgcacatatcctcctcatcagcatttatgcttgcagagatttgatcattaattgccagttcatggagtggactaattaaagtggagtggcggcattgcagatttgcagttgtcgctttgcgctccgcgcgcgacgagaaagaaacgtgacttttagatcctgcgtaccaacaaacacaagaacgacgaaacaactcaaatgtgtgtcaactcggcgctaaaagattatcatttccatggtacaaatataccttctgttcctgtgcatatcaactgcaaagtttaagtttaagcttattttaactatacatctactaaatgtgtgtcaactcggcgctaagagattatcatttccatggtacaaatataccttctgttcctgtgcatatcaactgcaaagtttaagtttaagcttattttaactatacatctactaaatgtgtgtcaactcggcgctaaaagattatcatttccatggtacaaatataccttctgttcctgtgcatatcaactgcaaagtttaagtttaagcttattttaactatacatctacttgacaatggaggtagttgacagtaaagtaattttttttaggaatagacagtgaagtaatggtaagtagttttgtttgatccatcagtcggagacccagtgtatttgagttctatacttgttacgtgcacaattgtcacgacctggcccttagttcacgggctcatcatagcctacaccccatgctgggcctcatcatgaaccgctggaatgccttcccttcgcaccggaggcaggcgtacaaacccacaattacaacaaagccaaaacgagaccaaatcctgggcattaccaacgcaccgaaattactactccctccgtcctataatataaaagatttttggagagatgtgacactttctaggactacgacctatccaaattcgtagtcctagaaaatatcatcgctctaaaatcccttatattatgggctagaggaagtaataactatataagagaactttccttgagatcaacagaaccataaaatatgctggagaataacaacgcacgaacaggatttaatatcctggacgaacacgatttcatgcgtgtgctcaataatgagaagccaaacatatcaaaatatgagtcgcgaagta

SEQ ID NO: 14798 - DNA, 1501 bp, Oryza sativa
attgagcacacgcatgaaatcgtgttcgtccaggatattaaatcctgttcgtgcgttgttattctccagcatattttatggttctgttgatctcaaggaaagttctcttatatagttattacttcctctagcccataatataagggattttagagcgatgatattttctaggactacgaatttggataggtcgtagtcctagaaagtgtcacatctctccaaaaatcttttatattataggacggagggagtagtaatttcggtgcgttggtaatgcccaggatttggtctcgttttggctttgttgtaattgtgggtttgtacgcctgcctccggtgcgaagggaaggcattccagcggttcatgatgaggcccagcatggggtgtaggctatgatgagcccgtgaactaagggccaggtcgtgacaattgtgcacgtaacaagtatagaactcaaatacactgggtctccgactgatggatcaaacaaaactacttaccattacttcactgtctattcctaaaaaaaattactttactgtcaactacctccattgtcaagtagatgtatagttaaaataagcttaaacttaaactttgcagttgatatgcacaggaacagaaggtatatttgtaccatggaaatgataatcttttagcgccgagttgacacacatttagtagatgtatagttaaaataagcttaaacttaaactttgcagttgatatgcacaggaacagaaggtatatttgtaccatggaaatgataatctcttagcgccgagttgacacacatttagtagatgtatagttaaaataagcttaaacttaaactttgcagttgatatgcacaggaacagaaggtatatttgtaccatggaaatgataatcttttagcgccgagttgacacacatttgagttgtttcgtcgttcttgtgtttgttggtacgcaggatctaaaagtcacgtttctttctcgtcgcgcgcggagcgcaaagcgacaactgcaaatctgcaatgccgccactccactttaattagtccactccatgaactggcaattaatgatcaaatctctgcaagcataaatgctgatgaggaggatatgtgcattaaaatgtgatattctttagtacagtttaatctttatgtagaaacaaggagaaaaaacacacttccacgtaaaaaaataaaccctcttttttaacataaaccatttttaaaaattattaaacttccatcaagctttatcaattacagaggaacaggtgtatattactcccacttttatacttgtacaccttctatcccaaaaaggataacttatagatataaatttgaaccaatgcttgtccaagtttatctttagaagttagttttttatcatacggatggctcctttagcaattgcatagtaacactgtttctttggttcatttcaggtagttctatttgactgtttcttgtcagtaataccattaattctcacagcctagtgac

SEQ ID NO: 14799 - DNA, 1501 bp, Oryza sativa
catctttattggttaaaaaaaaagtctcacatcatcttccttatttttaagaactgtcgaatcatcatcggccaaacgcactattcctgatgggccgatttgagcacaagtatcagcagcctttctcgaaaacggcccagtaatagcttgtctcatgcgccgttattttccactctagttgtttgtgctagtcctcaacgaaaacgactaccccgattagtttgaaaagctggttgacacttgacacttcctccattctactccctccatattaaaatatagcaacttttaattggatgggacatataggcagcgtgattcgttccattgaggcatggtatgccgctagtattcaagatcgaagcccaaacaccgcacagatgaaacgctgtggtgcggccggcggcccggggatgtagacagccacgcatgcggcatgctgttgttacgcatttgatattatcggattgtcactgactagacaagactactccctagtcttccccatgttaggcctccttcaaaggtcctttgaagacaactgctagctcataaatcgtacacatcatctaagagatagaacaagagatagtttctctaatgaattgttgtaacgctccgattttcgttcgggtttaaaaatcaattaataatacattttctagaaattaaataaaagttaaatcaatttaatcaagtgaaataatgggagaattaaaattttcccttaaaaatcattggccgggaatattttgcaatattctttgtgccctaaaatactctccggaattttccgcgaattttcggagctcgagaaatagttttaaagtcacaaagttcatttaatcaattaaaataaaaagaaaacaattaaaatcctctctcctctctttgggcctctttcggcccaagtcttccttcctctcccgcggcccgcgcgccttctccctctctcgggccggctcccctctcacttggcccgctcgcaaaagtctgttttgcgtccctccttctctcccttcgccgacaggtggaaccggcggtcccacccgtcagctcctcctcctacctctcgccggccgaccccaaccgccattgccgttcacgtcgccgcaaaatccggcgccctcccgcacccgagctcgcatccaacgacgtgggcacgatcccctccacgtcctccaccatttcccccactctccccgcgaaaatcggcgccggttaacccctccaccaccccacgtcggcgccccacttcgccggccgattccgccacgtccggcctcgatcccgccttcccgagcccataaaaagcatccccgtgctcccctcgtccgtttccccatttttcccgagcccggcatactctccctcgctctccccacgccgcacccacgcgctgccacactccggcgaactccagtcgccgtttcccgccgccacagccgttgccgcgccgagccgccgccaccgccagcttcgccatcccgcgccgcacgcc

SEQ ID NO: 14800 - DNA, 1501 bp, Oryza sativa
acctgcactgagaaacaaaagagaagtactcatatagacaaaattaggcccagttcctatcgcaagaaacataccgaaaacatagcccaatacacatatcaagtctcaatgtgtactacctccatcccataataaattcatttttagtccctctaagttctcgcaaataagtttatttttaaataattattgtatcggagtttgtaaaagtatgaaataattacatcagaaatagataaagttgtattagaaataaataaagtgtagaataattacattgtgatttgataaggtagggtattttagtttttaaacttattttgggacagatggagtaaatgaatttgtatatatggttttgaaaacctctagaaataagaacgtgcatgtacgctcacctgaaaattttgtgcgctcacaccatgtgctacatttgtcttttctttcaagttatttattccacccatatatactggcaatactctctccgtacaaaaatataaacttattattaaataagatattttctagtacagtaaatctgaatagatactgggaaatattccatttaatattatgttgggttatttcggaagggagggagtacttgtcatcccgaaattggcagccaaactggtgagaaaatagcctggaattggacaaacattgctgtatgtctttcatccatccaaaaattacgtacgtgtgtaaagaaccattaagcactagctggcatcctgggtggcactgaaaaccgaagacgctagctgtaattttgtactccaggttgcgtagcagtaaggtagtcacacacaagagttaaaaatgcattggtccagtggttgcggcaggcttcgttttcaacagcatttcattcccttgacatgagcagaaacacccgcaggaacacgaggggagggctacagggcgccgagggccaggccaaccgatcgagtcaacctttcaacactcgccaacatttcttcccctcctgcccatttactcgctaccaattgtacaagctgcccatccccctcattactcccttgccttttaagcactctttccttccttacaattccaaactttacacttctataccctcttctctcctccggccctatctacaactctacatctcctcctcctttctttttgttcttgttgtccatctccatctcgtcatacacctcccaagcacgggagtatgcctcaatgtccacagagaggtaagtggccacctagaaatgatttcagttgaattctttaccttttgtcccctttttgtctcttggttctttttgaaattatgcttctctctttctgtttcttgatttttttctctaaagaatcggagaggttttctgttccttttgcttggaaggatagcatgtaccttttgtagttcgtggttaaaacttgaaatcttgcattgtggtttgcatctggtccctctcctgaatccatgcaagaaaccctaaaaaccttcttcggccctttc

SEQ ID NO: 14801 - DNA, 1501 bp, Oryza sativa
aaggtcgaagtgttgctcttcgcaccccacgcctcgacgtgtatagtggtcagagcctcactactccctcaacctccatagcacgtcgcacactagctttcaggctctgtgcgattcaagccgctctgctgccactcacggctgtagggtaacactattccaccctgcaaacctgcacaaacttctcaactctctagccattgtgctgcttaactgtagcatcgactagacgagccaataattagctgttatgccttagcatcggctaaccaactccaaatatctagccgtcgtgctaccctaccctagcaccgactagaaaccaatccaccaaataaacctcacctctccattttatcctttcctcaattttattcgatttccaacctatagaaaccatcacctctcttttattttcaatctaaaatttattttgaacccattccctttttcctttcgcctcgctccaattttatttattccttgactttatcgtttctttgtagcaatttgcttataggctttatttgctatcttttcgtattcgtacgttagaccatacaagaagttctatcggcatccaaggagctgacgtggacccagatggctacgctgaagccacgggaaatattaaggcacaaggcaagacataattaaaattttgatcatatagaaaactttatatgatcttcatatttaatttgatgcataataccttactcttttaacatctcatgggtagatgttaaatgcttttaagcatgattgcatgagaacatagaaagaagcattggttatcattttatgtaatttactattccaaataactttacaaacttaggaatccggttaaaatgggcatttatgagttgagattatgaatgttgtgattatgaatgttgatgaagtttgtgatgctggtgtggggagtttggaaagtttttgggtggtttaaccggattataattacccccttataccatgggaaatgatatagttgcgtccatccacacaaccaagtaatttgacttagcctagtatattgtcccattatatgaaagactattgggtggctctatgagcggttttggggtgaacttacgtaaggagtttgggcggcagtgtttcacaacagtgggattcatgaaagtgtgacgatatagataccttgcctaggcctagcaagagttcgaccactatgatgaaccaagaccccactgtgcagtaactagtagtaagtgggactctcgaacggctatgttgtcctcagccttgcaaactgttgacatcgtgcgggtaaaactggacagtctctgcagaggtgaattaaatcattcgaatgtgccgtactcccggttctggagttgtgccattagggtgattcctactcctgaagtataagtagttttaaaaattaaattgttgaggataaagatgatttatggttttcattactcctttactttattattgtttatttattcatatctattcatcttta

SEQ ID NO: 14802 - DNA, 1243 bp, Oryza sativa
aaagtttttatgttttttctacaaatcaaagagacatgcttcttaatttgagtcttttttttggataataataggtgataaaaatagacgcttgtttgagcctatttggctatggcttgtttgagcgttttagttgcagcttaattataagctaaaggattcattacgtaacaaaaattaaaaatgtaacttgtataccacgtattcttagaggttttaaaccaaaagttccatgatgagttaaaaccatgtaaaaaattaatggattaattataattcaaaattattttctactagggcaaaagttatagatccaatccaaagaaggccttaattaatatatacttacttcgatacttgcaacacatgatggaagtcttccattagagccagcgaggagatacctgatcgacctcttaattagcacacacaaaggcgcgcatatatttactacttctctccgtagatatatatcatacgcctattaatataccatgatgactaattaactaataattatataaaattaaggtccttcacctaacactttgtaagagcaccatcaacaggtcactcaaatactaaatcccaaaattccatttaagaatttctaatatgcattttggattttagaaaaaaaactttaatccaatagactgcctagaatattaactctctaagacaaaacaagtgaggttactccgatcatctattagagcaggtacaatagcatgctataaaccaaccataataaacatatttaaaggagataaaagatgtagtcagccataataaacatatttaaatgagataaaagatatagcacggactacaagaaccataataaacatatttaaaggagataaaagatgtagcacatctattagagcaggtacaatagcatgctataaaccaaccataataaacatatttaagggagataaaagatgtagtcagccataataaacatatttaaatgagataaaagatgtagcacggactacaagaaccataataaacatatttaaaggagataaaagatgtagcacggactacaagatgtatgtgttgtatgtgtgctgtaacaggcctctctctagaactatgtagccaaggagataaaagatgtagcactgtaacaggcctctctctagaactatgtagccaaggagataaaagatgtagcacggactacaagatgcatgtgtgatgtaacactctctctagaactatgtagccaagg

SEQ ID NO: 14803 - DNA, 1501 bp, Oryza sativa
taaagtttaattatcattatattcctctttttgatatagcatgaatcacaataaagcatccaatgactcggtatgtaatgtaggtgcatatgcattgcgttgtaaaaatcttcttctaataagtagaacataattttatattactacaacaaatgcaaatggcagtgtgagagcatcaactcacgattgccctgtcatcacaaattttcaatatgaagattccttgtgcatgagttcatatatacacatcccgaaatgcttttttatatccaatggatggtttccattttagtaaagtacatgggcatgcataaaaaaataagattaggatgttaataattagggtcgtcaaacatccttagccaatcaacacaacttatagatgagacaacatctaagttggggaacaagacagagtagatcactagggaaataatttcaacaatattcccaacataaacagagagtcataacctctggctgcctccgccaacccagcaagcaccacgccacgcgaaggggagaaaaaattaaaatcacaggagtagaaaaaatagagaagcatgtagaaatgtggacgagaaacaaaagattaaaaaacataaaaaaactgaaaaaaaaacaatcgttcggatagggcataagaaaaactcatgaatcttgattctttattagaaggtataacgtggtagcatatgttatctatttttttgtgcttagagcacctcaagtataatgctaaaaatcgaactatgcgtaagaaaaaccgaactgaccacacagtgagaaagctctaagctagctgcatccgaataatgatgaactaatgcatgcatggttccatatactccctccatcccaaaatgtttgatgccgttgactttttaaaaatgtttgaccgttcgtcttattcaaaaaatttaagtaattattaattctttttctatcatttgatttattgttaaatatatttttatgtacacatatagttttacacatttcacaaaattttttgaataagacgaacggtcaaacatattttaaaaagtcaacagtgtcaaacatttagggaaggagggagtatataattatatattcttctccatcttatccattccaatgacaaattgacaatgaatctcagatccacatgtatatatgcacgaaaaaactatacacacatgtggttgtgtccagtgcggagccagggatgcagccgtccacctaattctgggatgttgatgagtggatcttgccaggagtaagcctgaaattagaacggttagataagaagaaataggtactagtaagtactattacttaatccaacaaatgcatgtgatgacgactgattaatcaattataagtcaatacaatgttacttaaaaaaagaacaacaatcgatttttcactagatacatgcatgtgctaggcagcttaattacacatggaacatgctaacatttttttaggcaaaaatctaaatagtgtgtaggcgatg

SEQ ID NO: 14804 - DNA, 1501 bp, Oryza sativa
actgagattcagacaattgcaaatgatataactagtaatatgttcctccttatgtcaacctaatttattgctagtacaaattgctactggctttgctatgatcttttgctatcgcccaaccgttatagaggccaactttacttggttaatccgatcaaaattgtctagcattattgttaaatatttcagaggacaaatattatgtgattgtagtgtcttgatcgatagttcggtacaatacatcgtgtccaccccccatccaggatccagcatcgagtttgccacatagtcctaatttcgcaattagattatttgcgtgcaattgggatatttagttaaattaatctactaatataaaaataccagttcattaaatatcttttctaacccttagtctgtatatccaacagctcatatcaaggtttggatctgtccgttctaccacctctaaacagcggttaccgatcggtcaaagtaacaaaaaaaaacaatttttcctttcctgcgccagcccgccgccgctcttctcttcctcgcgcgcaccagcccgccgccgccagccctctgccgtctccgaccgccggacagccgccggctcagggcgcgcgcccgccgccaaccctccgccgcctccgactacaggacagccgggcgccgccgccggcttaggcgcactccctaccccgctgccagccctccgtctccgcttaccgcctgagcctcctcgccggtgaccctgcttccctgtaagaatggatatgaagtttgacaagtttgacagctagccagccctccgctcgtcggtgaccctgcttccctgctctctacgcgactgagaggaaggagaggcgaggtctgctcgcgccggcactgcgctttcaggtccgtcccgccctcgccgcctcgccctacggtgagcacagtgctgacttctttgttcgcacaaattcatccatctatgtcagtccatgctcagttggtcacattcaagattaacgcaaacaccgaactccaattagcttccttaactgatcgacatagaatgaatcaagacagtcactttcagtaaattggtatgtctggaggttatttcagtttctgacttacatgctttatgttatttcagacggtgatttacatggtatatgctctatgctatttcagtgtctgactttcacagtgctacaaccgtaagcaaccatgaggcggcatcttaatacagtgaaaaacaatgcgaacgccacagcagaattttcaacacagtcaagtatgttctttctgaagttttatcttcactatcttgctataattaatatttttctggccacaacacatttttatcacataatggtttgattttacttttccatgccacatgttttaggaagaggcgcactgcataatcaaacttaactgctgccgaggttaggagaaagcatgaaagggagaggtatgcttcactctctacagaacagaaacaagctaggcttcaaaagaactg

SEQ ID NO: 14805 - DNA, 1501 bp, Oryza sativa
agacacattgtgtgccagccgtatttatgtgatggattttaatggctttggctgatgtccgtgtgggaagtggaagctacttgatcgctctataatgggcttagcattgatgacacttttgctgtggagtcggagctgctgtgttgcaagaggtgacaagctcggcaacgataacataaattctacgtggtcgaagcattcttgttactttgcggcaagctcggcaacgataccctatgtttaggctttgccattgttggttgtttggttggatggtgtgtgcagtgttcggtgtgttgcgcttgttcagccggcctcgtgtttggtgagacttgtgtagttgagttgttttttcttttcatttaacccgttgggtttttatccccgcttattgaaatataattggagcccttcggctggtttcgtttcaataaacaaacatattattatccataaaaaaggtgagtgatcgaagaaaaaaatttgctgtagttcagtggcaaatcaggacgaaaaatagaagaatggctcatgttgaagctatggcataagataagggtagtagagatgattttgctagccagtattggactattggctaccaaattttaatctcataatagatacgtaaaaaatgagtagcaatttgtaggcttgttagcatcttaatttgtaggctgtgttcttttggaggagttgggaaccccctcgcacagaaaatggagcgatagattaacacatgattaattaagtattagctataaaaaacttcaaaaagggattaataagactttttaaaacaatttttctatataatcttttttgtaaaacgcatacagtttagcagtttgaaagtgtgcatgcggaaaatgagggagatgagtcgggaactcatggaaaagaacataatggttgtaatgtaacacacgagtgccggtcagccacagcaagtcagtgatacggttgtaattgtgagtacatgtctacatattaaacattcagaactaattatgactgcaattcacacatccacgagttggctatagatggccaaaaggcctgaggcccgacggcccggcccatggcacggcattttggcccggcccaagcacggcatggcccgacggaggtcgggcccatgccggcccggcccgaccaccgggccatgccggcccggcccgaccaccgggccatgcctgggcccctccaccggcacgttggcccggcccggcatgatgggttggcagttaggcccgataaaaaaaaatatgggagtaaaaatagacatattatatgccatggacgaaagagtagggatctaaaatagacttttttttatctatacatatgtcagccaaagaggagggacggcaaatagacttattttagctatacatatgtcagcccaaagaggaaggatggaaaatagacttattttacctatacatatgaaatagcccaaagaggagggacgaaaaatagacttattttaaaaaaggcc

SEQ ID NO: 14806 - DNA, 1501 bp, Oryza sativa
gttcccggtcttggtgtttggtgtagatcagatttgttagataggcgttgtactatcaagacgggtctatgaagcgagcatgtttcatatgcatgtaggtgcatttggtgggattgtctagctaagtgtaatgagttttcttaagtcccaaacaaagaaagaagttggtacatcctataagtttgggtagcttaatgtggtattctccggtggagtatccttcggagtgtgagccctttctccttgctttaagttgtgtttcatggatggaaatttcatgagttggatatccctttgaataagcttttcatagagtccaagaacgtcaaattccgagacccgagtcaagagatatcatcattttactaacagctggttgtgctgaaaagtgaactgcggtatgaccgcagcccttatggcggtctgaccaatgtgtgttgtctggtctgaccgctgatcctgattttgaaggaggtctcatcttgacgatacagagccgaagacggtctgaccggagccgatggcggtctgaccggcatgcctatggcggtcagactggctagccatcgcccgtgcattaaatgcactgtaatgactagttttctagccattacaatagagagcggcatgaccggccaccccatggcggtatgaccgcccaacacctgggagttcgggtttcgcctccaacgactagttttggtggttgggggtttatatacccattccccagcagcaagggtagggttttggtactccattgcattatcttgaacccttgcaagagctctcacacccttgtgcatttagtttatctagtgaggtgttggagagtgagttaagccaatccaaatgcatttgcttctttgttagagctagtgtggcacttgatcatcatcggcaagcatcctagacttgttactcttggaggttgccacctcctagacggtttggaggagttgcccggtgacctctccaagaaggttgtgtaggaggcccggtgttgattgtgagtggctcggtgttcgccatctccagagtggaggaagaacgaccatagtgatagaggcttatgagaccactttgtggtttgagcggtgaagttggactcgcctcaacggtgacataggaagttggcaagctccgaacatcaggtgaaaaaattctttgtcacttgtcttctttattttgtgcaaatttactttgagcaagtttacatactagagtttatttgcgctattatcaccctaggcttgcaaatctcaacataggctagcttcttagtgcacttgcttgagattagttgatttagattttgaattgtgcaaaaccgttttgatttacgcttccgcatacaaaactcggttttagccaaaagttttaaaaccgcctagtcaacccctctaatcggcctcctatcctacaggggtctcagcccaaagtgaaccgtcacgcgctccatcctctataccctatctctactacctacccgctcctctct

SEQ ID NO: 14807 - DNA, 1384 bp, Oryza sativa
tcgcgcgcattaatgaacccgacgacacgcgcgcgcatcatctgtgacgtacgtgttcgtgtgaatagctcgctgttcgtggccaaggcgccaacaaccacacgtacgtcgacgtcggtcggcttaattcccaccagcagccgatcgtgcagtgcagagacgtacagcgcagtgtgacagtcgtagctagtagagaaggagaagaaaactgaaaacggccgagcgagcgaggcgagccatcgacgtctcgctgcatggtccctcgacgcgtaccggtgtaccacccacacacgccgcagcaaccaaatcggcctgggagttgagcagcgtacgtgtcctcccgcggatgtctacaccggccggccacgtacatcgccgtcgtcgctgcgcgaccgctcgctgggccgcgcgtccatatcatcccaccgcgacgggctccgatccacttccactccatctcccggctcgacatcctcctccgatccgacccgggcctcgcctcgcgcgcgaccccgcgattccgccgcttcgcgcgggccgttcgctaagttttcttcacacggcctgtacgtctcggggacgcgcaaaaggaaaaagtacaccgaaggtccctcaacttgtcctcgagatacaaaaccagatatcccacgtcccttaactaatcaaaaccggtcacaaaagtcactcggcggttttgaccccggttttatcctacgtggctgctgagtcagcgtgggacccacgtggaccccacatgtcagcttgggccacgtcagcctcctctatctttcccctattctctcccttccgcatctgtctcactcttcccttctcttcttaggtaagcagcgttgctggcactgccggggaggagaccgccggggcgaggcgggatcagccggaatgctgagctcgtccgcatccttgccaccgtcgccgccgggatcctcctcagcgccgcctcgatgctcgcgttctgaccgccggcaacgacgtcggtgtgggggatggacaccgaatagctccggtagtccgttccctcggcaggtgccaagtgtacttggtgtacgccgacgctgggtggaggaacaccgggatgtagccggcgagcatggagtcgaacgtcgacttgcgggtataggagtcgccacgcggctggatgcagaacacgcggaattgaggagctccatgatccgccccggcgagtttccgaagtgggtgcaggacggcgacgcgtgcactgctcgatgatctgggcgcgcacggtcttggtgctcccggggcgcggcgcgccggcgaacgcccagagccaccggcggtcgcgccgccgcatgcggtcctaccaccggagcacgtcggcgtctaacaaaagtttatctctaac

SEQ ID NO: 14808 - DNA, 1501 bp, Oryza sativa
agcaaaaaaaacatgtttaatataacacagagagaggaatcgcaacctatttttattaattttataacttaagttagtaggcatgttgaatttggttggttggttgcatatcgacatgatgatattgatgactagtgcatcaataatatagtaggtgatgaataaaggtggtaaaaaaaacatctaccgacttattcttataggtacgtgcaacacgcaagtagatatcgctggatatttgatgatgatataatattttgtatgtgctattctataaggacgagaaagactggtttggctcgagtagagttggatattaattcatttagccaattcatatattaacattaacagatttcaaggctctaaatgggttaaacaatgtctaacaattaaaagcttaggttaattagctacaactagcaagttgaacaattattgtttggttgtggctatgtataacttttccaatttagctcttaggatcaatttgtttgtgctatttggaatctactactttgtttactgtgatttgtgaacatgcctcctgatatgctaaacaacgcttttcttaaaaaaatatatatcaaaatttatttgaaaatcaaattaatgtattttaaaattgataataattaatacttaattaatcatgtattaattactggccgtgttttctatgtcacagttttgtttagccggacatcttagatcgaaccagaccttagtcttagctttgccacctagttccctaggttagttggttaagcggtcgctcctgactacgtctcggggtaaactacttctcaaccttacctccattcaaaagtcctaaaatatagtagtactcccttccctccgtttcatattataagactttctagcattacccatattcatatagatgttgtctagattcattaacatctatatgaatatgggtaatgctagaaagtcttataatatgaaatggagtctagattcattaatatctatattaatgtgggcaatgctagaaagtcttataatatgaaacggaggaagtaacttttaactctaaatctggatttgcacttgttcagattcataactaaaaatgttatattcttggatggaggtagtgctagagaagccaaaccaacaatttcggtttagattgaatgctttaaaccatgactcagaccaattacaaacgatttaggccctttttagtttaggggtgaaatttttggcgtattacatcggatatacggacacacatttgaattattaaacatagtctaataacaaaacaaatcatagattctacatgtaaactgcgagatgaaattattaaacctaattaatccgtcattagcaaatgtttactgtagcaccacattatcaaatcatgacgtagttaggcttaaaaaatttgtctcgcaatttacacgcaatttgtgtaattagttttttttgtctatatttaatactccatacatgcgtccaaatattcgatatg

SEQ ID NO: 14809 - DNA, 1501 bp, Oryza sativa
  unsure (1)..(1501): unsure at all n locations
acgtgtacccgctcggcgccgctacctgccgccggaactcctcccgcagcgccgcgtacaccggcgccgtccaccgcgtgatcaccgtgccggagtccaccaccgtgccggcgccggtggcggcgtcgaacgcgaacgatcccgcggggaccttcacccacgcgtgccccacgctgagccccgtcacgttcacgtagtagagagacgacctgtgcgggttcctcagcatcggcgtgtaccggacgctcctcggctgcccgccgccggcgcccagccggagcgagccggagaagtagtatgacctgtagctcgggaggcagtaggagaagacgccattgtacaagctcccggcctgagagagcagcgccatggggccacgcccgaaggcgagcagcccttgccttggcatgtttgtggtnggccccgtcaccgagctcacgcacccgaacgtgtagttcgggatggcgtccttgcccagcctcagcgtgtcgctggcgagcgccgcctggaacgacgcgtcggcgaacggcttgaaaaaggcgcacgtcgcaagcgtcgccggcggcggcgccgcgtcgccgccgccctgcggcgccgggcacgcctggccctggaacagcgggcaccacgacgaggagcacggaagggaggcgtagaaggaggagttggccgggccgaagaggctgctgctcgggcacgtgccgcacggcgagcagtgcgcccacgtcgcgtcggcgctggtgtcgagcgccagcagcagctgctgcgacggcgagccgaggccggcccggacgacgtaggacgggggggcctggccggaggcgacgggggcggaggagacgccggcggtggctgccttggaggagaggaagaggaggcgggcgtcgtcgtcgcgggcgagcgcgatgatggactcgagcggggacggcgacgaggggtgcacgttgtggtacacggagagctcggcggcggcggcggcgacggtggcggccaggaggaggaggaggagagggatggtggtggtggccgccatggcaatggagctctcctggctaagctagcttgcttgctaagagagtgtcactgaggggagtgaggattgtgactgagcgagctgggtttatatagggtttctggctgttgatcctgtagtctttggcgccgatcgattgaatggtttgagcttaattacggcggcacggacaacatgacgggctaatagcgcacattcaaatcattaagtactactctagtactctgtccaaaagaaaaataaaatctctaacataagtagtatctaggttcgtagttagaattggacttgtttttgtttttagagacgaatgggtattttaaaaattttgaaatatatttattttttgacaatgaactttcgtaaatagtttctgtaaaaacagattatttattggcttgaaaaaacgtgctcacgaaaaagagagataccataagctaataagttcatcattattaaggtctcctt

SEQ ID NO: 14810 - DNA, 1501 bp, Oryza sativa
agttggataaccaaataataggaatgggggaaaagaataaatagtgccagttcaagcaagaggaaggagcaaacagggatatacatgaggggaaggggagggggaggtgaagtagatggaaatgtttggaaatgaatgtggtgttccgtaattattaactctattttgtgagaaaaggcataaaaaggtataatacagtttgtgattttttaattaaaatattgttaatacgtgatgtagtattttttttcttttattatagagagcatggatgttctatgttttattgatcgttgtttttctcgatggtaggtgcatatgtacgtaggtacatgttctttaattcttttttccatcgatactgtgctcagttttgttattttttctggggtatgtacgtacatattttattttcctttttttccccatgaatacgtgtatatatttacgtacgtgcatattattttttttcttgcttttttctcttggggccgccagcggagaagtgaaggatcatgtaccatataggccaatagggaaaaggagagagattgcttatgggggttttattttttttctaaaaagaaatttaatagttaaaaatagtgggtccaccgatttatgagagtgccatgtggtagcttaggagcttttataggataccatatggtggtttagaagcgtttatataaagtttaatggatttttagtatataatagatagatagatggcccaattcagagtaattttagagaaaatttgtggagtgattgagaagcggtctttccaccataattgccacctgccggatccagcgtgttagctgtggtctgtggaaggctagaagctgacacccatgcttttgatccatccaagtaccctattagtatgttctaatttttccctaaagtatttgctcaattatacaattatacggttgtattcattttgattaatttgaaagaggccataggattatatgttaaagaaaaaaaatcaaccgttcaaatttaatgatccgtgtgtgagaagccaatatttatacgactcgttgcacattcaatattttcgatattttggtaattgggtttaatgtttaatgtagtggttattgatttaagggcgatatttttttaatgtgtaattagttgatacatttaaaagtaataaaataatttacatagaagtggtgaaacaacgcctaaattttcagaaatcgaacgcacaatttgcagtcttccccaaatccatttggatcattttagtacgaagtagaaagttaggtcattagttgaacagatacagtgatatgtgtatatatttgacagtgatgattaaacaaaaacggaaaagcaaccacgccacgctagtccacacgaaagaaggggaaaaaaatgaaaaagaaagggcagaaagtccctcagattgattagtagtgcatcgtctctatccgtcgcggattgcccaccaagaattcaagaaaggcaagagcagaggtga

SEQ ID NO: 14811 - DNA, 1501 bp, Oryza sativa
agctcgcttagcttggctcggcttaaataccaaacgagccaagcctaagcgtcctttctagctcgtttctgaaacgagccgagcctgagctgtctcgcgagtcgcttgatttggctcgtgagcctacgctatcattaattatatgggtgattttattttctagtgaagttattatttgtcaatatgtaatttatcatttatattttgatgaattgaatatataaagttattttaattttacatattaattatttgttattactttttttaatgattataaattatatagcttaatggaaggctcgcaagccagctcgagctagctcgagccacaaacgagccgagccaagctcatgttttagctcattgctataaccgagccgagccaagccgagactagcttgttgcgagccattgcaagccgagccgctcggctcgtttccacccctagtgacaagtgacaacgtcgtcgtgggcatattggggaagcggagcaccctgaaaaaaaggtcgcacgccgcagcctccaccgcacgcttcttcggctcccggatcggatctaccaccccacttcggaaattaaagacaaaaaacccttcgcgaagcaacgcaagcccacgcgtccggttccctccacgagtccacgcccgcccagggattccgcacgctcggaacgcgacccgagcccatccgcgcgaggccacaccacaggcgtgaaatccccgcgctgcccacgagcccgccgcagcgccgcgcgagggcagtccggtcaatccggcgcgcaaccctccccctcgcgacggcacgtgaccgcgcctcgagcagaccaccggctgtccccggccgtcggatcggatcgggatttaacctcgccgtaagccgcggataagcgcgggggattagaatacttaacctctcctctgctctcctcctcacccggcttaagcgcgcgggggggctgcgattcgcaggcgagagcacatgccatgtgaccccaccccaccactcctccctcacctacagctgttaaggccagtcacaatgggggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctccgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggcctaattgctctccccctctactgtgtttgcgtctttcttctt

SEQ ID NO: 14812 - DNA, 1501 bp, Oryza sativa
accaccaccaattcgcaaagccaggtttcgctgatgtggtatcttagtttgtggggctcgcaagtaaagtgaccacctcaccttcttcctatgcttcttctcgtctcctccatgccaacttgctcaatactatcggtgtcgacgacaagctatacgccaaatacccttgatgaagattgcggtcagtgtcgatgttgtctctggtggcgggtgatgggttcacaaagtggagcagcatgtgctcctcaaggtgctcgcctgtaggctgtcgccaggcgccatctccttcttattgaagttgtaacgcatcgtcgggaagggcccaaacaacgctattgagttggagatcgaggacgggagacggatcttgggtgggcgcaggtacaattattgctttcgatgcagcgagccctcccacccacaccacctgcgatgccgtcatgtttgtcattgcatatttgtctatcctctgtcgaattcacgggtgtccttcactgattgtgataggacttgggcaagcctcccttcgcacaagcaattgaccgagcttgagctcacgtagggcttgctggctgccgccgccactggatcccttcgcgtactgaagggcggacgagctcaagctcccaggggctcgtcggcaccgccaccactgcttctcttcccacaggcaaactcacaatgcactgtctcccttgcctccctcctctttcccgtgttgccacaaaccactggagcccctctttgccgacctcctactgccattgttgccttcgtgatcatctcgccgaccaccccgctcatctcctcaccaatgagctcctaggaagagatgggagaggtggatgtgtacttacatatgggccccaaattttttatttgttctcattaggatgccacgtcagcgaaactggtcatccatcctatcataggatctaatttaatccaattttgtaagttggggagaaggggtggtaaaatttctggtattatggtttagaatttaaactccacgggaagacgagggacaaaggcggacttgttcccatgcacatatgtgcttaccttgtgccttgtccgagctgttggtggcttcgtgtgcgtttagaactttcggcccatctccatctataaaatgaaacaacactatttttatctctcgagaggatatcctctcgttgtttgcatgtcatctaaatagttatcaaaaaatttaaaaaaattaacaacatagattaatacgaaatatatcactccacaaacatgcaagaccaaattcaacttctataagttacaacaaaaataacaaattaaactgaaaatagttatctcacattcgcaactatatttgttatttttgttacaacttgtagaagttgaatttaaacttgcatgtttgtggagtgatatatttcatattaatctatgttgccaatttttttcatatttttatgactatttaggtgacgtgcacgaaagagatgatttcactttcccgata

SEQ ID NO: 14813 - DNA, 1501 bp, Oryza sativa
ctagtctctatctctatctctatctctttctactattataaaagataaaaatatttttaacggttttttatgtcatcagtgttgagtcagttgttaagtacgttcgcttttaagatacatatccgtatttaagtcgggttttaaatttgttcgcttttaaaaaatacatgagttatataagaaatttcttaaaaaaacctcatatgctaacttgagatgatcgaactcctaattgcagctcatgattttttcagaaaaatatatattcaagcgaattcttacagtgaatttcgtataacaataataagattaaaatagtcttctatatattatctcacaagacaataattttgagaatataccactcaattagcgcgccttttaggttttaccaactaatcaatgcattgtactccttccttccctaaatgtttgacgccgttaacttttttaaatatgtttgaccattcgtcttattcaaaaacttttatgaaatatgtaaaactatacgtatacataaaaatatatttatcaatgaatcaaatgatagaaaaagaattaataattacttaaattttttaataagacaaacggtcatatatatttaaaaaagtcaacggcgtcaaatttagattttttaataaaacaaacggtcatatatatttaaaaaagtcaacggcgtcaaatttagagagggagggagtataatttaacattagtatttggtagcattttctcaaaaattgctaatgggcgtttgctgtgatcctggtggaacgatgggttttttttcttttcttttctagcctaggctcgcgcaccgcaaccatttcctctttctttactttcaccgttttgctgttagaaattgcttcgaattttgttgttttctcttttttattgttatcggttttgatggaagcaagttagtgcatatctctcttttttttcttttgttgctgacaaagacgtgcatgtactgcataactacatattaaacttttggaaaaagtacgaattaccgtcttgaactatcgcggttggtcgaattaccccctaaacctgaaaatcggacatcgtttaccctgaacttttaataccggacaaattaccccctcgacccaatccagatcgattttgtcctacgtggcgtacacggggcaatccagtcagcgttttctttttttgtttttgttggtggggtccacctgtctctctctctctttccctctctctcgggctctcgggccgtcgggcgcaggtcagcgcacggcgccgcgcgggtgcaggtggtgggcggcggcggcgggtcgatgagctcggccggctccggtagcagcggcgtgttcgctgcaatttcatcgctccatccatgccaccaccgctgctgctttttttttttgcgtggttgttggatccgctggtcctgcgtggtcgcgtgtggtgtgtgttgtcctctcgctggttttgacgaccttttcttcctcgatgccgctgtagg

SEQ ID NO: 14814 - DNA, 1501 bp, Oryza sativa
gtctgctaatatttctgtcaaaagttcagactgttgtgtcaaagccaatcttgtatgcacttgattgagcatcagatcactaatttaaaaaaagcaggaacagaaaaaaaaatactgaataaaagaagtctacaatatttggcaccacataaacaaatctgaaatagcatcaacagtacattctaggtgacatggctatccagcagaaaaataatattgcccatattttacaacagtttcggcctgcctcagattggtcaaggaatcaaatggactcatatatatccagtattttatttacacctgaaagggcatcaaaagaaatcttcttaatttctccccttttcttttttatatggtagaacctgcagcctgtcagattgccggctgaagaagtagaagaagagcaagttcagaacttcagatgcatatgcacttttaaatgcaaaccatttcccaagtgacaagttgacctagcttttcgtcaaactcaaaaaagttcattttcttctaccctttgcatgtatatatgctaaatactggagttcagagtctgaacatttctgctgtagtttacaatgactaagctaataacctttggactgtcaaaattcagaagaaagtcaggtgagtcatctggtaagaactgaactttggctctatttgccaagagatcaaaaagaaacagtcatcacagaatgacagaaacataaagagacactaaaattaaggagaggcatgcaggcaaccaatatgaactttgacccataatagctgcatctaatcacaaggtccaagacatggtcacatgtgtgtaggcccttctctcaaatataacatgcacacactaccttgtgctctctttcccataattttgttgcaccacacacaaaaaaatttcacactcctataagtccacaccacatctcccccctctctctccctaaaaaaaattctctctatatctaaaaagaagtttctccttttgtcttcctctaaacaaattctctcttaagctttctctccataaaaagcatttatctctttcctcaaaaaaaaatctttctttctctccctaaatttttttctccatttctctatctaaagggttcacgtcctctaccataatctaccattacagacactgacgtgtgagacaatagtagagttggactcacataccataccaatgactataatggtagtgatattatgatagaggatcctcacccctgtctaaaaagtttctctctttgtccgactaaaaaagtttccacatgcttatgatgagatgtatataacacatagagaccaagaaggagctcacctctgcaaaaacagtagcttgcacacatacaagaacacacacacacacacaccaaagctgaataagctgagaactaggccagagtgcatgcatgcatggatcatctaacaatgacgtccacgtcgtctgaaaatgcgcccgaccacgaccacgaccacgacgcctcttcgccgg

SEQ ID NO: 14815 - DNA, 1501 bp, Oryza sativa
attgcttaactacactaacatgcatgccgattgcagaagccgctcttgctaaactgctggtgctcttagggatcctgtcttcttgtttcaccgtggagcccttttggggttttcgccatcagttctagctgatgtaccattttcacttcctgctgcgcagaaggaagcttattttgagttaatatttctagtgggtttagagttagacttctgagctctgactgcttgtttctgcatctttcttttctctcatcttcttctcttgccctccttgtgaattgtatatttgtctagatttagatgcaatcaatttgcataaatactgtctaaatagatattgtgaggttgggcctcactccagttagcaataaaacttcgttcagaggttttaaggtttactactatattcgagttgtccaaaatagtaaatgccatcaaaatagtaggccctaaagattgtcgagacaaagaagaagcatttcgtttttagaggtgtttaagtacttcagttcttttgacttctgagaggacgtacctgagtcacataaatgcctttgtaccggctggttttaattgcatcggttggtgacgcttctggatcaaagtgataggttcaatgtcaatgggcttccactattggagctgacacagaagctaaaagttgacgggcaattctgttaaaatttgttttaagaaactctatagctgtattttgccaaaaactttaccttttgaagtggtaggtacaaagagagtggaacagaacaagcttcactatatcctttactttcttttctgagctgagcatcgctttctgcattgaaaggaaaatgatattatggttagctgatgaagaaacttattaatcatgaatagtagattagatagtggtcaatttctattaacatggcagataattaacagtactttacttctgaacaatcattggttaacaaaatacttgctgagctggcatacgccagccaaagtttttattaagcttagaaagtgttcaaagggatttctttgttttagtccacgagtccaaattcttgtatttttcaaccttgtctcatggaataaaaaactaacgtgtatacgatataattatatgaatttaactgggataaaatacaacttgctttcagattatgttagcttgggatagttttgcaaagatgacttgatacacacaatttcagtttcttaatagaatagcacccaaggaaatgttctgtctgtatccaccttttgtacaatttggtgggaatatatcttactaacatttatatttcttattaatttctagggagtttagaacggcgttgaatattgatagatatttagcatctcactaatggataataaaacatggctttggagaaaaaaatcctcagaaaggacaatttcaacgaagaacaaagccaatatatcagagagggaacaggaggtacatcacttatctctttaacattattaagaagccttatgaattatgata

SEQ ID NO: 14816 - DNA, 1418 bp, Oryza sativa
cttccccgccggccgctctctcccctttccaactctatttaaaccctccccgcacctcctccgtccgtttccgcctctcgccgcccttcctcctcgccggaatcgagctcgcgccgtcgctctctctccgccgtcgccgtcgagctccggtccgccgccgtcgtcgccccggaccacctcccacctcggcgccgcctccttcggcttcgccgcatcctcgccgacctcgtccacccctccgtttcgctcgccgaccgccggaacgccgtcgaccccgtcgacccgagccgcgccgccgccttcctccgctccggctgcctttttcgtcgtcgctgtcgacctagggtgagccgtggaccgccgcttctttttccccttcccttcccctctctcggccgccgctccgccgtgcctatggccgccgccggcgaccataggggcgcgggcgccgcctcccgccggctacgccggcttggccgccctcgggcgcgccgagtggctgccgcgtggggcccggccgtcagccgcccgcgccctcgggtgcggctgacgcgtgggacccatggcgccggtcggtgtgagcccaggtgcacccggtccaccgtggaccgtgaggctgccgcgtgggccccactcccgtggacccggtccgcgcgccccctcccctcggctgacgcaataagcccttttaaaattaaaatttaaatgaagaaattcgcaaatattcatttaaagagcatataaacttcaaatgaccataacttggccatttgaactcggaattggaccgttcaagtctctaatttttccttaagaagtcaagaacctatttttgtgctttgttccagcttgttatatggagtttattagagtaaaagccttttcttttccgttggtcgtgtagacgccgtagcttcggaagatccgctcttcgtggaagttgaagctgacgtttgggaaagcgagcaaggcaagtcacatcatccttgaacatattgaatcccagtttataaaattatgttgatttaaattattgcattatcgctttatttaaattcccgcgttatcactgttttatctagccatgcctatttacctttgttatgaccttattattgttattgttattatttccttgttcccctagaataaacaaaaccccaactagtggacactctactcatggtaccactagtatgattttaggtaaatgcttcgctggttcattaggcaacattaggtggttttacaactctagactttaggaatattctcatcacctggacacttttgaatggatggattattgtggaattggattcacacctccccctctattcaaaatcctcaaaatggttttaggctgggctcggggtgcatggttttgatagtagcacctcggccatataaggaccggt

SEQ ID NO: 14817 - DNA, 1501 bp, Oryza sativa
gcggttggccactcggcacgcgcgcgcgggaaacaacgggcggcgcggctgggcagcgggaccgggcgacgcggacggcgcagacgacgcggctcgggcgggaaaccacgcgggcgcgcgcgcgagcgacggtgcgcggggccggctttgcgagcggggagctcgcgcgagaggagggggcgctcggcgcggctctcgcacgcgcgagcagcgagcggggggggaaaacgcgccggggaaagcgagagagagagagagagagagagagagagggagcgcccgggagagagggggccggggaagagatgggccgagcggaattcggcccatcgaacccgggggaggcaaactagacttttcggaattgaactcgacgatagatcggggattgagatcttgagatggcacggacactagacaacaatcaaagaaacaaattttgcaattagggtttttcggagataattttcccgctaggcgccacgacggaacgggcgctacacttacccactagacatgtggaagtacggtagtgctttgcaacagaggcccgaagaccggtccttatatggccgaggtgctactatcaaaaccatgcaccccgagcccagcctaaaaccattttgaggattttgaatagagggggaggtgtgaatccaattccacaataatccatccattcaaaagtgtccaggtgatgagaatattcctaaagtctagagttgtaaaaccacctaatgttgcctaatgaaccagcgaagcatttacctaaaatcatactagtggtaccatgagtagagtgtccactagttggggttttgtttattctaggggaacaaggaaataataacaataacaataataaggtcataacaaaggtaaataggcatggctagataaaacagtgataacgcgggaatttaaataaagcgataatgcaataatttaaatcaacataattttataaactgggattcaatatgttcaaggatgatgtgacttgccttgctcgctttcccaaacgtcagcttcaacttccacgaagagcggatcttccgaagctacggcgtctacacgaccaacggaaaagaaaaggcttttactctaataaactccatataacaagctggaacaaagcacaaaaataggttcttgacttcttaaggaaaaattagagacttgaacggtccaattccgagttcaaatggccaagttatggtcatttgaagtttatatgctctttaaatgaatatttgcgaatttcttcatttaaattttaattttaaaagggcttattgcgtcagccgaggggagggggcgcgcggaccgggtccacgggagtggggcccacgcggcagcctcacggtccacggtggaccgggtgcacctgggctcacaccgaccggcgccatgggtcccacgcgtcagccgcacccgagggcgcgggcggctgacggccgggccccacgcggcagccactcggcgcgcccgagggcggcca

SEQ ID NO: 14818 - DNA, 1501 bp, Oryza sativa
taaaaatggtagagctaatttaattacccgagagttgcatgatggtagattctttgtgttgtaaatttatgattatttaaaaaagtatatatccatattatataaatggaaaaggaagaaaaaaagaaaaaaaaaagaaaagaagggcgtacgtacatggtacgtacgtatatatacccatgtacacatgcacgggagaaggagagctggggtccatagtatttggtttgtttaaagatcaatttcatctaatggtgtgtaataatggacccactaatttaagtgaaaatcaagggtagatgttttgctttttttcttatttctaagattttctataatttattagagtgccacgtgacagcttgagagtgtttgtatgaagtgtaatggacttttagtatataatagatagattggagccatgtcctaataactttactaatttgggatagaaggaaatactgtgatgttgttgtagcctattgttaatccggtctggagcaggtctgtgccgtgaactagtattgttcaattgtttgtgagtaaattctatactataaaacctcacttattatgatccaaattatacaaaatcatacagattttggtatgtgatacgtaagctcaggttttatggtcataatgtttcacaaaccacgttattgatcattttgattttaatctttcacacttttgggttctaccatcacatctcaaatttataagaattttattcatcatataaatattacatccattttcttaaattttgatatatgagtatatcaaaatggttaacattgtgattttgtgaaactttagatataatacccgtggttatgtgttagaacaaagtccaacaagtatggcaaacgcacccccttctcttgcagggagccttagtttagatccatgggggataagataagaggaagagagtgctgctaaatgaatgtaatgggaagatgcctccgccttcttgctcttggaggactccttttattcatatgtaatggaaaattgcagtattacccttgatcggttgcatcataggggcattgtcctaggggcgtttgagcccattattacattaatttatacaacaccctagatgtgaggggtcctttccaaccgtacacgctggcatggggttattccccaacattatgtgtcacgtgtcaaaatcgctgtggttttgtaaaatttggatcataataggtggggtcattgttttatagatattttttttattagtgtaatcaaatatatataatcaggttttctattggcaagcagaaatcaaactatcgagaacccgcgtcttggttaaaggagagatagtgagagaattttttttatttttaatttttttattaaaagttttacaaaaataatttttcattttgaaaattgacggatgtagtcgcctaccgccctctgggagggcgatttttaaaaatcgccatcccagagggcggcgaaagtgacgtggcagacggcc

SEQ ID NO: 14819 - DNA, 1501 bp, Oryza sativa
ctgaaagtaagagagaatgcaacaagtacaattcctccaaaaagaggacctagtccaaatacaagtgataccaaaaagcctgctgtatcttctgagctgcagatcagaagaaattaataacatcaatcagaaattcaaagtacccacatagtactccggaattgtatagaggaaacttacttgtggccatcagtaaatccctgaagcactgtacccaatgtttccatgaaagcaacagcaagcgttccggcagaagcaacttgagatggagcagcttcctgcatgaaaaggaaaagatgagcaaaactgcatttacaaatcaatggaacagaagattcagccattaacagatcttctaactaaatgattagagttcaccttaaaagcatcaggaagaacctcagcaattacaatccatatcatgcatccagcagcaaaaccagtacaaaagggaagcaccttttgaaatgcatcggcacaaaggaatgcagggacagcaacaattggctgtattaaccaagaaaaatgaacacatggtcagagtagtgtggaaggcaaaagaatgtcagcaccaaaatgtagcttgaaaccaagttggtatgctgttgcatacaagtagacaaacatttcgctcacaatgaaatactgacaggaagttgcactattggcaagtaaaaggaaaataatagtggcaatccccattaagggcttgttcggttgggccgttctcggccgggatcggagcccaatccccgtggaaaatcccggcgtggaaaggataccggcccacgcaagtataggcgttcggttaagcccaggcgagattttatcccggcccaccccggtgttttcccctcgtcataggccgggaaatattcagcttctctggtggcgaggaaaaaaatcctctcgacgcagcgacacaaagagagggggcgctgcagcggggacagctgcacagcgcagcgcgactccgacgcgacggcgacggcacgctctctcctccggcagttgactcctccggtggccaccttctccccggtgagttccttcacttcctatctcccctagcctcctcttctagtgttagggtttcttgcgcccgtggcctcgtgctactgcggcggcgcacgacggtggcaggcatggcgggggacgccgcagcatcacaccccctcaccatggcgccactgaagctctaagcgctatggcaaggagaagcaggaagacatggatctgttctttgttcctcacaaggtttcttgatttattcttctttctcccttgatttgttctgagtaatattcctaacttagtctgaagctctgatcatgtccttcctggatctgatcctctgtttgtagtgccctagtgagaatatgctgattctcctggtagttgagtagttgaaagaccacgttttctgattcttattgtgagttgttttaaatttgtacataaaggttatgaaaatggtttattctaaaaattagttggcagg

SEQ ID NO: 14820 - DNA, 1501 bp, Oryza sativa
aatatctggatatggatacattttaattgtgtaaatatctggcaactattgaccggctaaggccttgttcggttacgccctgatttaatccggaccgggaataacaagtacagtaagaaatttatgtagatacaatgtgtcggtgatatgggtccgggagtatcatgtttagagggataaggccgcccccaaacccacgtggcgtcccctgaggagggcggcgctccgatggagcggcggccgccaaatccaagcttagggtatcgagtttggaggaaggaggctgcccccagacccacgtggcacttccccgagggggtggcgcccggggtggagtggcggctgccccctcctcgctcgggggttgggcccgtcccgatcaagactagagggaggaggctgccccaggcaccacgtggccctccccccaggagggatcgggcccgaggtagggtggtggccgccccctcctgcgactaggggtcgggctcctccgaccccctctctaggtcaccacgtgcggtggattaggcagccgcctccaggcgcccacctacccgcatttatggcgtcctgagcggtggcgccacgccgcatttaatgtgatgtgcagtgcactcaaccgatctatgatcggtccgtgaccagtcgaatgaccgataggacagtggctgtgtacccccaccctgtcagtatgctaggcggcgtgcggcgtgctctgccccgtcacatcataatgagaggctttttagtctctcatcatagccggagtcagtttatccgctctagtcaaacaggagcccagaagtcttcgtcccttaaatggcgactgataggggcacccccatgtcaggcggcaagatttgatgggccccatcatcaagatgacgtgcgctgagacaagatatgcatttaatgcaaagattgtaatacttctccactaagttaggttgttgggcctatgtggtaaccccttaaggtataaaaggagttccatgcctacttgcggaaggggacgagccattttaatctctagagcagcttctgccgctcatgaggaatatctttggctccaacaaggagatcttgcaatttctcccacaatcaacatagcacaggagtagggtattacgcttctcagcgacccgagcctgtataaaccccttttgtctaatcgtcttggaggggctaaccccctcaagatcgcacagtttcgctcaccaagtcctcgaatctcacccgctgcccccagccgaaccaaaaaacaaaagggggtctcacggttccctggtggaggagttcaccttccgacatctggtgcgccaggtagggggcgtgttcgtgatttttgaggtactttcgagcgccggcgtgatgatcgtcgcgccgccaatgcgggggaaggcgtagcctcctcaggagaaccgcgccaccccaggcagggggctaggcccctacatcctcactggaaaaggataacggacagacctttgtggcgagt

SEQ ID NO: 14821 - DNA, 1501 bp, Oryza sativa
tacctgatctcaatggagaagctgatatggaagaagatggaagagctgctgttatccttggagataaccttcttggagttgatggccaggaacatgaaggttttcttgatctcaacttgcatccttttgatctcaacatggaggctatagaagaagaacaaatgcaacaaggtaagatttcaatacttatcaatcatctgcgctggaccaagcacttactaacttgatggaatcaagggcttttatttgaaatggttttatggatgatttacactagcacacaccagtttcctattagttaaataaatcaatcaattccatttagtaactgtgttccattccagtttgatgatccagaatcataccataattcagatataagctggtgttgtaaggttcgaatgttacagataatgttccccggaaaagaatggtacagttagtgtacaatttgagcattttggtttctagtattatttttcctgatccttacttatataagtgatatgtaagtgcataactttaattctaagcaatgactagaaccttataagtgatccttatcagtatactagaaaattataaaatgatatgtatatgctgagtacaggcaatgacagccaaaggtatatcacaccaatgcatattccctggcctgtatgtattgctcacaatatgcatgaaacaaggccaaacagctaggatgcgacaatgcgtacgtggattataaatttacatcttcaaagactactggaaatttgctccaactgtatagattcagtttcttatgcagtgcattagagctaatactgcttttcacagatccatcatggatgatcttactttcccattgaatggaagtgctccataaatcttttgttgaatcaactttaatttttttacagtacattagttttttttttgaaatacattacattagtttttatttagcaactaacaatctttctttatacatatgcagattagttatctccaaaatgttctctcactccacactacatatttaaacaacaaaatttcaagcatgtatacatgaacaaaggtcgcattagttagtcgctgacctcttgcaatttgcattattagaccactaaccattcatgcataagcctgcatgtaaaatgcaacttgaaaacatttacaagtgtgcatgacaacatgagcagtgacatatttacaagtgtactaaccaagaagtatttgggcagacaacgtgatgcactgtgcggcgcatgtcgtgcatgggaatgcacatgtaaatgaggaacaagaagaaactgaactaggtaaaattaatgtttgaataaatgtatgcattcttattaacccagattaacttaccatgtcaaacattttttgtagatgatcatgacgcattgcaatttgagttggaagccttggaggatgatcttcgagagtacggagtgtacgccgaagttgtcaatgttgtctttgatgtagaggagttgcccgactcaga

SEQ ID NO: 14822 - DNA, 1501 bp, Oryza sativa
tcggcaatgctagtagcggcgctaaaaacgcaggactatgagccagctgcgagcaatcctattttccgagtaataaagctcctcatccaattaggacatgttcagattgtagctaaaatgaaccttaccaaattttggcaataccaaaattttgtcaatttggcaatattgctaagttttggcagaattttttatgtatttaccagagtttgtttaaaaactaaatagatgcacatatttgacaattttactaaaatttgataaaatttattttgcctataatataaacaggcccttagagtttgtcaaggctgatatttcttttattccaagatcttgtaatgtgtgtggtcataatttagctcaatctgctgtttggttcattggttggacccctcccagagtttgtaagcgactgggtggctcgtgatatcgctgagcacacggtttaaaggtcaaaaaaaaaagaaaaagaaaaaaaaaagaaacgcctacgactagcccaaacgcaccgacctgtcctccgaccagaattccgatcgccaccccgcggttctgctctcgccggccgaacaacgcgtgctcacgctcgccgccgccggtcgccgcctccaaatcgtcgccagagaatccgcgtcctccccagatgacgctgcgcacgggagaagcaacgccgcctccccaggcgcatgccgaggaggagccggggcgggggaagcgccggcgcgtcgtcgcccgtgagacgaggctgcagcaggaggaggaggaggaggagggcgcctcatccgagccggagaccagaccgcgccctccccccgccacccccgccactgcagaggagcccgccgccaccgccgctggggcggaggccagggctcagctggccataaacattcgccgtatgcttgctgtcgaggcagagagaaggggccgaatcgctgaacgaagtatgtatgacatctctgcctatcctgctctacttttaaatgttattaggatttgtcgtcgaactccagatatatagtcatcactaaaaactgtgataaaatgcccaagaaatttggattttgatgaacaaagcctatagggaaatcattgcttgcacaaataccggggcatatgaatgtgccttgtcaaattaatttactcttcatataatggagtatcggctagacagattaaccagcttgctcctcttattgttctatatgttctctaattcaggattttcagcttatcgatgaatatattgctaggattttcttgcttatatgctagacatggaagatcatttctgtatgtattacttgcagtgcctttgaagcttttcatgatttcaagtaccatggaagcatatgcatatttttatgtatagagggaggcacaattgaactcatgtttctactggaatgcaatttgtgcatgaaaattatatgcaagtaaagctattgatattctaattctgtctgagtaactaacggtaataatgttttattctagt

SEQ ID NO: 14823 - DNA, 1501 bp, Oryza sativa
attatatagtaaaatcccttatattcacggatagagggagcatagattaacgtagaagcagtttcacccgaatagtaataatattgttgtgaattgtacggattcaactagaaaaaagaaactggtggtcagattaaattgaagataatcttgctcctctggaactggtgggataaccgaaataagataaatgtgggtgaacaagctagaacccccaggggtggagctacattgagaatggggttcctaggcactcggttccaaagatcattttatctatagtaatcctatgtttatcaatcccctcagttcagttaagtgtaccctcaacacagcaggcaaagcaggctgtgtacattctttgagtgtagaagctggtttaatccattatctaaaaaaacacagcgggcaaagcaagaagacaatagagactgcatacttgcagccttgtgctgtagaatgatactaatacttgctaatgcatgcacaccataaatcaataatagccaatgcatgtagcccagcgcttgcctctttcaacttttcttaattaatcacttcaaaatcaaatcaaataaacagaatgcccttgttattttctatggccagagaagagcaacactggcagtcatgctgtcaaaagctggtcaccagctctggagggaaatctgaagctcaactttgatggttcctacctggaagcaaccaaagatggaggatggggttttgtggtacgtgatcatagtggatgctgtatacttgctagggtttacaaaaccgcgtggtaaccatgcggttatcacggttaccatagacggtaactatttcagtttttgaaattatggtttgtctcgtggttaccacgcggttttcgcggtaaccgcgggggtgcggtaaccacgccaaaaacggtaaggtgaaccttgatacttgctggagctggacgaatgctgcactgcgagcccttgtagtgcagtgaatagttgatattggaatcgaatctgattcggcaatgctagtagcggcgctaaaaacgcaggactatgagccagctgcgagcaatcctattttccgagtaataaagctcctcatccaattaggacatgttcagattgtagctaaaatgaaccttaccaaattttggcaataccaaaattttgtcaatttggcaatattgctaagttttggcagaattttttatgtatttaccagagtttgtttaaaaactaaatagatgcacatatttgacaattttactaaaatttgataaaatttattttgcctataatataaacaggcccttagagtttgtcaaggctgatatttcttttattccaagatcttgtaatgtgtgtggtcataatttagctcaatctgctgtttggttcattggttggacccctcccagagtttgtaagcgactgggtggctcgtgatatcgctgagcacacggtttaaaggtcaaaaaaaaaagaaaaagaaaaaaaaaagaaacgcctac

SEQ ID NO: 14824 - DNA, 1501 bp, Oryza sativa
aaatgacaaatgccaacttgcctactttttacatttattttgctaaaaaatgttctaaaacggtaaaattttaatcattttagaggatctaaaccggcccttagctcaatgctaaaccaagcacgcacgtgtagtgtaaagcaccacgaacgcggtcgatgtgatctcccatcgtcccatgcctgatgctgatgcctccctccatcacacgcttccgctgaatcgcactctgatcgcgccccgtccacaaccacgagccgtgtcccgtgtacgtgcatccgcgtggagcgggatgcgggagcgcaacgtcgtaacgcgcaaagaacggggcgcacgcacgccctggtgcaccggtgcgcgggcgcacagctgccgcggggttggcacgcatcaacgggccggggagtcgtcgtcgtcctcgcaaagaaaaaaaaatccccaatcatttcgaggtgatcacctaccaaatcatcatcacgggcctgtgcagtctgtgtcgcggtgtatgtgcgcgttactaccggtttcccctccgctagtaatcaccgactctccccattgtgtcacatgggccttttgctttgtgatacggtcaggtcatagacaaattcacaagagccaaaaaaaaaataaaataaaataagagagagaaagatgggatagtgaaagaccgagatggataggtgcggtttgaaaaaaaaattaactgctgcagcttctcctaaaattaaaaactctctaaatgatttagtttttgtctatattctgataaaatgtaatggtagaatctaaaaaattatatagaaaaaaaaggtggaaaacacagtatttcgctaccaatcagctgcttatcataattttaaactatctaaacaggccgtatgatcatgtatcctcgactgcagatagggcaaacacacatttgcataactccatcagcaagtgattagattagcttaattaataccattttcattagtaggaaagttgattagcttccttaaccaccactgctaagctcagtcacctggctatagaaaaagccaataccggcagctgcctctgactcgtctcctcgttgctcctccctaccctagtcgatctccccttcgcctcgtctccccgtctcctcctcgcgagctcgcccgcccgccgcctgcgccgagcaccgccgatctccaccccggcgagcagtagcggcggccggcgtcctgctgcatcccgccggtgagctcacgtcctcttcctcatttctctccacccgcgccatttctctttgcacttgaccttagcttctcttgtagatgtggaagcttttgtttcggccttaagcttggtactaatggcggtttgtttgcagagaaatttgggggttcagctgaaccctctatgcgcgacgatagatccgcccttggggagtagggaagggaggtgaggtgaggtgaggagataggaggagttgagaaggcgctgattgttgggaggaggaggaggaggagga

SEQ ID NO: 14825 - DNA, 341 bp, Oryza sativa
attctttctttatttcctttttatcaaaaggaaaaagaaaaaacggagcaaaagggagcaccatgatttggtctgctcgagagctccccttcccaccgttggttggtttcgccggtggccacacgttggcgccgcggggaggagctcctcctgaccgtgcgatcaagatcggacggctgggatggcgtccggtgcaactagtggccgaggaggcgaggcgggggacgggtggctgtggatggagcggatcgcgtggggcccacggcccacgtgacggagcccaaccgcggccgcatgttccccgaggtgctcgggcccaccgcttcggccgcgtggggtca

SEQ ID NO: 14826 - DNA, 1501 bp, Oryza sativa
atccatatattataccatcacgatctaagtataattagcatactatgacaccaacagacacgttatgacaccaacgaatcgatttttttttggatccgccactatgcatggttgccacttgcccatactatttcaacaaggatattaccttagctctgttcagcaagctattccattctacatgctttgatgatctattttaagctgttacccttgagctactcccattgtcctttaatttgttcgtgactcagttcgtcttgctctttataaatagagagcacaaatattggaagtgtccatctggttagaataaatggagccttttgaggtggaatggtttgtcaaatttatttggtatattgcctctcagtttttcttcttccttttagtcacgtgcatcgccaccggaaactatctaaaaccaagttttcacgagttcctatgtgaactatattgcaacaagaattaaatttgaaaatatattgttcattcaatttttttaagaaatattcgggatgtaaaatcttttgcacaaatataaaagtcaaattagtacacgcaaatttatttgttaattaaactctaactactacacacatattcacagtcaaatttgttatttttgttacaacttgtagaagtcgaatttgaacttgcatgtttgtgagatgatatattacatattaacctatcttataaatttttttgtaactttttcataatcatttaggtggcatacaagaaacgggtggacgtccacccgagagattagaattcatccccctcataaacacgcaagactgcatggagcaagtctgtaagctcgggggttcccgaaagggaaaaccgtatgtaaatttgctcgtgttatatgaagtaatttcttttgtgcatcccagtttatttgtctggctgagagtttatgcaagggaccctgtaggagatagctcttcggtacttctcatcgttagccttcatcttgcttaggcattaggagaacgtgtagccgtagagaagtgttctcttcgggtgaaactgtctggggagacgataagctcttagctagaacgaatattctagggatatgagaagaagtttattttacaacgcgaataagttatacaaggatgagcgagggctgaatggctttctcaagttattaccagttttccgttgtacgatcgtttctacatcactgctaaacccagatttccgatacctcctctgttcctatatgtttacatggatatatgggatatatggatgagttcgttgatacattgaagagggacaaactttgttctttgcttgctctctacagtttacatgtacagccacacaacttagttctctacctcgtgctatcccttctgtctctctagttaccgttacatggctatagcctatatggcctagcactatgtacggagtatatgtttatgtgcaattacacaaaacagatataaaataacttaactgcaatgtttatgcagataga

SEQ ID NO: 14827 - DNA, 1501 bp, Oryza sativa
attggaatgacagtttaaaatgttgttttttatgaaaaatgagactattcaacatctttttatagagtgtcattatgcaaaatttgtttggagagcagtacagttctctcttggtttataccttcctactaccatatctaatatgtttgatggttggcttttgagggtagataagaagaagagtaaactcatacttgtaggagcttctgccatatgttgggctctgtggttgactaggaatgatatggtttttgacaaatcactatctatctcatatatacaggtaattttcagggcaacatatttgctccgattttgggcacagctgcaaatgtgtgaagatgatcgagagcttatgaaggttgcatgtcgtaagcttgagacaacggtcatgcaactccttgcaaactatagatggagattcataaatagacttgaataaatgtgctctccttatcttagtttgatattttattttgttgggtatgtttaattcatttgaactacactcagtgtttgggtgttacttttgtaataattggctatagctctgatgatcaaaggccgggatgttttattctattattttttaaaaaaagctttgcacgttattatagtagaagaaaaatgtttgaatacaactttaacgttagaacaatcatggcgggttatgatggggagaatagggtccgaatttagctgaaaaaaaacctaagtgctaaaaagatctcctagagaagaaggttccgcctctatctagatcatgttcaccactgtgccgatctggcaaaaaaacactatcagaggcacgagaatttcgtttccaaccaaagctagctgctttgtaacccggaaacgaaagagtcgaagcccttcctgaggttgcctagcgaaaacacactccattgggaactcccttccggcgagtcccagcccacacggagcttgtccaggcccatcagctcgttgtcttggaagcccaatcaagcaaaacctatcagtacttccggcccggctcaacacggccgtatgtctgtatctatcagaatttttttcatttttcatttttttaaaatatttacagaaataatctatcgtcagaaaaatttacaaaaatagacactgccgccctagtggaaggtggcaagctgacgtgacagacggcggctcaacggcgccgtgtgcgcattttgcgctttggtccttaccgcccttatttgcccagctggaaagaaggcagagatgaaaaaaaaccggccaaatgcttctttccacctttgttgataatggcccttctcgggctggctttttcatggaggcccattgccgccctggcaatgggtggcaagggtgttaatacaaaaagttcaacttttccaatcggccgtcaccgcccgtcgagccgttgtctgccacgtcagcttgccgccctgcactagggcagcaggatctatttttataaatttttccgacgatagattatttctgtaaatatttttaa

SEQ ID NO: 14828 - DNA, 1501 bp, Oryza sativa
ttcttctgaatatttctgaaatttcggtctaaccaagaccgagaccaaatagttctatctttaatatttttcaagtccgaacggtcttgcgctttaaatgaccgaacataaaacagattgaaaaccgagatcgaattttcggtattactgaatgctcacccctagttggacgtggatagcgctgcgatttagcatgccgaggcaggtggaagacgagaaaaatccaacgtgcggtagcataattgtggctgatagatacgaattattttctttttttaaattttttaaaaatatttacagaaataatctatcgtcggaaaaatttataaaaatagatcctgctgccctagtgcagggcggcaagctgacgtggcagacaacggctcgacgggcggtgacggccgattggaaaagttgaactttttgtattaacacccttgccacccattgccagggcggcaatgggcctccatgaaaaagccagcccgagaagggccattatcaacaaaggtggaaagaagcatttggccggttttttttcatctctgccttctttccagctgggcaaataagggcggtaaggaccaaagcgcaaaatgcgcacacggcgccgttgagccgccgtctgtcacgtcagcttgccaccttccactagggcggcagtgtctatttttgtaaatttttctgacgatagattatttctgtaaatattttaaaaaaatgaaaaatgaaaaaaattctgatagatacagacatacggccgtgttgagccgggccggaagtactgataggttttgcttgattgggcttccaagacaacgagctgatgggcctggacaagctccgtgtgggctgggactcgccggaagggagttcccaatggagtgtgttttcgctaggcaacctcaggaagggcttcgactctttcgtttccgggttacaaagcagctagctttggttggaaacgaaattctcgtgcctctgatagtgtttttttgccagatcggcacagtggtgaacatgatctagatagaggcggaaccttcttctctaggagatctttttagcacttaggttttttttcagctaaattcggaccctattctccccatcataacccgccatgattgttctaacgttaaagttgtattcaaacatttttcttctactataataacgtgcaaagctttttttaaaaaataatagaataaaacatcccggcctttgatcatcagagctatagccaattattacaaaagtaacacccaaacactgagtgtagttcaaatgaattaaacatacccaacaaaataaaatatcaaactaagataaggagagcacatttattcaagtctatttatgaatctccatctatagtttgcaaggagttgcatgaccgttgtctcaagcttacgacatgcaaccttcataagctctcgatcatcttcacacatttgcagctgtgcccaaaatcggagcaaatatgttgccctgaaaatta

SEQ ID NO: 14829 - DNA, 1501 bp, Oryza sativa
aaaaggagagaatatcagtggtgttgttttattttatgaatcttgagaaagagattgagccagcacttgagctgatcgatgaaaggcacccggcaagatacaagagggtgaagattatggactaccttgcagggctctttgaacatttcttgcaagggacaagagtgattgacacagtgaagatctgagtcactatgccagttaaaataaatagtgattgtgatatgtactctgtaaagtttatcagaaaaaaagaactattgtagagtatgagtcacatggtcgcatactcatgtaattatgccatccagatctgtagcgtttatcagaaaagaaaaatattattgtgaggtttcattttgtgtttgctgaggatgaatgatgagttttgtacttgtactactccaaacagtttgatgagctctgcatgctaggttaaaattctaaccttgtggaagataactcattgaagtacagttggtcagtgttatgggttgtgactaatcaactaactttttttctttgcttgtttctagatccttggaaagaaactgagccagacacaagactgctagtacttgatatttgagaagcatccaccactttgcaaggcagcaagaaagtgaaggcaagaatcatttagctgagccttgtgaattctagtacttcagttggaccatctaaaaggcaagcataatcatttgacagcttcagagtttttcaatttttcccttgatctacacatcttgatcttttttttttcttttagaaaataatacatctttatcttcttttattatgtttgatcttcttttgttcgataggaattgtgttctgtctattgatatgagtgactaattgactttgtgttgatttcgagcagaatagcagctctctccaggttactactcctgttactaaccattgatagaaaccgagagatagttgatctggtgcagatcttgtgtcaccatattacaccagttgaaatatctagaaggagataagaaaaggtaagcaatggaacttgttttcccccattcaggcattcagaactcaggagtcaggactagctcacttccacaatgtcaaactacttgaaataccagtccctttcttctgcccaattccacaatgttaaacagtttgaataccttcggtttaatttcaaaaaatgaatttgaaggttccctttcttgtgctcgattccacgatgtcaaacagtttgaatacctatccctttattcagctcaatctacatctacatcttatctacaacgtgtcttttatttccaccatgtacattgtgcatcctttcttctactgttgaatagtagctgagaagcagattccattcacgtgcctaatttgtcaatccattttcatccaagtatatccaattcaacatatttgcaggctataaatgagttgaaagatctcctttttcttttcaggcaagaagaaaattaagcaaagaaagatccaagaacaagaacactaa

SEQ ID NO: 14830 - DNA, 1501 bp, Oryza sativa
cgacggggatgggctccggcagctcggcggcgaccagctcgtcagaacggtctttctccccaagcacgtaccgactcggtggctcctcgacgccggccgccgccagctcttgcactatcgccggcgtcctccatgactcgtcagccattagtgttcttgttcttggatctttctttgcttaattttcttcttgcctgaaaagaaaaaggagatctttcaactcatttatagcctgcaaatatgttgaattggatatacttggatgaaaatggattgacaaattaggcacgtgaatggaatctgcttctcagctactattcaacagtagaagaaaggatgcacaatgtacatggtggaaataaaagacacgttgtagataagatgtagatgtagattgagctgaataaagggataggtattcaaactgtttgacatcgtggaatcgagcacaagaaagggaaccttcaaattcattttttgaaattaaaccgaaggtattcaaactgtttaacattgtggaattgggcagaagaaagggactggtatttcaagtagtttgacattgtggaagtgagctagtcctgactcctgagttctgaatgcctgaatgggggaaaacaagttccattgcttaccttttcttatctccttctagatatttcaactggtgtaatatggtgacacaagatctgcaccagatcaactatctctcggtttctatcaatggttagtaacaggagtagtaacctggagagagctgctattctgctcgaaatcaacacaaagtcaattagtcactcatatcaatagacagaacacaattcctatcgaacaaaagaagatcaaacataataaaagaagataaagatgtattattttctaaaagaaaaaaaaaagatcaagatgtgtagatcaagggaaaaattgaaaaactctgaagctgtcaaatgattatgcttgccttttagatggtccaactgaagtactagaattcacaaggctcagctaaatgattcttgccttcactttcttgctgccttgcaaagtggtggatgcttctcaaatatcaagtactagcagtcttgtgtctggctcagtttctttccaaggatctagaaacaagcaaagaaaaaaagttagttgattagtcacaacccataacactgaccaactgtacttcaatgagttatcttccacaaggttagaattttaacctagcatgcagagctcatcaaactgtttggagtagtacaagtacaaaactcatcattcatcctcagcaaacacaaaatgaaacctcacaataatatttttcttttctgataaacgctacagatctggatggcataattacatgagtatgcgaccatgtgactcatactctacaatagttctttttttctgataaactttacagagtacatatcacaatcactatttattttaactggcatagtgactcagatcttcactgtgtcaatcactcttgtcccttgcaaga

SEQ ID NO: 14831 - DNA, 1501 bp, Oryza sativa
gcgtcgaccgaagcggcggcgcgacgcggctggagtcggcggcggcggcgaagagaggtggttcacgtggctacggcgctacggaggtggagaggggaaatggagcggtggctgagcttgcccgggcggtggcaaagctggcggtggcggcggagcagtgcggcggcgaccctagcgacgggaaacggcggccggagttcgccgaagtgtggcggcgcgcgggagcggcgtggggagagcgagggagagagtgccgggctcgggaaacaaggggaaaatggagagggagatgcggggaatgtttctataggggaggggaggccggatcgagcacgggagaggcggagtcggggcggcaaccgccggggaagtggggcgccgacgcggggtgatggcggctcggccggcgccggtttttgtgggacgagcgaggaaaatggtggaggacgtgcaggggatcgtgcccacgtcattggatgcgagctcgggtgcgagagggcgccggattttgcggcgacgtgggcggcaatggcggttggggttggccggcgagaggtaggaggaggagctgacaggtgggaccgccggtcccacctgtcggcgaagggagagaaggagggacgcaaaacagacttttgcaagcgggccaagggagaagggagccggcccgagagagggaggaggcgcgcgggccgcgggagggaaggaagacttgggccgaaaatggcccaaagagagaaagggagattttaattgtttttctttttatttagttggttaaaatgaacttggtgcttttaaaattatttcatgagctccaaaaattcgcgggaaatttcagagagtattttagggcacaaagaatactacaaaatattcccggccaatgatttttaaagggaaaattttaattctcccaataattcacttggataaattgcttaactttttatttaatttctaggaaatgcattattaaatgatttttaattccgaacaaaaatcggggcgttacattgtgcccatatttgaacttaagtttgttgtttgtaaattgattatgcgtcaattggcgtgcacttgcaaatgtttcgcctcgtctacaagatggaatgatatgcctacctaaccctgttgcattttatctttccttcataatagctatatcatgttcccttgtaaccacctttgttgtatgttggtatttgtgcaaccttgtaagaatattgacggtagccctcaatctttaaatctgagaacaacttgggtgaaacttgtttctaaaaagctttgaaaaatctgacacgtgggttagtgcctgcgaaagaatatgagtttatgagaaaactcgcgacacagggtcattattgggcgagatgcattggtggttgctcgtaaggactatcctttaaactacatccgaacatgtaagtacgaccacatgggttaagtggaacactcccggctaaggaactagctaggccagggaagccttgaatac

SEQ ID NO: 14832 - DNA, 1501 bp, Oryza sativa
atttgtaaatatctaaaattcgaaattaaaaataaataatattgtaagaagagtctagagttcatatatataaaaaattaaaatagctaaaattcgaaaaaaaaagaaaatattaaaagatgggtttagagtccttaaagaaatatattttacaaatgattgaaattcgaaatgaaaaataaggaatattgaaagaaaagactagagtctaggtatgcaatttagaactaattaaaattctgagataataaaataaaaataaaagtagagtttagaatccataaaaaatacaattttttaaatactaaaactcaaaatttaaaagtaattaatattggaaaaagagtttagagtccatacagtaatataatttaggaatagctgaaattcaaaatttaaaaagtaaaaatattgaaaaaggggtttagagtccatatgtcagtgttacggtccaccttaggatttaggaacataaactgacacatcacaggtggccatcttaagctaatgggccagccgcccagctcgtttctatctgcaacataaggcagaaaaccaaggccttgacatttcttttaggacacacgggctggaacggccccggcccaattaattaaatcctgctattgaaaaagggttctgtaattagagttcctactactatacatacttccgcaaggtaatctagcacccaaatcaaactacagccaacgtgtatcatcagtagattccaccccaagatcgtgtgcccgctccgatcggcagaacctaatcacgaccaatccgtcgccaacacagccacaaacccacaattacgcggcggtgcattctcgttgctttgacggcttcgctaaacgaaagatatttaccgtggctaagcaagccctgatcacacgttccacacctcgcagcgccaccacatccgagccgatcgaccggcccaacccccccgtgagacagactccagaggccgcgagcggtggcatcgtcatcgcaatatcaaatccacatccacatctccatcgagcgatccacccacaacctgcaacggcgcgacccaaccgcaaagccgctcgcattgaaacccgcgtaggttgccttcgttttccgccccgcggcggcccatcatccgcgcgcgtgtggaccaggacgcgcgggcggggaaccgttggccacggcgccgcggcgcgttatcgcgagcctatccgcgcgcgtgtggcgcgctgggtgggtgaggcgccgagtggcccggatccacccgcccagccgggccgcacgccccccctcgccccagccacccggcgccgcgaacgacccatcaccagtcacgtacgcaccgctcggcgctcgctagctgccaccatctccctcccgctgtccgggggcgctggttgtcggcacgcgggggcgcgggcgtctatttgttgcgcgcgcgggcgcggcggcgagacgcgtgtgtagctactgctataaggagcgcgccgtgcaccgcctctcacaa

SEQ ID NO: 14833 - DNA, 1501 bp, Oryza sativa
tgctcattagctgattcatgatttgcttctggttcgactctaccatcttcaaaaccaaagcgggctggcgcacgagctgtacggcgggggcggctagccatctaaactcccagaagagggcggggtaagagtcagataagcacttaggagggcaagaagcaaagaaaatagcaactcagatagcacacactaggcataaactggatttttcaaatcataaaaacacctgatacaacgggtatggacaagtcacagagctacgccgagcttgactgtgcgcacaccacctaggagaaccagactaccaaacaacacccacaacaaacacacgcacgcactacctcgccacgactccaaaagagttggcggcggaacaaaagggcctatcacacggacggctgctgaagactgcctcctctactcctcgtcggcctggctgcctcctgtagtcggctcctcagtcgaagaaacgtcgatcggctggcgcgaagggaccggcggaacctgtcgagggccggcagcagcacggaccgctagcggtgggggagctgggtagtggaaacggaacacggtggaagaaccaacaacacgcttccgcgcagtgcggataaagcgtgggccacggcgggaggaagcaactggggtgtgtccgggggtgtaggaagggctaactgggtgtgggtagggggagtacactggtgagtacggcgcacgcgagctgggggagcgcgggccactgggagtgcgggcagagccgcgggagctgtgggaggacaggtggctggcgtggcagaggcggcctgagtcccaagagatagtgtcaactgaggtgacaccctcctcggccagacaggcctccaaggcggcgtagcggcgggcaagggagcggtaagcctcaaggagtaggtcgtgctgagtggcctgagcctccgaaagctcaaccatgcgagtcagcactggctgagactcgctgtacggacaagggtacctggcgtctgagtggccagaaggaaggcgtggaagctgccggaaggcggagcctccgagacggtggctgtagtcgtgggccaggcgacgaagcgcagtccaggagaggtcctggtacgcgatctagagagtgggcctggccacagtgaagtggtgtgggcgaaggccagctccgtgtatacctccacgggggtaaaggtacacagagagctcacagtgagggggaacacggtccacggagtaccccgtgtactcgggacacgagaagccaaggaaacgggcgaggtcacgaagctgagcgacgtggtgaccctcaccaaaaccgtgggaactgaagctggcgttcactgccatctacaattttgaaagagggagaaagatcagtaaccattttagaaacaaactattgaaaataaagaaaacaaaagaaaccttagcttttcgcaagtagttttgaacttagtatccttagggtcgtcctaagcgtcgggtttcgccctagggccaagcctgt

SEQ ID NO: 14834 - DNA, 1501 bp, Oryza sativa
agtgaaacacagtaagatcacttgatgaaataatttggttcaacatatgcaacaaacgatttaaaatcattgcaacacttaaaccccgtgtacatcaataaaccacgtgtccactaagatgaaattacgaaacaatatcaaaatccactgcaactcatccatacatagtgaaacacaatggcggaggcagggcccggccagcacgggcagctgcccgggctccatgccattgcaacaatacactgctccatggcataaacaacatttatgaaaattcttgactgaatgagtattatttctgtatgagtagtaccatttcgaccgtttctgattttggccatatgtaaaatttgactttttttctatttctttagcacataatacggtctacaataaagttaaattggtaaaagaaactattttactcacttgaactattttagcaaaacacttaaacctctaaataatttttcatttcgttttatacctccaatgtattgaaagtggttccccttattattgtctaacaacgtttctcctttttttttctctctacatataattaatatacgtttgttcgactaccaattttcgttgttaactttctcaatgttcatgccgtgcgttgctgtaccagtgccgtgagccggcgactatgatttgtgtgcattgtgccattacctaattagggctagctctgccgccccatctgtattttaaatttatatccgccactgattgtaatggggcgcgaatgatggacatacatagtgggggcggcccgcgcatatgggcgccccatttttttcgccgcatcaggcgcccgattttgagcattcggaggttctacggctgtgtttaattcacactgaagtttaaaagattggttgaaattggtacgatgtgatagaaaagttgtgtgtgtatgaaatgtttgatgcgatggaaagttggaagtttggaaaaaaaactttggaaataaacagggcctacgtgcatgggtgactcacgcagcctttctgtttctgccacggctccatggcgcaaagctgcacgaagcgtgcgtgcttccctagtgtcctcacttgttcagtccctgtcacaaattaaaaccagattatttgctaataagtgcttacattgttttggatgatcaccagcaaggctccgtcttatcctaacaacgccaaggggccacgtatgtgtagcttatacatatactccagaaaatgaaaataaatatcctaatagtgtgagcagctgcagacgctgacaaatggagcccacacagcctctggtccccagctgtcagcccgccgcgcccacctacccgcgtccacgcggcccacctggcggcgcgaggtggcgggcctttatctatccatatcaatctatcccatcgagtcggctgcactgatcgattccatcactctctctctctcgcctgctcgcggttgcctgtgcgttcgtctcgcgatttctcctcctcctcctgggatca

SEQ ID NO: 14835 - DNA, 1501 bp, Oryza sativa
ttgcttaaactcatgcctctgacactaattaagttgtagtaaaaaaaattagaagatttggtttctgctcgtatgaaagagtacaataataagcaattttgataaaagtacatatactacacgtaattcaattggtcatatatccatcatatctctattattataaaaattgaatatgtttttgccggtattttgttatatcatccgtgtatgagttggtttttaagttcgtttgcttttgaaaataaatattcgtatttgaattggtttttaagatcgttcacttttagaaatacagaagaaaccatataagaaatctgtttaaaaaaaactcgcatactaacttgagacgatcggacgtctaactgcagctcatgattttctatatatatatatatatatatatatatatatccaagcgaactgctacagtgaatttcatcttaactaaatcatataatagtaataagattaaaataaactttacccgttacaacgcacgagcaatttttctagtatatatcaagttaacaactctgctccagcacatgctgaagaggaaggaagagatcgagttcgatcgggctaattaacagaaagaaagggcataatagttttactaatctctttttaccagttaaaactactactataatgtttttagaacggatgaattataatatagtgcgcgcgaaaaggacaaatatttccattattggaactatttctttatctaaccctgtttgggtatccagctgatcgaccaggagaatgacgagccgccggccgatgtgatcgatcgatcgatcagccggtgatagagctttgaactgaaataatcaaaactacaaattagttgaaactgtctcagggcaacggggagcatgttgatcgattcagcaattaccgatatcctttttaattagcatgcatgtgtgctagctcttgaaaaatcagaccttattatattgatgtaacacacatgcatgcttaatacgcggagatcattgacaaattaaaagggccatatggaacaaagttactaaaggagtaaagaggccaagtatacgtacgttacatagagagaagacatggtcatatgtttatctgcacctgatactgtataacacagccaggcttcatcatcaatctaatgcatgcatgacaggcactaaaataatctaattgattaactaatcggtcaccgtgttgctgggaagacaacttgaatccatccactaatccatcaaattaaataagttcttgcccagatgcaaatctatcaagaccggttcagactttagagcagatgaacaagtcgttagttcagcctttttttatttttcttattgaccacttcagaatcacctcattctcagaggcctatatatatggatgcatcctttcctggccaaaaaccatcagctagctgtagctccatatacacaacaagctagcatcgagtaatacttctgcagaagcaacagttccatcaacttaa

SEQ ID NO: 14836 - DNA, 1501 bp, Oryza sativa
gagacaagggagagagaaatacttgaatgagtggatgggaatgattggcggggagccggttttttctcccagatccaacgcccggcttgaagtgttttcactaaatctatattttggaaattgctaaaaaaaaactgtcgcaatttttttttggtaaaagctttcaaatataactatggcatagttgtagtataactataatataattacactatagttacattgtaactacattgtacttacaatatgcttacattctaatcttgatataacttagctataaagttgcatattttttaatccttacaagtcacattgtagttatagtataattattgtagaattaaattacaactatactacaattatatttgaaagttttttacttaaaaaaattgtggtactttttttttataatccctttttttatatacaaaacacactcctggagacacaggaagtataatataagaagcgctaaaaagataaatatttccatatagggtatgtttagcaaataggatatgggaggtcggattgggaaatggaaatagatgaatggctaggattaaataaagtgtgaagaatggatggctaagatgcaatgttgccttttggagggtgggatattatttctcaatcctatttgccaaacacagccatattggaagctagtatttgttttaactcctctcctagctatccatatgcatctggccaggagaatgaagagccggcggccgatgtaattgatgatgtaattgatctgttgagctttcaactgaattaaccaaagtaccattagttattagcttgaaactgtctcggcagctgtaggcaacagagagcgtgttgatatattcagcaattaactgcaatactgacattatcaacttcccttttaattagcatgtgtgctagctcttgactaattaatcagacattcagacgttatattcccgtaacacacatggatgcctgaatatgcagagacgaaagggaccaagtatattttacatggatagagaagacatggtcaatctactcggttcttagtaatagttaacgtacattcacggttatttttttacaacttataggtgtcgtatcaaacttgtatgtttgtaaagggatatattttaatttaatttaattgtcttatcatttttttaaaatcttcttgagagataaaattcatctccctatctttatcataatatgtttctctgcacctgataacagagccaggcaagacataataaatctaatgcatgcatcatgcatgacaggcactggaataatctaattaattaattagtcggccaacctagctgttgactgggaattaagatagattgaatccatcaaattaaatagtttctttcccagatgcaatctattaagagttcaagatcagttcagactttagaggagatgaaccagtcacaagctagctcagccttttgttattgaccacttcaaaatcatctcatgctcagag

SEQ ID NO: 14837 - DNA, 1501 bp, Oryza sativa
gtcaagggggtaattcgtccggtattgaaagtgtagggtgagtaatgtctggttttcgggtttaggggggaaattcggccgaccacgatagtttaagggggtaattcgtactttttccttttcagcaacatctattcacccccctcccctctaggctacatctttaagctttcaccattgtcgaccacgtgtggtgtaccataccgccaagtcgacgacgaccaggtaggttttcccaaatatgatactcaagtgatactaatatatgagagcactaccagcttcgaccaatagaaatagagctattaccttacagataaggggcccgaaccttgtatagaccttgtatagaaatccttatctccatctcttatatctcaatctcgcatatgccctggtaccaacgatctccataccatgcaaataccgtagtcgtgatctacaacatcgtcaagtagtatatactgttttaaagttggctgcagtgtatactggttttcggtcaatattagtatatgcagtttttttttacattggtatatactgtttttttagtagtggtatatactatttatcagttcgtagcggtatattcttttgtttaagctagcgtcggtatatactgttttttatttactagcagtatatactgtttttaaagttagtttcagtatatcctatttttcaattagtagcagcatatgctattttaaagttagtatcggtatacggtgtctttgtcaggggttatggataccacatacctaatagtagttgattaaatctcggcagtaccaataacctgcggatataggaggagttccggataagaaaagacaaccacagttctacatggaaacgacaatgactactcggattgtatccatattggtttcctagttctacttggacaaggggacacttatgggtataaatacaaggccccctagaaggagaggggacaatcaacagacacatccaccacaatctacggaacaatagatcaagacagaagatcaacatataagccaacatataccaagacaagacgccggatatcgacttcagggataagcacggctagtcccctacagtgtctccggatactgtcaggagagacatagcgttgtctctgatctcgccgggcacgaacttgaggaggaagactaccctgttatcaactacgagtcagaccttcagaccgccatgtcgacaacagttagataggctaccccaaatattgtactggtgtgattatggtgaataagagcaataccggcttcggccaacaggatgtagggttattacctgacaattcaggggcccgaacctatataaaaatccatgtctccatcttttttacctcagtctcgcgtatatcctagtaccaatgatccccatactatgtaaataccagaatcgcgacatcaaacatcgacagtggcgcgccaggtagggggattttggtgcttcaggatttagacgagataggtttaagaga

SEQ ID NO: 14838 - DNA, 238 bp, Oryza sativa
gaacacaccaaaccattgctctagaacttggggtgcaaaagtagtagtagtcctgcgtgcatgtgcgacgtgttcaccaccagcccacagcattcattccagttcagttaggttagttactccaccgtggggcacgtggcaagtgtaggtgaccaccgtggggcacgcggcgaggggaccccgtgtcacgcacggcacaggacacttgcacgttcccctgcttcgcccgcgcgacaca

SEQ ID NO: 14839 - DNA, 1501 bp, Oryza sativa
aagctcgatgatagagttgtaatttcttcctagaaagatcttttctcctcctcactcagaactctaaacatgtactccctccgtcccataaaaaacaaatcagtactgatatattctagtacgatgaatctacatatgtatgtccagattcgtaatagtactaggttggtttttatgggatggagagagtaataatgatctaagagttttactcccgtcggcgtccggcagcctgtaccagacggtactagtaccgggaggtacaagatcaaatctggccgtccatcttgaaatgatacgattgggaaacagaaaagagaagcggaacgattccagagtcacgccgccgctttcctccctagctgcgctctttctttcctccctccccgcatcgcttctttctcatctattcctccctccgagcgcagaaacggagcagttgcgccgcatccacgccccgctggacgattttttcccatccatctaccgtccgcgccgcggtgctggagaaacggcgcgctcgccccgcatccacgcctccgccagtgcccattttttccccatccatctgctgtccgcggcagcgaagccaccgacgcgctccgtcaccagcaacgccgccgcattcacgagcgaaggtgccgtggtattctgtgtcccctatccccccccctcgacggctcaagcaagtacctaacctcccccgctgccatcggcgcagcctaggcccccattacggctcaaacactgctccactatatggtctagttattttgtaatgaacaattcaatctgccatgtttcttgtaatgaatttgtgagaaaagcacaagcttttgctggagactttaatctttgaatggaaaattttaagctcatctgtcgtctgttttttttatgctgtttacagggcatgatctatcgttgaatggagcttttgacataatttttgtctgctgtgaacagagcatgatatatatgtcgtattgagagccattaatattttgtctgctgtttttgctcgatctcctgtaaaatacatgtcattctgcggagtgatcagcagcacaacaatggttacaaacaagtgttttcaatgaacagcaatccagctagagatctaaaagttgaggaatcactggagtaaagtgctagacacatgggcaataattgctgaaaaaaagtataatttacatgattctgaaagactgaaacaaacatactcgtactagtgagctgtaattcagagtttcagacagtgggagtgttaaatatgtgacaatatattcggattagtttcccagtaggagtttctatcaggtgtatttattttatccccctatatatactcttgtaagccgtacaggaaggggtgacgttcacattgtgattcccctacgtttgtaatcatctcctctgtagtgatcattgccggtcggcatccatggttttttcccgcaagggttttccacgtaaaattcgtgtctccgttgtgcatata

SEQ ID NO: 14840 - DNA, 1501 bp, Oryza sativa
accgttcaggtcctcaaacttattcgactgtgtcaccccggtccctaaacttgcagatcactcgtttaggtcctccaacttgttcagttgtgttaccccggtccctaaacttggatttgaatatcatctgggtcaaataagacagtctaaagactttatatttaaaaataattcataactttttcatgtgaactctaatgaagaaaaactttatatcaaacttgtagccctcgactcgatctacaactttgtagttgagtttttttattctaagtcattttttgtcccaaaatgtaattttaaaattaaaatttcaaaatatataaacatgcaacaatattttgggactaaaacagttttaattcaaaaacttttcaactacaaagttgtaagtcacgtcgaaggctacaattttgatataaagtttgtcttcattagagttcatatgaaaaagttataaattattttttgatataaagtttttagaccgtcctgtttagggaccggggtgacacaactgaacaagttggaggacctaaacaagtgatctacaagtttagggaccgggatgacacagtcaaacaagtttgaggacctgaacggtcgatttgcgagtttagggaccgggatgacacaacggtacaagtttagggaccggtgatggactttactcttttggttatataggactgtaattttatattttaaagaaaataacaaatagatatttacttatacaacattgttatcaaaattacagtgcacttacatgtcatatcaactgaatttacaaatataactttagttatataggactgtaattttatatattaaaaataacaaataaatatttacttacacaacattgttataaaaattacagtacgcacttacatgtcatatcaactgaatttacaaatgtaatttttattatataggactgtaattttgtattttatttttattttagtttcaattgagagagaacgagagagaacagcgtgcatatcaattttttagagcgcaaaaaaaaaagaaattagcgcctctaacccgcccgactgaatcctatgcggattcccagcgctatatgtgcacgaatcttgtcacttatcgaacagcctaaaaaagacaaatccaagagaaaaaatcacacgacaaatctatagcaaaatcggcacaacattacttgatattcattctcgctgccaaattttcagattcagtcacagcatcacaatgcactaaatcacgaatatttagtgcaatttagtcataaattttgatatacaaaatggtatggttataactagtctgaaaagggctgatggttgcacacaagcaacggtaaaagcctaatattagaaaggagattgagcatccctctcctaataacaaatcttccgattattacatgacatgccaggaaaactgtcatacacaccagtctctccacatgtgaaaaatacagaaactggcaaatatacaaaagttgggttcc

SEQ ID NO: 14841 - DNA, 1501 bp, Oryza sativa
aggtaatctatattttgtaacagataaattagctataggttaacaacagttacagcacagaaaagagctggtaaatagctaacctgctggaattcgaaccatcctgatgattattactaggtgatgctaactgtgattggcggccacccgttgcctcttgagttaatttctacagttctaggtttgggtgagggaacacgacaatattgcaaataacaagatataaaaaaataatcttgaaatctcacatcaatggatgggttgaaattcaggaatgacattcgaccctttgcagctccagggtgtggattaccctccatgataactacgctgaagaaagagttagtattggtttagtctgcattgacagatcaaagaaaggtattggtaatgaagtactgcgtgtccaaaactaaacccaaaaaatgaatttgcatgacaacatcaaatgcatgtttagctgattagtgtgaagcatatctgggaagaaaacgttaaaaaaaagtatccaattatggacatacacatgaatgttatagtttctgaagcacaaagtatcatttctactacctccgtcccacaaagacttcatttctagctatgaacttagacgagtacttgtccaggtgcatagccagaaatcccaaattctctgtaattaggtaagaagtaaattagatgggaggttttgccagatatctcatctaacaaacccaaaaaggcacaatcttcatctaacagattcagcttaactcaaacataatctccaattcttcatcgcaccttgttatatagcatacaaaacatcccatgctaccctagagtcaaaatctctaataccatgctaaaaacaccaactcagcataaacgattaaaaaaacgagcctttcaatccccataccacttccgagcgactttaaccgacgagccaacacctccgctaggcaccgtcaccacctcctcctccgccgccgccgccgccgcctcaaccttgggcttctcctcaaccttctgcgcaacagccgcccgctgcataaactgcatcccccccgcacacaaatacaaaaataaaaacatcagacgagatagcaacgcgtgcggatgtaataagaggcaacatttccaagggatttcctcctcgccttgaggttcctgagggtgctcgagagctcccgcttcgccgccatcgccaccttcctcctccgccgccgcctctgccgctgccgctgcttcgcttaccgatttagggttagggtttacgcggctcgcggaagccgtcgccgcggggaggaggcgcacgacgagaagagagagaggagaggagatcgggttcgagtcggactcgggcccatcaccacggcccggtgcgcgagtggcgtgcgggcccacatgtcagccagggaaggagaaccgcttgcctggctggtcctacctgcggtctgaccgacatgtgggcccggtatttgatgtggtggactcctacgcggtttattactgattc

SEQ ID NO: 14842 - DNA, 1501 bp, Oryza sativa
gctagttttttttctcgtgttgagttggatgattttctctaatttttttttagaaatgatagttttttttctcatgttaagttagacggttttctcgaactgtttttagaaatagcgatttttttctcgtgttgaatccaattgttttttttactcgttttttataaacggtgttttttctgatagtttttccagagcgggttgttttttatgaatggtgtagtagatggaaaaaaaatcaatggatcctatccaactcaagcgtacatgaatttagcatttttctgacagtttttccaaagcagcttgtttttttatatatagacggtgttttttcttgcgcagttttttcaaaccattttttagaaatggcgcatttttttctgataattttttcctcgcatgttttttttaaaaaaatttacggacgatggaaatattttttctcgcatgtttttttattttttacgaaagatgggaaaccttttatagcgtgttttttttccttttttctaacttttttctcacgcgtttttattctctcgtgcactttttgtttttagttgtacgataaaaacttctccttttaaatagttaggttagattaaagatagagaagagatacatacggaaatgaatacaaattggacttttttcccgtctttttatttttttttctcacgcgttttttttattttatacgaacttttttctctactttcttagggaatcggacggactttttttatttttttttgggttttttttgcctttataggaatattttccctctttttaaaggaatccgatctagcctttttcttgccacttttttttgtttttcgccttctttaggaatcggattttttccagttcggatctacggatatttttcgccacttaggtgaaacagactgtcagggttatggataccacatacctaatagtagttgactaaatctcggcaggacccaccacataccatgtcttatacggaaacaaccttcgaatataggaggagttccgcataaggaatgatgaatagagttatacatggaaacgacaaggactacttggattatattcatattggtttccctagttctacttggacaataggacacctatgggtataaatacaaggccctctaggaggagaggggacacagaacaatagatcaagacacaagatcaacatacaagccaacatgtgccaagataagacgccggatatcgacttcagagataagcatgactagtcccccacggtatctacggatattgtcaggagagacagcactgtctttgatctcgccggatgcagattcgaggaggaaggctaccctattgtcgactacgagtcagaacttcaaaccgccaagttgacaacagttagataggctaccccaaatatggtactggtgtgattatggtgaataagagtaacgaccgacttcaaccaataggagtagggttattacctgacaattcaggggtccga

SEQ ID NO: 14843 - DNA, 1501 bp, Oryza sativa
ttgtgttggttgggcagaaaacaatgagctgatagaacatcctagaattaggccttgtttagatactaattttttttttgccataaacgtcacattaaatatttggacacatgcatggggcattaaatgttggaaaaaaccaattgcacagtttgcatgtaaattgcgagacgaatcttttgagcttaattacgccatgatttgacaatgtgatgctacaataaacatttgttaatgatgaattaattaggcttaataaattcgtctcacagtttacatgcagaatctgtaatttttttttgttattagtctacgtttaatacttcaaatttgtgtccgtatataaaaaactttacacccaacgtactaaacacacccttagtgcattttgtgctggtgtgaccgattctgaaagcttggcagcaaagagttgtgaaatttgttaatcatgtcaacttgtgctcggggtgtgcaaacctgacaagcattatgcttgtgataaccgataagtaatgtaggagtagttttttgtggtgagttgttggtggtggtattaaaagtcattgaaccgacataacaaggggcattgggacacatgagtatcaaatggtccaatttggccttattctatactcttctcactaaacaaacgcgagtactgtatacaaaatgaactaggaataaaaattgatgttttacttattttgtcaacccatatttgtgctctgctagctgacctgggtgtgaaattgaagcttgtttgacaacgaccattattctgatcgatctctttgtgatggggtaacattgatgtgatgctttctaatgtccctttaccaatcgtgatagcgctctcaacagtatgcaacagtattcctgaagtttttcgccaatcaggtggtgatgaccttgatctggtgtcccttgcaggcttgcattgtgttggtctaacaatccatttggaccatttgtcgtatccaaaggctcgtaagtttgtcaactcggctttgtatatctttatgcatgagatgtgtttccaggcgtgcatttgcattgtacttgatgtaatagatctcccggcctgatttatatttgtttacgtactactgatgcactctcgcacaggtagttgcgatgtcgtatgatgagagaagcagatctacgtgatgtttgccatttagtccttttaaagaacatattttataaacagattgcgagaaaacttgttgcgtatatgcaccctatatcggcgccaaatacaatcgcgctgaacctaaccatcaatcattttagtgtcgacctctctgacataagaaaatctcattttccattcaaatactattaatttgctatcaaatttggaaactaacaaatcgtcctaattggtttctgatagttcattttttatcgagtggttggttaaatgtgtgtgattgctgggaggcttagcatttatcttgtgacatagagatattatgggtcagctaagtttttttcaaga

SEQ ID NO: 14844 - DNA, 1501 bp, Oryza sativa
actttttcgttattttctattttactttcatggatgagttctagtaaccctagaatttggttaatatttgccgttttgtgctgaaaaatggtcgtgcttttccataaaagagacgaggttatcctttgctagtttgctcggaaattagtagttcgtcgtcacataagtacgatatttaccttctttgctaatttgctcttaaattagccgtgtgattatacgaaagtgaattaatctcaaaatcggtttagtcggctagttttgatctatcgattttgacgactccgtcgattaaatcacaaatcgttaggtgatcttgtgttggccataaaaaaagtgtcaacaatttctatctctactacttaaaaagtaggttcaaaacataaatctctatctctactacttaaaaagtagatctataatttctaaatcttaaaaagtaaatctctatctctactacttagaaagtggcgaaaaaaacgtagatccaattcccccttaaaatggggaaaaaatctgagaaaaaatagcgaagaaaacaacaaaaataaaagaggtctgtgtcgacgtttgatgtcgcgattccggtatttacatggtatggggatcgttggtattaggatatatgcgagattgaggtaaaagagatggagacgatgatttttatacaggttcggacccctgaattgtcaggtaataaccctactcctattggttgaagtcggtcgttactcttattcaccataatcacaccagtaccatatttggggtagcctatctaactgttgtcaacttggcggtttgaagttctgactcgtagtcgacaatagggtagccttcctcctcgaatctgcatccggcgagatcaaagacagtgctgtctctcctgacaatatccgtagataccgtgggggactagtcatgcttatctctgaagtcgatatccggcgtcttatcttggcacatgttggcttgtatgttgatcttgtgtcttgatctattgttctgtgtcccctctcctcctagagggccttgtatttatacccataggtgtcctattgtccaagtagaactagggaaaccaatatgaatataatccaagtagtccttgtcgtttccatgtataactctattcatcattccttatgcggaactcctcctatattcgaaggttgtttccgtataagacatggtatgtggtgggtcctgccgagatttagtcaactactattaggtatgtggtatccataaccctgacagtctgtttcacctaagtggcgaaaaatatccgtagatccgaactggaaaaaatccgattcctaaagaaggcgaaaaacaaaaaaaagtggcaagaaaaaggctagatcggattcctttaaaaagagggaaaatattcctataaaggcaaaaaaaacccaaaaaaaaataaaaaaagtccgtccgattccctaagaaagtagagaaaaaagttcgtataaaataaaaaaaacgcgtgagaaaa

SEQ ID NO: 14845 - DNA, 1501 bp, Oryza sativa
cccccatctttccctctctctctcgcgttcaaatgggcggatttgcccccgcaaatctcgccggcgccattgatggcggccggacctcccgcgccggtttccttcccctccggccgctctctcccccttccaaccctatttaaaccctccctgcacctcctccgtccgtttccgcctctcgccgcccttcctccttgccggattcgagctcgcgacgtcgctctctctctccgccgtcgccgccgagctccggtccgccgccgtcgtcgccccggaccgcctcccacctcggcgccgcctccttcgggttcgccgcatcttcgccgacctcgtccacctctccgtttcggtcgccgacagccggaacgccgtcaaccccgtcgacccgagccgcgccgccgcctccctccgctccggccgcctcctccgtcgccgccgtcgcccaggggtgagccgtggaccgtcgcctcctttcctccttccctcccctctctcggccgccgctccgccgcgccagtggtcgccggcggcaaccatcgggacacgggcgcgccgcctcccgccgaccgcgccagcgtggccgccctcgggcgcgccgagtggctgccgcgtggggcccggccgtcagccgcccacgccctcgggtgcggctgacgtgtggggcccacggcgccggccggtgtgagcccgggtgcacccggtccaccgtggaccgtaaggctgccgcgtgggccccactcccgtggacccggtccccgcgccccttcccctcggctgacccaataaaccctttttaaattaaaatttaaatgaagaaattcgtaaatattcatttaaagagcatataaacttcaaatggccataacttggccatttgaactcgaaattggaccattcaagtctctaatttttccttaagaagtcaagaacccatttttgtgctttgttcttgctggttatatggagtttattagagtaaaagccttttcttttccgttggtcgtgtagacgctgcagctttggaagatccgctcttcgtggaggttgaagccgacgtttgggaaagcgagcaaggcaagtcacatcatccttgaacatattgaatcccagtttataaaattattttgatttaaattattgcattatcgctttatttaaattcccgcgttatcattgttttatctagtcatgcctatttacttttgttatgaccttattattgttattgttattattaccttgttcaccctagaataaacaaaaccccaactagtggacactctactcatggtaccactagtatgaatttagttagatgcttcgccgcttaattaggtaacattaggtggttttacaactctagactttgggatattcatatcacctggacactacggaatggttggattattgtggaattggattcacacctccccctctattcaaaatcctcaaaatggttttaggctgggctcggggtgcatggttttgatagtagcac

SEQ ID NO: 14846 - DNA, 1501 bp, Oryza sativa
atttagtttgtatgttaaacctaaagttagaagatgtgtctagcacttaaaacgaaagaattatattagctatttgaatacatagtttacaaaatttgtttttaagtaattttatgtatagtccaatacaattttagataaattaaaaggcaacatatctaaatttggaagatgtgctgcatcataaacttttctatgccaagttaaaatagagatctattgtgttgtatatatttttgtactaagtttagactcaaccaataggtatgagaatttttagggataagatgcaaaagtggtaggagattgactattgctccattaactcatggaagtttcttgaacaatcttggacctttcaccattcttttactgatacatatccatgatctaacgatagatattgatcaaacgttgcattcaattatccatatcttcagatgatgttgctcaatgatgttgcatttttaagttttacctttcacttggagggatttggcaaccaatgataattgatcatggattatcagttccaattatcataatttggtttatgaaaccatgatgatgatgatgatgatgatgatggatcagtactccaataatgttctattactctccaattaatgtgcaggttttgttgatctcgtcggtgttgtgtagcctaaactacgcagtgacagtagtgttgagatatctgatctatggtgaggatgtgcagtcgcaggtgacacagaacttacccacagggaagctgtacaccaggtttgccatcctgacgacactgatcaccccgctggcgaactacacgcttgtgatccagccagtcacaacagcgatagaggagaagttgtcagcgacgacggacgttgagaataactggttgaccagggtgctcaccagcatagccgtcgtcatcagcacagtggtgctggcatgcacggtgcccttcttcggctatctcatgttgttcatcgggtcctcgctgaacgtcaccgttgctgtgctggtcccgtgcctgagctatctcaagatctacatgtcccgaggaggagttggctgcttcgagaggacgatgattgtcgggatactggtcataggagtgtgcgtcaatgttgttggcacctacacctcccttcaccagattataggcacattttgatcatgcatttgtgggtatggtggtaggttttggtagtaattaaataggtttcaaattcttttttttattttttttctgaaaaaaagatgttatacgctcaacacttttctaaataaattggcttgcataaatagactaactaaaaattgattcttaacacaatgcaaaaatagactaagtaaaagccaaattattttttttctgaaaaaaaggatgttatacactgtgttaagaatcaacctgagcggcttgtttgtatcataatttggcttttagttagtctatttatgcaagccaatttatttagaaaagtgttgagtggtttgctcaagagttaga

SEQ ID NO: 14847 - DNA, 1501 bp, Oryza sativa; identical to SEQ ID NO: 14845

SEQ ID NO: 14848 - DNA, 1501 bp, Oryza sativa
atgggcggcggcgaaggcaaaccagcgatcatgatgacgccagtcaatgatgacgaagacgcgcagccgtggaggcgaacaagccagtcggcatcagacaaggtggccagcaatgaagacgatgatatccatcagtagtggtagtggtataaaccagccgtagaggcgagggcactagtcagcagcagacgagatgaccggcggtgaagactataaggccaatcaacactggcagaatcatgcagccatggaagtgaagaaaccagtcggcaacagacgtagacagcttgtgttgaaggtgatgacgcctatttgtggtggcggcggcgtggccagccgtgaagacgatagcaccagttggcgtcatacgaggcggccggtcgatgaagatgtagacgtccaacaacggcgacataataaaccagccgtgcaggcggagacaccagtcggcggtggcgaaggcgagccagcggtgaagtcgtagatgcccaacaacggtggtgtgaccaaccaaccgtatagacaaaaacaccagtcagtggcggacgaggcggccggtcggtgaagacgtagacacccaacaacggcggcataataggccagccgtgcaggcagagacaccagtcggcggcggtgatggcaagcccgcggtaaagacgtagacgcccaacaaacggcgggataataggccagccatgcaagcggagacaccagttggcggtggcgaaggcaagccgttcggtgaagacgtagacgcctaacaaacggcggcataataggccagccgtgtaggcggagacaccagtcggcggcagcgaaggcaagccggcagtgaagacgtagacgcccaacaacggcaacataataggccaatcgtgcaggcgaagacaccagtcggcggcggcgaaggcaagccggtggtgatgttctgactgacctattcctgaagcgtaggaaataagcttaaagccatgaatccctattgtgcatatctggatctggatcctacagaacaaacatataggatgagtagtatctgatgtaaatacaatactagaggaaaattcaagcattttaaaatgtttataaatatgtttttctcctcttgtcaattttgatttccccgagcagatgactcattacgtttaaacactctgcccgactagtcatagcccccaagcatcgggtgtcggcctaggcacttcccaaacatgcatatgagtgatatgagttcgtcattaatggaacaaagtttcacggatcagaatttactactcgggtacttttgcaattgttaagagcaaacaataaatttatcttatctctatgcttttgatttattccgaataatacttagcaccttgcgttactcggtccatccaacgagcccccgggtgctaggaatcggcccaaaggcaactatccatcggcaaaccaaacaaaaagcataggaagatagaactccataactcgataggcacttttgtactcagattatatc

SEQ ID NO: 14849 - DNA, 1501 bp, Oryza sativa
tttatccatcggacctactctgatgggtgccccactggcacagacacaatgctcattttgctaccagaagttgtgctaatggctttctcaatcctggttcaattttgggttaattggatccatgccattacaaatatgccgattcagataaataactttataattcgtctattcatatacatgtcattcgaattcgaacaaaattaaaaccatgccatcgccatcgtgttttccatcaccatatagatcaaaatacccctaaacgtgggacccacatgtcagttccatcctcttcctccatcctccctctcttctttcttccccatctctctccatcttgtttcaaatgtgcagccagcaagaagggcacgcctctcatcaccgtcggcatagtcattagcgacgacagcggtagcggggtcattgccgccaccgtcctctcagtccccatgccctcccccctctcattgccactgaggatatgcaagagcgacagacttgctcttaccgactagacacagctgcctgagtgcgcggtggatgcagagccccacctcccagtgccgtcgagctccatggggcatttaaactttttgccactttcagatatggcaattatgaatttgccactcacagtctatgacatgtgggccctcatgtgcatatgacatgtgggtccagtggtaaatccttaattgtcacttgtaatactggcaaatagttaaatatctccctcattgtggctaacacccaccttgcatcctagcacttgctcccctccggctgcaacccaacccaacccagattcaattgaagttgcgcggcatggagcggcggatatagtatataggtatatacagcatataggtagagggagaccccaacaaaattggattggaccccagcctgtctccaaccaaataacttattaaagcccaactaaagaaacaatacatcaaagcttaggttagcccaactagagcccagctattcgtgggaaggtgaaaggaaaaaagtacaccgaaaaaccagatatatgacatccctcaatttacaaaaaccattcactttaggtccttcggtagttttgaccccggttttatcctacgtggcggctgagtcagtgtgagatccacgtggtcaccacatgtcatcgtggccacgtttggcctcctatatctttcccctattctcttcttcctcctctgtctctctctctctcactcttctcttctcttctctaggcaagccggccggcggttggggcggaggccgcccgggcgaggtgggagaggaggaggcggcggcggcggctgcgacgcgggagaaggcgagggctgcggccggtcgcgaatggcatcgacggcgctgcgtcgccgcggtggtgggcacggaggcggaggcagggtcggatgccgcggcggtgggcacagaggtggaggcgtggctgccaggcggagatgccgcagtttcagaatgcgtcggagccggcgaaatggag

SEQ ID NO: 14850 - DNA, 1501 bp, Oryza sativa
ctagctagataacactaaactaaacttgagagaatatgagagagctttgcttgaggtgtgtggaggaagtgaggaggtgaagcccttttatagctgaactatgacggttatgacggttggaatggtcggaattaccctccaaccatataggggcttcatctcagccgtccagccaaaacctggatccagcggcggccaggtgggttcggccgaaccaggggccggcccaacctggcctaaattcggcaggtggcctcctctattactcccatgcgcagacttgtgaattttggcccagttcatcgtgtcaattttgagttcttggcccattcatacataagtctgattctcgacatagtccgattgatcgatcatttgatttgatgtcgattctcctccatttaatgattattctctgcaaaaggttagtgaacctaatactagtggaatattattattctaacatgtatatgcattgcaagcataactagttctcctctattttggtaatattgacggtcgaaactgatagctaatgaccgtcaacaaaacctcccaagcttgaacctttgctcgtcccgagtgaaggatgaaaggaaacaaaaacttggttgttgatcaggagttgctactatgctgtatatctcaaaggtacaagtgcaaggtatatgtactctctctcagattaaataatctttggcacggtggcttacccttacccctgattcccacgagacactgcttctccttgccttgggcggttgaaagacataacagtaattagagcactaatcacccaatcttttattcaactttcattccgaaagtttttcaaatgattttgcaaaagaaatccaagttcctcgaatgattcactcagtctctccaagtgtatcaatatgaaatcctcgccaaattgcctttttgattcctactctaaggtttaatgtgtggagctcggtagggatcaaacatggcatacttgcattcacatttattactaagtcaaaaacttagactaaagctgatgactaaacatactcaagatcaagatcgtgcaaagtgtgtgtgatatatggtggaaatggtatatgaggaaaataaaggaaatgcttctcctttgtgcttactttcttctcccaaaaatccttcttttattaattaggagagggcatggctacattttcaatatcatgctcatgctggtgagagcataactttattatattttctctctttttttttcataaccatgcctttccctcctctttttttaggagaagaaaacacatgaaagcatggagaatttattttggtggtagtatggaaatggaatggataattgcttagctcgcaatgtaggagtttagcatgtgcatatatgtcggtgtatgatgttgatcataaagcatgagaagtaactacacaagtcacaagaatataacaaagttcaatggaatggcaagtaaccaaaatgtatatagttcaattatgatggcac

SEQ ID NO: 14851 - DNA, 1501 bp, Oryza sativa
aagtctaactgtcgtatattagaaccctacacaatcttatatgctaagtcttattacaaatctaataatcttatactatgctaagtctaagtgtcgtatattaggaccctaggtaatcatatatgctaagttgtctaagtgtcatacattacaaccctagataatcatatatgctaagtttaagtgtcgtatattaactctagtagtcttaattgcattaaaaatctaacaatcatatatttacatcacttgcatgcgcgaattcctttgagggctagctaccactccggcttgagggatggtgacgacaacgtcttttctgcaacatacaaaaagatgtattaggataaacgcaaagtaacatatattgtatttcatgttcgcgttctcgttaagttcatgtttcgttcacgatcgttcacgttcgcgttctcatgaagttcacgtttcgttcacctacgttcgttcgtttacgtgcgttcacgttaacgtacgttaagttcatgttcgtgttcttgttaagttcacttttcgttcacgcacgttcgttcgtttacgtacattcacgtacaacgttaagttcacgttcgttcacgttcacgttaggttcacgttcacgtacgtttgttcgttcacgttctcattcatgtatgtttccttcgttaacgtacgttcgttcgttcacgttcacgttaacgtacgttcgttcgttcacgttcacgttcacgtacgttcgttcgttcgttcacattcacgtacgtttcgttcgttcacgatcgttcgttcgttcacgtggcagcaacggagcggcggagtggcggcagtggagcggcggcgtggcggcgcggctgcggcatggcgcggcggcggcggcgggcatcggcggtgcgcggcggtggcgtgccgcggcggcgtcgtggtgtctcggcgtcgtggcgcggcgggcgtggcatggcccggctttgtcggcactgccggcgcgacgtcgtcgccggtgacggccgcatcgaggtcggggtcggcatcgtcggcgcggcggagtcgtgttcggccgcgatgacgtcggcggcggcgtcggcaacgaggcggctggcggtggtttggggagagagagagagatcgaggtcagagagagagagagggggaggcggtggcggctctcaccccagagatgcggcggcggcggagacgacggcgagatacgacggcggcgtcggcgcggggatgccctaggtagtggcggcgaaggagaagccaagggagatcgatcggggaaaaaacttctaagtgttggtggagaagatgagggcgcgcatcgggaatatatatagccctatatctttactcccggttgttctcatcaaccgggactaaagatattttcccgctatttccaaattctttttaaacccggttagggttaagaaccgggactactgataaacgcattgaatattgatttccattacatatgtgtttctaaaatagaaaataatgcatt

SEQ ID NO: 14852 - DNA, 1501 bp, Oryza sativa
ggagccggttccttctaaaagacatagaaataagaaaaacaacgtataaatggaatctctgcttggggggtgttaagtagtacaaataatcacatatttatctaaaaaattattcatcagtgtattaggccccccatgaacaaaccatatgcatggatactaggttgcgatttgggttagtccttggccaactagccgtagtatgtgttggctgcttagctttgcatgcagcaatcctgcaatagtaaatagctaaccgctgaggttaaattcaattaatatacttgtgtaattttatgtgttccttttgaactgcaacgatgttcttatatattttggcaacgtataataaggctaaaattaattctcttgtgttgccaaaacatatgtacacattatccgtgtgaggcttttagaagacaaaaatattaattgtcatgctatttttccgtattaattatcatttagtaagctgccccctcatgttcaaatactggctctgccactgaatgggacgttgtgctctttggaatattgttagattttaaaaatagaaatatttgagctagtgcctgatggtcctcgggaaataaatcacatgaattttataggaatcactcttgggtgatagaggaagtagagagaaataaacagaggacttctcacaggaagacaaatcacgaactcttaaggcatctgtagtgtttagttcggccaatctaatcgaagagttgaacaaaatttcaggtcagtagctatagtattcaaatcgttttgttttgtaggacctgtaaaagagaatcacccaatcattggtgtaccttttatgcatgcatgcacaataaatagtattttactccttctgttcgactccaatgtgagttcgatttgttttgacacctacgacgttcaacaacgacactgtgcatgattcgattctcctaccgtaaaatcgatttttcgttcacactgtagaggctcttgcctcatgcttattttcctcttgaaaaaaagggctggaaaatcattctataggatgtatattaccaaactatcgaatccattgaatcatataagaataaaactttaagaatgcaatcttctgaaattcttatgaaactaactaggtgtccgtaccataacattataaagagaacacctttcttctgaaatactaaactttttgagaagttttacaattgagcaaacactcagattctataatttgccatttgcaaaagcaaaggaggccccaacttgtttataggatcttaagagggggatggagaagaggggatgagcagcacaaaaagcccatcagcgcttcctcacctcacctatgtgactatcttcaattcttcatcccctcttcgctctcatcaacaagcaaatcgagaaaaaaaaaagaaggggagaaaaaataatataataacagaaaaggagatgaaaaaggagttccccggccaagcgccgacgagtcggttacactccgagatggacg

SEQ ID NO: 14853 - DNA, 1501 bp, Oryza sativa
cggagacggggatttttatacaggttcgggcccctgaattgtcaggtaataacactacatcctgttggccgaagccggtattgctcttattcaccataatcacaccagtacaatatttggggtagcctatctaactgttgtcgacatagcggtctgaaggtctgactcgtagtcgacaatagggtagtcttcctcctcgaatccgtgcccggcgagatcagagatagcgctttcgtctctcctgacagtacccggagacaccgtaggggactagccgtgcttatccctgaagtcgatatccggcgtcttgtcttggcgtatgttggcttgtatgttgatcttctgtctttatctattgttttgtgtatgttgattgtgggtctctctcctcctagggggccttgtatttatacccataggtatccctttggccaagtagaaataggaaaaccaatatggatacaatccgagtagtccatgtcgtttccatgtagaactctggttgtctttccttatccggaactccctccatacgtgaagtcagtttccgtataagacatggtatgtggtgggtcctaccgagagttagtcaactactattaggtatgtggtatccataaccctgacagtagcccccgacttcgatgcaaatgaacgaattcatattctcaaccgcgtgcaggccttggagtaactgttatcgagctcacgtgaccgttctcgatgagttcggagataacgttagacttcctttatcagcctcgtgcgggcacctaaagggtttgtctgagtcaatctccgacgtcgaccaagaaagtacagaacagacgactaagtctcccgtcttgctgtaatcgagaatttggattgaagtcaagaaattttatctcggcgggtacaccatctcttcattccgtattccttgtcgagatccaccaaccattctcgagtgattgagaaggcgcagaatctacgacggagccttgtcaacatttgtcgtactcgccttagtcgatcttggtgtagaaccatagagacatggagtcttcgtcaatgtcgaatagaattttcctgaaatcaacactcagaaaaaaaatatcagatagaaatagcccccgagcaaacgctcaaagggtgacatgttataatatatatggaaactaaaaatgaattaaatttacagaccaatgttttgtgtatgagcgtcttctcttttaccgacttcgatcagtcagtttgttgagtcatacactctccttagctcccagccttgtcatcggagaattattctcgggagataaggctcttggacctttgacctgcctcgattgaacaagcactgatcctagcccccagccgtgaagttggaaaacccaatttccgattacatggcttggttaatacgcactgcgagaactcttacacgaccagatcttacacagtcttttgtctctacaggattcgacaaggccttatcggctctgggcgtccccagccgaag

SEQ ID NO: 14854 - DNA, 1501 bp, Oryza sativa
gacacttgtgaggatgacatatgagaccatctgaatgaatgaagatgggccagggtgtcaaaataattgaaacctatttttaaggggtgttaaaaattaccaaatctcattgtcgaggccaccgtcgttttcctctaaccccgttgtcgttgctgcaatgagaagaaaatgctgctcccttcgttacaaactaagttttctttaagctgttcccattttgcctcaaaataagttattcttagtaataactatattgaagtttgcgaaagtaataaataaatgtatttaaagtagataggggcataattgcactaggattcgataaagtgaaggtattttaaactttttttaatggcatgtgtggtatgggtgaaaatgaatttattcaggatgaagggagtagtagtaatccacttaaggggaaggagcaacgtacatcgcggcccgtgggaagctaagtggtagctgtgtcggctaccctagcttctcgaagaggagaatgggtggcggcaagacgagtgtcttatggtggccttgcgaagaagcggaagatacaacgagcaggagaaagcatgtcccgacgagaggggtgggaggttcttatttgtgctccagcttcatcattgtatcaagtggagctcacctggcttgaaagttatttgcgcgggttagtgcctgcaaatctcagagaaagatgagactatagtcacttacatgtgtctcacgttattttttatttttttatgacttggctgtcacgccagccaagctactcttaaattttaaactggttttaatacttcgagaggcgataaaccaggtttttgctgttgaaagatgtgaatcggattaggtcaatttttggagggaattaaaatagacttttatcaaatacagatgatacaggctgaactgctgatacttaccagaagcccatttcaaattcggcccaaaattgtagagacccaacaccagaagctcccaactccccaaggcaagagcggcccggcgtgagaagcggattagccgaggccgagagccgggggaagaaccgaagaagattgccgtggcgtctccgtctccctcctcgccgtcacagcgcagccttgcgccaccgtcttcgtcgcacgccggattccaatctccccatcgcgccatccgctcctcctcctcctcctcaccacatgcccggctccacggcctcctaaccctgcggattccatcccattccccctcccgaggccgcccgagatgtactacgcgatgcggctgcgctgcctcctcacgcggccgccggtctccctcgccatctcggccagcgcaggcggcggcgagggatgcttcgccaggagattcggcgccgccgtggcgccgcggccgtggggcgcggggcggcggctgtgccggttctacggctcctcgaagggcggcgtgggcagcgccgaggcgaggagcgccgcggcggcggaggggagcagcgggcgatgcagcgagcaggagc

SEQ ID NO: 14855 - DNA, 1501 bp, Oryza sativa
aacgacaaattaagttgggtgctttgccttgcctgtgattagttttagtcgatcgatcgagcctagcgaacggtgctgccctcattaatctaatcaaatggatcgatcaatcaattaatctactgactgactgagtgcggttgggtcgtcgtctgtgtgtatacactactggagtactatggagtatattgctattggcctgatgcttggctgctggccgaatccaacgtgcctgactaactatcctcgtatactaatactagtggtattcgatcttaactacaagtcttaccccatgacttaaaacagagcagtagacgtagtattatttattttacaagtaggattaattgtagataaatatagtcagctgtaggccagcttaatttctctgggagttggacgcgattattcagtctgaaagggaaagggttgttcatagtttcaggtggtagcagctgctggtaattgaattaagccgcatgccagtgccatgctgccaaattggttcgatcgaaatgcattttgggttgttaggttgctgctatatacaatacatagatagatagatagcttgaattgaagggaagcaatctagccacgcaaaggcaaattaaccaagttagctgcagctgcagctgggatggcaagatggatggatcgctcaactaccaccatgaattgaccactgtgtgggtgtggagtagtagttgctttgctatgctatcttgtatcgttgcacatgtatacgcatgtactggaggtgatctttatccaaaaatgtaacggaggtggtggttggcaagctggatacatggatggttgtggctgcttctcttaattcttcacatacacgtatcggttagttatgactaccgtaattttgataaattgaccgttttttaaaaataaactatgtcaaaaactaattccaaacgccgtcaatcccgatggcgttcagctaaaatttctcaacgccactttagttgatactgaaaacatgttcgacgtgacataaattagcgtaaaaaggagctcatcgccatgttttaaatctcttaataggtttaaaatggtgcgcgggctaaaagaattactatttattgttatcattcacgagctagcatttttgtaattagttgagttagatatcggctttccattctcaatcaggttcatgtcctgccagattaagacgatagacagttttctccagctagccagcgcggtgctttgactttgtcatcgcgcgcgcgcatatatactagtactggagtctggagtcgagtgtatatatatatatcgatatgtatgatgatgatgaagaagatgatggtatcgaatcaaactaattaaaccggacagttgttgttgatgatgatatacgatcgagcaggagcagctgaggattagtacagaatccatatattggtagctacgagcctacgacctcgctgcctcgtatcgtgaaatgagatactagctagaaaggtggtggtag

SEQ ID NO: 14856 - DNA, 1501 bp, Oryza sativa
ctggcgctccaggggaatctgccaagagcaatacgcctgcgacgtggacgatatcatgccatcgtgctgaaagcctgaacaccgggatcgctttcgctttgtttttgctttttactgccttttcggttcttttttcacattgagccgtgtactcctctgcccccacatgttatcctagtgctccccctgtcaggctactacactttgttactccccatcttagcgcggattgcagtttaatttgacgctaactttcaaaaactctcgctttcattctgatgtttacttggacgcatgctggctgggtagcccttggtggcttcgtccatgtcggtctgagtaaggtggtatttggttggaggaactaaagtagggctaaactttaatccctttcacaaaaatttagtctctagttcccaaacaccccttaagactagacgctgtacgtatatctcgtcggctaatgaaactcccgtactcaagtcctttgccttcgcaagccccgcggggttcatctgttcggatctgaattgttcgaaacgacatagcccatgtgcttgttggtaatgtcgggagtggtcacccggattgagtgatgctaccactaggagctgaaatggcactgctcggtatctgtaaaaactgggcagcatgaagcgcgctccaagaagaaacttgttaccaggctgccagctactgaacctgagcggtaggggtgccgacagaggaatgccgtgctactgacaccgtgcgtgcgagtcctccaagtaaacagcacccggcggaggcttccgtcgtgcgcggtgcgggatcggaggacgaggtccggcggcgtttgtgtttcgcgcaccgcacggccggccggccagagctgggccgtggtgcatacggttcctaatcaacaccgtagatttgttcgtttatccgcttggactctcctaaccggctaaccgtccctctcagccgtaaaaccggatataactacaccttcaactattattaaaatcgtttaaaatgtctctctcagttgttttgagagcggtttttgctaacataatatccaagtggtaacccagacatcaaatgtattgaaaaataaagtgggatccatatatgaattaaatttgaaaatatattgttcattcaatttttctcaggaatattcgggatgtaaaaacttgtgcaaaaatataccgtcggtgtcgcagaaccgttgcgtgaaaatgacatgcgaatgatgtcgcggacggtatcgcgcggtctcgcgcggcaacgacgcgagaccgcgcgtgtcagggttatggataccacatacctaatagtagttgactaagtctcggcaggacccaccacataccatatcctatacggaaacaacctgcggatataggagtagttccggataaggaaagacaaccagagttctatatggaacgacaaggactactcggattgtatccatattggtttccctagttctacttggacaaggggacaccta

SEQ ID NO: 14857 - DNA, 1501 bp, Oryza sativa
gtttttttcactcggttttttccctggtcgatttttttttaccgcgtcacatgcaatcaggaatcggataattttttcgccctttttttactaactcgtttcgtttttttgtgccgtattttttggagcggacatttttttctccccttttttttcgctccgattttttttggtcggactttttttcaccgggttttttcgccctttttttactgactcatttcgtttttttccccatattttcttggagctgatatttttttctcctgttttttcgctccgatttttttgatcggactttttttcactcgttgtttttcgcctgtttttttcgtccggttcgtaatttttgggtcggacagttgttttttttccctccgtttttttgatcggacatttttttctccatttttttatcggactttttttcgcctgtttttttcccggttttttttacggacaatggaagcacgtctttatttttaagtagtagagattttgcttgagaaacatctaattttatcaattatttagctgttaattaatcactgtcatgggctcaagccatacaccgttgattctactatgtcacgcatggataaaagcaacggcaaagtttgccgttggtctcgaaggcagaggatgcggacccgtagaactaccgaactaatccctacgtatcgaaaacggaacgatataataataaataattaattgattaattaagtgtcagccaaaaataaaaaataaatgaaaaaaaatgaattacccccataaatcgtggtcgatcaaattaccccctaactcaaaaaccagatattttacacactcaactatgcaaaccgaacaaattaccccctaactcaatccagagtggtttcggtcctacgtgacagttcaatcagcatttttttccaaagtcggtgggccccacatgtcatactcttcctctctccctgctcggcttgattgtagagagagatggaggggagaggaggggaggggagggagaagagagagataggatggggattgaggaggtatgggataaaggggagagaggaagggtatgacatgtgagtcccaccgatttttcaaaaaaaaattgctgactagactgccatgtaggattaaaaccacaccggattgagttaggggataatttgttcgatttgcatagttgagggtgtaaaatgtctgcttttcaagttcatggggtaatttgatcgacggcgatagtttaggaggtcaattcatactttttccaaaacaaattaatacgatgcatgtgtgcgctgatcttctaatcgataaatataagggattttaaacaaatgaaacatatatatctcatccatacaaaatcctccctcgtttcatgctggtgtatgctgctcttctaatcgaatcgtgtcgcgtcgcaagcaaggtttcccaaaccgtcggggtcggggttaccgcgccctggcggtaagcacggttaccacgcggtaactgcgga

SEQ ID NO: 14858 - DNA, 1501 bp, Oryza sativa
aggaactattcactctaaattggaaactttccacaatcctactccaaatcatcaacattcaacttagcatggaaccgtgcagctcacccgagggcaatagcccacctccaaccccatcgtcaccaacgctcgcaaccgcaacaaggcacccacttcgccattcgctgcaccggcgctgacggcctttgccatgcatacaccatctgccttgctagggaagagaagaaataggggagggggagtggagggctcggcgcgttagtgaggatgatggtgcgcactgttgctcgttgatgcatcaaggagaagagacgacgtgaggggcagaggcgacattgcgtggttgaggcgtgagatgtggaggaatactcgatgaatcaatctatggtgggtggaaggcataagatgtggataaggtgttcgctagcttccactgcatatgatcggtcgcgaaataagccccctcgatcttgcccatttattaaaagagaatcttggtttcccatctctcctgcatatgtagaaaaatgttaagttggtaaggaaaatatatagtagaaacttaaaaataatcatatatataaaattctaggacaatggtagaaaattaaaacacaacgaagaaaaaacacaattcctttttttttctatctccttcttcactgttttgtcatttttatgtagtatcgtcttagttatatatttatataagtgttattttttaaattccccaaataactttttatgccgtgatttacatggtaaaccacacctaataatgaattttacatagagtcggtgtgcacatgacaatggctattgataggggagtgctattacaaaaatgcatatgacaatggttagtgatacatttggggagtgctattacaaaaatgcaaggtaatttagttggtaagggtaagaccatatatatagcttgtaattaattaggggcacacgacgccatagctgctttcaaaatcaaaaactcctccaaagagtctacctttttattctgattctgagaactatagttataaaatgtagaaaataaactagaatcgagatgctaggtgattctcaaaagctaactaataaatagttgcttcttagaagcataaactcccccaatcaggaccttagcctagtagcaataccaataacaagatcaaccaaacatggaaaatgaaaattaacagcaaacaaagtgacaccggaaaaataacatatgcaaaatacgtcgatcacaactttcagttaaacacacatgcaattaaacatggtgaatccgtactgtccccttggaaggttggattttaagcacatgaaaagaaattatatattactattccgactaaacaaagagacaattgatttgtgaacatgttatgaatatttcatattactcaccataccatgctaaatccaaaagtttacatgatgtgatgataattactacgaatatgaatactagcagtgttcatattaaaggtcaaagaga

SEQ ID NO: 14859 - DNA, 1501 bp, Oryza sativa
ttttgcatatgttatttttccggtgtcactttgtttgctgttaattttcattttccatgtttggttgatcttgttattggtattgctactaggctaaggtcctgattgggggagtttatgcttctaagaagcaactatttattagttagcttttgagaatcacctagcatctcgattctagtttattttctacattttataactatagttctcagaatcagaataaaaaggtagactctttggaggagtttttgattttgaaagcagctatggcgtcgtgtgcccctaattaattacaagctatatatatggtcttacccttaccaactaaattaccttgcatttttgtaatagcactccccaaatgtatcactaaccattgtcatatgcatttttgtaatagcactcccctatcaatagccattgtcatgtgcacaccgactctatgtaaaattcattattaggtgtggtttaccatgtaaatcacggcataaaaagttatttggggaatttaaaaaataacacttatataaatatataactaagacgatactacataaaaatgacaaaacagtgaagaaggagatagaaaaaaaaaggaattgtgttttttcttcgttgtgttttaattttctaccattgtcctagaattttatatatatgattatttttaagtttctactatatattttccttaccaacttaacatttttctacatatgcaggagagatgggaaaccaagattctcttttaataaatgggcaagatcgagggggcttatttcgcgaccgatcatatgcagtggaagctagcgaacaccttatccacatcttatgccttccacccaccatagattgattcatcgagtattcctccacatctcacgcctcaaccacgcaatgtcgcctctgcccctcacgtcgtctcttctccttgatgcatcaacgagcaacagtgcgcaccatcatcctcactaacgcgccgagccctccactccccctcccctatttcttctcttccctagcaaggcagatggtgtatgcatggcaaaggccgtcagcgccggtgcagcgaatggcgaagtgggtgccttgttgcggttgcgagcgttggtgacgatggggttggaggtgggctattgccctcgggtgagctgcacggttccatgctaagttgaatgttgatgatttggagtaggattgtggaaagtttccaatttagagtgaatagttcctgagatattgagaatgcttgattttgaatatgaagttttttgagttttttaattggtttgaaatctcatgtctataaaagtttatctgtacccaaaagtttatggcttcatctctacaaaaatatgtatgtaaaagtttctataaaaaaaatcaaaagagagtttatgcaatggaagtttctagagagagttgatgcaacaaaagtttctcaggagaaaagtttatgcaataaaagtttctatacaaaaagttttgcaatgaaagt

SEQ ID NO: 14860 - DNA, 1501 bp, Oryza sativa
ctagacagagtttatacgtcaattgtacaactttacaagacaactaggagatgcaaagcacgcaagacaggaggcagctgctggaaaggaaaacatccacgtgggtcggtcttattaagccacgtgtaccgggaaaccgatcccgtgccgcgtcgacgggaacgtcgcgaacagcatggttccgacgagccctccggcgagcggcacgtcggtgagcacctgcctcgtgtcgtaggacatcaccgggtagaagcaggcgccgacgttgtgatcgaacatggcgacggacaggaagacgatcagggacagcacggcgtggaagaagtcgatgaacctgaggcggtaggtcgcggccacgtccggcggcggcggcgcggtgccgtcgatgacccacaggccggcgcgcgtggccaccacgtaccgcaccgtccctttcccgtcgtggaagctgtccgtgaagcagaggaagaagcacgccgcggcgcagagccccaccagccacgccgtcatgacgcggttaacgtcctggcacttgccgccgttggtgaacaccggggacagcacctcgaagacgagcaccgcgcccgtgggcaggtgcttggcgagctccgccgtgctccggaacgcccgcgtgatggtccgctccagccgcgttgtctcgtcgtcagagccgccatcgccgtcgccgcccgccagcagcagcagaggctccgtctctggctgcacgttgtggcggttggttatgccaactgaaacgggtacagccgagctagaagctggcggcgcggtggcagctgctgccgatgaaacgctggccgccggagatgacgtcgccggcttctgggactcgagatcaatttgcttgtttgatgccatggcagatcaattcgatcttgattgatggaagaatatgtgcctaattaaatggtaagggtggatttatggaaggctcactttgtggagtgcacgtacgaattgtttaaagcacaagtaagatgaagccggcaagaaagcttaattgtttaagacttatcactggcacaagataggtcatcagtaagcctcatagcctcatctgtatcgggatagcgtaccggcacgaataccaaaagtcactgttacgaaaaatcatatgtatcgagtcccttgccatcacggatgacagtcacggatgatataccatgaagatcatcataggcttatcgtcagatagttgtttgtgacaggaagcgatcaaaagatttacagattatatatggagatgagattttgaatcttcttgatatgtgcttatatatattctaactgcaacgactgaaacttttgggtttgtttttgtgctaatagcgggaatggaacgttaattagatggccaaccgtagtttttataattcgaatggtttgatcgtgtccaaccttggttaagcatagtctatatagacttgtagcttgactttggcaaaataaaatatggcctcgtacacagtactttaattttatc

SEQ ID NO: 14861 - DNA, 1501 bp, Oryza sativa
tcattccccgtgattccctctccctttccccccatttttccctctctctctcgcgttcaaacgggcggatttgcccccgcaaatctcgccggtgccattgatggcggccggacctcccgcgccggtttcctcccttccccggccaccctctctcgacccggctctatttaaaccctccccgcacctcctccgtccgtttccgcctctcgctgcccttcctcctcgccgaaatcgagctcgcgccgtcgctctctctctccgccgtcgccgtcgagctccggtccgccgccgtcgtcgccccggaccacctcccacctcggcgccgcctccttcggcttcgccgcatcctcgccgacctcgtccacccctccgtttcggtcgccgaccgccggaacgccgtcgacctcgtcgacccgagccgcgccgccgccttcctccgctccggccgcctttttcgtcgtcgccgtcgacctagggtgagccgaggaccgccgcctcttttcccccttcccttcccctctctcggccgtcgctccgccgtgcctatggccgccggcgatcataggggcgcgggcgccgcctcccgctggccgcgccgagtggccgccgcgtggggcccggccgtcagccgcccgcgacctcgggtgcggctgacgcgtgggacccacggcgccggccggtgcgagcccgggtgcgcccggtccaccgtggaccgtgaggctgccgcgtgggccccactcccgtggacccggtccgcacgccccctcccctcggctgacacaataaacccttttaaaattaaaatttaaatgaagaaattcgcaaatattcatttaaagagcatataaacttcaaatgaccataacttggccatttgaactcggaattggaccgttcaagtctctaatttttccttaagaagtcaagaacccatttttgtactttgttcctacttgttacatggagtttattagagtaaaagccttttcttttccattggtcgtgtagacgctgcagcttcggaagatccgctcttcgtggaggttgaagccgacgtttgggaaagcgagcaaggcaagtcacatcatccttgaacatattgaatcccagtttataaaattattttgatttaaattattgcattaccgctttatttaaattcccgcgttatcactgttttatctagccatgcctatttacctttgttatgaccttattattgttattgttattatttccttgttcaccctagaataaacaaaaccccaactagtggacactctactcatggtaccactagtattattttaggtagatgcttcgctggttaattaggcaacattaggtggttttacaactctaaactttgggatattcatatcacctggacactatggaatggttggattattgtggaattggattcacacctccccctctattcaaaatcctcaaaatggttttaggctgggctcggggtgcatggttttgatagtagcac

SEQ ID NO: 14862 - DNA, 1501 bp, Oryza sativa
gttatagctgcaggtgaaagtgaagtttaaatgttttgcattctttgtatgggagggcatttgtttgggtcaaagaatgaacctgaaaattttcctgcagtaaggccagcaaagatggctactacaattccatcctttgatttatggagtgttgcatcttcgttgaatgattctccatattgtccccagagtaggacatcttgagtctgttccctacaaaaaatgttgcatataaacaattgctgagattacacaaaagtaattaatgagagcattgattttaacgatcaggtttggaaaaggtacgtactctaggttttgaattttaattctcctgagttttttgtctgatgttgggctcgcaaaatcatatggaccaatatgactgattactccaatcaaatctggaggaatattcattcaaaaaaaatctagaggaataagccaaaagaatgtgaagtgtaataagtatgattcaatgtggaattaaagatagcattacctatgagaggtttggaactgatacttttccctagaacttcatcaaatgggcagaagtcaaaaaggaactttggtatggttaatcctctagattccaggggttgaattcttgtgtcatgtttaaactagagaatatagttctggcactggtagatataggtctttctttttgcatcaatggcaacagtattactaattaggtagacagatcctttatttagcaaggggcggaattgctttgcaaacctttttggcacagtgatctgtgctattgagccctgaaaaattattgtgcaacaattgatatggctagtattaagtatagcaaagaagtagaatctagtattaatatttggtggaacacataagagaatgacatacaagttcatccaataggatgacgtcaatgctgatgaggggatctgcagattttgatctcatgtttatagcatcccataatcttattagacgtccaaaaaccttgcagttttgctgtccaacagatatatcttttaatgatatagctgggttagccattgaggtaaatctgaaaaaaacataataaagaaaaaatgaaacataagtgaatatacgttgtcggtgacatggggccgggggtatcgtgactagaggcttgggtagccgcggtcacccacgtggcctgaccccctcgggggggtcgggcccgagggtgacgtggccacccctccctctgtctccccgaggggtcgggccgctcccgtttcggccccgagggctggggcgccccgaccccctgtggttttggtgccacgtgtgtgggttaggtgagcacagcggggctcacctaaccgcatttatagcaggttggacgagcgcgccacgccgtatttaatgcggcgcagcgcgcgcttatccggtccgtgaccggtcgcggtgtgtgaccggtcacagaccggtcagatcgcgggttaggtggcaacaggcggcctgtcacacgccttgccccgtcccgtcggaa

SEQ ID NO: 14863 - DNA, 1309 bp, Oryza sativa
tttatataaaaattgtagccctcgacgcgacctataactttgtagttgaaaagtttttgaactaaaattgtttaaggtcccaaaatattgttgcatgtttatagattttgaaattttaattttaaaattacattttgggacaaaaaatgacttaaaataaaaaaaaattcaactaaaaagttgtagatcgcgtcgaggactacaagtttgatataaagtttgtctttattagagttcacatgaaaaagttatgaactatttttaaatataaagtctttagaccgtcctatttaacccagatgatattcaaatccaagtttagggaccggggtgacacaactgaacaggttggaggacctaaacgagtgatctaaaagtttaaggatcgggatgacacagttgaacaagtttgaggacctgaacagtcgatttgcgagtttcgggaccgggatgacacagcggtacaagtttagggaccggtgatggactttactcttattattttgtgatgaacaattatcatttgagattattgttttgatatttttagattattggtgaagtggttttggagaaggttgattttcagatgataaatagggactgctgtcagtttggaccagttagagcgaactgtggttgccgatcagaccggcgtgtgttgcgcggtcagaccggtcagcccgcggtctgatcggccgaatatgtgtcgatttcggtttcaggttgttttctgtagatatttgtggataaatcatgtttatgatttctagatgaatactaagcgttgttgacagaaaacacgaggcctgggagatctggttaactccagtgcaggtccaaaactcgccttcagatgtatgagcgtgccagttgatttgatcctgcaatcaacaagaaacaaagacaaagaaaccgtggttaaatccataaatgatagccgatcggctaagtgccgatgacatatcatttacctttgggccgatgtcatatatacatcgatcgacaaccataaatgaataaaaaggaactaaatctactcgatcggctgtagatattaataatatataatccttatgtcgatatatacttaaatcaagtgattgggatagatcggtcgccatgccgagacagtataaatcacttagatcgaaatatatattaacaacaagattatatatgttcatagcatagccgatcagatagatctagcatgtatcggctaatactccgataccactctgtattaagatattaaagcaaataggatataccaaacagaagcctaatatacttaaatgcagcaaga

SEQ ID NO: 14864 - DNA, 1501 bp, Oryza sativa
ctagtcaaaaaagagaaaaaaaagcaagatgcctcatacgggtatagtgccattgaccacaaaaaaacctggtcctgcacttgctctactctgcagaattaccaatgaattaggatcccaaagcagggaaattggtcaattttgagaaacaaaataaatcttaatatacagctttctttcagaattaagaacacaaaatatttggacgcaattgagatttgctaactacaaactaaaggcagtataaattgctggatggaaccacagagttgcggctcgtaagttccggctatcttcatccttagaacctactccgtccgtcccaaaataaactaacctaggttgggatggaatataatctagtacaacaaatctagacatgtctctatccagattcgttgtactaggttatgtcccatcccaatctaggttggtttattttaggatagagggagtacacatcagcattgcttaatcataagcacctcaacatacttgaattcaacgatatggctgacagactaagccatggtacgatgcataatccagcataatgagttattgagatatactaacggaacaagagagaaatggaagaggcactcctgaatgaagatttagcgtaacacatgactgaactaaaataaaactaccataggctacatcataattaactgaatcattttgttcacacatgaaaacacactaatatttcatggaccattactatacaacacagaaaacaactagcacctttctcctaaaaagcaggagcaacacctcaaatttcagccaccatcaaagagatccacatttctgctggcaaatggtaatcttagaacgtcctgctctcagtctgattagggacattcctcttgacacgttttttcattctctctgcccactggtggaacacattagacgcatcaaatttacctgtaaacttcaccttctgagccaattcatacaatatgtcaggcttcccagccttggagaaatctgcagcaaacttattgtagtctatctgtggagtcttcatccctttttggatcatctcttcaatgtatttacatgcctcctcaggtctaccatgtcgtatatgcccattaataaacactgtgtaagagttcacatctggacaaatccccttccggtgcatctcctcccacaccgcacaacccatcatgtagttcctcccgccaaggaaatatgacttcatcatcatgttgtatgtatggatcgtaggctcaagtcccttctttatcatctttttatatattcttgccgcatcatctggcatattcctattcgtaagtagcttaatgagagcattgtatgtccgtccatcaggagggcaccccttttgagtcatttcctccaatagggctgtcactctatccatcctctttgcattcccatatcccacaagcaagcatgtataggtggcgacatccggctggcacccaacatcctgcatctcctcgaagcaccgcattgccat

SEQ ID NO: 14865 - DNA, 1501 bp, Oryza sativa
taaaccctgtacacacgtctttgaaatagtagggggaaataacggaagaggccaccatccaaagataaataaagatttttatcaagattaaaataggataaattgtcggtgaacatccaagaattaaaagttaacgcagcctcagtcacatgattagcatgttcacattcaaatgtgaaaaaaaaatctgaaactattttttgatgaaggtgctatgtgatttatcaaacgctctccttctcttagaacaatggatgtgtttagttcagcgcaaagtttagattttgattgaaattggagatgatgtgactgaaaatttgtgtgtatgacatgttgatgtgatggaaaaggactgaagtagccaatgtcatgtttccacgcacttgcgtgtgaacgaaatatgcatattccccgtaactttttccaaagaaaaccaaggcccccctttttcttaagaaaacaagaaaaccaagcccgtataagcagcttgactcccgcgtctaaccattacgaacgagaagaaaccgcccacaagccagcgtgtgaacgaatcaacacacgcggagcgcgaccgaattaaccccccttcccccaacgtcatcagatggaacaaattcccctcggtttagtgttaaacgtgccacaaatcacctcctaatcactaatttttttctctcccatcctctcgccgaaaccacccaaaacccaaaagaaaacggaaacataagagcaggtacaataacgagctattagctaactataaacatattttaataagataaaagataagagagaaaagcagcagactacgaatctgtagccagctgcagcacggacttcaagacgcaatgtgtatatgacagatggactatatatgttaatagtatagtaagcaactattatatgaatatgctattaaattagctatagataaattaaagctagcagtaggctatactattaaacttgctctaacaaagaaaaagtaaacgacccaatcttcggcactaatcaaccggaggacgacgaaccaaccaaccacccttcctcctgacaaaagcaaccccactcctcctacctgtccccgcacaatccccaaggcgcaaacgcgtgccccacctgtcacccacacgtaccctgaggctgtcagattcgatccttagccatgttaatttagggcaattaaactacaccgagacgaacgaacgaactataagccatggtccagtgcttagccgtggcgaatatatgctccctcccctaaataaagctcgcgaacgacgtacaccatccgatcgatccatcaaaccagacggctagctggaggcgactattgtgaacttgtgagagagtgagcttacgacccacgggctgcacgttgccatccatcggtcggatcgttgtgatccgtcgatccagtcaagtcgcaggaaccgtgaaaagatcggccgatccgtcggtagcttagctcccgattcggtggctttattcccgccattaa

SEQ ID NO: 14866 - DNA, 1501 bp, Oryza sativa
atccatatttgattactgctgtttagttcatagtacaaagattggtggccacttaccaattgtgatgataaccaaatatccctattgtaaatataaacgacttgccacaatcttcacattacaccttgaagttataattgaacccacatgggttatgcaagatcaaatgagcacaaaagaacttttgttgcaacatcagctccgtgcaatggaatctgttcttccccccatcttgaggatctgacagctatccaagttgcaggaaatggcaacatatgtagtttctgcagctcccattgcaagcacgagatcacaacggcatgaactggtgtatctactgatcattcaccacaataatgcagcatccacaagaactcttttttagatactgagcaagccacacaagagcttaatcccaataatctttaatttgcttgcgttgcatccgcctctcgcttcaactcaccaccacttcccacgttctacaagggagagtagtaattgcgcaaatggccagaggccaatgcatctcttggttcaaggctaaacaatccccatcataccaatcttgcctggaagataaataatactcgccgtacctccgcgacataattgcgcatgctggttttgtttatggactgtcgatatcaagatcaagaatccggccgccatcaaacatagcaccgtccccacggggttgacctctgaggattggagataacatttctttgccaagaacaagaaacaattggtgatgattaattgtttttgtgtggcgtctccatcctcgtggtcagcaatggtggccacccagctgcacccaccctacaaataccctctcatcacacgcatggcagaagcaactcagccattgcagctgactatagcggcagcatctctctaattaagctagtgcttttctttgccttgaggccttttcaccttgctgaaatggagagatcatacacatcagcggtgccgttgatcgaggccgacgcgatggcgcagtttcttggagctcatggtgatcactgcttcacctacgagcaaatggatgagtccatggaggcaatggcagcgatgttcttgcctggccttgacaccgactccaattcttcttctggttgtctcaactacgatgtgcctccacaatgctggcctcagcatggccatagctctagcgtcaccagcttccctgatccagctcatagctatggaagctttgagttcccggtcatggatccgttcccgatcgccgatctcgacgcgcattgcgccatcccctaccttactgaggatctgatcagccctccacatggcaaccatccatcagcaagagtggaagaagctacaaaggttgttacaccagtggctaccaagaggaagtctagtgctgccatgacggtatgcccctgcaaataacttaatagaacagtgatctacttcagttaccatgctgttttattttccatgcctaattggattgatgaactgatacagg

SEQ ID NO: 14867 - DNA, 1501 bp, Oryza sativa
caaaaaaataatctataataatccataagaattcatctatttgtttagttattaactacatctaaattattaccgcgaattgatttcttatagaaattgccaagaataatccataatttatattaaattttgcaattctatgactataattaacctataaaattccaattattttaaattttctaaacttccctaatctccctctaatttcctttttttgtctctttttcttttcctctctttctttttctctctctctgccggcctctcttttcctctccctctctctctctgccagcctctcttttcctctccctctctctctcggctctctctcccacccgagcggtggcggcggtggacgcgaggggaacggagggcggctcaccggcggcagcagcggcgacgacggcggcagcgacggtggcgcacggcggcgcgggagtggcggcacgagaacggcggtgcgggggcacgggaacggcggcgcggcggcacgggaacggcggcgcggcagcacgaaggcggcggtgcggcggcactacggcggcggcgcggtaaaaagggaggtgatggaggggaatgggtgtgggggagaaaagaagggctggggggttttatagggtgtgagagagaggagagagagggggcggtgaaggagggtgagcgacggcggcgcggcagcgcggggcacgaggcggcgatgggacgcgcgcggcgacgggacgcgcgcggcgatgggacggcgcggcgtgacggcgatggcgacggcggtgtagggctcgaggcggcgacggcaatggcacgtggcgacggcgacggtgcgcggcgcagcggcgggcgatgggacacgcgcgtgacgggacgggtggtgacagggcggcagcggtggcgcgcggcgcgaggcgggtcgcgacggcgacggtgacagcgtggcagcggcgacacggggtgcaaggcgatgtgacgggcgagcggcgacggcgacagcggtagcggcggtgcgcggcgcgaggcgtggggcgcgggcgcggcgtcggcgcggcagcggggcagggttaggctaggggacctcgtcgaacacctggcggccgatgaatagtgccgttttctatttacccgatttaagcctatttatttatttaaaattgattctataaaccttaatttttgtacaaatgaagttcactcaatatttgtgttattccatccaatgggtccatccttgattaattttacccatattttatttttatataattttcttgaatttaattagagttaattcttattccgacacttttcaatttaattgatacaaatatagtcgtaataatattttactcatttctatcctcactaaatattattttaaattgtactttaattatttacttagtcaatttacttttcagggtttattcctaactaattatccattattcgcgatttataaactccgaaatcaaaattcaataaaataatcgaacaaaattggcat

SEQ ID NO: 14868 - DNA, 1501 bp, Oryza sativa; identical to SEQ ID NO: 14865

SEQ ID NO: 14869 - DNA, 1501 bp, Oryza sativa
gacgccggccggagctaaccgaggcagacctgcaggcgatgccgtacctcaaggccgtggtgctggagggcctccggctgcacccgccggcgcagttcctgctgccgcacggcgtgcagagcgacgcggaggtcggcggctacgtggtgcccaggggcgcggagctgaacgtgtgggtggcggagttggggcgggacgaggtggtgtggacggcggcgagggagttcatgccggagaggttcatggacggcggcgaggtggaggtggacgtgacggggagcagggagataacgatgatgccgttcggcgtggggcggcggatgtgccccgggtacacggtggggacgctgcacgcggagtacctggtggggagcctggtgagggagctggagtggctgccggagacgaagggggaggcggcggacatggcggaggagctggatttcaccaccgtcatgaagcacccgctccgtgctcgcgtcctcccaaggccctcctccctctactaatcgtgcttccatggatgaatcatgcatgaagaataacatgccaatcgatagttttgtgatggttgtaaaagcatgtgtagttttatgatacgtactttatgtttaaatatgtgtaatactgttgatttttgaaataatatttcatcattgtcttatttaaatatttagggtaaatataaaaaaacataaatcatgtttaaattatagggtacacataagttgtaataatatgaatgacacatgcatgttttttgttttgtaaaatgaatggtgaatcgtcatatgagtcaaccgcagcgagacgtacgcggtgatttcgtgaatctcaagatataccagttgagtctttgatggtgcttataaagaaagagtgtgcatatgtgtatccatcttatgtttgtactatcattcaaaaaaacaataaccatgaaaaactcaattcatcacccaaggggatatccccttattttcgcatgtcacttaaaaagtcatcaaaaaatatgaaaaaaaatagtaagataaatcaatatgtaatatgtcacttcacagacatacaaatacaaattcaacttatacaagtagaaacaaaaataacaaatttgtgaatttttgtttcgaattgtataagtcaaatttaaaatcgcaggttgcgaaaagatatatcatacattgatatatcatatattgatatatcctgatatgttttttataattttttttgaacgacatgtagaaaacgagaaaatattccctcgagggacaaaattccacttcctatgatatactaacaatatacgtttgaaaacggaacggtgaaataattcattgtagaggaaaatatatagatgaaataattgcctgcggaaaaatactttgggctttgatgggcccgtggtttttcctcgttcagtcggttgtgttttatcgtattttcccctgaattcttgttgtgtaaaggaaaaaaacaaacaaaaaaaaaccattgtagaagc

SEQ ID NO: 14870 - DNA, 611 bp, Oryza sativa
aaatctcagccacaggcgggcgcttgggccgttctgtacgggcctcggccacagcccacagccacactagtaaaatgttttttttttcgaaacaataccaatattgctgcccagcttaatatttcgcccaacggcaagctcctgccgatatctatctcctctgtacgtatgagtgtcagtcggatgcttgcatgcagcaatcagtatacatacttgtgcaattgaatactccctccgtttttcgttataagttcattttgaatttggtcaaaatcaaactacttcaaatttaatcaatctatatacctacttaaaatatacctacttaaaaaaataagtaaggctttcggtagggttttttcgtccgtcaattttttttcacacgcggtatttttctcacgcgcggtttttttggccggtttttatcagattccggtttttttacgtgtggtttttgtccgatttttttgtccgattgttttttggtgggcccggatattccccaccgcgtccaatttttttgtgggcccggtttttttccaaccgttgattctgatgggcccggttttttatatacaaaagaaaaaaaccacaggaatccatgttcacca

SEQ ID NO: 14871 - DNA, 1501 bp, Oryza sativa
tacttaaaaaaataagtaaggctttcggtagggttttttcgtccgtcaattttttttcacacgcggtatttttctcacgcgcggtttttttggccggtttttatcagattccggtttttttacgtgtggtttttgtccgatttttttgtccgattgttttttggtgggcccggatattccccaccgcgtccaatttttttgtgggcccggtttttttccaaccgttgattctgatgggcccggttttttatatacaaaagaaaaaaaccacaggaatccatgttcaccatgttcacgcacagaaacacagtagtccaggttcacgcacaaaaaacacaggagtccagttcacacacaaaatatacatacaaaaaaacagagtccaggtttaccaggttcacgcaagaaaacaatatcgcatacgagtcaggttggttcgcccacaccttttcctgctcctgtttgcgcagcccaagtcaggagttagattctatcccgattctatcccgagtcagattctatcccgcttttgtttccgctatatttagctagcactcccactaacgtgattttatagatttttctcgcaggacaaaatacacaaatatgattacaggcaatacaaataatagaagcgcacaagaagatatagatcacaaggctcttcttcctctaggatgtcaagccacctccaattaatgtcgattccaggttatcaatgaactcaaccctgaatgcaatttcaatttcattagatttataagattaatattgaataaaactacccaaggtcttttttctgtccatgcagaaacatatagcaagttagcaacaggcatattttcatttcagttgctcagcggctattttcataacataccaccacaaaatctaggagttgcaaacccaaacatgaaaatctcttttttaagtggctttatatattactagaagaaagaaaaagtattggtaattgcagcaagagcaattttatgcagaaaaacattaactgtgcagacagatgaaccatcgtttaattattgcaattttttatcatgctctaagaaccttaatgtttatcatgctctaaaaaccaagtaaatacaacacgactagatgaatgtctttctgctttctttttaccttatgtccgctctgcttttattcttatttattggcagtaattaccggaatatttttggcaatcatctcgattctatacctccaacccatcaaagggtgataagaagaaggttcacaatgcagcacgacattgccaattgcctgaaaacaatgtcatagccaacacttataccaatccagatcagcagacatcagtatggagctcttaaaaattccaaagcattacaacggggcatagcaagtacaataggttccaatttagccatgcaactaaacttaattctgaaaaaaaaattgacctgatcatcataactctttagattaagaaagatatatcttgatgatctttcagaatttc

SEQ ID NO: 14872 - DNA, 1295 bp, Oryza sativa
  unsure (1)..(1295): unsure at all n locations
atctgtttttttttctcataaaactaccagatgtttcagtcatgactgaagactaaaccgagctaaccaaaaatcaaattccccggtcttaaactgaattatttgcaatgtatttcagtcctcagtttcagctcaccaaaagttagagtttaagagataattaaagaaatgttattgacaagcgtccaaatataagaaatgccatcaacaagcgtgagttctaagaaatgttaccgtacaaacgactttgtctaaaaatgtcatcgtcgttagggttctatccattccacgtcgataaatacattgttcatcctgtagcacttaatggtgcggtatggatggaatcctaacaacaatggtatttttggataaaatcgcttgtacaatggtattttttggaactcaaacttgtcgatattatttcttggatttggacgcctgtcagtgacattttttggattatctcaaagtttaaagcaagtggnggngtgttttggtttccctttttctaacaataacccttttcgagttgtagtctttgaaattttttcccggcatatcgatatgaaacatactatctcgtgctattcggtatttttttaaaaaaagtttaaaagaacaaaccaaatctgccaagcgaatgagcattctaaatggaccttcagctagcagcatcagtgcggtgatgaacactgccattctgatggacctttggcgagcagcatccgtgcggtgaaaactggccctccgtttagttttctccctgcagccttcacgtaaccgactgtagcgaaatattctgtcggcattgcgtttccgctttcgcggtgaactggcccggacccggctgtgtgtgtcatcccggccccggtcgagttccgcgtcctcacggcgtcacgggtgttgggttcctcctctccgcgtacgtactaacccccgtacacgcgcgcgcacggggaaaactgcccgtctcgcttcgttttttccacccgaaatttagttgggaaatcggggatcccgcgactccgcgagcgaccgagccatcaccccatcagcccgcccatcacctcagcacagcagctagcagccgttgcttgtttttccagcttcctcatgcacctcacaccgctgcctttaaagcccacctcccccgcgccgcgcgtccccgtctcatctcatcatcatcatcgcccgcggccaccagccaagccatcgccgcgcgccgtcgtcttcttgagcttggcttctttcttcctctctctctctcccctgaccaagaaggggcgccgtggcca

SEQ ID NO: 14873 - DNA, 1230 bp, Oryza sativa
ccgccgccgcctgccaacgccacgccgttgccgcgcgccgtcgccacgccgccgccgccttcgccgccgcgcgcgcatgccgccgccgccacgccacgccgccgccgccacggcctcgcaacgccacgccgccgccgccgtcgccacgccgccgccgccgccgccacgctgccgcgccaaccgccgccccgatgccgccacaccgccgttaacgaacgagaacgagaacgatcgaacgaacgagagcgagaacgtgaacgagaacgagaacgatcgaacgaacgagagcgagaacgaacacgtcaacgtacgttgccgcgagaacgtgaacgagaacgatcgaacgaacgagagcgagaacgagaacgatcgaacgaagacaagcaagaacgagggaacgaacgtgaatgagaacaagcgaacgaacgtgaacgagaacgagcgaacgaacgtgaacgagctagggaacgtgaacgagcgaacgaacgaggacgaacgttaacgtgaaatgcaatatatatatatatatatatatatatatatatatatatatatatatatatatatatatatatatatatatatatatatatatgttacttcgcatttatcctaatacatctttttgtatcttgcagaaaagacgtgttgtcggagtcgtccgtcaagcctgagtggaagagctagtcctagaaggaattggagcaggcaagtgacgtaataatataaatgattgttatatttgtaatgcaattaattaagattattagacctgtaattagacttatcatataagattgtgtagtgttctaatattatttgagttttaatataagattactttatttgtaattagacttagtatgtaattattgactacggaattggtgcgacaagtagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacaga

SEQ ID NO: 14874 - DNA, 1501 bp, Oryza sativa
ggtggcggggaaggagtcgggtgcgaggtgaggtggctgggcgttcagcagcagcggctgcggtggtggtgaccgtgtctgcggtcaccagaggcatggcggcttcggatggctagccgagggcgtgggagatggctgcatctggccagcgtggcatcgtttggtagaggggtcggagaccagcttggcgcagagaggcgtagccgatggcaggggaggccggctcggcgcgagaggcgcgggcggcggagatggagaccagcttggcgcgagaggcgcgcccgatggagggaggccggattggcgcgagaggctcgtccggtggaggaggccgacttggcgcgagaggcgcggccggcggtggagaaggcgacctaggtgtggggaggagctgccggtgagtgtggcgcggttttcggcacatgaaggctggccggcggaggacgtcggtgcaggggtctcacatgtcggcagagcttgtatggtggtggagcatcagtgcttcagccatggatttgcaggtggtgagcggcgggtgaaaacccagtccggccttggccggaccgacaacgatggttcattccccctcctgagggcgttgtcgtgttgtctcacccctcaagggtgattgccgggcgaaagcctagtcttggctccattgagtcccgacggacggtggcggcggtttttctgtcgcttctctttttcaagacgtcgtttttgtatcctctagggggcgatctcgtctgtgtccctttgttgatctagtggcggtcggtcacgtttagcggcggccggtccggtgttagtcttctcctgggcttgtgttgacgatgtcgatgtgtgggtgatggtatttttcttttccttttttctggttacgaccctacagggttgtaatcttgtaattttttcccgctgaacttagtcgttaaaaaaaaaggtgcagggccctgcaatcttccgcctgctttgtgcggctctacttaccagcgaagttccaggcttccactcccgtgcctctccgtgagctgaaccatccagaatccagctagatgaccaagccatcgcattgcaatgaagagcttgttactttatgcacgggacaacaatgttgctgaggaaacagataaacttgcgctgggcttgagccgattaccgtgggctatgcatgtatgcctgtgctgcctaatccacagattccacaacaacatatttataaccagttagattaaaaaaaatagaggattgtgttatgtagctaacaccatgttcatctacagctgacatagaatattttgatattttggagctaatgacccagctatattattagactctatactattaaacaatataaatttgctctaagggtaaggctgagctggattgctttggatccgatgataagctctctctattaatcttgctcttagagcagcgctaataagtcggtgattagccggtacatgtcatctggatctgacgtggaaggaaaaat

SEQ ID NO: 14875 - DNA, 1501 bp, Oryza sativa
ctttaccaatcggcagctggtagaaccgccagcattagaagtattgatggattgatcgatcgatcgatcgatccgggaaaaatatcagcagcactggctgcaggcactgagttatactccagtatattgacagaggcagatcagggagaattttcaggatacatttggtgatcactgctaggaatcgggtgtgctgccaaggaaaaaattacacaggcaatagcagcagcccatccaaaactatcgaacagatcattttggcacgcttatttcatatcttgggatggatcaataaataaactcaaaatgtattaatttcccgggcaaattgcaaaataactttagccagtacctcagtagtaaacagataaattaataatacaacacgcaaaacagtcactgtcagtatcagatcctggcaattgcactgtatttaggtgataaatagagtgagatatacattaagtacaagcctataggatccggattccggatgccttaagcagcagcagtgattctaacaagactctcggtgtatggcattacgctgaagttgaagagattcttccaccttggtggcctaccaccctgatacctgatgccacccagctcgcacacggccgtcagctcatcgctccacaggtcgtagcggtggatggtgtgttttgcccacagcaacatcccgccatcaccaagaaggcccattggatggcaaagtctcgagacatagatgcagtatcgccgctcccaatcatcaaaagacggcgaatttgtcgtccaaatcgtcacaggcatggtgtcactgttggcatgaaggacgcacaattcgccgtgtagcacgtccggcctgaccttgtcatctagggcagggtccagtgaatgaggaagaagagtgacgcggaacgcttggtcttgcaggctaaaccaaaggaggccaccatggagagtgtcattagggtagcgaaaccgatccatgtaccagaacaagtagccaccattgacagtgaaggcagtgagccatctactgacagggtagggaggatcagtgacggtctccctccagccacagcctgcgcccgtttcaccgacggtgaacacctccatccccatgcggatggggtccattgaacggtagaatgctcgaaccaccttgtacttgcgtgtgacaggatctaggcctagccctgcagcgtagcaagcttccatttccgtgccatggtggtggttatcaccatggccgtcagggagagtgatggtgtccctcgtggccgggttgaagaggtagaggttggtgtctgtgggggcgagcactaggccatcgcagtgggcgaagtggcagacgaggtggaactcgttggcagggaaggccgtggcatccatgaacctggcaatggaggcacctcgctgccattggtagaagctgatttgggtggagaagttgttgggccaatcacctagtcctccaactgggggttgaatatcgcaacgcccaaggagggtg

SEQ ID NO: 14876 - DNA, 1501 bp, Oryza sativa
ttgtacagatttgccggaacacgagctgcggcagtcgcagcaactgatcgtgcaaagctgtgctccagttgctactggagaggtgtgctatctctttcaaccttcaagtttttctagtcgcagaaatatcatggtgcagtaacacaatgcataactgctctagtagctttgctgtagataatgcagggaaaattaggttatcacactgagggcttgttcggttaatccccacgagtacaggattaattccatacctaatcccctccgaagccccttgtggagggattagccaaacaaggcctgaatctgctgtcctacatttctgatttactttttgctcgataattaattacaattggggcttggtctgctccttctgtggacatttctcactgcaaatgacgagagagatttctttagttgactatttgactattttggtcactaggttgatgctacctattgaattgacctgcaatgttctcagtgattttatgaaataagctatgcagtccaatgctttgatacacatatttttatggacatatcatactctcaaaatggatgaccccatgaaagataattctcttgaatatgtctcaagtttgtatgttagtcttgatcttgaccctccaagtagttaaaactttcattattagtagaattcacctattacttcatttttctcttctttctgtgtcttgcctcaggtacatcaggaggctacccaagaattgcaagacaggcttcctagtctcaacatatttactgctcagcgttcctttgaagtttcaattggctctaatgtattttcagacattgaaattagcatgccttctcttccgtccaagattgaccagtttataggaggcaatgatggcagtgttcttgtgagcatggcttctgcactagtgccaaaggaggtgacagacatgtctggctgtatcaatatcttccatgctacagttgacagagagagtactaggattggtgaacctgaaggatcagcttcactttgttgttctagagtagaggaccgtgaggaactagaaaaggagtccaccctccttactatggcagttggcttagctgtgggaaagaaaaatgggattgagcaggatctgaatcttagacctagcagtcctagaaattgtagcacaaaggcaacagatgatatggaaacgttcgatgtgatttcgaaagaagctgaagctctacaatattgcagcccaaatgctcaatacccacagaagatcctaacttgtggtcaggacagtgatgctctagtagttaatgctcatgtggcaattcatgagaataagatagaagacattacattccagcctcctgaaggcaccaaaacagaagctattgtacatgaaatggtccatgaaactatgggaagtttgtgtcaaccttcttcaaacacaaaggttgaacatgcagtgttgccactacaagccccaacttatggttgcattagcaatgagaacttgaacat

SEQ ID NO: 14877 - DNA, 1501 bp, Oryza sativa
aatattccacgtgttgatcgatgaacaacagattcagatattcagatcgtacattcgtacgtacgcaggtacgttcattcgtttctgttcagcattactatatatctcgtcgatcgatgaatgaattattagctcatggttgcatatatatgtgggcataaatatctctcatcacattggaaatatcttgcattgctagctagcccttgaatgtatcgatcgatgatggcataggcataacgtatggtcgagaatactccctccgtttcaaaatgtttgacaccgttgactttttagcacttgtttgaccattcgtcttattcaaaaaattttgtgaaatatgtaaaactatatgtgtacatgaaagtatatttaacaatgaatcaaatgatatgaaaagaataaataattacttaaattttttaaataagacgaatggtcaaacacatactaaaaagtcaacagtgtcaaacattttgaaacggagggagtatataggtatagcaggacaatcgagcagctagctagcatacagatatcagtagtatttttcctcttgcatccttttctttttctgaagaagaatagatatcatcatcgacttgtttgtctttttttttttgaaacttcatcgacttgtttgtcaatggaatgcacagcaacatgcatcgatcgtcaaatccgtagtttcgtaaccaatcatcaaattaatcaaatcatgcatcgatgtgcaattgtgtatagttactccatttacgaggtagtactccaattaggactagtagtgcttttaactgtttttatcttcgttatgagtcatgaccgtggataagttcaattcacattttaaatcgatggattttcatcggtctctcctcgaggtgacaaattatgagcaaattgcagacgagagaagctagggtcttttgacagagagtgaaaaacggcaaccctggaattctcattttctcctcgtatttgtcaacctcccggtttttctacctcgtatggtatcacctatccaaacctccttaattttttactcagtagtagatagatagatgatcttagtaactgaagtggatttactgacttaactctagtgtttactcttgttcgtctgaaactaggaatatcatacagccgccgcagtacaaaactgagttaaaaaacgcacgcctacgtagaacaaaactgcactggtaaagtgggccacttgaatagataaagaaatggcccagctagtcctaatgactgaacgggaaagtccatttgacgtccctcaactatggtttgtctaggttagtccactattacagcccacaatgccttctttgaactgggctggtctttacattctccaaacacaaaaaactagtgaaagtttcgaagttgggggtatgtttttttagataatagttagggatatgttttagctgaatgaatggtgattgatactccaaaattgtatgtgctgtggtcatgacttggacaaattcga

SEQ ID NO: 14878 - DNA, 1501 bp, Oryza sativa
tatacttctccactaaagcttggatcaaatggcacttgtctttttcaaaatacccagctgacttgcaacgtttccgcttgccgtcaggccagtacatcgcttgccgtatcatcttctccattagagggagcctatcaagctcctcacccctaattagatcaatgaagatcatgtatgattagtatgctgtactttctcaaagttgtcgatacaatgtgctataaagttgtttgcacatgttaccaagtctggtgttcctcaattagttcacgtagaaagataaatttaacacagcacatgataaaacaatggagagtgatagttgtttccatgcctagattatatactctcaaagcatcattaaatttcagatttctaactcacttggaacatgggacactgttttgagcaattaattagactaacatgcagcaattcagaatataacatcagaaattatggaagcccggtatttttgtaaacgagaactagtcatcttttctataactagggtctgggtcatccattatattctgatttttttctcaaatactattatattctgattcaagctctcaaaagttttttgttgtcaaatcaattcaactgattttgaagtgtatatgtgtgtcctaattattactatgatcctaaatcaacctgaagctccatgagatgaaacatgcaccgaaatataaaaggcagttactgtctgccctaaataaatacatccaagtatccaaccacaagagtttgcaacaaataaacagataacaagataaaacaaagttaagaagcctcacatttctggaatccgcaggtcatgaagatgttggtttatagcatcatcaacttctgacagactctgatatggcccacaacccacatcgggatacatgtggaaacaccccccaggatccatcctgatgtagaatacaaaataccaaccacgaggtctcctgaccaaaatggatgacccaggagatgaccacaggcagcactgtgatggcgtcgaagtttcagtgtcgtcatgctgcacagtaagtggagaggaagaggaagaggtgtgtgcagttatcggttctttcgatgctgtattactgagcaaccccacagagaaggaaacatctggttctcgcagcacttgtgcagacgaaggctcagcagaatttaccaacctgtagcaaacaagctcaatgagtaagagaaataattttattctggaaggatctcaatcaaaacatatttattcattctaaataaatattgcagaaggatcattttgcagtggccaagttagcaggggtcaaaaactatatagactttaccaatttgttacattaatccctagaaatcacatatgaatacaccggttatgtttgtgctagcaaacagcgcttttcccccctgtcctgcctctccactcccaagaatctagtgtcacaaactgctacttccactaatccatcgcaagtcttacagaagacgtatactgtctatc

SEQ ID NO: 14879 - DNA, 1501 bp, Oryza sativa
ttgaccccaaaaggtaaatatccatccaaatgaccaccactgtatgcatcattgttagggtgcttcatgccaacataaccattattcctacagccatagcaatgaccttcaaaaatggggatatttgtcagttttaacagccaaagtaactgggcagatggttaccatgctgataagtgatcaatggtaaataaggcatgtcttcagtacaaggataatgaatcacatcctatagaaattttcaattatatcgaaaagaaacagtactccctattagtgtgagctagacagactatttcaaacgtgaacactgaggtagtgttttgatacaagttgctgaaggggcacatgcactacagcatatatcctaagccaaaaggcatgcacaacttaccaatttgctgttacatacaattttttaagcagaaagttatataggataagaaatttgaactaaaattgtgcagaagatatattaccgttagcactaggtttaattatgcagcaacagctgaccacccattcatattctccttgcatatgtgatatttcagcaaagaataggttctccacaccacacccatcagctcttttcaccttcgcagtgaaattcaaatggtggtactgcctttgatcctcataaattactccatgttgcaaaaaatccttaagttcatacgcaaaatcctaaaacaaaacgcatggatcagataaacaaatgttaaaatagtaagacataagatatagataatatatatttgtgtgtgtggagagagaaagaacatacccccaaaagattatgatcctcattatacttctccactaaagcttggatcaaatggcacttgtctttttcaaaatacccagctgacttgcaacgtttccgcttgccgtcaggccagtacatcgcttgccgtatcatcttctccattagagggagcctatcaagctcctcacccctaattagatcaatgaagatcatgtatgattagtatgctgtactttctcaaagttgtcgatacaatgtgctataaagttgtttgcacatgttaccaagtctggtgttcctcaattagttcacgtagaaagataaatttaacacagcacatgataaaacaatggagagtgatagttgtttccatgcctagattatatactctcaaagcatcattaaatttcagatttctaactcacttggaacatgggacactgttttgagcaattaattagactaacatgcagcaattcagaatataacatcagaaattatggaagcccggtatttttgtaaacgagaactagtcatcttttctataactagggtctgggtcatccattatattctgatttttttctcaaatactattatattctgattcaagctctcaaaagttttttgttgtcaaatcaattcaactgattttgaagtgtatatgtgtgtcctaattattactatgatcctaaatcaacctgaagctccatgagatgaaacatgcaccga

SEQ ID NO: 14880 - DNA, 1501 bp, Oryza sativa
agctaattagcgagggtgtaacacattatcttcatgaccatcttccgaattttggccatgctctatgatcagctgccatcgcatgcatgcatgcctcgatctggcggtgatctcagtaaccgaatgcttatcggagtcaacatatcgcacatggccctgcttagtaattaagatgcagatcatcagtgagccttaagcccttaattagcacaattttattaaatcattgagtgtattattatggcacgcgtggtataattagcaaacagctagctaacagcccacatttcaaaaagtcaatgtatgaaccttaacaacgctgctatacgtccgaccagcgtacgactcaacggcgaaatacacggcgcaagcccaattgaattagcgatcgttgcagaagttacggacggcggacggccaatgacgtagtcgtgcgctggtcgtacgcgtcggttggacgtatagcattttcggaaccttaattactccctccgtttcacaatgtaagtcattctaacattttccatatttatattgatgttgatgaatctagacatatatatctatctagattcattagcaccaatataaatatggaaaaaactaaaatgacttacattgtgaaacggacaaatagtttttttgttccaaaatcgtgagagcaaaaggatcacggatggattcgcgacatgtgctgggaacagggcatttccggattagtcgtgcagataagctgatccgagcactttccatttgtattaaatttgctcgctcatagtactgctgatgtgatgcaaagattatcttagtctaattttgttgcaccttcttctttaggtacaacgtataataatgatcagaacgcgtgacatgcatgtacgtgctggttattactcccttcgtttcaaaatatttgacaccgttgactttttttaagtacgtgtttgaccattcgtcttattaaaaaaatttaagtaattatttattcttttcatatcatttgctttattgttaaatatactttcatgtacacatataggtttacatatttcacaaaaatttttgaataagacgaacggtcaaacatgtgctaaaaagttaacagtgtcaaatattttgaaacggagggagtacgtgacagtacgccaatgtctgcagttaatcaggactcaggagcatccatgcatgcatgtttccaggatatcaatacgagcccactacacctccaattataattaagttggcataggtaatttggacagctagctagcgcgtcttcgtgcgtaccaattagaacaggctataaatgtaagccctcagtttcattcacatttcaccactcctccggtgacagtgagtgagccgagggttttcgatatctggataggagcagactcatcgctaaatgtcttacccgactattcaaaacaccggagtacgtgggtccgtgacgctgacgctgtgaactagctagccatggccatggctgcttcttcttctt

SEQ ID NO: 14881 - DNA, 1501 bp, Oryza sativa
aatgagtgggagagagtagttatattgtttagtttatggaatttaggaagtgtagtgtaaaattttgaacttccttgtcatttagaaatagaagaggactaaatataaaatgttagaggctttgaagctacctatataggtaatcaaatgagccccatgacatgattaggcatggctagtgctaaaatccataaaatccatgccaatccacgggctacaccaacggctcaggcatgacctaataagactcgggccgtgccgtgccgggccgaaggcacgacaagcccagcgggttcttccttggaatatatctattttgcatccgtcatctatttgggccttgtctgataaggctagaataagtctatttgcattcctcatttctttgggccatgctttatttggctaaaataagcctattttgactccctcatctattttgcctccctaattgttgggttgtgccgtgatgggccggcccaccatgccgaggcagaggcccagacacagcccaacagttgggctgagctggtacgggttagacactagtcgggccgtgcatgtctgggccgggtcgtcgcgccctgggctgtttagccatctataactccatgaggccattgattttgttttacatttgcacatgtagtctcagcatagatagtagccatattgtattcgaggcagggtttatattaccgtcggtaactatgcggttactgccgttaccggccttaccgcgggggtatggtaatagaaaaaccgcggtaacctacttaaatttaaataaatttaaaaaataatttgaatttttgataaattttgtacggtttcgtacggtttttcacggttaccacggttaatgcgcggtaaccgtgcttaccgccagggcacggtaaccccggtcccggcggtttgggaaaccctgattccgaggtaactcggtaaagccgcttgcacagttttgcattgtaaatgccctgatcgagttgcatatgcccgtgatgctacagctctttcccacaacttgggacaggaagactcagtgaaaaaaaaaaaacaaagaacagaatgcccagacaaccctttctaaaagacgtgaattagttgacaacccaacggcttattattccctttcatgattcctaacttcttttctggaaaaaaaagcatgaaagcaagcatataccttaattaagcacacatgacacaattaaacaaagaacaaccaagtcagagcgatatgggtacgcaaagtcagcagaggaggaatcaaaatctattcctccccgagcagcgactcaaacgtaacacagctgagcagctacctaataagctagctagctcacgtacaagcatgtcgtcccctctctctctctctatatacatatatatgtaacgaattaagtcaatgtataagcaaattaaagattgtctgcagaaaggaaaactcaaacaaatcaattagagagagagagagagagagtaaatcgatcgacaa

SEQ ID NO: 14882 - DNA, 1501 bp, Oryza sativa
tggaaagtgacgggtttccttcacagggacggtcagaacacaggtgtgtgggcggtctgaccggctagtagggccggtctgacctcaagtatgtgggcggtcagaccggcagggtccgagtcagagtctattgtcgtcgggtctcgggtttcattgctcgagaaggcatgtttcgtgtttcctttggtttctatcccgagttgggcgtggagaagggcctgtagagggcaagaccaacccttatttaagggacaaggccggttcactgtaaaacccccgaatacaatatacttgaatcgttcttttaccatgtttttctattttaccctagtttagtccatctttgtcggtttgcgccgtaaatcgtccgccgtcgctacgagagtgcgacacttctttgtaggtttgtcccgttttgcccacgagacgggtagttatcctcttatcgatctaaatcggcctagaggctgattttgatctctaaatcggctccgttagccggtttagctgtttttctacgaaatccatcttgatttggccctttggctagatcgaggtggttggcgactccatatcaccgcaaggcgtttaggtgttgcgatcatgcttgtcgacttggcacaaaaagttgccaacaaatatacctataactggcctcactttttttagaacaactggcctcacttagtgtatttgtcatggttatggataccacatacctaatagtagtcaactaaatctcggcaggacccaccacataccacgtcttatacggaaactgacttcggatatggagggagttccggataaggaaagacaaccagagttctacatggaaacgacaaggactactcggattgtatccatattgcttttcctagttctacttggacaagggaacacctatgggtataaatacaaggccccctaggaggagaggggacacggacaatcgacgaccacctcaatcaacacctaccacaatctacggaacaatagatctagacacaagatcaacatacaagccaacatacgccaagacaagacgccggatatcgactttagggataagcacggctagtcccctacggtgtctccggatactgtcaggagagacggaagtgctatctctgatctcgccgggcacggattcgaggaggaagactaccctgttgtcgactacgagtcagaactttagacagccatgtcgacaacagttagataggctaccccaaatattgtactggtgtgattatggtaaataaagagcaacgaccggcttcggccaacagggtgtagggttattacctgacaattcaggggcccgaacctgtataaaaatctctatctctatctcttttacctcagtcttgcgtatatcctagtaccaacgatccccatactatgcaaataccagaactgcgacatcaaacatcgacagtggcgcgccaagtaggaggattttggtgcttcaggattttgaagagatgggttcaagaga

SEQ ID NO: 14883 - DNA, 1501 bp, Oryza sativa; identical to SEQ ID NO: 14882

SEQ ID NO: 14884 - DNA, 1501 bp, Oryza sativa
gttcgaatcaagcccgtaatcgtcgccggcgcaatcaatggagccgaatcttccgcgcgcgattcctccctctccggccgctctttccttcccccggcgctatttaaaccctccccgagctccgctctttcgtttccgccgctcgccgctcactctcgccgtcggaatcgtgctcgcgccgtagcaccttctctccgccgtcgccgccgtgcttcggttagccgccgccgccgctccgctcctcctcccgactcggcgacacctccctcggcatcgccgcatcgccgtcgacctcgtccgcgcctccgtttcgctcgccgaccgtcggagcaccgtcgtcatcgtcatcccgagccgcgccgccgtctccctccgctccggccgccgttctcgtcgtcgtcgttgtcccggggtgagccgaggaccgccgttcgccttcccccttccctcctctctctcgggcgccgctccgccgcgccgatggtcgccggcggtgaccatcggggcgcgggcgcgtcgctcccgtcggccgcgccggcgaggccgccctcgggcgcgccctcgcggctgccaagtgggcccggccgtcagccgcccgcgcccgcgggtgcggctgacgcgcgggacccacggcgccgaccgccgccagccgcgtgcgcccggtccaccgtggaccgtggggctgacgcgtgggccccactccccgtggacccggtccgcgcgtcccctccctcggctgacgcaataatccgttttttttaattaaaatttaaatgaagaaattcgcaaatatccatttaaagagcatataaacttcaaatggccatatcttggccatttgaactcggaattggaccgttcaagtctctaatttttccttaagaagtaaagaacccatttttgtgctttgttcctgcttgttgtttggagtttattagagtaaaagtctttttctttttccgttggtcgtgtagacgccgcagcttcggaagatccgctcttcgtggaagttgaagccgtcgtttgggaaagcgagcaaggcaagacacatcatcttgatcatattgaatcccattttataaaattatgttgatttaaattattgcattatcgctttatttaaattcccgcgttgtcactgttttatttagccatgcctatttatctttgttacgaccatattattattgttattgttattgttattaccttgttcaccctagattaaacaaaacctcaactagtggacactctactcatggttccactagtatgaacttaggtagatgcttcgctggttaattaggcaacattaggtggtttttacaactttagacttgggaaattctcatatcatttggacactgtggaattgttggattatgatggaattggacatacacctctcttcctctttcaaaacccctaaaacctgttttcggtggggtttgggtgcatgccagttatgggaagtagcaccccggccactataaggactaaa

SEQ ID NO: 14885 - DNA, 1134 bp, Oryza sativa
gttgatggaagtaaaggatgattttttttaaattttgttcaaaaaagtgggaaatgggaaaagaactttgttttgggaagatagctggataggtggaaaaccccttaacattcagttcccaaatctgtataacataactttgaccaaacatgtgacaattgcaaaggtgaaaatgaaaggcttgcaatgtatcaaattcagaagggatctggatggagataaaatgagagattgggtgagaatcaaaaatagtttggaaagtctgatcttataggatgactctgaagacaaaatttgttggaatttgacaagggatggtatcttttctgtgaaatcgttttataaagcccttaaaatgcatcaggtgtcttttccttaaaagagaatctggaaatttaagattcctctgaaaattagaatttttatttggttgtttgttaaaaacaaaattcccactaaggaaaaatctgtacaaaaaaggttgaaggaagggggatgaaaaatgtccattttgtgacaaaaaagaggatatacaacacttgtttttgattgtcctttggctaaattactctggaatatcatgtgttgggctctggatataattccaactttgaatcatcatgatctttttgacactggcttgatagatatgataaaaacatgaaacacttgattgtgattggcttagctgcaatcatttggacaatttggaagtccaagaataaaacatgctttgagaataaaattccaagagatcctactgatttggtctttatggcttgttcctgggtggattcctaggcatctttgcagaagttggaagcaaactgaataacagttgggagctagactcataagacagatggcaagtgatatcttttgctcaagacatggatggagacctgggatcaggaggatagaaggatgaagatgttctctttttttttgtgatctgttttatccctttgatgtcagaatgatgtaatcgtgtctagccatccagcccgtgaggcatctggataagctttttagctttttttttcttctttggttttgcctttctgacttagtaaggatattttcatttctagtaagagaaatgggggctttctggccctagttctaaaaaaaaaa

SEQ ID NO: 14886 - DNA, 1501 bp, Oryza sativa
cacggtcgccatctgcaaccatcctcctcgcgcacacacgccgcgcggcggtcgcggacgtacgagacgacggaggagcaacacatacagagcgtcggcgtgggctcgtggcgaccgcgcatggccagacatgcagcgcagtggccggagacagttgaggagatgcaaattttgtataaggccctgtttagatcacactctcaaaaaattttcaccctgtaatattgaacgtttaaacatctgcatgcatgaagtattaaatataagctaaaaaaataactaattgcacggattgcgactaatttgcgaggtgaattaatcttttaagcctaattgctatttgatttgacaatatggtgctacagtaaacatttgctaatgacgaattaattaggtttaataaatttgtctcacggtttactgatggattctataattagttttttattagtgtctgaacactccatatgacaccctatataatacccgatgtgacacgccaaaactttacgcccctggatctaaacaccccctaagccttaacattgcgatgagtagggttccccttaccgttttcggcgtagttatcggtccaccgcggtaaggtggataccacggtaactgcgaggtaaccgcgagacattttttttttagaactagggccagaaagcccccatttctcttactagaaatgaaaatatccttactaagtcagaaaggcaaaaacaaagaagaaaaaaaaaactaaaaagcttatccagatgcctcacgggctggatggctagacacgattacatcattctgacatcaaagggataaaacagatcacaaaaaaaaagagaacatcttcatccttctatcctcctgatcccaggtctccatccatgtcttgagcaaaagatatcacttgccatctgtcttatgagtctagctcccaactgttattcagtttgcttccaacttctgcaaagatgcctaggaatccacccaggaacaagccataaagaccaaatcagtaggatctcttggaattttattctcaaagcatgttttattcttggacttccaaattgtccaaatgattgcagctaagccaatcacaatcaagtgtttcatgtttttatcatatctatcaagccagtgtcaaaaagatcatgatgattcaaagttggaattatatccagagcccaacacatgatattccagagtaatttagccaaaggacaatcaaaaacaagtgttgtatatcctcttttttgtcacaaaatggacatttttcatcccccttccttcaaccttttttgtacagatttttccttagtgggaattttgtttttaacaaacaaccaaataaaaattctaattttcagaggaatcttaaatttccagattctcttttaaggaaaagacacctgatgcattttaagggctttataaaacgatttcacagaaaagataccatcccttgtcaaattccaacaaattttgtcttcagagtcat

SEQ ID NO: 14887 - DNA, 1501 bp, Oryza sativa
tcatctcgtcattactgacatgtgggcccacgcttcaccttggcccaccggtcattggcgtcctggttaatgtgcgaaaatcaaggagagtggccatcaacaggcaggagccatgagctggcccccacgagaagttgttggtgttgggattgggaatctgttggctattgcttgggatgaaaattaaaggaaaatctataaattttgttctcaaatgaaatgaagggttgatttggtttgtggcctaaattggtcttaccaattcgtcaatgtcaaattttggtaacttttagcatggctaattttggcaaaagtaaaattatgtttggattgaagccaaaatagcctaaattaactgttaaaatggcatatttttttaggtatgtcaaaatttggctccaaaccaaatagacaataaacactattgaaattgccaaatattggtaaggccaatataggcctcaaaccaaaccaacccgaagttaacctgtgatcctcctcctgatcatgtgctcacagaggttaatttctctgagctcagcaaaccatgttcagttaatcaatttttgccatcaagttagagtgaaaacatggtgaaaccctgaatacacttggactgggttaacgagatgataatcgtcccatgacttggaacaaatggccatcatgacagtcacatcaatatattattagcactacatcatacacctaccaaataataacaaataaccttaagtccttaacaaataataagtgcacaaaaacacggagaaaaaataacaaaaaagatatccactcgcaaatcaaagaaagactggcagagtaaggctgtctttagatcacactgaaattttggttgaaattggtacgatgtgatagaaaagttgtgtgtgtatgaaatgtttgatgtgatggaaaattggaagtttggaaaaaaactttggaactaaggctatgtttagttcagcgcaaagtttggattttggttaaaattggagatgatgtgaccgaaaagttatgtgtgtatgacaggttgatgtgatagaaaaggactaaagtttgaatccatctaaacacagcctaaacaggacctaaacaaattcctaactactctagctaaaatatcgcagaaaccctccccacaaattaattgatctgcttcctcctcccctcctctcatgtcattgtcctgcaatacacgaggagcaaagagttgtgtgtaatcctcctcctactctgggtcagctcttaatcccttcaacttccgtcggttggacgccaccggaagccaatccctgtttggtgttttacccccaattttgtcagattttttggagcgaaaccacgagctgtttgaagtgttcggcttcggaatctctttcttggagttctaggaatggggttttgatacaaagattgaagcctttttgttagcgttggtgcaaagattgtattgtattgttttttttttctgcgatgggtggaggcgtcacggagcggc

SEQ ID NO: 14888 - DNA, 1501 bp, Oryza sativa
aaaattagagacttgaaccaactaaatccgagctaagatgaattagttatgaattttcaaagatttaatcggattaaaacatttatatagattttaattgaattatgacgcaataatgaattatttttgaaaaggaaaaaggggattattgcgtcagcgggtcggctcacggtggaccgggtgcatggcggcggttcacggaaacaaacggccgtgatcgatctatccaaaacggatggccaagatctaacggtctacgaccgatctacgacggacggcgtcgatgacgtcagcgatgacgtcatcaccgacggcggctcggcctcgcatgctcgccggcgaacgacggcgcggcggcgcgaacgaaggacacctacgggttgcgggcgacgtggaaaactcaccggtgaccaaaacagcggcggaaggtcaacggacggcgacggcgacgaggaagaagcggcggcgaccttcagcttgacgacgacggcggggctccggcgatctacagcgacgacggaggggtggacgaggtcggcgacgacttgacgatcacgacggcggctttcccgagcgacgacgacgaccagagcgacggtggcacacggctggacgaacggcggtgacggcggcactaggctacacggcgctagagcagagctattgatgtctccctgtacatgcatcagattgccacctcggaatatgcatggcaagtgcatgcatgtatccttgccgtgcttccaatacaatgtgccagcaactcctctgttctctatccgttgcattgctcattggtgtagcttgtgtgcatatgacgtgcactttgtgtacgccgtccgtgcctctcttacgcatcgcagtccgcagccctcgtggtcaccgtccacgaccccatcgtcccggccctgcatgtccgccgcgccatgccgcgctcgctgacttcacccttccatcactggcctccctgccgtcgctgatgaaccctgagttccactcgacactcaaggctgttgttggcccgatctttcggtgagttgagataactacgatttgggagacacgttgacgacccgactacaaccgtacgagacgttgtgttgcgccttagcgatcgatacacctctccgtgggttgttgatcttgccggtgcagatcaacccttttcctgcaagcaaatcgaagaaacaagcaagaacaagataaaagcaatctgatattgcaaataggaatttaatacaaatgataagttggggttccgaaaaacaaccaaacggacggtctagccgacacgtgccctgcaaccaagtagcaatagctaaactttaatctatcaaaacccaaaaaactctaaagggctacctacctatttaagtaggtgggaggtcctctaggtcatcctccactgggttggtgcgcaccccacatgggccccacttgggcggagtcccagacgaagttacaagcccatagggccattacaggtgtcgcagcaccttgt

SEQ ID NO: 14889 - DNA, 1501 bp, Oryza sativa
cctcggccatatgggcctccagagcggcgtagcggcgggcaagggagcggtaagcctcaaggagtaggtcgtgctgagtggcctgagcctccgaaagctcaaccatgcgagtcagcactggctgagactcgctgtacggacaagggtacctggcgtctgcgtggccagaaggaaggcgtggaagctgccggaaggcggagcccccgagacggtggctgtagtcgtgggccaggcgacgaagcgcagtccaggagaggtcctggtacgcgatctggagagtgggcctggccacagtgaagtggtgtgggcgaaggccagctccgtgtatacctccacgggggtaaaggtacacagagagctcacagcgagggggaacacggtccacggagtaccccgtgtactcgggacacgagaagccaaggaaacgggcgaggtcacgaagctgagcgacgtggtgaccctcaccaaaaccgtgggagctgacgcttgcgttcactgccatctacaattttgaaagagggagaaaatattagtaaccattttagaaacaaactattggaaataaagaaaacaaaagaaaccttagcttttcgcaagtagttttgaacttagtatccttagggtcgtcctaaacgtcgggtttcgccctagggccaagcctgtgctctaataccatctcttgtcacgccccgaactagtaccgaccggaactagcccgtgacgctccaaattaacctgtaaattgataccagacccaggaaacagtgctggtatcataggaagacagattatcacagcaacagaggtctctttattatagagtagaggtacagtcatgttgggctgcggacagatcccgagctcacaactgcattacaaaagggaaacggaagccaggacttggaccaaacaacacaggcgcgacttgggaactaggccgaaaccctaaaactcatcgtagccggcttgctcctggaagaactcctcgtcagcgggatccgcttcatcttcttcagcaactggggggggaattatttatatagagcaagggtgagtacaggagtactcagcatgccatgggaaataggtgtttattgcaggcttcaaggaaaggctgttgtttttgcaattgatttcatttgaactcttttctgaaatcaactaagtgagcgcttctcaaatgacacggatgagacagtgcgtctcgtccggtcggagtatgtgcaatgtatcagtctttagatttgaatcaaggttggcacccggccaacagcttttcaaacggccacccgggccaacaactttcaaacggccacccgggcctagctgattccatcagctacagatttttcaatcatcgaacccctttccacaacagcaatttcacaagcagtagtcaagcaaaactacgctaggaatcacctcacatccgcccatgaccgtgggcacggctgttcgaacagtttgttaacctctgcagagggggtacactttacccaca

SEQ ID NO: 14890 - DNA, 1501 bp, Oryza sativa
cttcttttttcttcacttttctcgaacaaaaatgggccctacgtgcgggaggcggtgtacgtgtccttcgctggaatccagtggcggaagccgcgctcgctttggaccaagtagggcccatcaagggcccaagtgggtgtgggcccacgtctcggaaaccggcgagccgctgcagcgacgcgcgatggttcagtttctcgaacgttctagaactactagtactggcttgcgatgagctggtgggttggataagaacgacctaagttggtgggctgccgcgtgcggcggtgaggtcagttttgggctgacgtgcctaacgctgtgccacttgggccgaaaaaacgctttttttattcggcaattcggtgtattttaaaagacctaaacgcacgtggtgttatccatgtgtactgggcctgtattgggttcaactggaactttgggcctgaattcaacgtgtagtatgacttattaataacgttgtttattattattattattattattattattattattattattattattattattatttttaagataatggaagtatataggctttacaacttctctaggaatacatgcaaatcagcagtaggatttgagctttaatggataaaatcatgcgctaatagctttatcaccattgtggcctactttttactactaaacaaatattgattttgaatttattggccatttatctatacatctccctgccctcttacacatcttcatcctcaactctagcttcctccatcgcctacccactctacgcaagtgtagcggcttgcttaatgttgccgtcgtcctcgccctcccaccactactaccgagggtggaggattgaggatggaggaatagattagtggttggcacttgggaggatattgcattgaggatggaggtacggagtagtggttgggacgtgggaggaaggagaaggagagaaataaagtgatggatttccgaaaaaaaaaagtgatggattgatacataggtctcactgttatagacccaaatgaaaagtgtagatgaaaaaactgcgagtctggcttaccaaatagccaaatcaggagaggaattagctatgtgaatggttggagaggctgatttcgtcggaaatgctcgcgcttcccaagttctcattcctactaggctttgggttcagacgatgaggccacctggcaccgcactaggctttgggctcatttcaggcgccggcagccggcgcgtcacggagccgaaaccgccaaatttcataagaaaaaaaaataaaaataaaaagaaagaaacaaaaacgcaaagaggagaaaagaagctcgtctccgcgtctctgcccgccctctcgtcgatttctcatttctttctctccctccaatttgccccctctttgtcgttttagggtttccgcgctccaactcctccccaattctggtccccgattcgcgcgatctcggccacccatggtctccggcgtcgcccaccgcccgga

SEQ ID NO: 14891 - DNA, 1501 bp, Oryza sativa
actcatacaacaggctaactacaaattatctataagctgccttggttagagcaagtttaatagtatagcccactactagctccaattcatctatagccaattcatacaatagtttcttactatactattaatatatggtctcacatatcatacacacattgtgtcttggagtccgtgctacagctgactacatatctatagcctgctgctcttctctccaattatttatctccataaaatatgtttatagctagttaatagcctgctattgtacctgctcttaaagcatacatacattaaatataacaagtttttttttgtgtgggacctacataacaaattttttctcatctcccgtgaccgatacagcgtggggcgctgtgcaagcgccggcgctaaaacaagcatccgcttgtttctcttccagcgatttctttctctaatctggtattaggctgattaataagttttggagccttcttaacggcgctattgtacctgctctaagtaggttaggtttatgggatagagggagtacgagactcgcgcatcaatcatttcattccatgccaaacacatgatgcatgtgattgacaattgtttggaggcaaaaggtaggggtagcgatgtgtgctacgctggcagccttgctgcacgtgtcatcgtggaggacgtacgtgtaggcaggcgtcttgatcgacgagctcctcggctcttctacgggtccggtgcttgtgacttgggagagatccgagagggtaaaccggccggcgagaaacgggaggaggcagcttgcgagcagcaggggtgcatgcctcttgcgggacacgagcgaaaatgccgtgcgcgtggcgcggaccgaatagttgatgggccgaataccggcacgagagggccgtggtttagcgggcccctcatggaccgtagtttggccttttaggccttaatttccatgggcttctagtcacgtgtgtgcgctcctaggctattgacggcatagatgtctatcaaaaccggtgcaattttactccgcttaaaaataagttcactttgctatatagcactctatccaaaggaaagatttgaacttagactagctgcgtaggtactctattttaggttgatatctactccgtcttgatcagaatcccacagtgagatgagatgttccaattccaattgtgctagtccctgtttgtaatgtgtaaatatttttcataaataaattagtcaatgtccatctgaatctagagtaaacacttgtaacccgcttgccattgtttttttttcattaaaagaaagaagaaaagttgcatctcatttagaattttaagattaatcattttcgttaaccagccttgttttcatgtctaagaagacgactttaaaaacggcctaaaataatctttaaaatcatatttcacaatctgactttttaggaactaatgaggtggaagaaacggtggccaagcttacatggtagtagcacgtatatcgtttc

SEQ ID NO: 14892 - DNA, 1501 bp, Oryza sativa
cgataaaggccggcctgtccaactacatcccaaaggataatgtcacagtccttactgccagaggcgatgatggcgccagaggggccgaatacgagggcggaagccgcagagcggtggccatggagggtcgcctcacaggagccggtctccgtgtcccatagcctgatgctcccatcggcgtgcccactcgcaatctgaagcaaaccaacacagcgcacgagatgatgaaaccagctcaaaatgcggagagattaaaccgcaaaaggggaaagggaggaaggttcagcgtgtgataccgaggaggcggaggcggaggcggcggaggggaaggtggcgaggcaggagacggcgagggagggggacggggcggcggtggcgaaggagagggaggggaggccgcgcttgaggtcccaggcggcgaagcggtcgagggcggcggcgaggaggaggcggccggaggggtcgtacgcgacgttggactccggggaggcgaccacgccgaaggagatcgccggctcgtaccggaggtaggccttcaccatggcgcccggccgccggcggcgtggtggaggaggaggtggagtgcgtcgctgcggttagggtttatggcggcgcgtgcgacttcggtcaaggggggtttaaaagccaacacactagacaaaaaaaaaaggaaaatagaaaaatagatataaaagagtaaaattcataaaaatttcgaggcatatctaacataaaacctaaattattataatttttttcagtgaatctcagattttaaggtaaaatatcttaagcttatattattgtttttaatatatttatgtataataattataagataataataatacgagatattgcagagtacatatcatttttttcgattattggtagtatcattagtttttatatatataagcaaccggttatatatttgtattgtgttttttcaattgtataatagtaaaggaaaaaatgaattatgccggagggatgtgtattttgagcttaataatgtaaatatatacttaaaatattataactattaatgaaattatgagcatgtgatataaatatggggattcttcaaaaacattttctcttagtatctggtattttctaaaataaatcataatatatgggattttatattacatagtactccttcgttttatattatcgttagatttttttccttagtcaaagttatatatgtttgactaaatttatagagaaaaatagtaatatctacgacagtaagttagtttcattcattaaatttaacgttgactatattttaatacaatatttgttttgtattataattcttagtattgtattttgatacaaacttaaattatagaaaaatgattaaaaaattcaatcgaggtataatatgaaactgaggaaatgtgctttaaaatctatagtgttttccaaaatttactccagataaaaagtcacacaaggggggggggggggaaatctctccatttgccag

SEQ ID NO: 14893 - DNA, 1501 bp, Oryza sativa
atttactccacttcttcaaacctttcctcaaagccttcaatttaacaaaaatattcttggctacattaccttcatacccatgattttgccaaatggattgaactaaatcaaagaaaccattatgctctacccaaaaattttcaaatctgaagatgtcagccttggggatgtcagttccaatttgcacaacacaaggtgtgtgatctgaagtagaccgagcaagtggctttactaaggtatgggggaaggttaaggtccaaacagtagaggtaaaaaaccaatccaattgctctagtagaggactatgctgcatgttactccaagtgaaagcccttcccttgaggggcagctcaactagacccagatcactgatcattgcattaaacaggaaaatatcattcatgtctgcacccggcctatttctatttgtaactgatctatagaagataaagtctccaagatgagccagaggtcatcatcaagaatgttcaactggtggagccaggacaggaagttatctctttcaggagcagtgcagggaccgtaaactgaaactaaagtccaaactaaaccagaatgatttgaggtgaaagtaatcttaacagcaaacctttcaattataatatctgatcccccaaaaactgaactgttctagccaactaaaatgccaccagaagctccaacagatggaaagaaagcaaacttatcaaaacgtttgggagcaaacttctttatgtaagaatgatcaaaagaagatctttttgtttcctgaaggcaaaaaacagcacaaccactttcctcaattttatttctaatggctaaccatttgtcatcagaattcagacccctaacattccaacagaggacattccaatttctcatagccgaattcatttgacaactagtcttaaagagagaaagataacaagcaggaataatccatgcagttcccaagcacaccaacacatagtaccatcatagagtttacataacttaaacacaaaataaaagggctgataaaggaataaacacatgccccaaaagagtgccactagcagccctaaaagtctgatagaactaggcttcatcattggatggtccaattgctttcggcttgatgacctgagcttctcccaagtccaccaagcttgaaacctcctcaagggaagtcccacacatcttagatccaatcttctggagaaaagatatatcacaatcagcaggtataacagatgtaagatcactttcagactcacaagatatatcaggatttaaatcagtagaagataaagaatcagatgggaaaacaattccacttgcctcagccaactgtttcagctttttaactgccttccctcttggctttccaacacccatgtttggatcctcttgcagagtattcttgaaactatccctaagagccagaagtctaccactccttctaacttgagagtcaacaaaaggtgttctcttcttccctcttttcctaggggaaggtgga

SEQ ID NO: 14894 - DNA, 1501 bp, Oryza sativa
tcggctctgccaccctctccaagtgacgggggtgacggactggtagttggggaggcaatgctgctggcctccggtggttgtcgtcaagcatctcgaggcgctcgatgctggtggacgtcggaggcctgacacgacggtgacctcatggatcctgtctactccctccgtcccataatataagagattttgagtttttgcttacactgtttgaccactcgtcttatccaaaaaatattagaattattatttattttatttgacttactttattatccaaagtactttaagcacaacttttcatttttatatttgtataaaattttttttgaataaaacgagtgatcagacaataaaaaaaaaactcaaaatccataatagggacggagggcgtacgttggcgctgcagctcttttgaatttgatttgaatttttgtaagtgcacgtggaaaggggagtcgggggcagagggaggcacatgcacgctgattagactgactgaaatgaaatgaccctctcgatatatcgtagatacggaatctacagttaaacaaaaaagatactccctccgtcccatataaaatccaaccctaacatctcagtacaaaattagtgaagagtgaaaataattaaaatatctcttattattttaaaaaatagtaatagtgatagatacgtaaaagttattgaaaaaataaaacttatcattttacatgttgagagtacgtagaatggtagaagttgattttttatacgtaaaatttaaactccagatattgacttttttttgaacggagggagtaactaaaaaaagcaaaacaaaagaatacgcttttgtccattgtgcatatcatactgctcggtgaaatttttatttggaaaagagtgaaaaaggggtgcatcgtcatcatattcaccaccacgtttaaggcatcttgttcaattggattcttaacgagtaactaaaaaatgtaaaaaaaaaaaactagaaatcttatgatgtgagaattgagtttatgcccttatcggttggcaatacattattataagcagtaacggcttattagctacttaaaaacaattttaaagtaaaatttttatatatttattgttaactacttaaaaataatgctaaaaaaatagtgttgaaaaatactctgaaataaacttcaaaattaattcataaatttaaattttgacaatgactcatgggaaacgagaagcccttaaagagagtcgaagtgcttgcttgcatgtcccaccatatgcaatccctggtgaatataacatcgtccatgtaaagccatacaaaaccatattacagtttttagtggtagttttcttcatgccagaaaattcttaaatggacattttttgagtttatttacctaaaagaaatgattttgtggtccatgagaagctaccatatatagcttttaatatgttaatttgcggtagctcttgataccttaaggtgctaatatctatgctaaacttgtggtgc

SEQ ID NO: 14895 - DNA, 1501 bp, Oryza sativa
aataatgttggtccacagtacagcattacaaacttcatgatagagtatgaaagagtaatggatacaattcaaaacttggaacagtttgatgatcacatttcaaggacaaagaaaccaagcaaactttggtcccattactacattgagtaccaagcaatgagaatgtataatcgcaaaatcttcatcaagtttcaagttgagttgaaaagaacaactagatttcaaataaatgaagtagagaagttcaaaacttatgaagttttttttggcattgaatcaaaatattcaagtaatcagaagaaggaagtaccttgttattgtggacttggaaaaggaggatttcaactgcatttgctcaaagtttgagaaagatggacttctatgctgccatgtattgaaagtaatgctccacctcaatgcaatgaagataccagaaaaatatattattgaaagatggacaaaaaaagagtacaaaggtcttgggggaaaaggcaatggaaatatacctttagcacagagctcaatcctgagattcaacattttgtcaaggaaaagtgcagaaatagcatcaaatggatcgaaaagcaatgaaactttccagtttgcagtggaagagatggacaaaattgctaaacaattggaattaatgtgttcaaataaagatgctgagcaggagatcaatgattcagatccaaatgcagaagacaatttgaactcacatgaaaaaggcaatcaacaatctgaggaaaatacagaagaaatattgttggatccagatattgcaaaatccaaaggcaggccagctcaaagatataagacaatcagggaagaaatacagcaaaaagaactatatcattgcagtcattgtcagaggacagatcacacatttccaacgtgccctctgaaacacgttgagtttgacttgccaaggaagaagagaagaaaggttaaaaatacaagagaacaggtaacaaaaattacaaatccatatgaattgaatttttttaaaaaagtaataaagaaagatattatttgttgcaggatggtgtagagcagaaaaagaaagatgtttcaaacaaaagaaaagatttgcaacaagatatatcacaggagaagcataattctggggctgaattagaaggcaaaaagaagagaaattcatcttcatcaaaaaggggtggcacaaaagaatagaaatggaaatgactgaaaatagagagaggtttacttgaatacaatggaaatagacatattccataagtttctgtaatattccagaacatgtactctggtgtcacaccccaatctgataccgccgtacaacggcacctgacaggagcgtgtcgtagggaaaacggcgtgaaccgtttcctacgaaaccgcgatctcggtaccagtcccaggacatagtgctggtacccacggtgacaaatatgaatcatagcaatccttaaaataaatagagtcgacttatttaccttaacttaggttgcagctcaga

SEQ ID NO: 14896 - DNA, 1501 bp, Oryza sativa
ctcctcgtccagcatgaacttggcgttcgccaccaggaagtggtacttcttcggcttcgcctcctgcgcgcgcccaatccaccacaattctccgtctcaaaccgggacgggaaaattatcaaaattagggcgggaggcgaggggcggtttggtttacctgatcgggaggctcgggggagccctgctggtcggagtcgacggccacggcgcggagcgacaggcgccgccgcctcggctggcacgagacggcgggcgggagcgcgaacccggcgccgacgcggggcagcgcggcgcgggacggcgcgagggtcgcgaaggggcggagggacagcgtcgcgggagccaccattgccccactcgcctcggctgccgaactcggggacggagccgaactgaagtgctgaagctggtcgtgtcagctcggagagggggcttgaggtcggaggacgacgatggacggtgagctttagccttatctctggacacgaggggtgggcgcctttaatactactgtgccgtgccattactggttaaatggctccatgacagcacacgggttttcgcactgtgccgttttgaggcccatagattttttttttgggcacacgtggaccctactttgggttttatataggaataagttcatctgaggtccctcaatctctatatacgatttcaggtctaatcccaggcctctcactgagccacgtggcatcacgcttgcgctccatccaaattctcagcaggagaacatgccacgcattcaaaatgtcccatagccgtccgatgacatacgaacggtgagaaaaaggtccagcggacctaaatataaaatgcaagttttaagaagggtttttaaacaaaatggacaatgccatctagaagagcctggagtagaggaaaaaaatcccagaaccaaaaaaaaagaaggggctgtctatataggaatcgaatgatttctgaagctccaatcatacagattttatctaccataggatgcacatccaacaactcagaaaaagtgatacaaatagatattacacttaaaaacagatatattatttgattatttgaacgccatttttttaaagcctaaatccagatccagatccataaaagcccaaatccatatccagatccataaaagcccattagtaaaaagaaggcccaaaatacaaaatttgaatcaaacacaaataaacaaagcccatgattttttcgcccatgcgaattatttgaaggcccaagtctatatccagatccataaaagcccattagtaaaaagcaggcccaagatacaaaattagaagcaaaacacaaggaaataaagcccaaatcataatccaacagcctatccaaaaaagtagtagggaccaaacttggaagccaagtagatgaaaaacatgtcacgtgaatcaaccatgtatgggaccacacttttcaatcccctacttttcaacagcactactagttcacaaacagatctagcacgaatcaaaca

SEQ ID NO: 14897 - DNA, 1501 bp, Oryza sativa
aggagaaagctatcagctccgtgatcgacgccgcacagctcaagtgggaggccccgacgtcacaaggaggcctgcatcgggggagtctgacggcgtcatcccggcggagctctactgcaagatttgccggaacgtgatggccgacgcggtggtgacgagcaagtgctgcttcgacagcttctgcgacgggtgcatcagggaccacatcgcctccaagtccaagtgcgcgtgcggggcgcaggcgcgcgccgacgacctgatccccaacacgacgctccgcaccaccatcgccaacctgctcgccaccaccaccggcgcggcagcaagcgcctcaagtggaaccgacaagacgaggagctccgccggcagcaacgcggcacatccggcggcgccgctgagccccgcagcttcgcaggcgagccgcagcagcaacgtgagctcagagaaggccgagcacagcgacggcggcgcgtccacgtcgaagaagatcgccacgatctcaggtgccctcggcccaagaaaggcgcaggagacggtggctggcgaccactctgcagaatccggagctcgcgccgtccatggcggcgatcactacggcgtcccgttctgcccggcgaccggctacgtcgaccccttcttcttcggcggcatgccattcggagccgatccttacatgtactacggcggcgtgccttacggctgcggtggtgcacccaacggctactacggcggcgaggagctccgtgacaggaagagggcgcgcgtctctcccggaaccggatgttggtgatcggcttcggagaggatcagaagttgccgattaaaagccatttggagattttccttttcgtctcatttttgtgttgatatatagtgtgcataagatcaaagtgaaatgctagagatgaacaaattcagctctcttgtctctctgtattgtacggctgtacccatgtataataatgttattaattggaatggttttccccaaaaaaaaaaatctgaaatcttttgtcttgtgatcctctactaacatgttaattggtattatatattttttcactcaaaacttgaaatcttttgtccctgcgtgagcgtgactttctcgctcaaacacaagacatgcgcgcaaggtgtttgattctgctaacgacgggcattttgacgtacgatctcggaacaattgccggggcgcgcgccgacgaagatagcgaattggcgatccagcggcgtcccatctcgttcggcctgacacaccattgcttaaccagtctacgacggcgcaatgcatgacggctcgccccaccggatgcctcccccggcgtggcgcgtgcaacatgccaaccagcgccaccggccggagcgcatcgggcgattccacgccggcggagctccggttcacgacgtataaacgagacacaagaattaatggaaactctagggagttgcatgtccccaagccaaccgtgtaatcctcaccatgtcagctgaaccaaaaatc

SEQ ID NO: 14898 - DNA, 1501 bp, Oryza sativa
gtaggcgataactatatcattgtagcaatttatgatatacgatatcaccttcatatgttaatgcgtaacttcatgtcacattaggcaacagtatgttaatgcttaacttcatgtcatatgttaatgcgtaacttcatgtcacattaggcaacagtatgtatgcttctaaaatatttgacgtttaggactagatttaactatacttttgaaatttctaccatcaataatttctcaaattcttagtttaaaaactcacattgtcttacgatattgtttctccttgtggcttgtttgaatcatatactgttgactagaggtaataacggtatggttaaagattgttgactccgtatcatattgtgttagggagagactcgctgacatttgagaaaggtactaggtaggggtgctgtgtcgtgagcgcattgcagcgtgagaggaagagacaacgggaaaagtgtatgtggtactatttggcacaactccacatctcaaatccatggtagatttaaactttatatgtgttataggcatatcacaagtgccttcaaccgaaccttccaaaacaatcaataagttgtgaggcaaagtaccaaagggcgaagcacctgccagtggtgaaggtgaataccaggcggcgaagcatctaccaagcggcgaagcaaagtcccttcaccagcatgtggcgaagccagttagacttgaaacaattttttttatttttaattttttattaaaatatttacaaaactaattttgtgtttcaaaaatttacaaaactagtcgcccagcgccctttgggagggcgattttaatgacatggcagatggctgttgcctcataagtaacggacagcaaaagggcctgccattttgcaggcggcccccttgcgcccttagggagggcggtttaacactgtgcggaggccgcctgcaaaagggtggcgagggcggcctggctttttttacaggcggcccccttgccacccttagggagggcggtttaacactgtgcggaggcccttgcaaaagggcggcgaggcagcctggcattttgcaagcggcccccttgccgcccttagggagggcgattttagcccctccaagtataaaaccccttccccctctctgatttttcattctattcgctcaaaatccgaaaaaagagaaagagggaggggtgaggggggaggagaaggggagcagcgaagccctgctggtttgttgactctatcacaggtaatatattccttcgaaatgtgtttccaggttttttttgcattttagttttattaccatatactttagtagatctggagcacacacaccctatttttagaatttgagacatagggcaaacaacttatgtgtagggtctttaacttaaggcgtagtatgttttttgaagagatagggcgtagtatgtattgatgaatgcggcgttagatctggttagtatgatatgaacttagttaacctagttagtttttcatcaggcacaa

SEQ ID NO: 14899 - DNA, 1501 bp, Oryza sativa
agcttcttgagatacaaatatgctcattgtacagaacttcttcctgcgacgtactttgttaatttcctcggagtgtcctataatcctccatatcaatgctactgaaataattgtgaattctgttgttaactgcatctcaataggcatatatgtttaagctgatctgaatactttttattagaaacaacatggaaccacaatttgtgtatatgtaaaattttcattattacaaaatgctgctacagatcttggctttgatagacggttggtgctggatgtatctgccttttatcaaataaagctcttgtttcttaagttactgatggcaacttttaattttatttttcttggtactagctctgcaaagcatttccttttctcagtggttgtttatgcaaaccaatatgtctttttcaggtttcagaagcttctggagatattattgtgagggaagaataatattgcttacgttgacaaccgagagccctaacatctgaattaaaaattgtcggtacgactccatgtaatcccatgataaacagtgagaatctatttataaaatatgtagatcccatcctatttttatcctgcattttgaagcccagtatagatacatgcaatacaatttcctatccaagacgttgctgctgaaattatgctgaaactataataatttgccttaataaagattagctaaaacattgtttatgaacataaaggttcaagaaaaaaatgtagtcttttagggcagatagagctatagagcactatctttccagaaaataattccaacaaatattcatattatattttttgacacaacatttcatggctcctttgtgtcagatttagtgtaggttggtttccttttaagtcagttcattatttttctttacaataggcgtagatgtagcaccaaaattaaaaacgatagcagcaagataatgctgaaatcttgtggtatagattatgaaaaataactgatctgacaggtttggtgcgacatgactcagtttaatttgtgtgctacctagacaagagtagtaactaattatgctaaatgcatcattataaaaagaatataatgcttttttattatagtggtagtgcttgccgatactttctgcgagtaattctttttgctttttctcccattctatttggtgtttttcagggttttcttatcggcaagcaatgtcatcaagccacatatgcacatcataaccaggtgaccaaggaagctataacttacataaaaaaactctctctctctctctctctctctctctctctctctctctctctctctcctctctgcaattatacacttcatattatgccaaacatttatcaaactataacaaattgtatttttggtatcattgattgttttccgtttatacgacaaattgtaaacagagagatatgtggcatattaaacttcacatttatatggtctgtttaatatgcatagtgggaaaacataataaactcgcattta

SEQ ID NO: 14900 - DNA, 1501 bp, Oryza sativa
gaatggtaagttcattaacatcctgtgtcttactgcataagtgcatagtatcagccacatcaggtatcttcatgttggtcaagtcctttcgatctgatgaacccgtcaagagcaggattcatcaccaatggtttgccgctccgaggagtcgctgccatcgcctgctgctcctgccatagcgctgaggatcgccgtcgctgccaggtactcctgccgcctcctgctgctcgcgacgccgtgttgaggagccatcaccgccgccttccggcctcgccgaggagttggagccgcagcttgctcctggccacgccgaggagctgcgccgccacctgctcccggccgcgctgaagagctgctccaccgcctgcttctggcgccgccgcgccaaggacttcgggatgggaatggatctgggggaaggaggatatcgaacatgtactgatgcacacccacatatattacttaagggtacaatggtaatcccatatttccaaaattatttttctcttctaatttctctttccttaactgaatattgtgggacccacctaactgccatccatagtaggggcaaacggcaacttcgttcagagaaagcgggggtaaaattgcaaacgctaaaaaactgagtaaaatcacaattgagattgaaagctggggtataaacacaattctcccaaaaaaatattatgagaaaatgaaagtgttgtaaacatgactgcttgttttccattgccaaacagactccattttggattttattaaccaatatagtctgtattgtcctggttattacaacaaatcacttgttgctctcaagtgcgagatttagccatcaaagctagatggagtaaaaagattttgttgtttccaccatcctctgcttttggtagatggagtaaaaagattttgttttaaacctttctgatggttaataaagctgttttttggtgatccattaagctagcagcacttaccgtggactgaagatgctgattaagtcttctcccgctcgcagacaacacaggtctggcttcctctcagccaatctctcccaacctccatctccaaggtagcatcactattttccctttctttttattttcttgtgtgttggctcctagcctcctacagacagctgcggaatcaagaggccctatggctgtgtatcttaatgtttactcgatttctgctcaaaatgtttcctcttttatttataagagactgcagccatcttgtttgatttcatttcctttttgtctattcatttttcagtgcctggtctaataattcagaaagatagctgggtaaacctgcatagaattttcaaattcatatgaattctaattttccttccgggggtactatggccgattcaagaagtgtcccacagaaaggtgtgcgtccttcactgttcaaggttcaaatgaatcctcacgaaatgtaaaaacaggtgacttacgacatcattgattggtgaccctgttagattatttttctt

SEQ ID NO: 14901 - DNA, 658 bp, Oryza sativa
ccagatgaaaaaagtacggccaaaagatttttctatgttatgttaataataaataaagaagtatttattggtaaaacttgttaatattgttataaaaatgtattgaagttggttgttgcgcaatttcatatgttacgtgaggtattattttgtaccttattcgacgtattagtactcggataatttatataggcctatcgcagtctgggtcgtagaaacattatatggacttaaacaaggagaattatgtaacatgaagaaatagtagtacaatttgaacatgatacgactatttgcattgcggttacatagatgatattagatttgaactaggagggaggtagtgcaatagttgaacacaacgacgatataataatgggacaaggaagcatgacagtattgattccaaactagtagatctacgtagttaccgatatctacaatacgcacttctagattagtacaactaaaaccctaaaaatataatgcatttattcaaacaaatttttaaagaatacacactatttaactcaatagtcacatataggatctatgaatattacctgaaattggcgtctgaatccggcagggcttcgccccttcttctcttctcctcccctctcttctttttttttcactggaattgaggagagaagaa

SEQ ID NO: 14902 - DNA, 1501 bp, Oryza sativa
aataaacttattttgggacggaggtagtagtggctacgatggtacactcaatacatacaagtcctatacgtgcaaagtatacatgaaaatgatttcattcttattgaatgatagaaatagtccctattcaacgtgcgtgcatatagatgtctaattggctacttggcatggtccgcctcgggcacaaccaagacacgacctaagatcagttgggttggcacaccccgactgacacaccgtgcccacccacgggctgtatctacggcgtaggcacgacctagtaagactcgagctatgccgtatcggcccgaagacacgactagttcaccatactcgtccttagaataagtctattttcctccctcgtctctttaggctacacgttattgtctgttataagactatttgggctccctcatcgttttggactgtgtcttatatgactggagtaaatctattttgcctcccttttctctttggaccggctgttgacaagctatgacctgcggaagcgttggccgtgccatatcgaggaagaggctcaggcacaacccaacagtcggtcggaccggcatgggcccaataatagttgagccgtgcctggatcggaccaaaactccgtgtcctgagctagaccgtaaggccatgggccttttgaccaactatagttgcacgtcctaggttacgtttgtcgacccatcactcgagattgctatttagcgatcagtcgcgcgcccccttccccgcgcggctggacacgtgtcgcgcgcggagagggggcggcggacgcgtcgcgagggaggaccggaggagcgagttttccttttttccccttttttttccgtttatgttcggttgttttttctttctccggttttttcgttctattcggcctggttttttttggtgtatcttttgtttggttctttttttgtttatttaaagatgtataaatataaagtttatattcgtatgtataccaagtacgtattcgtacatatagaaagtttatatacgtgtttgtatacgcgtatataaactttctatatgcatatgtagagtttctatatgcgatacaaagtttctatacacgtatacaaactttgtatatgtgtatatatttttatgcattaaaatatattcataaaaattatatatatacacgtatgtatatactatatagtatagtatacatacgtatatacatacgatgtatatagtacttacatacgagagagactaggcgagcgagtgatcgcgcgcgcgtggaggcgcgcggctgatcgcgtatcagcgccgcccggtcactctatcacgtgtacatccgaaagcgaattttttttatttttaatttttttattaaaagttttacaaaaataatttttcattttgaaaattgacagaagtggtcgcctaccgccctctgggagggcgatttttaaaaatcgccatcccagagggcggcgaaagtgacgtggcagacggccgttcgctctcgggc

SEQ ID NO: 14903 - DNA, 1071 bp, Oryza sativa
ccgcacagccgcccgaacgtgaacgaggaggggaacgtggagagggatgtggaggggaacgtgaatgaaacgtgaacgaacgcgaacgaacgcaaacgaacttgaacgaacgcgaacgaacgcgaacgaaacgtgaacgaatgcgaacgacgtaaacgaacgtgattgaaacgcgaacgaaacgtgaacgaacatgaacgaaacgtgaacgaacacgaacgaacgtgaacgaaacgcgaacgaacgtgaacgaacgcgaacgaacgcgagcgaaacgtgtacgaacgagataattaaactattgttgaacttagcatatatatatatatatatatatatatatatatatatatgattatatatacttgaaaacgtgaaatacattatatgttcctttgcgtttagactaatacattttttttgcatgttgcagagaagacgtcatcgtcgtcgtccctcaagccgaagtggtagctagccctcgaaggaattcgtgcaggcaagtgatgtaaagatgtgattgttagagatataatataagattgttagatttctaatataagattattagattattagagttagcatatgtgagtgttagtgattattagattattagacttagcatatttgagtgttagagatagttagagatttaatataagattattagaggtttaatatacgaaacttaattagacttagcatatgtgagtgttagagattgttagagatttaatataagattattagatgtttaatatacggaacttaattagacttagcatatgtgagtgttagagattgttagagatttaatataagattattagaggtttaatatacggaacttaattagacttagcatatttgattgttagagattgttagagatttaatataagattattagagatgtaatattcgaaacttaattagacttagcatatatgattatctagggttctaatacacgacacttagacttagcatatatgattatttgagttttaatacaagattagtagagttttaatattacgcttagcaaatatttcttctatgaacaga

SEQ ID NO: 14904 - DNA, 1037 bp, Oryza sativa
acgtggagagggatgtggaggggaacgtgaatgaaacgtgaacgaacgcgaacgaacgcaaacgaacttgaacgaacgcgaacgaacgcgaacgaaacgtgaacgaatgcgaacgacgtaaacgaacgtgattgaaacgcgaacgaaacgtgaacgaacatgaacgaaacgtgaacgaacacgaacgaacgtgaacgaaacgcgaacgaacgtgaacgaacgcgaacgaacgcgagcgaaacgtgtacgaacgagataattaaactattgttgaacttagcatatatatatatatatatatatatatatatatatatatgattatatatacttgaaaacgtgaaatacattatatgttcctttgcgtttagactaatacattttttttgcatgttgcagagaagacgtcatcgtcgtcgtccctcaagccgaagtggtagctagccctcgaaggaattcgtgcaggcaagtgatgtaaagatgtgattgttagagatataatataagattgttagatttctaatataagattattagattattagagttagcatatgtgagtgttagtgattattagattattagacttagcatatttgagtgttagagatagttagagatttaatataagattattagaggtttaatatacgaaacttaattagacttagcatatgtgagtgttagagattgttagagatttaatataagattattagatgtttaatatacggaacttaattagacttagcatatgtgagtgttagagattgttagagatttaatataagattattagaggtttaatatacggaacttaattagacttagcatatttgattgttagagattgttagagatttaatataagattattagagatgtaatattcgaaacttaattagacttagcatatatgattatctagggttctaatacacgacacttagacttagcatatatgattatttgagttttaatacaagattagtagagttttaatattacgcttagcaaatatttcttctatgaacaga

SEQ ID NO: 14905 - DNA, 1501 bp, Oryza sativa
tcgttgggcagctgcgacgccgtcttgccggcgagcgcggcggaccgcaatgctccggcgatcctctccttgaacgccacgacctcttccctgctgaaaccacttgcgacgccgacgtcgccgtcgcggtcatcctcattgttgccgacgacgacgacgccgccatcttcactgccgccgccggcgtgtccttgggctagccttagcagctcgatgaccatctcgtcctacttgaagaggacgccgagtgtcttcctcttcttcttgctcttcttcttcttgggcggcggctgatgctgccgctggagcttgtgctgtccggtgcacgcgcgcgtgaacgcgagccactcgtggagctcgacgccggcggcgaactccttgggccgggtctgcttggggcggatctcgacgagggaggagaactccggcctgctcacgtccatgagcagccgcacgtcggcgaccaggcgcgcgttggtggcgaggaggttgcgctccccgtgccccggcgtgcccatcagccgccgcgcgaaccgcgccctgaaccggtgggagccgatcagcagcttcgcggtcagtggcgacgagatcccgtatgggatgctggcgacgcagatgtcgaacttggggagctcgatcgccatggagtcgcccgtggtcacctggcaacgggagaagaagagaggatcagcgttttttttttcttcatttttctttgaggcattctgtcgaacgcgtgggcggggaccgtgagcttgtgcgcgaggccgaggccggcggcgagggctgtgacggcgtcgaccgggcggagcggagcgcggcgtgcgcgacgatggcgtcgaggacgcgcgggttggtgaggagatgctgcccgcgcgccttgtgcagccagaaccctcctccgtgccggtgccacgccgccgccgccgccgcagtaggcgaggccgaccaggagcagaggtagcgagcgccgccgcgttgggctcggaggaaggagactcctccgacgttcatgccatcttttggtcgacaaaaaaaaattacaacggtgaaaaactattcatctgcatggaatttaggaattttcgtgcaccgtggtaatttcagcatgatgtaaggccattcccaatctaagacaccagatatagttcataaactccacgtcatcaagaaactaggactagacaataattttccaatgcaaacaacactatttcatatttaaatttaatgctacttatctcacaggatgtcttgaatgttatgtagaaatcatgtctcatgacatggtttccttttctttccttatttattcacttgacacatcatttttatcatatgtggcaacttatttaatgctatagacactattttagtcattgggttgggaatgggctaacaaagcccaaaggcttattagaatttaggaaattaattcaaagcgaaattatgaccttgaatttaaatcaaactgctaatgcgtgtgaatacaatgcataca

SEQ ID NO: 14906 - DNA, 1501 bp, Oryza sativa
actgatgagcgctgtcaatactagggtttcacatcgtttgtggttgatgtgcttaagccgattcagtctatactcttgcgaaattacggcggctgctcttccacgtactagtccaggtgtgacaagactcatcggtctcgatggtaccttgcagcactatcattttttattcattggagattgaggagatccaacggtccatcttcagtactgcggcaccccgctgaactgcaaaaaaaaaatctctttctagtttatttagaaggtgatcccataatttaaaaaataactatagataaacaatgcatgagaaagcagcttctgcttacatgcatggaataaaaaacaagttagtccctagatagtgcacatgctcttaaggggcacacttggaaattttaaaaaaaatctacttaacctctagagtaatataggatttgcctacttaatcccaaaccggtttaaataccccatgtagtggttttgttaaaggtattgcttacatggctgacgatattgcttacatggtacacacatgagcccatctggcctaagttaacataaccgattcatttctctcactaatctgcgagcccgagaattacatatcagcatcaatatgcctcttctcagagtcattatgcttgttaaagaaatacttaacacatgccattgccatgtaatagtcaatgtggccaaaaccacttataaaaccgctctataagtttatttcaactattttgtatacttaacgggatagaatatccatttcataattcagaggttaagtaacatgtaatagtcaatgtggccaaaaccactcaataagtttatttcaacttatttgtatactttacgaggtagaatatccatttcatagttaagaggttaagtaccatataatagtcaatgtggccaaaaccacttataaaaccactctataagtttatttcgattggtttgtatacttcacagatagaatatccatttcataattcagaggacaagccttggtgcatcagaataaacaagatttaggagcggctgtatggacaggtttgcctcccacccttcagatcgagtttctgcggacgtgttagcctctttcccaattgattttcctccaaatggccgcggcttttttatgggtaagtgaagagggcgattttcagcaaagactttttgccagcgagaggtagaggaagaggccgatgagattggagtgagttgttgaagaatatctttgatttcggagaaagtgagaagtggggggaagaggccgacaagattgggacgagttgttgaagaatatctctgattatgtagaaacccgggtcgctcttatccttttttttttcacacgagtgcaactgtctctttttttcacacgagtggagttttgccaccgaattggctctccccgatgaacgagatttttcttgtcctacaaagttaaagcttagcttactcttaaaggctagttttttttccaaacatatag

SEQ ID NO: 14907 - DNA, 1501 bp, Oryza sativa
aaagaaagcctcatcttcatcgcgaaacacctcctccctgctagtaccccctccaccttgcctgctgcgatcattcctccacgccatgcctccctcctcttctcctactcctttgtgtgcggataacccctcgccgccggccaggaagccaacagtcgcactgctctcgctttcccttctcttttctgtaaaaagcgaacacagctgcacggtgtggcattcccttgcctgttcgacttgtaccggcgtcggttcccctcctgtggcccttttaccacggcccaagtttgcaagcagccggcccaaaccactagtaaacttgaatttaaaccttctctctttaatccccacccagacaaaaacctcttccttttcttttcctctcacaccgattgacaacaaatcgaccacgtgatctgtctcctcggttctcgtcaccccctgtcccctcgcatttgaaccttgaacagtgaaggacgtgcacctttctgtgcgacacttcttgaatcggccatagtaccccgggaagataaattagaattcatatgaatttgaaaattctatgcagggttgcaaagctatctttctgaattattagatcaggcactgaagaatgaatagacaaaaaggaaatgaaatcaaacaagatggctgcagtctattcaatatatagttgcaactgtactttacaggtcacttccttgccatgaaggaacaatctgtaaatacaaactattaatgtgtcagtaattcaatttgtagtaatccgttgtgagcatataaaagagagaaatttaatcttgaataaagctaaaacagtaagggtaccaggaatcctaaaatctaaaaataaaagaggaaacatcttgagcagaaatcgagtaatcattaagatacatagccatagggcctcttgattccgcagctgtctgtaggaggctaggagcaaacacacaagaaaataaaaagaaagggaaaacagtggtgctaccttggagatggaggttgggagagattggcctagaggaagccagacctgtgttgtcagtgagcgggagaagacttaatcagcatcttcagtccatgggaacggtaagtgctgctagcttaatggatcaccaaaaaaacagctttattaaccatcagaaaggtttaaaacaaaatctttttactccatctaccaaaagcagaagatggtggaaacaacaaaatctttttacaccatctagctttgatggctaaatctcgcacttgagtgcaacaagtgatttgttgtaataaccaggagaatacatactatattggttaataaaatccaaaatggagtctgtttggcaatggaaaacaagcagagatgtttacaacacttccattttctcataatattttttaaaggaaattttctgataatttagaaacatataaggattgatgacattttctgataatctagaaacattttctgataatcccaaattgggcaatctaaaagatcaacaca

SEQ ID NO: 14908 - DNA, 1501 bp, Oryza sativa
gtgaaattgaatgcagtagtatgcacatgaaacttggggcaattcaatcgtaatagggcgagccgtgaagccaaaaatatattggtggtatcaaactaaatatcctgtgatttgatggtattaagtgaacgatttattcggttccaatgaactagctgacctgactagcaagcaacaatcatgtaacttttcaccttttcaggacctttttttttccaatacgatatcaaataagtagatctagactctagccatttcacaacactacaatatgtccacgtataaaactatccaatatataaacctgaagcgaacacatccttcggctattccaaaattctgtttcttcacaaaactctacaatatatgtcaccagtgcgagccagacaaaacgaaaagtgatttttagataaaagatcattgcaatccagctttaatttataacaaagcttgcaagaaaaacaaggtaatatcattgcaatccatctttaatttataacaaagcttgcaagctagaaaaacaaggtaatatcattgcaatccagctttaatttataacaaagcttgcaagaaaaacaaggtaattaactaaaaatggtgcaaagtgatcgatcgagagtttgtcttcacgtccttttcttttgcttcaaatacgtttcagtaccaagcattcaacaagaaaattaacttagcaaaaatcaacgctcacatattcatggcatcagcttcagacaagctcgtcctctcggccatcgtgctcgccgtcctcgccgccgtggtggcagcggcgtcgggctacggcgacgtcggcgagtactgccgcgtggggaaggcggtgtcccggaacccggtcccgtcgtgccggaactacatcgcgcggtggtgcgccgccgccgggggccgcatggactcccgcaagcagccgccgcgggagttcctggagccgtgctgccgggagctcgccgccgtgccgatgcagtgccggtgcgacgcgctgagcgtgctggtgcgcggcgtggtcacggaggagggcgaccgcgtctccgggatgatctcccagcacgcggcaccggggtgcgacgccgcgacgatcgccgggatggcgagcgcgctgacggactacggccggtgcaacctgcagcacacggccggttcctttgcctgcctcatgtttggtggtggcatggattagattaattatttcattagtgattaattaattaattaggcctttgcttaattaattatcgatgtttgctagtactagctagcagtatcatgtttggatgctgcttctctatgtttgtgataatgataataaaaagaaataaaatgaggaacggatgttcctctttgttgttattcttggaaaatcgttttagttatgagccatgttttgatttatgttggtgcagccagaaatttttcgctggttgtgcttactttttgcaccaccagtttttataataactcaaatctaatatgttttgtataaaaaagt

SEQ ID NO: 14909 - DNA, 1501 bp, Oryza sativa
atattgtatcctaaacattccgtttatttaaaatttcctaataatcaaaatcgtagcagaaatgattaatgatgataagtaaatgaaaatagaggggtagggagatggtttaaaatgttaatggtagtagctttttttcgcgaacacgcaaaagagttaacgctaaaatattagaagaaagtagagtttaagttacacaacaaaaaggttaaaaatagcattgccgaaggaaaaagaaaaggaaaagactgaaaagattgctaagattaaactacgaaaataaagttggtagagagagatccgccaccactagccaccgcctcctaaacactaacagtcggatccaccgtctcctagccgtttaccccgccacgaacgtaggcccaccgccctcctctatctccgcggctttggtgccaccgccgacacctcgctgcccgtctgtgtccaccgcccaccgccgagccggcgcctctcatggacatccctctaaacccagcgattcccccctcttccccctcccccacccccatcctagcccaggaccctaaaccattctactgttttcgtcggggtcgctagagttggagaaggtgttgccggagctggaggggaagagctaaggttaccggagcacaatcgtgaagtaaatctcaatgtcagtaatctgcatgattttaacataaaaatcattcgctagccatttagccattttgatcaaatattcagattgattgacgcatatattctccggacattttgatcgagcaacaacagatcaattaattaatcacctgcaagtcaaacacaatttttttttatctcttggttaacgcagagatctagtctagttgtagtagtgtggcactgtggcgtccttggcacgtgtggtgggcgcgcgtggcgcacgtacgaacgtgtgctgcgcgacaccccacgtgccgcacgatccaacgcaatacgcaggtggctacactccaaaagaaaatgtacgtgtatatatactcgatctgtgcaaaaaccctcacgtacgactaataaatactgtacacgagtactcggcagcatgtgacagtgcgtagtaccagtacattgtgtgaaattaatcctgcacgcttgggtagttcattactttggtttctcagttgccatcttcttcctttgtttttttttcatgcccataacttttgaagacgttttactattcattttattaaaaaaatataattatcgtttacttggttatgatttgttctactacacttatatttttatatatttgaaaaaaaatatttttacacttatattgctaactttgttgcttatactagtattatataatcaatgaacttttctcaactcaattatcttatttccgtcatgggcaactttgtctatgaagtagggttcctcctatcgttttcgacgcggttaccgaaccccgcggtaaccacgagacatagtgtgattaccttataaccgccacacggttttgtaaacc

SEQ ID NO: 14910 - DNA, 1501 bp, Oryza sativa
gagaaaaaattcctgaacttttgaggtgtgaagcttgtgcaagcaatctgggtggttggtgctgtacttaaccactagccacatgggaaaaccatgttatgttgacagcttagggtactagtatttggagtttgcgtgtcaacatcagtaaggatgggctaattattctctcaagttcactctgcttcgttatttgggttaatgtgatcgagattaggtagggaaagcataggatttctgccgctcgaaaacgagagactgtatataaaaaaaacgaaattgggattgctacttttacctgccatgctaacatacattcagtttaattcgcattaacaccagttgttaccacttacgaccagacgttaatttaatttgcaggacacaagttgttagcaaacgttaatttaatttggagcgatgcaaagtgtggatccaacgatttggttaataaagaatccatgattaattttaacggatttaatcatgtgcacttagtgtcaacttttcgtgtaataccttttaaggcaccgaagcaagatcatttaaccaagcaaactcatttaatcaagcaaaccttacgttcaacttttttttaaaaaaaaatccgttcaaaaatctaatcaagcaaaccctgtttaataaacccatttaatttgcaaaccctgtttggaacgcagtaatcccacttaatttcgtcatggctgtatcaattttcgtagtaattccacacaaaatggatcaatttcagcattgatacaaatttttttaccgcgttccaaacaaaacctaaaaattatagtatcattaggcgttgatcacctgaattaatgcttaattaatcttcttccatccctctgtggctctgtgctagaggaggttaatcaagctatttaagcaagcaaaccctgtttggaacgcagtaaaattccatttaattttgccatagctgtatcaatttccgtagtaattccacataaaataggtcaatttccgtatgaaaataaaaaatctccctccttccaaagaaagcctaaaaatatactactactccagtaagtatgattagtcccttgatcacctggattaactcttaatcttcctcatccatccctatatgctagaggaggttaagcaataattaagcaaccattagccatgaaaaagacttgactaatgactagtacaaaattcaattcaaccttgttgtcaaaaaggcggttaaaaaggaagcaaccccaacccccctctccctccctccatccctcttcttcttcattccttcctcctccctcctcttcaaccatcaccaaatccacacgcttcccaaaaatccaaacccaaattgcaaccccccaatctccattgccgtcgccgccatgatcatcaagacgctcaaggcgcggatcctgtgcgcgctcaagtcctcgcttccggccgccgcgtccccgccgccgtcgccgaccaagccggggcgagccgccgcggcggtggtggtggt

SEQ ID NO: 14911 - DNA, 1501 bp, Oryza sativa
ttatatagttatcatttattttattttgacttgattcatcatcaaatgttctttaagcatgacataaatattttcatatttgcacaagagatttgaataaaacgaatggtcaaatgttaattaaaaagtcaacggcgtcatacattaaaattaaaatacggagggagtaattcataataataagagtataagaatatgatactagtacatgttttaataagtatgcacgggacactggataattatttttttagattctcactgattttaaccccaaagggcaaaggcccagacctaggggtgaaaacggtacggaaatttccgaaaattccggctaccgtttctagtttgcaccgaccgtttcagtcggtattggtaattgtcggtatcggaaatggaaacggtaatctcttccgaaaatggtagcggaaatgatatagggtgttttccgaccgttttgtcggtaaccgtttttttatcggtaatttccgtcaaatttccgacaaaattccgaagaaggaagccggctgggccttgctagcaggagcagcccattaggcatttaggtcggaaagaaaaaccctagggcgtcagccggcgtgtcgcttctccttctcatcctctccctgtcttatgactctcgcgctatcgcacagctcttcgccacgccgccgccgccacaaccacatgtccatgccgccacaccgccgcttgctagtcctagccgtcgcatcctcgcgcctcgccgcgtcccttgccggagaagcaagatggcacctgccggaggaaaacgccgcatcctagcttctggatctatccgacggcaacaacagagaaatgagcattgagttcgccaccgttgcgtttgccaggtccactaggtataggcgtatagcttgaatgcttgagcatgatttttttacatgtacagatgaatgcctgagccttaatgttttttagcacgattttctgttgatgtgcgagcgtgatttttgcagatgtacagcttaatccttgagcatgtttttttaagatgtatagcttgagccttgtgttaatcgttaatcacttcctctttttttaaatctcaatctgctgcatctggaagtgcaagtggaagtcatcatgtgggtgtgactgcatcatcatcctattgtatgctatagccacattgatgttgaagtatcgttgaactttgtttatattgtttgtcgaccttattgtcaacttattaatcatcatataacggtgttgtgtggcagcgtgatcatgcaagggtgaaattataaggtcatcttcatacatagttaaatgtgggatgataccacggttcgctgtttccgacatgaattttcgacttccgaccgataacagtagattcccgttccgatggttccgtttccgatataccgacattaccgatatcgttaccgtttccgagtataccgttccgattccattttcgaaaaaacaaaataaaaatggaaatggtagagggttt

SEQ ID NO: 14912 - DNA, 1501 bp, Oryza sativa
  unsure (1)..(1501): unsure at all n locations
ttaggaatagaggtaaactaaacagttcatattctgtacagtttgggtacgtcagtaccttgcgattgtcgcacggatccggggctatcgctacgctcgtgcgtcgcgcacgtcgcgcacgccgcgcacgtgctcggctgctcacgtctacacggagtcgaatctcatccttttacagacacacttatcgcgcctccccactcacgcaccacaactctttcttgagaacagaatattcgcaaaagaaatatcacaattaanngtaaaaggaagccaagatatttatgcttagcgcccatccggcccatactatagtatacactcatcactaacaaagttaagtaggtgctacactgctactaccactaattaagaacacaaattagaacgcgtaatcagcaacacctttcttgacctgcactgcactgaactgaaggaaagctagctaatggcaccacacactagtatttttacaagaaaggcactgtacagttatacagtatttgccacactacccaactccacaccaacaaagcaatatgcagacagacacgtgcaggtggggccgccacccagagacgcctgttccacgtgacaaacttcccaaactacccctgatctgatcgctaattcgctatggtacctcatggcaccccgcgtaattaacccgcaaaaccgagcctcttcgtatacaacctcgaaggcagggcagcggcaggggcagcacatgtcccacgccgcaagggatccctacagggccccaccctccaccaccgcactcaactcaactcgtgtcctttttcacgacgcgcaccgaaacgacactcactggagggtggggaccgccaccaccacgtgtcgccgaccgcctgccacgtgggcagggcgtctcccccgctacgcgcacccaggcgaaacgcacacgccgtttcgcccgccacaccgtcgcgtcggggtcggtaataactaacccgagacagggagagagacgagaccgaccgacgccgcgggcttagtccagtggaaggtgttcgtccactcgcgctcgcactcccgccgttacgcgcgcgcgcgccgccgccgccccgacctcgccgcgcgcgccgacgaacctagatgcggtgatgggaagaaggggcgcgggcgcgggcgctgcggtggtggtggtcgcggccttcgtggcggcggccgtggcgtcgggggacacgctcgccgatctcggcggcgccgccaaggggatcgacagcgtgccaggtgcgtgggcttgagctgttttgcggcgagtggtcctgcgattcgtctctcgttctattctatctctccgttgcgacttgcgatcgatcggtggagtggagtggagtgagcggagggggatcggatgagtagcttaattaggtcgagttcatccgtttcaatccattttgttactgattggagctgtgttttttgggtggatttcaccctgctgttcaggaccactgcgccggtgctacgtttgtcc

SEQ ID NO: 14913 - DNA, 1501 bp, Oryza sativa
tgctgcaaactgcaaccaaccaccgattgtttgttcatgctgttgcagttttcagtcaacaaggacgcacacaagagccgatcgccgtagacgacgatgcagcacggcgagcagagcggcgccaagaaggcggcggcgtgggtggtgtcgcccaacggccaagtcaagcgagaaatggcggtggaagcggcgcgcggcgagggagctgctgcagccgccggagccggagaagaagaagaagaagtccaagccggcgggatgatcgccgcggcggtgggcgacggcttcgagggtgtggagatcagcgtgcggatcgacttggccgtgctccactgccccctctgcctcctccccctcaagcccccgacctaccaggtaccagctgttcgtccaattcatcacctattcttcttcttgctgtcgattcgtgaggtgctcggctagtgacgatttcttggcgtgcagtgcgcggcggggcacttggcgtgcagcagctgccatggcgacgtcccgggcaagaagtgccacacgtgcggcggcggcggcggcggcggcgtctacgcgcgatgccccgggctggacacgttcctccgcgccgccaagatcctgtgccccaacgacctgttcggctgccggagctatgtcgcctaccacgacgtcgccgcccaccagcgcgcgtgcccgcacgcgccctgctcctgctcggagccgcgctgcgacttcctcggctcgccgccgatgctcctcgcccacctcgtcgccgaccactcgtggcccgtcagcaaggtcccctacggcgaggtcctcaccatccacgtgccggagtcggagcggcgccacctggtcgtcgcgggggccgccgggggggacgacgagcgcgtgttcgtcctgtccgtgggcgcgctcggcgtggcgagggccgtctcggtggcgtgcgtcagggcgaacgccgcggcggggccgcgctaccgctgcaagctctgggcgcacgccccgggcggcggcgccgcggacttcgtccacatggactcggcggtggcgagcagcgccgccgcgcccggtggcgaggtcgccgtcgacgaggaggccaggttcctgacggtgccgccgtgcttcctccacctgctcgacgccggaacgtccaaggagatgctcatcaggctcagcatcagcattgacattgacattgacatgtcctgatcgatcgacatgaaacatgatggtctactagtaatgtcctaaattcgtgattagtgctctgatgccgttcaagtttaggtgctagtttcaagttctaaccagccataagctttgctatttggaagtttgaactctgatgttctaaattataattttcgtaaggaaaactcgagttaaaaattcgaacttgtactttccttcaacctcgtttttaatcttcaatggatagaagtagatgccaaaaagatcctaattgaagcaaactatctttaccccaaaccaaaaccaaacactgccggcc

SEQ ID NO: 14914 - DNA, 1501 bp, Oryza sativa
cgcccagcttggcttgatcgtgggtgaagattgttggctatggaaaatttagtcctcgcactcgcgcaaagatgatcatttgcatagaattattattgcttatgtttatctctcgcccatctcttcctcgcggtcccgcggtacccacgtgtcgcgcgctggcttgcctcccttggtaacaaaaagtttgtattcacctcatccattcaaacgattctttgctagaagtgtgggagctatgattcctagctctatcctagccctgcgtcgagctctggtcgccgtcgacgcctggggtcccctgtgctggctcttccatagcagctagttttggccccaccagctggctacggcgcccagcctggcttgatcgcgggtaaagattgttgactatggaaagttcagtccccacgctcacgcaaaaataatcgttttgaatagatgaagtataacacgaacagaggttaacaagaggcaggggcaagcaaggtacgcggcgtaaggtcacgggcccgagagagtctaacaacatttgctgagtatatacaggaaataagttcacgacctaaggtatgggctaaactcccgagcccgcagtgcctcggagaccgggaggaaagtgggaagttaaggcgacgtatgaacgtgactaaactcccaccgcccaactcccagaatgataggacagaagatcgggcccgcatgtcaactgactagcagattggtgtcaaccctgatcacctgggaaaggttttggccagggctaacgccgggggctactgtcggtgatatgagcccgggggtatcatgtttagagggaggaggctggggtggcggccactccttcccaaagactagtcggaggaggctgcccccaatgccatgtggccctcccccaaggggagtcaggcccgaggtggggtggcggccactccttcccaaagactagtcggaggaggccgccccccaatgccacatggccctcccccaaggggagtcaggcctgaggtggggtggcggccactccctggccaagactagagggagaaggctgccccaggcgccatgtggccctcccccgaggggggatcgagcccgaggtcgggcggcggcggccccttcccgtgactagggatcgggctcccccgaccccctctctaggtcaccacgtacaggtgcccacctactcgcatttatggtgacccgagcggtcgtgcggcgtgcagtgtactcaaccggtctgtgaccggtcgaataaccgatgggactggctagtgcgcctgtgcgctgcttttgtgtcaggcggcgtgcagcctgacatgtcccatcaaataatgatggtgagaagttctcaccctcttatcccagtgtcatgaccggcaatggtgacactgaaaaagttgtaatcaataaagctgtgagagctgccagaatccaccaaaagtaacaagactttactgtgaaccaatgctctcaaacgaatagcagtaggaaggtgagc

SEQ ID NO: 14915 - DNA, 1501 bp, Oryza sativa
tgggacgcgcgcaagaaagccggcggttcggcagcgtcgtcgtcgtcgtctagctccggcagcgcgatcccctgccgcgccgacgcttgcgaacgctgggacgcgcacaagaacaagaaagccggcggctcggcagcctcgtcgtcgacgtcgtcgagagccagcggcggtagccccgggcgcgccgactcctgcgaacgctgggacgcgcacaagacacccggcagccctgcgtcgtcgaccggcagcaacgggagcgcctgccgctccgactccgtcgagcgctgggacagcagcaagcggccgctgagccgcgcgtcgtcggccgagcgctgggacatcaacaagaagcctcgcccagaggaagactacgctctctgcagcgggaagagcaactccacaagccgcacgatgaagacgacgacgagtgcgcagatgatcagcaagcctcacacggagacagtggtgaagccgccgccggcgctgctgccgttcgctggtcctgccgcctacttctctgctccggacccgagcatgcttcccgtgcccaccttcttgttggctcgctgtcgctagagtgtgcttgctgtcgcagagaatgctctgcttgagtccgacatatgtgtgttcaggttgtagaggttggcatggttgtttgtattgtgccccaggcgcatgcttcgtgcctggttagctagaacgattttgacgatgaggctgtccttgtatgatttgtaacttccagttatattgaactattgatttgatccttctctacttagtgaatacatggaacgtgatgacgtcttcaattaaatggattgtctactagctaaaggtgtcacctgggccaacagcccaaatttactaacattcatgcttaagagttaagagaacactatttctagttcttctcttcttcctcctccctaactcctatatcataaaatcgattattttgtaagtttgtgtgtgtgtgtgtgttttttttttgttctttttgtaaacggtgttcttgggtaggtgctaatggtgggctgtggaatccggcaaagctcggcccagtatcgtgtgggcactaggccttgggctgtgatccgcgattggcgccagggcggccattttaggttagaataagtttactttgggttcctttatttgttgcccagtccgattttcgtcccttaatcacaaaaccgggtacgacggatcccccaacttacgaaaccgtttaaataaggtccctcgtcagtatttgactccggttttggctgaggtggcgccgacgtggcttcttttgactagatttttgtccaacgtgttattgacatggcgctgatgtggcaattaaatccgaaaaaacttgtgggggcccacatgtcagttgcacacacaaattaataaaaaaaggtgggcccatgtggacccaaacgtcatcctcacaacctcttctctctgtcccctctctctccctcttgtctctctcccgctcatgggcggc

SEQ ID NO: 14916 - DNA, 1501 bp, Oryza sativa
ccgccctccccgaagcccggccgttttccttcgctggcttcccgtttgcttgtcaccgacgccgttcatcgccatcggtgagctcttcacctaatcctcctcgttgtcaccctcctggatcactgtagaacactcccgaaccgtcgctttgatcgccggacccctctccctccccggcggcgttccgcccttccccgcaccgcgcctcgccgtcgccggcctctctcagagtctctccgccccatccgaccctgggaacaagttcccagagtcctagagatgctcccgccaccacgaattgaccccattctctcccggcgtgttttcccccttttgctcaccgccggtggccgccgtcgaaatccgccgcctccgtccagtcccggccacatccgagtcgaggaatggagtctacgtctcctttttcctccctccggtggtctcccttcctcccgcctcgcctcgcggccgctccgccgacgcgcgccgccgcccgccatccatctcccggtcggtctcgtcttcctcctctcgccggcccgcgtggctgccacgtaggcgccacgtcggtgccaactcggctagaccgagtcaaaccggccagcctggctagcccctccgtgcgcacggaccacggtgcgccatgcggctgcacgtgggcccgtcgcgcctcggtccacccggcgcaccaatcgtgagccgcatccacccgaaaccctaaacggcgcccgcgtgctcccatccctccgtgaaccgtgtcgccgacatgtgggccccacccgggacctcgcatggtgggttcggtccacccggaccgccccctctcccttccgcgcgcccctaatgggccgcctccttgcgcccgcgccggcccaatggctcggccgagcctccttcaacccattgggccgcgcctcacgctcggcctaaaagtccatatttcctccctcagtccaagtcagtgtccatctctcatgagctaaaagtccatatctgctccctcccaatttactcctctctcaccttttgtaggccccacatgtcaatgagtaattaaagaatattcttgggaatattcttttccacgaattcaataaaccatctctcatattcccgaaaaattcgatgaatcatttccttgtccagaaaattcagataaacttccaatattcatatctctcgatccgtagctccgatcgactccgttccacttccagtatttctataaaattgagatctatttaatggcactattaattagtctaaataggatccttcttttggtcttttgtttaggttttcgattgtttgcgtatagttgcggttgcggattttcgtcgatcgtggttatctcgaagattcgtgaagctccgtgaaggccttgagcaaggcaagtcaccctttgaccaattgctcctataattggaaaatcattattaatttgtttgcaaatcgcattattagcaacacacatttataacatgcttggcctcagtttgcg

SEQ ID NO: 14917 - DNA, 448 bp, Oryza sativa
tctacagtccctttcttccctgccatgaatatacatgtactatggctactagctcatgctggacggttctcaatgagatcaagacatctagtgtgcgatctatgaccaaatatctaacatgctatcctgaataagaaagtaaactgtgcattatttatttcagagtttgttactaaaggagaaggacagccatgtaggcatgcatgccatgcatatggtccctgaaaattaagtactagtaataagtatggaactttcacctatctatctatctagctctttcatgcatgatcaggcaggaaatccaagtgttgtcttgtcctataaaagaagggaccattgatctacctctccacaattcaatccatttcttcctctaccatactatacctagcttgccaccaacaacagtacaccatgcccaagaagaagctgtcacataggctgt

SEQ ID NO: 14918 - DNA, 1501 bp, Oryza sativa
tatattttgagatgatggagtacatattctaggaaatgtcttgttcagtcataggtttatatattttgagacggaggagtatagattctaggaaatgtccttgttcggtcatatgttcatatattttgagacggaggagtagctagtaaggtgggtacgtgtaatcgtacgtaccaggtacatgtcgtggtgcatggcacggttgatggcatcgagcgacgcctcgcggaaaacggcggtgaggtggtgcgactcggcgtcctcggacggctggaacatgagcggcgcctcgcgcttgaggttggaccagagctccagccggcggtcgatcctgtcctgaaggcccacgacgcagccgcagtccgccgtcgcgtcgatctcggtcgtctctaccccgggctggatgccgcacgcgtcgaactccgcgtcgacggccacctgcttcatgtactgctggtggaaccatccgctgacgccggccggcggcgacgacgccatggtggtggcctgctgcgtctggtggctcgccagccacgagtagaggtacagcacgccgtcgtgctcctccttggtcaggctcctgcgcatatcctcgacgtgatgcttgggaagcttctccttgaggcgctccgctgcgtccttcccggctggggtctccttgatgaacttgtcccattcctccatgagatccttggccatctgcttctggtccggctcctcgtcgtgctcgtgcttcttcaacacctccttcacgatgctgaccaccttgaccctcaccatctccaccatgaccgcctccgaccacgtcacgagatgatcgccggttttcgttgcgccgcccgcaggcgcaggcctctcgacttgtacgctggactcctccatattctccaccttccgtccgccagccggtgtgctatactcaccggccaccgttagcagcagctgcggcggcttcgcctgagcgttctccagctttggcacatcgaggtagacgatgaacttcttgtcctcctcagcggacaagacgccgacgttgatggtgcccttggacgacgccttcccgttcccgctctcgatcgtcttgtcgtaggctccggagtcgatcttgttgatgagcacgccggagttgtcggcgacgtgcagttggacgcgcgcgttgacggcgacggcggacgtgattccgctgaggaagacggcaagcgcttgcgcgacgttggagagtttgtcgtcgatggggtggtagctcccttttggtggcggtggcaatgtgcaccatcgacttggggttgcaccggctctggcacatgccgaaagtgtgtgctgggtaccggacgccgcccagcttgtcgtcaaggacgccgttgtcctggccgtcggagagcaggaagatgaagcctggccggtactgcttgtcgccggcgggacggctgtccaggaggcccgaggcatgcttcagggctggcaggaacttggtgtcgccaccggccttgagctggttcac

SEQ ID NO: 14919 - DNA, 1501 bp, Oryza sativa
tttccctccggaagaatgttcttgacgagtttcaataaatcgccaaatgccttgtcactaacaccattttttgccttccattgcaagaactccagagtggtatccaactttttgtgcccctactcgcaacctgagtacaacgatgttctgtggtcctctaacatcttgtccaatttatgggccctcttttcactttcgcagtcctccttggtatcctgcaacatctgaccaagatcatccgcaatgtcgttataatcagcatctctatcctcctcgcccgtttgatttccttcaaatccagcgtactgagcaaagtctggaatattgtcgtcttccacttcatcttcttccatttcaaccccttgctctccgtgggatgtccaacaattatagcttggcatgaaccccgactcaaacaagtggaaatgaatagtcctggatgcagaatactccttctgattcttacacttattgcatggacaacaaataaaacccttctgcttgttagcttcggccactctcaaaaaataatgcacgccatcaataaactctttggaccgccggtcagcgtacatccattgccgatccatctacatgaaatgaaaaaaaaatcgtacacaaatattcattcgtacaataatgacagtcatacaataatgataaaataatcacaaactctttcaacagtcatacaataatgacatatcattattcatacaaaaattataaaatattccaccaaataattcttatttattattttttaagttttaaattcttttaattttcaatttagtttgttttcttttatttaggattaactttcactatattttcctactcaactattttataaaaccttttttagcaaataaacaaaatttctatatattctttcttttcccacacaaattttctctctcatcaacttacaacaaaattttggagacaaaaaaagtgtgcaaaacatagctccaaatgtaatatgaccaaaaaaaattggaggatgaagttgctaaccttttaggcacctccgatttgtatataatcaccaaagtaaattcactataaattttggcatgacctcccctcttttttgaagaaattttgaagcttgctctcgggctggaggaggaagaaggcatatataaagaggggggatctttagtccctgttggtgttaccaaccgggactaaagttacgatctttagtcccgattggtaacaccaaccggaaactaaagatcccggggggacctgacaagccctgacagcatttgaaccgggactaaagaggttggtgttaccaaccaggactaaagatcaaatatgcccgttaccctttttaaccgggactaaagatcatctttagtcccggtttttgttgcaaccgggactattgtggaattcggccgatcgacaaaagatggtttctccaccagtgtttcactcgctcaagacattgacagaagataagtacttgcctttttcagagaagaac

SEQ ID NO: 14920 - DNA, 1501 bp, Oryza sativa
cgagctgcggcccggtagtcgagatgtcatacggcggagggttggtgcccaatgctaggggctcagttctgcctgcctgtcccgggtatcccggccgtaggtaggattgggtcggtactcttgtctaaggctaggatgggttggaaactatgtcacatctttacgacgggttccaaggccatggaatgcggagtaaagatgtgtcttgtgggtaaagatgtacacctctgatcagagtaaatctattcgaatagccgagccctcggatatgggcaagccgagcaatgtacccaagtcagtgttttaattcttaaaacttgctcaacaactaaaatatggaatggttggcctgggttggcttgggacgagctgggacccaggtcgggttgccagttcggtccgaatcatcgtaggccttgggttaaggcaggttcgtgagggttcacggccttgtttaataatactgtgtagctctaggatcgtctttacaaaatggctttgggcaactaagtgacttttaaatgctgtttaccgcaaaacttaatccctatattattattcccttgtacctcccttgcattaatcatgcatctgccggtgtggcttgctgagtactgtggttgtactcattcttgctctatcttttcccccttcagtaagagaagctttggagaagatgtcttaggtgaagtcctggcttataccccagttgagcgcctgtgaagatggagccgtaggccgctagtccgctgctgtttatttttgattgtcaggccttaagtgcctttgtaataatgtaaatattatcgatataataaagatgtgccttttatatcatgtttgtatggtgtaccccggcttttcctgggacggggattaatacactagcgttcgggaaaaggcaattttcccggtcgcgacaagctggtatcagagccatctcgactgtaggataagccaagtggataaaacctaaggacatattttataaataaaaattatttgcgaaagttcctttttctccttcccctaatgctatttgcaaaaggtttactccgttcttccttcttcggattttcaactagtactagatggtcaggtcagtgaagaagaagacatcgtcagttgtttgccgaagctccggaagactgcaggatccgctagcgaaatggaggaagtagtgaagccagctgtgaaggagggaagatcttggagaacccgtcgcagaacctaagccaccctatagggtagtgttgttagtcgtgtgttccttgcttgtgtgtgtagcgcgtggtttgcatcggtgggttgtgatgtaaccatgctaggttgtttgcttaatcaacttgcagaataagtgaaacaaacaacacatcaataagaagagttagttcctttaaggtcttgtccctagttctggtctattcttcccttgtatgctttccctctcaacctctaccttgtgacagatggatagtactggtaacaaaggctatgggaa

SEQ ID NO: 14921 - DNA, 1501 bp, Oryza sativa
agccggtccgactgctcctctgcatgccgatcagactgggccctgggccggtcagaccggcgcgattataccggtacaggggatagatccaacgactaatgctagttatttgtatcatcttagaacatttgatcctcctgtatctactgctgcaaatagtccccaagttcccccgcatgttcctaatgcttataatgatgttgctagggggtatcctcccgatactagacaaggccaatataatcatattgcgccacaaacacaacctatttggccaccaaatccaccgccaaatcagcataggcctgataatatggaggatatatttagtgagattattagggataaattcgggattgaaactaggaatcgtgctagggtttacaaaaagccatatcctgactattatgataatgtgacgtttcctcgtaattatagagttcccgaatttaccaagtttagtgctaaagatggtaggaccacatgggagcatgttggtcaatttttagtataatgtggtgaggctaatagtgatacttttaaattgcgcttgttttctttatctttctccggtactacttttacatggtctttacgggcaaattctattcatacttgggctcaattagaagaaaaatttcatgattatttctatactggagaaactgagcttaggttatgtgatttaacatcggttaagcaaaaatataatgagcctgtcattgattatattaagagatttagggatgttagaaaccgatgttatagcttgaatataacaaaaagcctaatgttaatgtgattgattaccctgaggctagtgatagtgaggaggaaggtgatcatgatatatatgttgctgaatggtcatggactaacaaaaataagccttttgttagctctaacctaatgccgactcctcgcaaagatcggcaaagtgaggttaaatatagttttgatgtggccaagtgtgataagatttttgattatcttttacaagagaaacaaattagattacctaaaggccatgtcataccatctcaagaagaattgaaacgtcgagcttattgtaaatggcatgattctcattctcattatactaatgattgcaatgtgtttcgacgacaggttcaatcggccatagatgaaggacttgatcatgatccttttccggtgaatacaattaatttcaattataagaaggtgttgattcggccggagcaagctgaatctagtaagagaaaaggggtggttattggcgaaccaaggccaaagatgatagtgccaaagaagccggaggttggcgtttggaaggagaataagagtagagctttgacttctaaagcccctaggaagaccaaggtgacttttgatatgcttttggagaaatatgagaagcaaggtggtgagaaaattcgcaacaaaggtaaaagaccaagatcacctcctagggagcgatttggtcattcaccaagacggtcgcattcacctccatatcatc

SEQ ID NO: 14922 - DNA, 1501 bp, Oryza sativa
gcagagcgtgaacggcgccgggaagtgcaccatggtggccgcctgcagcacggtggtgccggacaccaccagcaccgcgcccaggaggcacgcgcacccgacggcccagtcccccccgccggcgttcgccgccgccgccgtcgtcgtcctgtggctgctgctacgcgtggcggcggcggcggcggggctctgcaggacgctcatggtgacggcgccggcgaggcacagcaccgtcccggcgatcttggccctcgtgtaccggcagctgaggtcgaccctctcgaagccgaggcacgcggcgacgacgaagatgaagaccggggcgaggttgggcatggtggaggcgatggccggcgacgtcttcttcatgccgtgcagcatcagcgcctggaacaccgtcaccctgcagccaacgacaaggatcgatataaatctgtcatcagacatgttttgcacaaaatgtgataataatcgtttgacgggaaaactattttaatctctcaaggggatatccctttatttttttcacgtcacttaaatggttgtgataaaaaaaggtgtattaatacgcgatataatactccacaaacatacaagttcaaattcaatttatacatctcgtaatgaaaaaaaacaaattaaaccacaactagttaacgtatatttagagtcaaatttgtttttttcgttgcgagacgtagaagtttaaatttttttcttgtatatttatgaagcgatatatcacatgttaatacattttcttagtttttgtcataatatttaagtgacatgtaaacgatgtaaacaatgagaggatatattaaaatccacttcccgattgacatgttatacatgcataccctccgagggcgagcaagaagaggcggagaagaaggtggttggcgttgaggtgcgacggccatctcttcctctcgaggttgatggcgaaagggagggtgaagaggcccgtggcgaggctgccgaaggtgacgaggaagagcgggtcgaggccgagcgccagcaccggcgcgagcaccaccatgtacgccgcgcccgcgagctgcaccgccaccagccccgcggagatcgccacgtcctcccactcccagctgcaccaccccgccgccggcggcagcacgggcagcagcagcggcaccgccgcgtcgtcctcgccgccgccaccgccggtggccgctggcgccattggacgacgcgcgcggcaggcaagggcgaagagggcgcgcgcgcggcgcacggcaccaccacacgcccacgccacgcgccccggccgtggaacggaaacccagcggtttcctctttggcgcgcgcgcgcgcgtgcttgtgtaggtgcgcgctttcgtccgctcgctcagcccaccacgttgctccgcaccgcacgtcccgcgcgcatgcgcagtatcgctcgccgctatttttgggcatcctccccgtctagccctcttttttcttcatcatgtatatatgggatacagttgataaa

SEQ ID NO: 14923 - DNA, 1501 bp, Oryza sativa
ggagaagccgtcgcagaggaggagcgagaggtcgcggaaggaggcggggagggagcgggagacgaggtccaggtcgtcgtcggtgacggtgatgcgcttgaggaagagggaggcgagcgcggggaacgcggcggcggcgacggcggctgcccaggggcggaagtcggcgccggcccagcctggcgggaggaggttgaagtcggcgaagcgcgggcggcccttgaggaggacgcgccgcgcggccgggaagcgtcgcgcgacgcgcgccggggacgcggcgaggaggttgcggacggcgacggaggcgcgggtggcggactcggcccggctccacgagcggcacaccagcgacgccgcgcaccggtcccgcgccgagtcgaggaactggagcaccgtctcgaggacgttgtcgagcacctggtccggcggcggcgacgcgcgcggccgcttctgcgccggcagcggcggcggctggtcgtcgtcctcctcggacatgtgggccccacccacccccccaccactcgcgtggttggttggtggccggcgaggagtggagtggagtggagacgcgccgcggcggaggaggggggggaggggggaggtgggtgtgcgtgagcgacatccagcgcggagccggggtggtgtgtgggagggaggcgtgtacttgttgttgtgttgtatgtttgctgctgctgctgcggttgggccgggagccgcagtgctctacagaacggcacacaccacggcggcaccaccacagtgcccgccccccccgtgggactggcaaaggcaaagagagggaagctgggatagatgtaaacatctctcattatttgcttaggtgtggttagttcatgtcaaaataaaattggaacgatgtgatgaaaaagttgaaagtttatgtgtgtaggaaagttttgatgtgatgtaaaagtttgaagtttgaagaaaaaatttggaactaaactcggcctttgtgcttttttcagatggtgtgatgaaagcgtgaaagagattgtatgcacggggggagttttggacacctgaatttctctcttccagctaggcatgttttgattcgttgaaagctatttgaatgctttgttctggtagtgaagatggttatttcaattacagtttattatcaaaatcaaattttagtgtcttcggttgtcacatatgtcctatcatctatatagatttgagtaatatgtactaaaaagtgtcactgatagctactagctgaggaggaagatacgtgtaaatacaagtagcaacgtagagacggaagaacgtggagttatgcattttgaaagaatggaccaaccgcgatggtgaaacaattgttcgatcacactagcctttgagatctatacctgagatataggatgaggcacgcaaacaggatagtatggcttgcgactatggcgagagagaatggatatgagatgagtggtagtgtggaagtgacattagccatgaaaagacgaaaagtggagga

SEQ ID NO: 14924 - DNA, 1501 bp, Oryza sativa
cgatgttcctctcttctattattttgttcttgaaattcccctttttttgtaatgttcttagtaatttctattacgtggcttgttaattgtgaaagcggggactagtttcatgacctgtcaaaaagcatcccctttgccacccttgtagcagcacagtccatttcagatcttatcaagttcgccttggcctttctctggtccaactgcttcttggacattctgttctttttcatgacgtctgtaaaagccatacacaataactttgtcatatactgcatgccagcaaaaaaataaattacaacgaagtatacatatagaaaaaatggctgcgatgactacacaaatatgtcaattgtgaaagcgtgaacaaaatataagtaaagctattgatatatatgttacttcccgttcatggaaaaatgctgttttggataggaggcaacaaaatcttgatttctttttaactcactaatatacacaaaaataaaatatgaatatttattattgttatatttaactgtcttttattaatataattatcaatacgaatgacaaaaacctatgaactggtgagaattaatgtgtcgagatggtacgtatgacgagtaaaaaaggaatacaatgagttgtttattttgcaataattaagatcatcgatcagataaaacaaatacactttgaaggacattaaactcacacccaagctaacaaccctcttgttttattttgtttcctttctcacaaaataacaaactctttcttgcccctcacttaagacctatattttgatatcccttatactttctttaaaaaaagggctggcacaaactgcaactcgacaggattatagcacaaattatttgtagcctttaatttgtatcattttttcacaaagtgattttgcgtacgtgcttcttctagccatatataatgccgtgccttgttaatataacctgttatccaatgtgcgcattaaagctatctatatatgaaatttgtgtttcagataactccaatatatatatgcttgatcaggcacgtctactgttgcagcttccagaggcattacttttaaaatatttgtttggaactattgtttttcttgttcaacaatttggatcaccatataagccatggaactaaagatcaacagattttgttaccatgcataactatgcgtcgcgtctgttgacaatgtgtgcattaattcaatttcttgcacggaagaatcaaaataagttgaaataattaaagagtgtggtgcatatcaatcccctttaaccaacttttatccgtgtgatgccagattaggcgtacgaataacaacaaaattttcattcaaaaccacaagctaatccctcatgaacagccaaaaaaaattgtctccatttcctgaaccactttagtctttatagctatatataaaaccacccatagatgggagagcttctatccctctcatacaaattaacaatcaagaatttctgcaaacaaaaaaaaa

SEQ ID NO: 14925 - DNA, 1501 bp, Oryza sativa
tgaagtataaattagttaatatagatcataaattggtaatttaatggtacaaaacatagttctgtaacctttattttaaaccgtgtgtttttaaaataatggttcgaaataaaattatattatattgttaatataatgggtgaaataacagagtccaataaattttatttccaaagattatggatctaatttatttacgtatatattatgatatatataatctatgtttataaagttatagttctttaaaatttaatatcactaattatagttacaatctcatctatacatgcatggagaaaagagaggaggagatggaagcggatgtaatttttaatgatacatggaataaaaatttatgtttttttccattttatcctttttaatcacacattacagttatatatgtattttttggtttttttattagctgtgtgtaagtacctttctctcgtcggtgcgctgagagagattaggtgtaaggttattaatatatttaatttaatgatccgagataacatatccactaatttaaataaaaatcgatgaccagatgttttgcttttttcctcgtatttttctagaaatattttctaatttactaatgtgtatttttacaacttaaaatattaacagttaatatgtgtattgaattattaatttggttttctatctcatcaagggaaaaaaagtgagagtacgtatgtacgtacgtatgtggaactttttgtacgtgcaaatcttacaaagataaacatagctaggaaatcttagatagatctaattgtaattagctaaaaaataggagtagttacctagaaaataggagaggaaaagagaggtcagagggagtacctgcgcatgatagggatggggctaccggattttttttccggaagagatctaatggttaaaatatatgggtccactgatttaacggaaaatcaatgcgactcaagagtgtttataggatgacatatagcggcttaggagcgtttgtagaaagtttaatggacttttaagtatataatagatagattttttatgatttgtcacgtggcgactcgatagtgtttataggatgccacatgacggcttaggagcgtttgtaggacgtttaatggacttttagtatataatagtagatagatagatagatagattagcatatactacctccgtccctccgtcataaattagtaaattagtagttgctttgacttttttttttctttgaccattcgttttatttaaaaaattaatacaaatataaaaacagagaaatcataaagtacttttgacaataaagtaaataaaaaataaaaaataaatctataattttttaaataagatgatggattaaaagttaaaaaaaaacttgacaagtattctggatagaggttatatcatcgttccgagtactactactagtcctgcgttttctgtatcgatcggtcggtgacggtgtgtacatgtgcgcgatggcgttggtgcatgcagg

SEQ ID NO: 14926 - DNA, 1501 bp, Oryza sativa
attgcgggcacgcgccgcacgtctctcgctgttttcgcggtggttgttcgatcgggtcgggacgttgggttgggttgggttgtttcggcggcggcgcgcgctacctctgcctccgcagcgtggctgcgtgggggggatcacgtgcgtcgtgcggccgcgccagcgatgcggtgtaaatccaccggtggtggtggcgtgcgaatggggcaaatgacaacgctgggaaaatggtctggttggttttgggttagagcaaatataatagtaagcctgctaaatgataaggtggaggagagaagagaggagagagaggagaagcgagctgtaaacttaacagccggtttggacataagaaccaagaaactctgtgagagaggcaagtgtacccaatattaatgataaaaagctaactatattataaaggtacgctgagagaatactataaagaaccttatagccagtaagttggctgtattattaatcttgctcttatcggttaaaggccctatctagttcccacgtaaaaacttttcaccttgtcacgttaaatgtttagtcacatgtatagagtattaaataaaaaaaattacacagattacgtgtaaattacgagacaaatcttttaagcataattgctatatgatttgataatattgtactacagtaaatatttattaatgacggattaattatacttaataaatttgtctagcactttacaagcggaatatgtaatttgtttttgttattagtctacgcttttaaatatgtgtatgtatatccgatgtgactcgtgaaaatttttcacccctaaaactacacatggcctaatttttggtttactctggccggctacggctagcggggcatgtacagtacgtacgcacgcacgcacgcacatggtggttaggtttgggcaccgtttgggccctcatgtatgctccatcgtgtgtaaagaaacgtgtcaagcaagtgcgcccgtgtgcacgttgagtctgaggctggaggctgtgcacgatccaaaattaggtgggggtgaaaaagattttcttttgactatccgtttttctacaggaaaccctccttttctttcgtctaaacaatattgactgtgactaaaacgtgaagattggttgaagatggcattttaatcgattgtagtatattttttcttggcatcaaaccaacttatatataacatgtgttactgtgcatgtggcacctaggtgcattgatggaatgtttacaatgaacgattcttttctttattttttttctggttatgacctcctatgattgtaatcttataattttttctactctatcaatataaactttgcactgtttgatgtgagccgttaaaaaaaacagcctacgcaaccaagcaaatccatggttcagagacactaaaaaatgaaaaaaaaaatccaattccgtcatacatgcataatatagagttgtctcgttgccttaggaaaaacagttaagctatgcgtcatgt

SEQ ID NO: 14927 - DNA, 1501 bp, Oryza sativa
aatgtggtagtgacgcttcctcccacattcattcctttccaatagacacgtcaaatgccgcgcgctcctctgaccgtgtgtccaagcttcatgctaatcaaatcaatcgatgctccctttttttttccctcaaaaaaaaatcgatgcttcctttttccagcgagcgatctgcatgcgcatggctttccagattccataccggatcaaggttcctgagcaacggattgagatcgggttacacttgtaactgcaagataaaactgcacacaattttggcaatctatttttaggatcaacggttcagatcggagctacagtatttttttctatagtactatgcgcggtacagcatgcaatctggaccatccaatttgcatccaatgacatgcactactgctgcttaagttgcagtcacagtagtgactgcagctgacccgaatccctgagcaacatcacctatgcctttgctcttgtcaccatcggccggaaaactcgtggaaattaaaaccattgagttaggctctgataatcagatgttgtggctggaaagtacgcacgcgcggggtctaaagtctgaaaggcggcgactacaaaatcatcaatcgatcacattgcctttttcattgaaaccatattatgctgtcatatcctcgagtattcgtgtaccaatatactccggaaaagctaaaaataccgcgacaatgacatctgagtcaatgactcgtgataactaagtacagaaaaattggcacatgattttccaaggccatgcatgctttgctgccacacggccgcccaagcaggaaaggcaagcacatcctctatctttccctagtgtaacaaagcgatgcaagttgttgcttttccccgggaaagtgattatatttcatcaatagatatcccctcgtttcgtacataccacctaaatagtcactaaaaattttttaaaaaatttttaacatagtttaatatgaaatatatcactctacaaacatgcaagtttaaattcaacttctacaagttgtaacaaaaataacaaatatagctgcgaatgtacaataactatttttagttcaatttgttctttttgttgcaacatgtaaaagttgaatttggtattatatgtttgtggagtgatatatttcatattaatctatatatgttgtcatttctttaaaattttttgataattatttagatgacatgcaatcaacgagggatatcccctcgtggaaatccacatcccttttccccacgtagtgcggcaggctaaatcatatagcggcaaatggttgaatgcaacttcaagtgggcgaatttgcaaacattcccgggcgagccggtcatgtttgactccacacttgcgcactcaatccggcatacgtagctatcggcacagcggcgctagctagctaggccatctttagtgcaaaccatggcgccgttcgttaagggtagaaacctctctctccccatctgctgcgccgatgctcgccggcta

SEQ ID NO: 14928 - DNA, 1501 bp, Oryza sativa
ggattcgttcggagttaatcccgcaagtttcgccggcgtcttcaagggcggccgagatctccgcgcccgtttcctccctctccggccgcgctctcctcctcccggtgctatataagcgtcccccgtgctcttctcctccgtttccgccactcgccgcctctcctccccgtcggaatcgagcccgcaccgtcgcaccttctctccgccgtcgccgccgagctccggttcgccgccgtcgtcgctccggacctcctccccactcggcgtcacctccatcggcttcgccgcgtccccgtcgacctcggccacccctccgcttcgctcgccgactgccggagcaccgtcgccctcgtcgtcccgaaccgcgccgccgccttcctccgcttcggccgccgttcccgtcgtcgccgtcgacccggggtgagccgaagaccgccctttcgcttccctctcctctccgctctctcgggcgccgctccgccgcgccggtggtcgccggcggtgaccatcggggcgcggtcgtgccgcctcccgtcggccgtgccggcgaggccgccttcgggcgcgccctcgcggctgccaagtgggcccggccgtcagccgcccgcgcccacgggtgcggctgacgcgtgggacccacggcgccgaccgccgccagccgcgtgctcccggtccaccgtggaccgagaggctgacgcgtgggccccactcccgtggacccggtccgcgcgccctctctctcggctgacgcaataaatgagtttttaattaaaatttaaatgaagaaattcgcaaatatccatttaaagagcatataaacttcaaatggccataacttggccatttgaactcggaattggaccgttcaagtctctaatttttccttaagaagtaaagaacccatttttgtgctttgtttctgttgttgtatggagtttattagagtaaaagcctttttcttttccgttggtcgtgtagacgctgcagcttcggaagatccgctcttcgtggaagtcgaagccgtcggttgggaaagcgagcaaggcaagtcacatcatccttgagcatattgaatcccagtttacaaaattatttttaatttaaattaatgcattatcgctttatttaaattcccgcgttatcactgttttatttagccatgcctatttacctttgttatgaccatactattattgttattgttattattaccttgttcaccctagaataaacaaaaccccaactagtggacactctatttatggttccactagtatgaatttaggtagatgcttcgctgattaataggacaacattaggtggttttataactttagactttgggaattctcatatcatttggacactatggaatggttggcttatgttggaattggacacacacctccccctcttttcaaaacccccaaaatggtttaggctgggctcgaggtgcgtggttgggttttgttagtcgtacctcgggtactataaggattaa

SEQ ID NO: 14929 - DNA, 1501 bp, Oryza sativa
ggctcaagggggccttgaccgcgccctgatcgggggcgcccagcccaatggctggtgggcccccgtcacactgcgccatataaaagaggggtggaggccggcacggcacatggtacgagattcaccgccgccgccaactccaccccacaaaaccctaatccgatcgagagggggcgcagccagtgacgggaaacgccaccgccgcatccacgtcaagccgcgacgacaacgacgatgtccggcgcctcttcctccacgatctcctcaaccggtcggtatctaaaccctctccctttcatctacaatgtcgttcatcaaacccaaatagaaccacccgactagatctaacctaggtgatcctagtgcaaagtttaacaatggtatcagagcaaccctagtgtttagatcgtttcggggaaagaaatccaaagaaagaaaagcacaagatccgcacggatcaaaagaaccaaaaaccctaaccctaattcttacctcgtcgccggccgtcgttgacgccggcaacggagggggggaggggcaaagaggcgccgcctaggagccactcgacggccgcgcgcgcacctgcacgcgcgtgccggcgagggggcccgcggcggcgccgccatctccgtcgtcgccatctctctctcacacggtgggggttagagacggtggggggagcggagaagagaaaagaaaggagcgccggccatggcgcggcggcgcgaaggtcgccggcgatggcgacgccgtccacgcggtcgcgtgagagagagaagagaagagaagctagggttttcggcggccggccgggagaggggggtttttgatcctccgatctcggcgcccggccgtccgatcgaaaccctagctgatcggacggccggcggcggccggaccgaaatcggcccaagtggggagcgcgcggcggcggctttcccggcccaggcccaggttgcggcctgggggaggggagggggcgctcgcccgcgcgcaaagtggccataggccgaccggcaaaggccggaaaagttcaatttaggtccctcggggccgaaaatgaataaaagagaacagtagcaatttttccattttattttgtcgatttttcatgcaaatttcaatagaattttgaatagatttttgcatgttttacctctgtttaaatttgaaccaacgggagaattttcacagagagagaattacagagattttgctactgttcatatgattttatatagtcttccgctgcaaatagatgaaattgatgaaaattagtgtttctaaaattaaatttcgaaccaacgggagaatttaattttaggaacattaattatgtgctatgatgttgtaattttctgaccaacgttgttaattgcaatattatagttatggttatatgtgttatgtctaattctgcccaacggtgatgtaggcttaatgcataatattttaatgttaattttgttctcaccgcacatgattatttcaggtggctact

SEQ ID NO: 14930 - DNA, 1501 bp, Oryza sativa
ccccaccgtctctaacccccaccgtgtgagagagagatggcgacgacggagatggcggcgccgccgcgggccccctcgccggcacgcgcgtgcaggtgcgcgcgcggccgtcgagtggctcctaggcggcgcctctttgcccctccccccctccgttgccggcgtcaacgacggccggcgacgaggtaagaattagggttagggtttttggttcttttgatccgtgcggatcttgtgcttttctttctttggatttctttccccgaaacgatctaaacactagggttgctctgataccattgttaaactttgcactaggatcacctaggttagatctagtcgggtggttctatttgggtttgatgaacgacattgtagatgaaagggagagggtttagataccgaccggttgaggagatcgtggaggaagaggcgccggacatcgtcgttgtcgtcgcggcttgacgtggatgcggcggtggcgtttcccgtcactggctgcgccccctctcgatcggattagggttttgtggggtggagttggcggcggcggtgaatctcgtaccatgtgccgtgccggcctccacccctcttttatatggcgcagtgtgacgggggcccaccagccattgggctgggcgcccccgatcagggcgcggtcaaggcccccttgagccgttgggctcaaggggagagagatctatctaacaagtacgtcgtccagcctttgtcggcgccgtcccagcggaggatgcggccgtcggagacgccgctgttggggccatcgccgaacttgtcgaacgcgacgctctcagggccaaccagcgttgcgggcagcggcagcgtctcgaccagtgtggcggaggtgtccttcgcgacggccgcggcgagggcgtgcgatggcaggagcagcaggaagacaacgatcgtcagcgccacccgagtcagagtccccaccctcccggtgccgaggacggcgcccatgaatgagattgagaatcgcctttgctttgcttcgtctggctgtcaaactagcttctcttcttcgcttcgcgctttgtaatggtgagatgttcttcgcttctgagatgcttggattggtggagagcggtggccgtgcctttataccggtagccacatccacgtcgtcgattcggataccgactccgatccgattccgactccgattttacaacgaacctaacctcagcttgttgccttgtttacagtccagactgtgcttaatttcggcctgtgtatgaatggatctggatctaatgtcagcccatgaaaaaaggttggatggttaggcctgcattgaatttgatatggatgtatgtttggcccagatataattttatatgggcttagtttccagccgacgtatgttatgtcgtgggcaatttacgccctcagttaggaataagttcactttgagtccctcaaaatatagctccatcaaatttatatccgtgaaccgcaatatcagatattttaaacc

SEQ ID NO: 14931 - DNA, 1110 bp, Oryza sativa
accgacctcgtccacccctccgtttcgctcaccgaccgccggaacgccgtcgaccccgtcgacccgagcagcgctgccgccttcctccgcaccggccgcctttttcgttgtcgccgtcaacctagggtgagccgtggactgccgcttcttttcccccttcccttcccctctctcggccgccgctccgccgcgccggtggtcaccggcggcgaccatcggggcgcgggcgcgccgcctcccgccggctgcacaggcttggccgccctcgggcgcgccgagtggctgccgcgtggggcccggccgtcagccgcgtgggccccactcccgtggacccggtccgcgtgccccctcccctcggctgacgcaataaaccctttttaaattaaaatttaaatgaagaaattcgcaaatattcatttaaagagcatataaacttcaaatgactataacttggccatttgaactcggaattggaccgttcaagtctctaatttttccttaagaagtcaagaacccatttttgtgctttgtttctgcttgttatatggagtttattagagtaaagtccttttcttttctgttggtcgtgtagacgctgcagcttcgaaagatccgctcttcgtggaggttgaagccgacgtttgggaaagcgagcaaggcaagtcacatcgtccttgaacatattgaatcccagtttataaaattattttgatttaaattattgcattaccgctttatttaaattcccgcgttatcactgttttatttagccatgcctatttacctttattatgaccttattattattgttattgttattattaccttgttcaccctagattaaacaaaaccccaactagtggacactctactcatggtaccactagtatgattttaggtagatgcttcactggttaattaggcaacattaggtggttttacaactctagaccttgggaatactcttatcacctggacactatggaattgttggattattgtggaattggattcacacctccccctctattcaaaatccccaaaatggttttacgctgggctcggggtgcatggttttgatagtagcacctcggccatataaggaccggt

SEQ ID NO: 14932 - DNA, 1501 bp, Oryza sativa
atgaggagggttacctcaggccggcccaaccagcccaccttttatcctgcggcctccctgacttcatctctccgcagacttatgaattttgggcattttgggtcttctgaaattgatattttcagcccatcttcctttaagtctgattctcggcatcgtctgattgatcgatcgagtgttttgatgcctattcttctccatttattgcttattctctacaagaggttagtaaaccaagtaatagtggattttattttattctaacactatatgcattgtaagcatgactagttctccttttattccggtaatattgacgggcgaaattgatcgataacgaccgtcaacagcgggcggcgccagaggagatgttgccgccattgacggcggacgatttgtgattttgtggttttttagatgatttgtgaatttgtggatgattttgttgtttagtatgttcattcgatctgtgacgtcaatttgatgtggggatttgggaatgtcggcaattagcaaaataaaaaacaatgaaaaaaagaaaaagagaagacctttagtcctggttggtgaatctttagtcccagttatttcaaccgagacaaaagatagatatctttagtcctgctttcagagtcccagtttgtaacccgggactaaagaggttgtaaaccgggagcaaagagggtatacccaacagtgtatagtactaaccagtgggtttagttaagttgcccgcatctctttcgataaaactgacatccagaaagtaaggcaagtgggggtaagcgtaagccaaaaacaagttacgtcaaagaaccaaagaagcacggcggtatcttcttctgttcacgcacatgcatttatgcatttccaactcgaatgtgtgccagtgccactcgcatatatcaaatcaacatattggctcgtccctccaattcgagacaatactacaacatctagaaaacaactttaaacattattttttattataatatatatgaaaacaataacaaataaatgatattattaaaatactttttaagactactctatacatataatctccatatttctaagataaatattttagaaattattatagataaagattttaaagtttgatcttatattctcatttgtgttcaaaacgaccagtattatttgtccggatgagtagtataattacttttagagtttaaatttatcttaaaaaatatagttatttcttctttatcttctcattacagtgaataataacaatctctcattgaatttctatacctactttctatttttaacaaatcataaacttctaaaatttatacacctattttctatttttaaccaatcaaaaccttccaatttaaaagtatttaagaatacttaaattttagtactgaggggagtagtctggtacccacactacctgcatgaaaataataataataaaaaactgatgccaccacactaccacagcaagtctggtacccacgctaccaac

SEQ ID NO: 14933 - DNA, 525 bp, Oryza sativa
aaatttgatgacaatttataaattagaaagtaaactatggtacgcatactgctttgactatggtacgaactacctatgtatgcggccagagtgactatggtatctatgtgtggctgtgtgttttggttagccggctgtgtgccatggcggcttgtttgggaacttgagggaaggggattaggagtttacacgagggaattgatggtgagattaagatgggaatttgatttttcattccagtctcttgtttggtagaggtggtggaaattgataggaagtttagttggagattaggtcattaatgaaaacggatggctgagatttgtttaggcaaagtaaaggaagaattccctcccaattaccaccccctacccagtattgaaaaggagggagttcattcctcaattccccatccccatccccatcccaccaaaattcccatgtctcccaaccaaataaaacagttaatagcctcatccctctaaactcccaatcccttctaaaaactccccccaaccaaacagg

SEQ ID NO: 14934 - DNA, 1501 bp, Oryza sativa
aaaattaacatgataagttaaaatataatatatcacttcagaaatatgtaaattgaaatttaacttatacaagttgtaacaaaaataacaacttgtaaaagtcgaatttgaacctgcatatttgtaaaatgatatattactaacttgtaattttttaaaatttttttttataattatttaggtggtatataagaaactagtagacgttcacctgagagtttagaatccaacttctatgattaattaacagacacgaattaatcgatggtgtttgatttgatttgcagaacgcgatcctggcgccgcactggaacatcaacgcgcacgcggcggtgtacgcgacgagcgggagcgcgaggctgcaggtggtgagcagcgaggggcggcgggtgttcgacggcgagctccggcgcgggcagatggtggtggtgccgcagagcttcgcggtggcggggcgcgccggcgacgaggggttcgcgtgggtgtcgttccagacgagcgacggcgccatgaacgcgccggtggttggcaagtcgtcggcgctgcgcgggatgccggcggacgtgctggacaacgcgttcggcgtgtcgagggaggaggcgcgcatggtcaagttcgggagggggcaggagctcgccatcttctcccccaagtccggcgccgccgcccgccgccgccgctctcccggccacagggacgacggcgtgctcgccgccccggcctgaggcgtacgtagataccagcgtgagcgcacgtgcgcatgtacatgtagtactaataatgtgcacgttttccgttaagggtgccacgcactgcatgcaccgtatgttggcccgtacatgtacggtgtacccgatctagaataaatgaagtcgctgctgctaccaaagtgcagtgtgttaattaagagctcgtttcgctttatcaattaaaatttggcttaaactgtgaattaactgtggaacaatccgaaattttgtcggtcgatcagcgcatgaatctatccatggctgtgttcttaagagcaagttcctaacactcatctctctcattttccacgcgcacgttttttaaattgttaaacggtgtattttttttaaaaaaaagttttctatgcgaaagttgtttagaaaaatcatattgatctatttttgaaaaaaaagttaatatttaattaatcatgcgctaataaactactccgttttccgcgcccattatgcaggttcccatcctcccctagcgaacacagccataatattagttttacatgagctcgagggaggagtcgtcaaccatcgtgtgtagttgctggaagtagggacgtaggcgggtgaccgtgaacttgtttataggtcaaacaagtagtaaacctgcgggttcatgtgtcgtggtctaacttactgtatttatggatgtaattgagtcaacccatgaatctacttatatgtcaaaaatactagtaggcaatacacaaatcaatctgtggcttactcactaattt

SEQ ID NO: 14935 - DNA, 1501 bp, Oryza sativa
tcctctgtcagagcaaccatcagctaatataccttcaaccgggtaaccttctgaaccaggagttttatcttatggtaaaatctgtcattatttctgatgcttgcttgaaatttgctgctgcagttcatcaaggttggcttctctgcaaaggcttccccatcatttcctgaattccctccgaacaaagaagtcccttgccaaaaaggttctagctgttccattgtttgcgattgttcattgtttagtttcgtttcttttcttccatgatgagaccatgattaaggagttaagcatttatattacaggatgttatgggcataaacaagtggaggtttgagaagctaaaagaacatatccaaggagacatcgatgctgaaaatgaagcgtatgaaaggtatacacagaatgttgggttactggaggaaacgttcggtcttacagaagatgctgctgatgaacctgaacctgaagcaacttcttcagaagagaggatggaaacattggtttccgaggcaaaggtgaggctgaaatcggactctgcaaatgcagatggcttccgggacaggattgctactattttggaccagaagataaaggaattgctagaaagcaaaagcacctacgaggatgacaaccctcctgaccaaaatccagatgaccatccaaagcctgtcaagttatccatcaagcagcaaatggagagaggtgcaaagatgactgagctccttgctaagatgataagagcacagagtgaggttgatctgaagatctgctctggtattgcggcgcagctgtttggaaagaagaatgaattgagcaaccaagaatctgttgcatctgttacgattccttattcttttccaaagctctggactagggtggagattgatgatgccatgatgtgtaagatcaacggcgaattttcgtcttcgacagaggtaatgcagctataaacctggaattaatctgttcagacccaatgcttgtctacactagaagaacatggttgaaccacagcttcttttctgcttaacctactgttcgtttaatgtaagcaattgtaattgttttcatcagagacaaaaaccatgagagcaacacagtagtttgaccagtttgtattaaaccatgacatgagagcaatacagtagtatagttgtttttctttattgtctatgagacatcgcttgtctccgccggcggcggcggcggcggcggcggcggctgtggcatcttgttcgtctttgagacgcgtggctcgccgaagatcgtgactatacactcgatcgagaggaagtcgccggcgaggaacgccggcgtctcgacgaactgcacgccggagcagctgaactggccgttcctggtgtcgaacgccgccgtcttgtcctcgcggaggacgaggcgctcgccggtgacctggtcgacggccttgagctcgtagaccacggacgccgcggcgtcggcggtcatgagctcgaggaccaccgacggctggcggcac

SEQ ID NO: 14936 - DNA, 1327 bp, Oryza sativa
agaataactattatacaccacttccaacccaaccactcctactctcagcctaacccaatcagcccacactatcccatcgccccatccctcacccccctccttgatcgatgtctttttttctcatccattttctcgtttctttttcaccttttcttttctcccaatcatcctgatcctgcatctgtgtttcaaaaaaaaaatcgtcctgcgcctctccctcttcttctaatcaactctcttttctcctcattttctctttttttttctcttcgaaatttccctcctcataaatatttttcttttgaaattatcattgtttaaggtatagatggctataaggcccgcccggcacggcccggcccaggcatggcccacggtcgtcgagccagcatggcacggtcagcacttcgggccgtgccgtgccagcctgaaggcaagggtagcccatcgtgccttcattaaaataagtttatttcccctcccttctttttggctgtgatatatatatatatatatatatatatatatatatatatatatatataataagtctattttacgtctctactctttgtgacgtgctttacatatgtttgagaataagtctgtttcgcatccctaaactttgggccgggccgtgtcgtcccagagtgccgaggaagcagcccaagcatggcacggctgttgggccgagccggcatgggcacgaccggagtcggaccgtgccgtgcttgggccgggccaaatttatcgggccttgggcgggccatatggccattgttgggatttcttaacgacattactagaaatataattccccgcaatggcgcagaaatacttctggtatattatggttacagagtgtatccgcaagcgcatggatataccattgtaccatttcacccgagagtattccaagggtatcgtatttattttatcccgtgggaagatcatgtagagagagattgactaatagtttatatattccttgtgataatcatattctaaacaggggttaagataatccaagggtagagtgacacacaagcatagagtgacacacaagcattaacaactcattctcataataaatgatctaagctaggtggaaagaaaagagaaagagaatctattcctatacctctaatatacataatatacatatattctagttaactgatatactagcaaataccctctatccgatgccctcctggtacttcgagaagctacccctgactgtcgaattccttacgacagcacgtcatgaccatacaaccggggctaaatacggaggaataccctccccagggaattaacttaggat

SEQ ID NO: 14937 - DNA, 1501 bp, Oryza sativa
tatatcttgtgggatgattaagcctatctgtccatacgtccttatttcatttttacggcagctcatccgtagcttacgagtctaatcacttcaagagtccgcttcagatgagcatatataacatacaattaaaaaatatcattaaccattatttttgtatataccaatgtgttaacaattacatatatttgttactgatatatagaccttttaatccctcgttattctttttcctttaaaaataatagatagttggtaggagatgtttaacatatggatatgggcctgctagccccacctgtaattttttttctcacaagaaaatagaagtatgtggtgcacgcagcaataaaaccaacatcatcactactattttttttaaagaagtatagataacgttcttgactgacttttgataagctgtttgatagttcatatctctgctattataaaaattaaagatatttttaccgacactttggtacgtcatcctgttgacggttggtactcgtagaccggatatagagggtattggggtacgctggtacgaggatctacgtagtacgacatcaaggaaacaagagacaaagattatacttcaggccctttaataggtaatagccctaatccagttgatatgggattatatagagagaaccacaaattacaaaggaaataacagaactcgatgatactggcgagatcgtagttgagttgatttgactagatcacccagcgacttggctcctgcaaactccggcttcgtaggctgtggtcgctgtgttggctatgagattcgatcccttaggtcctcccggggggtcccttttatatcgcaggtcaggtggtctccaagtaggactcggaggtatcggaccctgcacgatatagtgacgacccagtcctatatgggtaggaacctttccattggtggactttgagatgaatttccttaacgtatacagagaacgtccgtacacgcgccgatgtaccgtattgccgtatagcgtacatccaagggtagagggtataccttattcgtaaccctgacagtagcccccgacttctgcttaaataaactcctataaccgatcacgacttctgatgtcggagttgttgtcgttctcgactggtcgatctcggtgtggggatcgtagagacaaggagtgatcgacaacaccaggcgaagttcaacggttatgagtgaatttaaattgaagtccgagaaaccgcctcgcgcaacggacccagaaatttccgacggccatctctctcctttccttggaattcgcaccgtcggtagtgcgcctatttaagggagttttgggaatccatttttgagtccggctggtgcgaaaactttctagcctctaaacgctcttcgtcttctccgcttccacgcaaaccctaattcgctcgcctcggcttcttctccggcgatctccaacggcgatggacctcgacaagtccacctccagcagtgcgtccttgaagaaattgc

SEQ ID NO: 14938 - DNA, 1501 bp, Oryza sativa
gatctggcggcggcagcgcgacctcggcgtggatccggcggcggcgcgacctcgacgtcaatccggtggcggcggcccgtccccatgcggatccggcgccgatgacgacgaatgacggttggagcagcggattggccgacgacggcgacgaatctggcggcgcggaggccggctggattgggcagcggtgggctagggtttggagtggcggattggccgacgacggcgacgaatccggcggcctggaggccggcaggattgggcggcggtgtgctagggttcggcttttttgtttttttttattttgttgaattcattttcgcatgcggttggtacaggggatgcatgtggttgctctagccgtatgcaaagatgacaatctttgcagaagatttcacgtagccgcatgcgaaaatcgttgccgtccgtctgcaaagacgtattcttgtagtagtgtgataacaacttaattccataacaacttttcaaaaataataacatcatactatatgctttatggtatcaaatattacttaagagatatacaacggtaatatgaactatgtaagaatgcaaaccatgtaatttagttgtgtttttttaaagccggtccaatttaaattttaatacgtgtgagattaacattctcaaattattttggaatttttcaaaaatatttggttgatatttcaatagtaaaaaagcctacagttttgaatcatagatgtaaagaaaattcaccaaaaatattttcagctggtaaaatatatatcattggttttttggcatattattttaataattgtttaaatgatatgaaaaaagttagaatataacccaaaataaaatatttattttagaagttcaaatatagttaatatcagtccaacgacataagtcgataaaaatagctatttattttaaaagattataataaattagggttcctaagtagtaatatataatgaaaacatgagagagaatagaaggggagagggcgtgaataagggcggagggggtggaagcccattaccaatgcatgcggcgacggagggcactgaaaatccatccgacgttgtatatatgtaccggcagtagagacatgctcgggtatttcgcaagagtaataattaatctagtagtactttcccagttccagaatatatctctactattataattattataattattgaagatgtttttgtcaaaattttcgtacgtcatcagtatttgagtcggtttttaagttcgttcgcttttggaaatacatatccgtgtttgagttagattttattgtttccttttggaagtataaaaggagtcgtataagaaatattttgaaaaaacttgcatgcttgaaatacatactcctaattgcagctcatgattttctgaaaaaaatatccaatcgaatttccacggtgaattttactctggctaaaccatataacaataataaaattaaaatagtatttacctgctgcaatgcacaggtatt

SEQ ID NO: 14939 - DNA, 1501 bp, Oryza sativa
acgacgaacaccggcggggttcgggtggaggggagacgaggccaaggtcgacctttccgctgcaacgctggaggaggagacggcgacgtcggccaacgcacgggcacggcggaaggggctgccggaggcgacgttgacgaggaggaggatggagaggccggcacgggccacagcgttccggcgaaatagaggagcagccagaggagaggacgacgctgcgacgtcgacggaggagacggcgacgtcgatcggcgtaccggcgacgaacagcagccggccggagacggtgcagtggtggcaacgccactggacgccggcgggaacgcgcctccggtggtcaccgcgcgaaacggagggcaggccgggggagaggaggcggcttcgacgtcgaggatggcgacggcacagcctacgggtgcacgggtgaggagggggaggcggctggaggtggccggcggcacgggagagagaggagggcggcggggagaggcggtgcggccacgggggagctcgggaagaggcaaaaacgagagaacgcacagagggggttccattttataggcgcggggagggatccggccacgggagagggcggaacggaggcgggaatggcggccggcggccatggaaggtggccgggaatggcggggccgttccaggcgactgagggcgcaattcaagggggaaattagggggaattgaagagaaaggaaaggggattaattccccctaatcaatttggaatgaagggaattgattcgcgtggatttgagggaggaaacggatagggtttcacgggagagggaggagccgggcgggaggaggacgacgaccgggtgggtgggacccaccggtccgcacggtcaacacgcgtgcgcgggagggtggcggctcgacttgggctggggcaggcccaggcaggaggagaggagggaggggtggcccaagagagagatgggaaaggaaaaagagagggagggaagagagacttcggccgctggccgagggagagagagggaggctttgggccggacttggcccaaaggaggaaggaggatttaatttagttttctttttaataaactttgataattgttgttgttgcttaataattatttccgatgctctggaaattcaaataaactttgagggctccttttagaccaaggagaatttaacaaaaattctccgggccacattcgaatttttcttgtacgtattttaatgtttgccaatttctttttgaattttaattaattctattattccttttagagaatgatttttatttcgggatgaatttatcaggacgtgacaacgttatcagcacttcgctctaagcgaagagatactacatcgcttttgattccgagaaaagcaaaagaaatagaagaaactaaggaaattgaagaaagaagaagggacatggcaacaaaagagttcgacgaactcgccctcgatgggactaactatcccatctgggcttccgatataaaaatca

SEQ ID NO: 14940 - DNA, 1501 bp, Oryza sativa
tcaaaagaaaataggaagtgagcttttcaaaaactctatatgaatttaatgtaggctatgctataggagaaatgcctgactcacaattgaagttatcaccgtaagaatatccttcatcctcaacaatcatgttatgcattatgatgctttgcagcaatgactttaataagaaattctcatactaaaagatgagttgtatacgtacaataacaaactgagaacgtcgaacaacaaatgcacatgtgacatctttttcttgccccttctttgtcttgtgcagattacttgtccttcattcgtcggggctactctctctttttacatgaacacaattttcaagatggtgaacggtgtattcttaagaaacattttatttaaaattttctttaaaaatcaaataaatttacttgtaagtttgtcattgttaatacttgactaatcatgcgctaatgttttaattttttttccacattcagctacgccacttgagcagaaacgaatgggacctaagagtgtcacataagattaggtgatgagatagaggagagaaacatgagccacatctcttatgcaagggagaagctctatacaaacataaaaaaggtgtgaaaatattagtagtattggaatatgtgtattagagatgacatattggttcctagtcacactttgccatcactaaccgagaaaagttatcacactttgtctaaggtgggtgatcaactttctcatttaacaccggaggaattgcattacaggccaaacaagtgctcttcttgtagtcaaaatgtttcctgttcgaatccactgaaatgagtggattaaattttggattaaagtggcacgcttttcaaactgctaaacgatgtgtttcgtgcgaaaactttctatatgaaaattgttctaaaatatcagattaatccatttgtcaagtttgtaataattaaaactcaattaatcacacgttattactacctcgttatacataaaacacttaatctttatcttcatcatctttacatctttaggagattcaaaccccacctaaatcgggatcttttttatcttcctctctttggcatgtagcacagaagttgttactagatgccgaggtacgcttggtcctgcccttcaatactctggagacaagttgagctcaggctgagtcaaaacagcctgttcctctaacaatttctcaagctccagaatgtgttgtggctgttctttcaaggagagaatttgagcagtcagggaggagcattgtgttggtagtttgaactgaatggaagtctagagtaaccttggcctgcccaggcagcagactgcatagaaggaataagttcaccggaggtccctcaacttaacagcaagattttttaagatcccttaaccacgaaaccagaaatctccactcctaaactatacaaaaccgttcacttaaagcccctaggcagtatatatgggtggtttcgctgacgtgacatcttagacaacaaaaaaa

SEQ ID NO: 14941 - DNA, 1501 bp, Oryza sativa
gagcaccaccacgagataaccagatcgaattgcccccacacacgcacctgcacgaaggcggcgactgaaatggaagcgtcgatgacagcgagcgcgacctccgccgagataacaggcatcggcaggcatcccccgccgtctccggccgcggcgccgcgggacatgccgtggcggcccatacgcccgggcaacgacgagcggcggcgaaggaggagagagaggaggaggaggaggaggaggaggagggtgaggatcagggggccagagggcggcggcgcatctcgcggcgggcaggggatggcccagggctagggtttggtgcggaggccggagcagcaggcgggagcggaggcggaggcggaggcggccggaggagggtcagggaggaattgactggaggaggccgcgcctgttggattggaaagcgccccgagacctcggttttttagtcgtggtggcctcggtttctagtcgtggtgtggtgccggggtgcgtggctgcgtgcgtatgaagtgtggtccatggtgatgcgcggggggatccccacgtgaggatgggggcgtgtaaaccgtgaatatgcgaacacgaagggcccggaataccggattgatgggctggattcacgttcaccgtcggtacaacagtaagcttacgttggcgtacacccagggggcttacgtttgttcgatgtagatgtactacaatgttgaaaaaactcggagtaccatatgaagtttgttcgattttattttgaaacggagaaagtataggatagactatttttattgtgtctattttgtttaaatttctagatagataggattagtttttcattaaactatttttattatgcagtatatgtatatctggaacttttttctatttatgttgaattatccatactcctattatataggatgttattgttagcgtcgtccttgtaagaaaagcaatctgatcgaccttagtacttataggttgtttataggctattgacaattggcctaacaattagaagacaaggagtgtggttgtgtgtggggcgcaagtggagcgggagcatggatagacggggaggggatagagcatggatagacggggaggggattgcgagggctttacgctagtacaccactagatattttctttggtcacgacttaaatcgacttttttttttgtttggatgaaacattagagtaaactagatgaaaccccacgcattgcactgggatattttgctgagattggtagttgaatttgataggctaaagtggtataaaattatttaaagaaatattgaatttgatctaaggctcttgatgtcattgactatcttgctaaagtggtcatacatatgttgctcgggcttttagcattcatcacaacaaatcactcgaattgtcccttcaagatctccacatttgactcacggacgctatcaatttagtttgtgaaaaaaaaaacgcccaacatgacatatcaattttggcttccaactgg

SEQ ID NO: 14942 - DNA, 1501 bp, Oryza sativa
ggggaacctcggccacctcttcccatcgccggagactcacgggacgtccgctattccgtgcgccggtgagcccttcctcccttcttttcctctccggccggccatgtcgttgccccgtcctccctaacagttccccttccatcctgtggcgcagctgccgctcgtccgcctgttcccgagctcagctcgtcaccggagcgtcgtcgtctccgtccgccccgagctccgccgtcgccgcctcccgttgccatctcgccgccggccgcatccttcggccgtgtgccgctcggtgagctcccctcccctttcccgctaccctccgccgctcacccgcgcgtgctgccgcgccggtggtcgtcgccagtgaccatcgggccgcgcgtcaccgctcctggccggtcggtcggcgagctggctcctgcccgcccgtggccgcccgattcaccccgggtgaatctgggccgtccacgtggccgctcggcgccgccccgcgtcggtgccctcgtgtcgccacgccggcgccaccgctgccgctcgtccgccgtggccgtccacgtggtgcgcccgcgcacgtgccgcgatggactgagtccaccgtgcgccctccccttgtgccgttgacgtgtgggacccgcctatcggcgtcggcccctctcttgctgacgtcagcgacagtccttttcctttaagaaattaattattaattgcgcaataaatcgttaaaaattctagaaattcatttaaatggctcaaaacttctaaaattcatatctaattgattcgaactccgaattgagccattcaacttgcaaaattcatataaaattgagctctacatgtttgtttagtttttatgtactatttccttggtttttattagagtttttcctcattttgcgtgcctgcgtgtagaatccgtcgtttcggaagtccgcggtcgcgaggaaaagtgttcggaagattgtttgaagaagcaaggcaagtcacacattccccttgagcattttgatcctaatttacaaatgttttaccgtttgcaaataaaattgcatgtcttgctaattacatgggattagggtttacctatctgctcgcttgtgccatgtttacttgatatctgtccttcgtcaacattgggtaataaatcgactagctcatgttacttatgtgacctagctagaactatatgcttagccatgcttaattaccactagctcagttgatgggataattacagtattagaccttttttagtatcagaatgagctgcgtgctcgagacatctggccatgcttcatggtcgtaattatccaactaaaatgcgattacatggtgggctgtgggtgcatggttttgctagtcgcacccatggcaattaaggaccggttcgcgggaaaccctggaagaatttatcgtgcttaccacaagccagcgtgggcaacggctgggcttgtagtgtagctttcctctagccgacgcatccaggcaagggtgggcgtga

SEQ ID NO: 14943 - DNA, 1501 bp, Oryza sativa
atttcacctaataattaacacactgacaacttcatgaagctttcaccgaaaatatttgagatagatcacgtgtcacaggccggctcaataacatggtacaacttagattgggagtataattaaaatgggcatagctaggaaggcaacagcatagaacattgacaacataatgatcatgcatgtattaagacattgacccactctggcaaaatctagtctaataaaaaactcacaaggttaattagaacattcagagatggatctcatcatgtcctgatggtatacttgtaaatgcaagtcgctttaatcatacaaggatggattttaaaaaaataaactcttccaaaacttatttctaaacatgaaccttttggcatggcgagacaacaataccatgtgcaacccatcatggcgtgacagtgttgtttcacctaagtggggtggtgtgaccaaaaggtttggattggaaataagttttggaatagtttacttttgaaatgaaaaaataaaaggttcaaaagaaataataaagaatcaaaaggatgtgataagaaaataactcaaatcaattaattagttgctctttatttatgctacattgaaagaaatgagttttttttaaaggaaaacaaataaaacagatgaaaatgtgttataaatttagggaagaatttaaaagcaaagatgacgacttattttcagttagcaactactccactatagctctaggtgaattggagagctactagctagggatctttgacttttgccttctgtttggttaatttcaactttcaagtatcatcattgcgggacgttgactttctaatcctagtgagcaatcaaactttgataatcgtgtcacattaactaaatgagacccatttaagtttaacaaacaagcgttttgacatagtaaagtaattgctgattatcaatggcaaccccttctcatgtaacatccacgattttcagagctcaaggatttgtctcagcaagggatggcaattgtggagattatgggtatcccatatctacacggcgatggtattcgaactgggtacaggatacctaatgtagatagaatatcttatctgtatctcgggtttgtttcttaacttgtgtatcaaggaaacaccctgagacttagtcggttacgactgtatcttacttatattttcgtattccgttagggatatagattatcttttgtaacccggactccttccccatatataaggggggtccgggcgcctctaggggcatatgctgatttttcccgaatcatacaatcaataatacactcggcggattcatccccggacaggagtagggtattacttcttttataagaaggcctgaacctgtataaatcttttgtctccaaacccatacactttcctagcttgatagccacccccttttattattgccgaaatctagtttcgacagttggcgcgccaggtaggggtagcgtcaagcttttcgccgatcagtgcaa

SEQ ID NO: 14944 - DNA, 569 bp, Oryza sativa
tgacatactccaattgtcggttcatcaccgtcactttgtgcaacccactgtttgtttaacaatgacttgttaacattgttgagtcatgggggaaaaatgtgagaagcatatatcaggtatcatgtgagaggcatttagggcgtgtttggttgctgccctcgcctgagcgctatcactcaggcaggtcgatctagccgcaggtgaccgaaatcgaacgcctgagatcgacgcctgagtcaggcgtgattcccagggtggcatccaaacacgcccttaatttcgtgcacaagtgtgtgtatacaagcgggagatacctagtatataatgtgacattacctagtttatgaatctagatatgagcatgtcagaatcatagtaacactagcaatattttaggttaggacggaggtaattaatactagtacttttcttttccttgtagatgcttgctttcagattttgttcaattgataattggaggcaccattgcctggctatgggcaattaccaatttactggtaatgcaagcatatgtacactatacgatacgagtacgacgagtggctaaa

SEQ ID NO: 14945 - DNA, 1501 bp, Oryza sativa
gcagaggcgcagcgcgtgcggcccagcccggacgagggcgacccggcggcggtcaggggaggcgcggaggagggtccggcgacctcccgccggcggccacagcacagggcggcgcggcatggccgccatggccgagctctagggtgcaaggggactcggcaaatggcgaggtctctaaccaattagtttggcgcaagagcttgtacagcttatggtgattccgttttgctagctaggtgggaaggagagtgctcgaggtgacctacccacggcgagcccgccgatggcgaagcggcggccgggacggcacgccgaagggcgctaatcgccaaaactggtgggggatttagcttctactccgtactagactaggaggagctataggagtgaggttttaccgagagacagcgggatggcgaagttcggcggcgcgcagctcagtgcggacgaaacaggggcggctagcggcgacgcttgcaggtgttcgatgcgtggttcccgacgttgatccaaggcagcagaggaagtagaggcggcccgagccacggttcccgcggtcagctacgccggcttcggctccaaccggtgatgatgaagcatgcacacaaggtgttcgatgaaatgtattcgaggaaaaggcagatagggatgaagtttttatgggggcttggcttggggataggccaggatggcgtggaggataggatcggcagctggtgcactcaatggctgtctagattccttctccattaaggttctgtctatactgtgtgttctagccggccctagctggagaggaaggctccgttcttacccgccggcatccgcatggtggcggacgtggccatggcgatgcgtgcacatgggagctaaggtagtagttggctagggctaggggtgacgcgcgatggcgacggcgcgttcgtggcggctcagcttttgcgcgtggattcggcggctcggtcgggctaggtctctggtcgaccacctggtggcccatgaacagtagcaaaagaaaaggaaggagaagataaaggaagagagtaagggggctaatctgtaaaagtgacttggataggaatttgaatgaaatgtagctctatatattttgtatttgagaattcaaatgtttgatttgaatatttattttgttattcattagttcccaaatgaatttgctttccattatattatccaaaaattatccaatataacttctaggctttgatattccttaaaaattaattaaatattccaatgtgacctttaataatacattagcacattggtcgagtttatttgtatggcaaagtattgcatatagataagtttaatctatttaattaattcttactccatgaaggcactgtgagacttggtgcaatatcggtctaaatattgaatcgagtactcatataagccctttttatatatagaactcaatttatttacatgactaattattttatgcgagtaaattttattccatgagagcctcaat

SEQ ID NO: 14946 - DNA, 1501 bp, Oryza sativa
gaagtctgcataatgagatcccttaccaaatccttctgagctcaccttacttctgcaagaaagaaagaagaaagaactcatgaggtaagtaataaaaaaacaaagttgcaagttaattacaactcaaacatgtacgccaacacaagattatctggttgacatttcacttgcaaattgcaaactttaaatgcaagaaaaagcaaagtacagtggtgaaattgtactgttaccgtatcaaaaggtacaggttattagcataggcatttttttagaagaaacaaacaacagtttggaaagctatggagtagcaaagccagtacttaataaaatggcataggatcccactaatttgaaatttttacagaccaagaaagatgaaaggaaagtaatgtgcactacatttcttctcacacctgtaacctcaggcagaggtaacagtgcacctagttgcccacagccacaaccacaaggacccccaatggcctttggcagcaggaatccggcaaacacagcaggaacccattcacacaacaaatgtaaaaaattgcaggaataccaaactgcccttgattcatccaacaccatcaagatgaacagcatgggctagaatggtcattctctctcaagaggggaataataatagcagccttacatggaatggagcaatagcacatagcagaaagtaaagaaagggagggtcaaaaattcaaagtgagaagaaggctgcagtaaacttgcacagttacagagaaggccctgtgtgtgtgctggtggtaaagccattctgccattattgtgaatttgtgatccccatgggtctagatcctgaaatgtgtttgcccatgtttgtagctggttcagtgaagcaatgcattcatgtggcaagaacctgagcggccaaaggattaaaattcattgcagatggagtgatgggaggacctgacagatgcaagcagcgtgattcatgctctcagctaaaaatatgggagctttaaacgttttaaaaactgaaacttatctgcatttcttgcagtaacggcaacgccattgtatttcggattaaagcaccggatttctagtgctactattaacagtattaaagggtatttattgctaactctttctcaggttgcggtttgcaagaacaagatgagaatgagaagaaagaaaagaagaggattcaaaaggaatgaaccttttttaaggaaaggaatgaacttactcctcaaaccaaataaacaacgagacatgaaacaaagagtgcaggaaaaacaaaagggatgcaatgcaaaaggagctagcaagaagaagcctttcttgatctttatccctagctattgaaacacgccatggacatggagaagcccagcaaccatgagagctctcaccctttcttcctcctcctacaacaacaatggccatggtccatacatacaaagaacccaagaaacaaccccacaagacaatactgcaagcacacacgcatttccgcaaacagaag

SEQ ID NO: 14947 - DNA, 1501 bp, Oryza sativa
actgcccccgggtcggtcgccggcgcgagcactggagtgcggggggtagaaaggtaaaatcgtgggggtggaggtgtgaacgcacgggccccgcgtgggaggggcgggttacgcgtgtcgggcccacatggcagggactctcgggccgcgtgtaccactcccctccccgcgtagcactagctttttgctgattgattcgtctcggctcgaggggcttaactcggtttggtttacttttctcttttgatttgatgataatgaattgatctaatgatcccctctgcaaatggcgactggtcaccggagtttgatcggatttgtttagttttgcgatttggttaagctaaacctcgccaattaatctggctgctgatcctgcccttttgcagaaaagccctccaggattgatggtttttgtgtctgcctcaaattggccatgcatcaacatgaagtatggccaattattgtgcatcatgtcagattgtcagtatagtcagctgatcactgtagtagcacagtgagaagaagatgaatacacaaacaacaatctttgctgatatttttcatatccacaagaggggcctggcctatttggaaggtatttctatggctacgatatataaaaccaaaatacgcgacgactgaaggaatgaaagataattttaggataaaaactatatgattgtactcttggcagtcaaaaagttcaaggttgagaaaacccattagactaattctagaattagggtctgaatttagctacagcttataagtcgtagctcaaacaagcatgctcgttaacgtattcaaggcaatacatttttaacaatgataagaggagaccggccgatttggaaggtatttctatggttgcgatatataaaccaataatacatgatcataacaataaaaaaataggataacaattttgtacttctactcttagcagttccaaagttaaaaggtcggcaaataaaccattgaattaattctaaaattacgacgtaaaattagcaacaacttagaaatcgcggctcaaacaagaagggctcttcaagtattccactatagtaaaatgctcgtacctcattctatgcaaaagatgacaatatttcattttaactttgtaaggacccaggagtaattacaacccttttagagcccctcctaccaaaaccccctgagagagaaagctaaacaaaaactagaaacattctcagttccagaagaatatttgcacccacagaaagaaatcatttacaaaccaaagattaaacaaatccaaacaatcatgattagctaagaccacttccccctaaaccccaaaatatcattaaactaatcccctccctaatcacaatcccatacatatatacacccatccatccatccatccacacatcaccacctcaccatctccatccatctcacccgttaacccgctaagctctctctccaagatccgcttcggtttcctctccggcgatctcgccggcgacca

SEQ ID NO: 14948 - DNA, 1501 bp, Oryza sativa
cgcctggcccaacaggtaggagacgggtgctgggcctgtttgtcttgggcctgccttgcccccccccccctttctttttttttccctctatcttccttattattcttttcttgctctatttcactcctacatgttgtaaagaaagctaagtgtaaaattataaaattttatatttaaaaggatgtcacgactattttttattacaaaaatctgagcatatataatctaataaacaaactggtatggacttagccactttctaaaaaaaaaatcaaatacatacattgtacaactatgtaacaaaggtttattaccctaccaaactttgaaacaccaataaaataacagcactgctatctccaaagaaaattataaactaactcaaaaatactgaaggcacaaaagggctatagtaaaaaagaaaatggagaaaaagtaaagttaaataataatgctacatcaatcatatatatgggaaggtaataatttcaaatcgcgcgtgaactcatttgaagtgatgatcctatcaataccatgatgcgtgcaacgatattatgctaagtcaatgtacaaacatagcgttgtatttttaggaaaaagtacgaattacctcttgaactatcgtagacgactgaattaccccctcgaactcgaaaaccagaccttttagaccctcaactattaaaaccggacaaataaccctcttaactcaatccggagtggtttcggtcctacgtggtatatgcgtggcagtccagtcatcaattcatttaaaaaagtcggtggggcccactatcaggtcactcccctcctacctctctccaccaccagagcaaaccaccacctcgctgctgccgccgccgccgccgcactcctcgtaatcgaccacccgcgcaagcatcacctcgaccgacgcgcgcagcagcgtgtccaggtcgtacggccgctccggcacgctgtcgaggaacaccagcttgttgccttcgcctgtcatcatcgccagcgagtgcgactgctgactgcttgacggcgacgtccttgtctcgctgtccgtcctcgccacggtcaccgtgatgggctccgtcatgtcgggggtggccgctgcggtggtggtgctccgaccagccgttgctctgctcagcgccggaagcatgccaagtaccccacggcgagcattgttggctcaaaaccgggagaaagcctttctacaccccaaaagctagctcatgaggtgagggacccctcccgtttttaagttggtgccactccccctaaactttcaatgtgggactattcccaacaatctctcccgtcacacattggtgccccttagccctgaccaggctccacacacgagcacatacaggcctcacacccgcggtccactgactggcccaacacataggcacatacgggcctcacacccgcggtccactgggcttcgggcttacaccacacgagtgtgcacggcacttagagagattgtgggcccagctctgat

SEQ ID NO: 14949 - DNA, 1501 bp, Oryza sativa; identical to SEQ ID NO: 14947

SEQ ID NO: 14950 - DNA, 1501 bp, Oryza sativa
tcaagcactaagcaagtataagcagcaaggacaactctttctttgtcaggagaacgaccgaaatgagacctgcatcaatgatcaacaacactctgatcgataaacaaaattaattgttagcttctataatgcagcttaattttgtactaaccccgttgataattgccaagctattgctaagatagccgccgagagaaaagacaaattatccccccgggggggggggggggggggatgcaggcaccgactcgttttggtagcggttcggcggatgatcgatcccttgcttggagtcggggcggtttttgtggggtttctcccgggccatccggggcaaaagtgctgcactttgacgcgtttccgggagagccagcctagctgacacttttgacactgacatgatggtttccggggcagagcggtattgccattgccacacctgcacctgcccatccagcaaatgttaagatttctacagtgtctagagagggactagctacctctcctgtgaatttttttaagagctatatgatgatcgttccgattctttcatatgatgctgatattctctctctatagctgtgcttagatctaaagtttagatccaaacttcagtcatttttcatcacatcaacctgtcatgcacacacaacttttcagtcacatcatcttcaatttcaacaaaaatccaaactttgcgctgaactaaacacagcctatttcgttttgcgtggcttgtgtcggtccgttatttgtattacatgatgccataaatgttctgtttttccatccccaatgtaaccattcaaggtttgccataccggttatgttgagttttcttttttaaaatgaaaagcggtgaaccaatggtgtgacctatgattttgagctaacatggaaccgtttaggattaccttactggttttaagggttacagcaccgcttggtcactgcatgaacaatgaaaaatctttaacaaaattaatatgatttttgaaaccaactttgtttctgcaaaaaatacacgacagtttgaaaaacgcgtacttggaaaaagagactgtgggagttagaaaagtacagtgtactggagaacacagcctagcttccaaatcttatccttccgtaatccgtagctcttcagaatccaatggctacaaggaagagagtttctcccccaaaggtgaaacggaaacaaagtccagtccacggaagtgcgtgtcacgctataataccgactcaaaacgattcccttctcccatccatccagctacaccacgtacactaccgtgcccaactctgcaacccaaagctgaagaggctgcacctgcacaaaaccaagcaagctgtgacggctcacgagcgcgtgaccgcgtgagagagaaaaaagaattgaatactagtagaagacaatggttcggtgggatggccaggtcgagacccggtagtagcagtagtggtgcagtggccgggcgcgcgtgatcgcgacttccccgcgcga

SEQ ID NO: 14951 - DNA, 1501 bp, Oryza sativa
catccgagacttgacctgtgctgcgcgcccaaacctagttcttgctacgttcaaccatggggtctaccagcaggggcttaccggccgcggcaaatctttgctcgatctcccgccattgatcgacgtgaccagcgtatccgctcgaccccaatctatggggatatttgttcttcttcgcgagctcggacatttttttcctcaaagccaatgcttcagctgttgtacgatccgcaacaaacgtgtcccagtcagcctgcgatatatgtccataatccgtaaacggtgggagattcttctgaacataatcccgatttagatcggacttccactgtcgccatcgatctcccatctttttaagtgcgtaatctctccccctgacctctgatccaggagggaacacaaaatacttctgcaactcattccagagaagtgtcttgatgttgtcgtccactgtttcccacaacttgacattaatgggacaacgcgtcctgactagagtgccacaggcgttgatgaacttggaccgcactatcggtggctcgatgggcttcccatcctgatcgagagcaatcacgttgtaagtttccttgggtaatttattcttgcttctctcaccacgtctttttttcccactcccgcctgcacttgtagatgtctccgtacgttcaggtgcagacgtagcggtgtccatctcaacttcttgctctgtcctgttcctcccggctttacgtttcgagcggcgtcggactaccatctgcacagaataggtaactctatacaccattaagttcatgtcacatcatagttagggaataatacatggctaacgattttcatcacttacggcctgttcgataggtatgtagtccggatcatcatcgcggggggcgacttgtgttatttccattggaaacgggtcacttggtgtgcgccacgtttcttcactagaagcgcctggatgcttattgctaccggaattttgaggagcgttaccttcttgaggcgctattggtgcgttcgatggaaccttttcgttcgacatcttccaacttgacgtaaaaaaatttgacataagtcccaattttacgtaagtcccaatttaacgcaatttcacataagtctcaatttgacataagtcccaatttaacataagtccgaattatacataaatctcaatttaacataagtcccaattatacataaatctcaaattaacataggtcccaatttagcataagtcacaattaaacagaaatctccatttgacataggtgccaatttaacataagtcacaattatacataaatctcagtttaacaaaaatcacaattatacataaatcccaatataacataagtctcaacttaaacataagtcacattttaacatagctgccaatttaacaaaagtcccaattatacataaatctcaatttaacaaagtcccaattatacataaatcccaatttaacataagtcccaatttaaacataagtcccaat

SEQ ID NO: 14952 - DNA, 1487 bp, Oryza sativa
gtcggcatcgtagcggcgtggtcctcgtcgtcctcgtccccgtgcagccgctgccggctgtcctcgtcgcctcctcgccggtcccggtcgtcgtcgtcgtcgtcgtcctctcgtcgttcccggtcgtcgtggcgttcgtccctccgtcgagccgttctcgtccgtcgtccgcgttcgtcaagcgagccgctgcagccccgtcctagtctccgccctcggctccgcgtcgtcaagccccgtgccggccgcgtctcgccttcgtccaaggatcgccgccgaagccgtcccctcgccgttcgtctccgttgtgcccgtctgtctccgccgcgcccgttcgtcgttgtcgttcccacgcctcgtcgcgtggtggtaaggatccgtcctctcgcttccccgccctcgtcctttcggcgtcgccccgtacccgttgtgcggtcgtcgaccccggtacccgtgtaccggtgtcggtagtcgttcacgtgtgcgggtggtgaccgtgtagtgtccgtgttagtgtgcccgcttggtagccgcgtggtttccacgtgtgcaacccgtgtggtgtctagtggagtccgtttgtcggccactcgcttcggttgacacacggggtccgcttccgtcgacccgtggaccgtctctgtgtacccggtctaccgtggtcctttaggttgacatgtggggtccgcatgtcaacggcgcagccttcctgtcctttccaggctagcgcttacacatgttttataattgcaaagcttgattacaataatccgcaaatctccatataacagcattaaacctcggatgatcatatcttggtcatacgaactctgaatcgacccgttcaagtctcctaatgtttgttataacctaaagaaccctgtgctttctttttatgtgttgttattgcttctttataggcttgtagctttgcttgtgtgcttcgcgtagcttctgtcgttccggaggttcccgaagcgtggttcgcggtcgtcgccgaaggttcggaaggccgttctctctgagcaaggcaagtcacatcatccttgagcatattgaatcccagtttacaaaattatttttaatttaaattattgcattatcgctttatttaaattcccgcgttatcactgttttatctagccatacctatttacctttgttatgaccttattattattgttattgttattattaccttgttcaccctagaataaacaaaaccccaactagtggacattatattcatggttccactagtataaatttaggtagatgcttcgctgattaattaggcaacattaggtggttttataactttagactttgggaattctcatatcatttggacactatggaatggttggcttatgttggaattggacacacacctccccctcttttcaaaacccccataatggtttaggctgggctcgaggtgcgtggttgggttttgttagtcgtacctcgggtactataaggattaa

SEQ ID NO: 14953 - DNA, 1501 bp, Oryza sativa
ttaatgaaatagtcccaaaccttcgaggtacacttcttctgcctctttgctaccggttcaacttctcctgtgaattctccatcttcttcatcgggaataacaacaggttctgaacttccacctccacctccagtggctgtggttgcatcatttagtaccaatgcatttggtgccaatgccgagtgaccagtaccaacagctacggtaccagccggagatgcacctgtgcttgcacacatactagtgtttgcatcaccactagccattctatcctaatcctacagccaaacagcaaaagtaaaataagaaaaaaaaatccttccaagttctaacgtgatgttgagaaagggcaatgaaaaactgaaactttggctaacctggatggctggatgagtcgctgagtgttgacttgactacccaagaagatgacgaggtggcgcgacgtccttcggctctcggcgttgaggagccaaaagaggcaaggggccaggcggggccttgcggtggtggtcggcgcggcggcagtctgacggtcgtcggcttgtcgcacacccacgcggcgacgtgcgacagcggccggtggtcggtgggcatggccgcgtagccacttggtggtcggcgaactgcgaaggcacgacggcggtgctggagcctggatgcacgcatgcggcgtgcggcgcggtgctgcctggctgtttgcctgcctgcgttctgccctgatctgaactgtgaagtgaaggctagggtttgtgcttggcactttgtttggtgggccttttggatgtgggctggctgttgcctgttgtgttggcctgttgggtgcttgcctgttgggctgctgtccatctatccgggtaatatacggatagattatcgggtaatacccgcataatttcccggataatccgtatccgtcggataccgctctcccgaacccgatctcatatccgcaaaaaattacccgtatttgaaccctgtatccgtgtaagggtccgggtacccgaattcccgacccgaatttgacccgaaataatgtggccgggcgggcggtcgggaaatacccgccccgttttcagtcctagctgcgcgtggcacgacatagttatttgggttctgctttagaaatacttttcggaaaggtctattgataaaattaaaaaataaaaaagtctaaaaagaaaaaaaaattctacgttcacccacccaattaatctgttcctaaaaatcaatatataatttatagaactctagttgtaaatgttgtacagagagatgagatgatcgatcgatccggcaggcaggaccatcactccagcccgtcctgctgtcatcttgagctgtaatactccgcacactgtccaagtgtcgctgtacgtggaagacacaagaggcagggcatatggccagattctgtcccaacaccaccattcgtctggatcggagacgtcgcgcgcggcgcgccatatcctgctcgcgtttccccggtttttcgtattaaaac

SEQ ID NO: 14954 - DNA, 1501 bp, Oryza sativa
ctctctcacgttcaaacgggcggatttgcccccgcaaatatcgccggcgccattgatggcggccggacctcccgcgcctattccttccccgccggccgctctctcccctttccaactctatttaaaccctccccgcacctcctccgtccgtttccgcctctcgccgcccttcctcctcgccggaatcgagctcgcgccgtcgctctctctccgccgtcgccgtcgagctccggtccgccgccgtcgtcgccccggaccacctcccacctcggcgccgcctccttcggcttcgccgcatcctcgccgacctcgtccacccctccgtttcgctcgccgaccgccggaacgccgtcgaccccgtcgacccgagccgcgccgccgccttcctccgctccggctgcctttttcgtcgtcgctgtcgacctagggtgagccgtggaccgccgcttctttttccccttcccttcccctctctcggccgccgctccgccgtgcctatggccgccgccggcgaccataggggcgcgggcgccgcctcccgccggctacgccggcttggccgccctcgggcgcgccgagtggctgccgcgtggggcccggccgtcagccgcccgcgccctcgggtgcggctgacgcgtgggacccatggcgccggtcggtgtgagcccaggtgcacccggtccaccgtggaccgtgaggctgccgcgtgggccccactcccgtggacccggtccgcgcgccccctcccctcggctgacgcaataagcccttttaaaattaaaatttaaatgaagaaattcgcaaatattcatttaaagagcatataaacttcaaatgaccataacttggccatttgaactcggaattggaccgttcaagtctctaatttttccttaagaagtcaagaacctatttttgtgctttgttccagcttgttatatggagtttattagagtaaaagccttttcttttccgttggtcgtgtagacgccgtagcttcggaagatccgctcttcgtggaagttgaagctgacgtttgggaaagcgagcaaggcaagtcacatcatccttgaacatattgaatcccagtttataaaattatgttgatttaaattattgcattatcgctttatttaaattcccgcgttatcactgttttatctagccatgcctatttacctttgttatgaccttattattgttattgttattatttccttgttcccctagaataaacaaaaccccaactagtggacactctactcatggtaccactagtatgattttaggtaaatgcttcgctggttcattaggcaacattaggtggttttacaactctagactttaggaatattctcatcacctggacacttttgaatggatggattattgtggaattggattcacacctccccctctattcaaaatcctcaaaatggttttaggctgggctcggggtgcatggttttgatagtagcacctcggccatataaggaccggt

SEQ ID NO: 14955 - DNA, 1501 bp, Oryza sativa; identical to SEQ ID NO: 14817

SEQ ID NO: 14956 - DNA, 1501 bp, Oryza sativa
tttttacggtttgaatgtaaagaaaatatgccttttttaatggtaaactctattttttagcccttatatgttatttttaatacattttccaccctaacctacaaaaattagtagttttttagacaacacagcgcacccaccaccccccaccccccgcgtgcgcaaaaaaaaaaacacccacccacccaaaaaaagagacaaaaacctttaaaccgaataaataacaccctattgtaataaaggtttaatttagatttttattatgcatagtttgttatttattgggtccacaaccataaaactaatataatcaaaaccatcatgaaatttggtttagggaattatttatccagttttaaaagttgagggtgcaaaacaaaaggcactgatattataatgtagggtgaaaaatgaaatcgggcaaagtgtagggagactttacaagtcataaattactcatagcaaatctgttggatttttctacggtctgaacacccatgtcatcaaattggttgccccaaatttgtcacttgatccaatgcatggctgaaaaattcacaggtgcctccgcacacgccatggcccagcaaggcagacgatgtgaatcacatcatcctcccaaaagcttcacagcctattcttggccagttgcttcgccctcaaccgaaacaaagaaaaaaaaagggagaaagaagagggaaaaagaaaaaggaaaaaaagggaagaaggcacgcacagggaagcaatagcaacgaattcaaccaaccaaccaaccaacccttctgctgcttcaatcgatcggcaacaaatctttctgggtggtctggtgctcaactcccccatcgccattttatgcccgaacctgtttctccagccaatttgatgaggattaatttccaaacgggctccgatcgatctccatgattaaccatccggcgtggtgatgagccgccgccgccgcatcgtcgtcgtctcccgatgcatcgccaggacgtgaggacgaaggaggccgaggaggagaggatggaggagaacaatctcctgcattttctagatagcccaaacgcgcattacagaaggtgccgcattttatcagtatatctgtcgggtttccttgcgaatttctctccgttttttgttcatgcaagattcagtaagaactttttttttctctcttcctctttttttttttataaaggaaatgtgaagaatacgtatccgcgcatgatgatgaagcccattgcgatgcatcaggtttttccccttgctccttcctttcctcttcacgttcatcgtggttaaactcattggggatctttgaaacgaatagattatagatctacgaaaagcttcacatgtatactgaatatcgcacaatgtcgaattttgttggaggagatttccatgatttttaactcttgttattaacattgtgcgaaactagctcaaacgggttaaatggctctcaaattggcattgcatggatggttcttccttggag

SEQ ID NO: 14957 - DNA, 1501 bp, Oryza sativa
gccgtttgcagcgttgcttggtgtctcagaatcctcacggatttcacgccacggcgaccgggaatttactaggagcaccccgtgcagaggcaaaagtctagtgtttacacttcgcacatcacgcaggctcgcactgtcaaagacgaggaaacatgggtcatggagtatggagggtaggtgcgccggtgtcccggtaacatgacagcatgttacatgatgcagtgaagcatatgtagcgaaatttcctgcgtcagatgcagcagtgctatgaaactcaaaagagttttatggagtgtgtagtgtattggcatttggctgtgtggtgatgatctttaggacgatttttgttaccaacgacttttccgggcgatgatcctatttgaacccctttctgttactgtttcttactagaagcttgaaaccaacagattgctggataatactacagttatacgagtacactagtgatatgctatgccccttccctttaggtttggaagttgacctgaccagaacaaaccatctcccctaggggaagaagacgttaatgacgaaagcacaaggacacgaatacttttcagggctgccaaccttgtaaagaaggaaaaagaaaaaagaacatcgccgtcgaagttgatgcgggccgaatcagtcgccactcaccaaatttcccgataagttcgatatgttaagtgtccgcaataaatgttaaatgttgtgtttagttcagcgcaaagtttagattttggttgaaattgaagatgatgtgactgaaaagttgtatgtgtatgacagtttgatatgatggaaaaggactgaagtttggatccaaactttagatctaaacacagccaaagatgcaccgacacaggaaaattgctggtttctccgtatcgagagaagacatggtgagcatagtcaaagcatctcccacagccacgcgcgtggaatcctcgattcacctatgtatgcttgtatcaggggcggatcacagtagaaggaccggtatcacgacaccgataattttcggcaaaacctataacaaaattgtttatccatatattataacatcatgatctaattataattagcatatgtcggtaacatggggccgagggtatcgtgactagaggcttgggtagccgcggtcacccacgtggcctgaccccctcgggggggtcggacccgaggatgacgtggccacccctccctctgtctccccgaggggtcgaaccgctcccgtttcggccccgagggctggggcgccccgaccccctgtggttttggcgccacgcgtgtgggttaggtgagcacagcggggctcacctaaccgcatttatagcgggattggacgagcgcgccacgccgcatttaatgcggcgcagcgcacgcttatccggtccgcgactggtcgcggtgtgtgaccggtcacagaccggtcagatcgcgggttaggtggcaacaggcggcctgtcacacgcctcgccccgtcccgtcggaa

SEQ ID NO: 14958 - DNA, 1501 bp, Oryza sativa
atgctttcccgccgtcataaacaatgtgctgtaattttcagagtcctcagggtttcagatccttattatttgtccacgagacttagagaaatgatacagtggcgcatttgataattggtaatattatgtgatagggaggctcacggtcatggagaatctcaccgacccggatggatcgatggatggatggatgcagcggtggaaggcaaagtcaatcccctagctgggagtttggtcggcaaatctgaagaccggtgatggagtagagtagccatccagccactagtggcgcatttcgtctagaactagtagtattacgccaagttttctttttttgagaacttattacgccaagttggaatagaattacagggatttcttcctctacctcgcctatcttacaacaggtacaatagcagactataaaccagctataaacacatttcgagaagattagagaggatagaaaagagcagcaggatatagatttgtagatagctgcaacacaaactccaacatgcatttgtatattacaggtgggacaaaatattaattgtgtagtattccctccgtcctataaaaaacagagtctagaatcggatataacatgttactacgaatctagacatatgtatgtctagatttgtagtattatgatatgtaacatccggtattatattggttttttataggacggagggagtatatgtttatagatagctattgaatgaattaactactaaattgactatatgactatagatgatttaaggccggttcttctaattagcttggcgccaacaactatccgatcgagcactgaaatttcgcatgtcgcgtcgggcgggggggagctgccactgccaccttaaagcgagccgcttctggaacgagatctccgctgttgcgaaaatcttccttgggactcgcgaaagacggggctcgaatgactcgtggccactggattttaaactacgcgcgagcctacttgcctattgccgggaaggccacacttttgggccttttttctcatgctgcgtccatgacaatagcatggcatgttggggggatttgttcattctctctcccggttcaggatgagcccccggtatcgatcggataatttttttagcatgtgttttttaaccatccaagcagaaactccaagttgttgctacttttgaaataaaaaacaattgagaaaacctcaaagaaaaaagagcaaagtggtagctacactaaattgcaagtttgtccagcggatataatatatttaacagccactactcctctcggtgaccttatttccacctgaattatatgcgatggaatcatggaataataactttgtaagcagtagtagcagtcaggtatccctaaattgcaaaattgtccagcggataatatattcaacagccactacttctctcggtgacctgattttcacatgtattatatgcattacttttacatggaataataactttgtgaagagtagtac

SEQ ID NO: 14959 - DNA, 1501 bp, Oryza sativa
ttatagtcggtttacagcctactattaaacttgctcttaatcgtcttcacggctgcatgagcgtgtgaggccgtgctagcaccggcgccagattagtcgcccacttttctctcccttctcaattttttcccatccatataagaataagatgatatgtcgtattttggagcatgcatgctgaatcagtttattgtatccgctctaagtaattttcatggtgtgattcgtgcacaggggcggatccagcatgggggcagtggtgtctcgagcctcactacaggtgtgaagactatgagaacctccacgaagaccccactaaatttttttaccatacgtagatgggttggtggactataactttatatagtttgctcagatcatactgctatttttttctggatccgctgttgttcgtgcagtaggtgcgggcatgtgtccaccaagtcggacatgttctgcttcgggccttcggggtcattgtgctcatgcgaagaccgatgccgccaacccccatcacggtccaaaattgctgagctacgtaagcacacgcctgacaaaaatcaagcagcaccagtagatactagtaccctgtagatgaaacacgcctcactacacgctgttacaaactgcacacctatagatggccatatggcccgcagcccgactgcccggcccaagcacggcccggcccgtcagtgttcgtgcccgtgccggcctggcccgacagccgggccatgcctaggctcccgcagcagcacgctgggccggcacggcacgatgggccggcacggcacgatgggccgacacggcccaggcctgtataacggtaggcacggcccgacgaggcccatcgggagccgccgccgcgtgcccacgcctcatatataaaggccaccgcgtcctctcgcctccgccagtccgcctccctcacaaccctaaccctaaccctagccgcctccgccgatccacgcacgcctccgcctccgcctccgccttgaccgctccgcctccgcttccgcctccgtcgatccacgcctccacctccacgcgaccacgcctccatctctccatccctctccgtcgccgtctctgatgaacgccttgccggatctaccaccgagggtcgctgcctcgccggatccgtgaccttgtctcatctccgcctctccagtctttggatcgttggccgtgctctcgatttcctctttctttttcattttttttgccactatcgcccgctcaccgtttctccgtgagctctttgtcacatcactccccaaacccagtctctgctatcttcttctcgtagatccgtcgatctctatcatcaacggcaactccggtgctccggatgcgcaggtacaccgtacacacctatctctgctcttctctcctctcttggttttctacttctctccggtccctaactgctctcttctctcattctgtgtgtcttgcaggtcgctgagcggtagccgccgttgaggaaccggagtgccga

SEQ ID NO: 14960 - DNA, 1501 bp, Oryza sativa
tccggagcaccggagttgccgttgatgatagagatcgacggatctacgagaagaagatagcagagactgggtttggggagtgatgtgacaaagagctcacggagaaacggtgagcgggcgatagtggcaaaaaaaatgaaaaagaaagaggaaatcgagagcacggccaacgatccaaagactggagaggcggagatgagacaaggtcacggatccggcgaggcagcgaccctcggtggtagatccggcaaggcgttcatcagagacggcgacggagagggatggagagatggaggcgtggtcgcgtggaggtggaggcgtggatcgacggaggcggaagcggaggcggagcggtcaaggcggaggcggaggcggaggcgtgcgtggatcggcggaggcggctagggttagggttagggttgtgagggaggcggactggcggaggcgagaggacgcggtggcctttatatatgaggcgtgggcacgcggcggcggctcccgatgggcctcgtcgggccgtgcctaccgttatacaggcctgggccgtgtcggcccatcgtgccgtgccggcccatcgtgccgtgccggcccagcgtgctgctgcgggagcctaggcatggcccggctgtcgggccaggccggcacgggcacgaacactgacgggccgggccgtgcttgggccgggcagtcgggctgcgggccatatggccatctataggtgtgcagtttgtaacagcgtgtagtgaggcgtgtttcatctacagggtactagtatctactggtgctgcttgatttttgtcaggcgtgtgcttacgtagctcagcaattttggaccgtgatgggggttggcggcatcggtcttcgcatgagcacaatgaccccgaaggcccgaagcagaacatgtccgacttggtggacacatgcccgcacctactgcacgaacaacagcggatccagaaaaaaatagcagtatgatctgagcaaactatataaagttatagtccaccaacccatctacgtatggtaaaaaaatttagtggggtcttcgtggaggttctcatagtcttcacacctgtagtgaggctcgagacaccactgcccccatgctggatccgcccctgtgcacgaatcacaccatgaaaattacttagagcggatacaataaactgattcagcatgcatgctccaaaatacgacatatcatcttattcttatatggatgggaaaaaattgagaagggagagaaaagtgggcgactaatctggcgccggtgctagcacggcctcacacgctcatgcagccgtgaagacgattaagagcaagtttaatagtaggctgtaaaccgactataaatttatatggaagaaagataatttaaaaaataaagagggttgactcttatacaagagctagccattcacatacttcaagataaatacattaaatgcaaaggtgagagatagagagaggaggagaaaaatagagataaccttatggctga

SEQ ID NO: 14961 - DNA, 1501 bp, Oryza sativa
gggagcgctctcgattttcatttcccgttatttattaccttgttgcaactagtgagatgatttaggtcatgtttgttttagcttagaattattttaatttggttaattactaatctgaaacaaacagacagattattatgatatattattataatctataagtaagaataatataatctggtaatatcctctaaacttgttttttaaggattattgggtggctaaagacccactacttttataaattgtatgtaaattacctaccactgccatcaaacccaacagatccagcgcatctccttcctcactccctagccgcgcgtgaatccggcgcctcccctgatcgcgcgtgcatccgcttcctctctcccaggtcgtacgtgaatccagcgcctcccccggcagcgcgtgcattcgcttcctctctccctagccgcacgcaaacccttccccaagcccacaccctataccccggatccttccccaagccgccaccgccgtcttatcctcctcccattctacaataactgggccattataaacattagcttttcaaaccgaataatccatactctaataatcgagagaaaaaaacaactaatagcttattctactatagcttattataatccagtttaagtaatctaaatcaataatccttacttgcaacaaacagggccttagtcttgtgctgcggttgtcttatctggtacctgcggcttgacagggtccttttgtctactctctccgtttcaggttacaagacgttttgactttcgccaaagtcaaactactctatgtttgactaactctatagaaaaaaatattaatattcacaacaccagcatagtttcattaaatctataattgaataaatttttataatataataatcttggttaaaaatattactatttttttctataaaattagtcaaacttagaatagcttgaccttgaataaagtcaaaacgttttatatcctgaaatagaaggagtagatgactccttgcccttgggcctaacatatacgctggtcgcggggaacttgagctacggcctactatgggccaggaaacagctcaagtctgctgtgctggataaaccatgtactatagaaattatagtcctctgggctatagcccaatcaggtctggttctgcccctgaaaataaaatagcccaaccactagtgttctgtaattgccatgggagcgttcaacattgagtgcacttccccacctttaaagttggaaaaagtacgaattacccttcaaattatcgcggtcgaccgaattatccctaaacctgaaaaccagacatcgctcacctaaactttcaataccggacgaattaccccccctcaactcaatacatggcagttttatcctacgtggcggcgtatgcgtggcactctagttagcatttttttaatggtggggcccacttactctctcccctcctatttctcctcttcctcctctctctctcactcaagcgagt

SEQ ID NO: 14962 - DNA, 1258 bp, Oryza sativa
aatattaaaaaaataaatttaaaaattcaaaactcgtgtccatagaagttgggctgggccgtaggccaactcggcccacaaaaaccaccgcctcgtctcgtcgcctcgcctccgcttcgttcgccacccttccttcgattcgcgccgccgagagttctgtgtctctctcttcttctccttccctacttcgccgccacgccgtgcaggtggagatgggaggcggcggcggcggcggcgggaggaaggaccgcggcgaggggctcggccgcgcgctgacccggcagcggaacaaggccgcggcggcggccaaggagaggggccacgcgctcgccctcgcccgccgcgcgcgccagccgctcgagtccgtcatcgaggtcagcgacatcgacgccgtgctccagcgcgccgcagaggaatacctcctcctcggtggtggtggcggcgacggtgccggcgacgtcgccctctccgcctcgctcggctccgggcttatcgatctgtaacatcttaaacgaactttttttgttgggtatcctaagtgttcgacgaaatgtctctgaagcgggttgctcattcgggcgcgggcgcgggcgctcctttgcgatgcagggatgggacggtggagacggaggaggagaggcggtggctgcgggaggagcaggaggcccttcacgcgggcagcctcaaggtgccccgccggtgggtgctcaacagcgcttctctttcttctcgtcttctaaattttgggtcagtgatgtataggtggatgtgatgttctcgatttcagaccgccatggactccccagatgacggtggaggagctcgacgccaacgagaagcgggccttcctggagtggcggaggaacctcgcaaggttggtcaggtttcattggttattatgctgattcttgtatgtcttccaatgtttgttgtgtttatgtgccaaaaaaaataatatttggacagctacttatgcttggttatgaaaatttgggatggattcctttctacttctttaatttagatattacactggcaacaagtgaaatgttggcctgtatctaattgtgtacaatatatcctttttccttcttggactaagaaaagttgaaactcgtatcttgaatgtgtgcgcagtgagcttctggtgcatcaaagtcaagcatgatgttgcctatcgttctgtttatttttatataccaaaagattctttttttctcctgcagattggaagagaacgaaaaacttgtccttaccc

SEQ ID NO: 14963 - DNA, 213 bp, Oryza sativa
aatgttggccattggatctggcctgatccaacggctgggattgtttggtaacgcccggtaccaagaatgtccctgatgcggtaccgcctagacaaattggttggaagggtattattgtaacttcgcgttgctgctggatggatcaggagggatggatcggggctggcagctcgctcgaaccctagtatttgctctccttgcctttcactccca

SEQ ID NO: 14964 - DNA, 1501 bp, Oryza sativa
tctatatgtatctatacatcatatgcatatactatatatatatatacatacgtatatacatataattttttatgaatatgtttttaacacataaaaaatatatacacatatatgaagtttatatacgacgtatataaagtttatataggatatatacaaactttgtatacgatatatacaaattttatatacatacgtattaaaaaaaatacatcacgtatacaaagtttgtatatgcttatacaaactttacatacgcgtatacaaactttgcatacgtacgaatacaaattttgtattcatgcatcttaaaaaaggggaaaaaaaccgaacagaagagaaaccagaaaaaaaaaagaaaaaaccaaaccgaacagaaacgagaaaaatgaagaaaaaaagggaaaaaaaaagaaaaagctaaccgaacagaaacgaaaaaaggggggacaggaaaactcgctactccctcctctcgcgcggcgcgtctcgtgccaggccgcctcttcagcgacgcggcccaagcacggcccagtggtctgatgggcctattcgtgccgggccggcacaagcacggcccaaaagaagggagcaggccgtggtggcgtgcggcttcgtcgtcccgtcgcggcagtgacggccgcgcccaccctgctcgtcgcggcgatgcggcccaccgcgcggcggcgtcaatcagcgaacagttttgccaacggctggtgctggccttgctgctaccagctagctaccgatgaggcaatgaataagacgagcaagatgacaatttctctctcccttcatggcatcatcatctccatcccattgttgcaggcgtaacgacggcggcggctgcggcgccgcgaccttccagtgcctgccgtccgcagtggctagctagcaggcgtccgtcatccctgcaagttagttaattgcagcggcatcaacatgcttggtgatcatcactactgtaacttgccctgactttaacatgggggtgcaagtatgattgctaggggatgtctctaaggattatgatctggaagtttgtcttgttcaaagtgattattttaaatattgttctcgctctttagtcagtataacatcagtcatatggctcttcattgcaacagattacagactgtacaatgatctttactagtcagtgtacgattaattgtctaacttatgttatttggaatttaatcttaagtctaacgatcgtctgcttggtgctagctagctgatgagcatgtagacgacgaatgtgatgcaaagtgaaacaagaccttgattatacaggactccatcgtaatggcattgtgatccagggctttccacggatctcttcaatggtatagtatgggcggcacggcccaggcccggccgttcctgggccgagggtagtcgggccggatgccggcccggcagccatgcttggggtcgtactcgagcgaggatcttgtccctggcggcgtcgcaggcttcccgccacgccttgtgc

SEQ ID NO: 14965 - DNA, 1501 bp, Oryza sativa
tataaaaggtttttacctattatactttttttgcatcatccatttttctactgcttattagccatatatataaagctcaaaccttgccagtgtgacaagaatacactcatacgtatacacatgacagaatcattaatttagcccgcatgttttctatctagtgagggtttttttcataacaattaaaatttttaactaaaggggaatatactaggatttgtcactcaatactcggtactttctttctgttataatccatttccattatctaaaaaaataatgattagtatttctcatttgtgtagcggtgaccactcgacttgaaacttaatggtagctagagaacgggatctcttgaaaatcagaaagatgcatggtatcgaaaatattcgggcatggcaaatagcaaaatattcagagatgaggtgtgcaggctagcggctggatctgtctcatttccgggccggccttttgcattatgggcttgtttgcctacttgcttgaccgcaaattgggtcgggccggacaattgttaattgggccatgtatgcaaccgcatctttctttctgtagatcgaaagatccatcgctttgtcactgttcacgtcgtaatagcatgtagtatgagtagtagatgacagacaccccgtaaaaaaaaagtagatgacagacacaaacatactccctcctttcctaaatacttgacgcagttgaattttttaaacatatttgaccgttcgtcttattcaaaaacttttgtgaaatgtgtaaaattatatgtatacatcaaagtatatttaacaataaatcaaatgataggaaaagaattaataattacttaaattttttaaataagacgaacggtcaaatattttttaaaaagtcaacggcgtcaaatattttgggatggagggaatacatagagaaaaaggtccagcatctatgtattcgctagttagcgtgtgtgcacttgcttatcttacgagctacgttggagatccatcaattgatctgcttgtttatgtgtctagtgtaacatcagattagtgcaacgatgattgagcaaggatcgaaaagtatatctttctatagatccgatcgatcgatcgatcgatctttttacctaaattagtggcacgagctaattaactaagatggccttgcaacacactcaaaaaacaattgtggaatgcaactcaaaactcactcgatcgatcgcttacaagctactagctagcaatctcctgttgcaacatgtgtcgttcaattggcatccatctgcaacagaagaagagctgcccattgtgctacgccatgcatgcatccatcccaattcccaagcagcagtagtgagaaagaaatgggaattagctagggctttgatgccaaggaaggcattgatttgaagcaacgtagtccggctgctcaaaccgtagcatatgagccaactccatcccatcacttgcttcccttgcaaacgcaaccaacaacccattcccat

SEQ ID NO: 14966 - DNA, 1501 bp, Oryza sativa
tgcctaacagactatttcctaccaattggagcaaatgcagaggaatagtccactgggagcttacaggaacgattcatcacattagtgtccttcgctaagccaataagcactagtccacaagacacgaggtttatggagtgtctaatttgtatatgcaagcaagcaggtatgttcacctacattcacacattctttttgtgcatattctgttatttacactatcattggttctgtgtctgaagaaactagatgttaaaatacaattggttggcccagaaaatcctaaactgggtgtgcacatttcttaccgtgattgaagaagaattgaagatccaagttaaataaatgcgaccgcaggtaccaaaccacacacacaaagttattacgctagaatgcaaataaggacatggaaatttgtgcttaaacaattaaaccatgatctccatatattaaattgtaaagagaaacaggaaaccaagtaactcaattgatttaacacaatgtcaatatcactaactatatcagttgtatctgaagcccaatggtgcgataacatgtttattaacgatgctggtttctattttgtcagtataaaagcaggcagcagcagatggtagtagttaacaaatcgaatagcaagccctattagtattcctctattggaataaaaaaattcgaatagcagacctgctccttggaagtgaggttggggtcgacggcgaagtggacgtcgtgcatgaggcgctcgatcatggtgatggtgtaggggcggcgtgtctccgggttgatggtcttgtccatgacgatggtggcgatctcgtggaactgggaggagagctgggcctcgcgctccttgccggagacctggagctcgcccttgtcgaggatctcgaggcagatggcggtgtggtcgtcggtggagaaggccttgaggaggtccttggacttggcgaggacgcccttggagacgttggagtagacggtgtgggattggagcacctcgtcgatgtccttctccacccgcgtccgccatgacagcaccttgttcgggaagcacgcgatctcgaaccgctgcccgtgcttacggagccgcaccaccgccacgttcgtcagccgcttctgccccaccggctgcaccagcgtccgcgacatctcccctccgccgccccaaaccctagctctcgctgcctcctcgcgccgccgcggctttggtttggatgggttggagaagacgacacgacacgagacgagaggggaagaggagacgataagttgtatcgtgtcgggcctgcctcctaattgggctggttcgtgggccggatgagaggcccgtgtaaatgggccgccgacatctgcttctcgctgcgacgagatcctccaggaaagcttttctttctccttttcctttttccttttcttttcccatgctgataaaacagtgaatgataccatagtgttgttttttctacttttattgattcaccggttatgtatgcgatgg

SEQ ID NO: 14967 - DNA, 1501 bp, Oryza sativa
tgctggtctcctcccaacctcacctgcgacttcaccaacgattacctgaacgtccgtaatcgatcgatcaacataattaaccaactcgatcactctcacggtgacactaattttctgatggattttgcataatgcagggctatgtgtcatccaagacgctctccgagaaggagctcctgagctacaacggctcctcgccgtcgccggcgttcgaggtggtcaccctgacgtgcgcggtcgtcggcggcgacacgctccagccatgcccgtggagcagcagcatcccggtgatcctggcgccgctcaccggcgacgagccctcccacaactccctcaagttcctgcaggcgctgctggggtccgtgccgctggtgcacgtcgaggacgcctgcgacgcgcacgtcttctgtatggatcagccgtccatcgccggacgattcctctgcgccgccgggtaccccaatatgaaggactgcgtcgaccacttcgccgccaagttccccgacatcgagatcaggctcaaagagtatgtgtcaccaatccaactcttgatatgctacctccttcctttaatgtatatatgaggtagtattcattacgtatttatcttgattagttagttgttgttgaatacagtatgtagtaactgaatttgtgagattcttttttttttttttttttgaaatcagatcaactttcattgacccggctttgatctgatttgtgttgtgaatttgtgagattggttttgtgttcgtctttcgcagggtcattggggagggggtgagagtgcaagctgacaccaacaagcttgtggatttagggttcaagtacaggtatggagtggaggagacgctggacagcagcgtggactgtgccaagaggctgggagagctctgatagtctgatgtgatgtgttgtgtagcaaaatcccttgcttcgcttgacctgtacatgtataccgtgtgcgtacattctgtgagaacggattgatgaatgataaattcgttcctgctcaattatccgttggtaaattcgttcctgctcaattatccgtctttaactgagcaataaactaaactatagcgacgtttttgccgctccatctcggtagtataatttgttggagcgattcaccccgctccgctccattatttggtgaatctagaccgtttggcacagccccagccaaacggggcctatctagcgagcaaatgcaggtcgattttgctatacatttgtcgacaaatttttccccaaaaatttgacagatgtaattacagtacaattgtagtgtaattacactgtaacttgtatgtaattacactgtaactatagtgtaacttgtatgtaactttcaaaaatctctccgtaacatgttatttcggtaaaatggaggtcgtgggaacaaattctttcacatatgtgtgtgctatgatttgttttcttcctcacttaaacaaatcgtgtaatagatctaacgattcaaaattatgtgaca

SEQ ID NO: 14968 - DNA, 1501 bp, Oryza sativa
ttttcctagggttttgctgcagtggagagagagagagagagacagggaggaaggaggattgtgttgtgggtgacggcagcactgaagatatctagtagtagaccgtgaaatacacaggattgagtcggtatgatgcgtgggcgctaagtcgggtgatccacgtcaccgtttcgcaccacaacacagcaacgaaacggaactgcagtaacaagtaacaaccgagatttcgtacggatataggagtatatatcttcttttgtttctagaaacttttttataggatatttcttactcgtttttaggagagaaattaactagcatacgtatacgtacgtatacgggcgcgttctctgatcacgtccatcgatcaatctgcgcttgcttcaacatacatacagggaagatctttatttggatttcagaacaaattttaatttgggcctgatgaggttcagtaattataattagtgggaggtgctccttaacgtgatttctggtgtggataagaatactgtttcgactgttatttacttctgttttgctgtgggatttgacgatggccattgacaataacttcccaacttgtttgtgaattcatatgccagcctcaccactctctttgaggctcgtagctctcgacgatgctaaacgttcagggaggcacaggcaccgtggctcgtcaggaaacgatggttttggttggggtcgtcggagaagaaaactccgacccctactgctccaaattgctgggccctagccattttgcttttgggccttccggcccactagattcgatggcggcccactcgattcgacgggcgacactctgtggacttcagcagattcccctcacgatctgataaacctgcattgggactacctatacatttgtcgacaaatttttccccaaaaatttgacagatgtaattatagtacaatcgtagtgtaattacactgtaacttatatgtaattacactgtaacttgcatgtaactacagtgtaacttatatttaagtgtcacataattttgaatcgttagatctattacacgatttgtttaagtgaggaagaaaacaaatcatagcacacacatatgtgaaagaatttgttcccacgacctccattttaccgaaataacatgttacggagagatttttgaaagttacatacaagttacactatagttacagtgtaattacatacaagttacagtgtaattacactacaattgtactgtaattacatctgtcaaatttttggggaaaaatttgtcgacaaatgtatagcaaaatcgacctgcatttgctcgctagataggccccgtttggctggggctgtgccaaacggtctagattcaccaaataatggagcggagcggggtgaatcgctccaacaaattatactaccgagatggagcggcaaaaacgtcgctatagtttagtttattgctcagttaaagacggataattgagcaggaacgaatttaccaacggataattg

SEQ ID NO: 14969 - DNA, 1501 bp, Oryza sativa
accatataacgccggccggccgcactgccgaggccgcgacccgcgctctgccgcacggccacgctcgcgtcatgcagctcgtctccatctccaagaaccaccgcggcggcaacgacgtggacggcaagcacgatagcagcgacgtcgacgagggcgccaacgccgacggtgagcacatctcgccgcggggctcctactaggtggtccggatcaagaaggacaagatcctggcgccgcacgtgcacttctgcagcgtgtacagcaagggcttcaagcgcgacgacaacctgcggatgcacatgggcggccacggcaaggaggcatctgcaggagcttattgtgcgcggccacggcgatgagtacaagtcgggggcagcgctggccaagcccggcggcaagggcgtgtcgccatcgctgtcgccgtcgccagcggacgtgccgaggtggtgcttctactctggtcgccgaaccttgcgtgagagagaggggagatggggagagaggaggaaacccagggggaatgacatgtgggccccacgtgagccccactattttttattattttgtctaaaactgacatgtgggtcccacgggttttattatttttctggatcgaactgccacgtaagcgccacatccacgacacgtcagatgaagaccgagtcaaactagccacataagtgccacgtcagccaaaaccgccatctaaaccactgagggaccttttctgcactggttttaatagttgagagacctattgtatctggttttccgattgaaggatgaaaatcggattcgttgacaagttaagggacctcagatgaacttattccccaataacatgggcttctcttacggcccaatttaggtgcatcttcaagagcatatagcccagtctagcaaccatattaacggacatatgggccttttttctccacactacctatcaataaagcccataggaaagtctgatatcgaggtgcagcagacagttagccacagagcccccataggttgcggccaaaatttaaatgggagtgaattgcatattaggccacttatttgcaacttggactaggcctactatagtgttttcactttacaccaagtaagcttaccaagtgttgcactttggtccaccttatcccatctcctcttttaactccggcaccattatcccttcacctgcccccgaccagctcccttctgtgttgctaggactgcacgacgctgcctcctgttaaacatgtgatatgtatttgtgtgatgcacacggcatggttagatggatagatatgattagataaggctagattgagtttgttgtaacagaataggagcatatctatccatccacctgcgccgatctctgtaacccacagcggtggttattatcgctaatataagattaacaaaggtgcggcccgagagggttgaacgcttctgaacctctgatgtttgatatggtatcagagcctttccactaaacaaatcccgatcc

SEQ ID NO: 14970 - DNA, 1501 bp, Oryza sativa
aattccgtttagccaggttatcttttgttaacaccacccctcgacataaatacgatagaaacattttcactttgagagggatttttaacttctagatatgtttgttaaaattgggaactcttgtatgtgcaagataatgagttttaaccaagaatcttccatcaggtgttagattcaatttaaagtcatctttctcgtgtgacaacactatattagcaatgcgtggaaagagatgattccacgccactaacttaaggccaataatatccttgcgccaagtgaaatttaacagggttgtttagaatatatttgaaatggttgcttgtttatgtctgacaaccatctctttgtttctctaagacataagcagagcttcttcttcttactagtgtatataagaaagaagggggaaaagaaaaaatataactattctggccatttcaagttatagttttagttttattctaagtcaaccattcataactttaactatcaatttcttatttaaaaagataattgtgacttatcaatttctagaaatttgtaaagtttaacaacatgttaattgtactatatattatgaaggtacttttcatgatgcatatataaacacataaatattatgatattaaatgtttggcttatgataaagttaaggacaagtaatttaaaagggtgagattatactttatcttttgtttgcatgatgccacaaattatagaaactagtagtagtaggaacaagatggcgtgtatggtgatgttgttgtatgatgtgggggtgggtgactcaggccggatatgccccttcacggacaagaagaccaacagggcgaacaaggtgtccttctcaaaccacaagacgaagaagcagcagtttgtgaacctgcagtacaagaagctgtggtgggaggaaggcaagcgcttcgtcaagctgcgtctctccaccaaagccctcaagaccatcgagaagcatggcctcgacgccgtcgccaaaaaggccggcatcgacctcaacaagaaataaatcaaatcatcatcatcatgatgcatacatacatgtattctctcatcaattgccgctgtgctgaatagaccagagctgtatgtagtccattattaaatccattcatctcgatgatgcaatttattgtagagtactacagtatgcattcatcggtggtggtggccggcttcgtttccttaaatttccttttatcccgtgttgctgctgcaagtccggctcgaattgtttgctactagtgtttcatttcggtcgagttcctaattaatactgtatgttggttacgaattataagatggatggatgtaacttgagcagcatcaggtcgtgcagttggcatcttgcgcttttcactttagagtgtcttccagtctaagctgaaattgattaattattttatttcctttttggctattgatatttaataagagcctaaatgaaagaattaacttgtacaaaattgaaaagctgtttgtt

SEQ ID NO: 14971 - DNA, 1501 bp, Oryza sativa
tccctcctccgccgcacctagtccctcctctccgctggcgcccaccccaccacggccgctgacaccctccacctgcaagaatgaaccatcatcgattgacgacgacggagaggagggagtggagggaggcacataggagacgaggggagcgccgcaacggcggggatggaggggtcgcccaccacgtggtccaggcgcagccgtgcagggatgcgtcctccggcgtcagaggctgcatcgccgccttcccttccagcattgcgttgccgctgagttggtattggtttcacgcgcacgtggcggtgtgggagatttggggtgatttcacggggggagaggcgagggcgtggtggaggaggagacgaccggggagtgaagcaacgcgccgtgcatgagaaggatcgcatggcagccccgtgcactcgccacggagcccgtcgaatgcacctgcaagactgcaacctagctcactcgccagtagagcctcgtcgtgagcctgtgatgcccacctgtcaccgagaagaagaccaaagcggcggcgacgcatccccaaccctaggacatttaattatctggcacactttaagatgtgccaattaatgatttgccacttactatgggtgcagtgacaaatcttttataaccactcgtaaaagtggcaaatagttaattattcccccaaccccagtgtgggaatgtcgttgcacttcagtacaccccttaatcgttaacgaagtcaacaaacaagaagaataacatgtttgatgacgtgctgctatcgattttgtcatcctgttctgtttctgggtcccacaatttttaaaatttccttttggtaacaactccctccgtctcattatataagggatttagactttttgcatgcactgtttgaccattcgtcttattcaaaaaatttggaattattatttattttatttgtaacttcattatttaaagtattttaagcataattttttgttttttatatttgcacaatgtttttaataagtgtggagattatggataccccatacacacacggcatgtatatccgactgggtatggggtaccatgtataaatagaatatctttaaagggtttcgggttaaattcctaaacttgtatatcaaggaagcacccgagattttagtcggttacgattgtattttatctataactgcttattccgttaggaatataggctgtactttgtaatacggactccttcccctatataaggagtggtccgggtgcctcttggggcacgatttttctcccagatcatacgatcaataatacactcggcggatcaatccccagacaggagtagggtagtacttcttattaagaaggcttgaacctgtataaaattcattgtctctaaacccatctactttttcagcttgatagctacccccatttagtattgccgaaatcttgtttcgacaattggcgtgccaggtaggggtagcgtcaagttcttcgccgactagtgtga

SEQ ID NO: 14972 - DNA, 448 bp, Oryza sativa
cactgcctaactggagctcgtgcccgaacaccagtgtgagtaaagtcatactcgggagcttctctctctctcaaaaaaaagtcatactcaggagctcttttgcaagtagcaaactaaactagatagctagtctgaattgatgagacactgtcacccactggaataatggcattgtaatagtgaagttacatgcatttctgttatgtttcagggaaaaaggggctactacatcatcaactttgccaactttgatgccttcagttaggcctgctcatggattggatcctaatggatttaatggattggatttcagtgtgggttggctttggatgggttgaaatggattgatgcagctaatgggctggggtgggttggatggagatgtaaaacggtttggattggattggttttggttaggaaagtttgggtagaaagtggattcagccca

SEQ ID NO: 14973 - DNA, 1501 bp, Oryza sativa
attttttttctcaaaaacatcacattgaatatttggacacatgcatagagcattaaatatagatgaaaaaaactaattgcacagttatgacggaaatcgcgagacgaatcttttgagcctaattagtccatgattagccataagtgctacagtaacccacatgtgctaatgatgaattaattagtctcaaaagattcgtcacgcggtttccaggcgagcggtgaaattagttttttcattcttgtccgaaaaccccttccaacattcggtcaaacatccgatgtaacatccaaaaattatcatttcaccaactaaacaagctcttataattgaagtgttgtatatagactagttttacttttaaggccttgggtgtgtttagttcacaccaaaattggaagtttggttgaaattgggacgatgtgacggaaaaattggaagtttatgtgtgtaggaaagttttgatgtgatggaaaagttggaagttggaaaaaaactttggatctaaactcagcccttgtttagttcgtgaaaaaaaatttttgggtgtcacatcggacgtatgactgatgtcggaaggagttttcggacatgaatgaaaaaactaattttataactcgcctggaaaccgcaagatgaatcttttgagcctaattaatccgccattagtacatgtgggttactatagcacttatggctattcatggactaattaggcttaaaagattcgtctcgcaattctcccctaactgcgtaaatagtttttatttttatctatatttaatgctccatacatatgtccaaagattcgatatgatgtatttgggaaaaaattttgaggactaaatcgggcctaaaatctaggaccgcacgatttacaggggacaatcgcctagtttatttaaattttaaataaacaaatagctgaaaaagtaatagaggtccataaagaaaaaaacatttcagcaactgaaaaccattcaccacaatttcacccccagcgtaaaataactgactgtcacaaacaatgtgcaaaaagtagatggcacatgaatgaagcaaaaataccaggacgcatgcatgtgaaaaccttggtgaccaaaaattagttatcgagatgtcatcctcaccaaccagatgaagacacaattaatgcagtgcacacaaccatatcatttcaattgtgcattagtacctttttccttgcctaaaacaacccagcaaagtgatctctcacatatcatctctttctccagcactacccagccacacaaccataagtcgtctctcagtgtgcagcagcaatccaccatcctccatcgtctgtcagtccaatgcgagctacataccgagagaaggagaacaccacccaaccttcgtgactcatccagcgcctcccctgtgccgcaccggcgactgcgctgctccgatccacaaacatcttggtcgacgaggttaggagatctggcttcatcttcctgcatatcattttagttgtatt

SEQ ID NO: 14974 - DNA, 1501 bp, Oryza sativa
gtacagagagactaaaacgtgagaaactgatcgaacggcacgcgaggggcgcgactgatcgccaatcagtgcctcccgaatcctgaggctgaatgacataagtgtgcattgtgagaattgtatccaatgtgtagctttgttctagatggcatagctttttcaagtgaagcactatggatggccttgggaggtcagtcgcccccccccccccccccttctagtctctcttacagtatacaatgtatatagtatatccatacgtgtgtgtatatatatagtaatatatttttaatgcataaaaaatatatacacacaaaatttatataggacgtatacaaattttgtatacatacgaatacaaacttagtatacatacatgttaaaaacacccggaaaaaacggaccataaaagaaacaggaaaaaaaagaaaaaaccaaccgaagagaaaaaaaaaacagaaaaaaaccaaaaaaagggaaaacccgctcctccctcatcccgcacggcacgtctaccgtcctctctctccacgcgcgacatgtgtccagtcgcgcggggaggggcgcgcgactgatcgcatatactagcaatctcgcttggagcaggtacaatagcaggctataaggcagctacaaacatattttaatgagataaaagatgagagagaagagcagcaggttacagatctgtagccagctgcagcacggacttcaagacacagtgtgtgtatgataggtgggaccatatattaatagtatagtaaagcatctattgtataaattggctattagattggctataaacgaattagagctagtagtgggctatactatactattaaacttgctcttagagagggcggcgaacttatcgcactggcacgcgaccacccgcgcatcagccagcccccacatgcattgtgtccgagcgtgacactgacaactacgtctcatgtaggggtggaaaaaaaagctcgggctcgtgagctcagctcggacttggctcgagcttggttggcttggctcagctcgtaagtcaaacaagccaagcccaagcctcctttttagctcgttgctgaaatgagccgagccgagctagctcgcgagccgcttgttttggctcgtaagcctaggccatcgtgtgtttatattgattattttactttatatagtgttattatttgtcaacttgaaatttatcattaagattttgaagaattgaatataaaaacttatttaaattttacatgttgatgatttgtttttacttttttttaataattattaaatatatatgaagaggtgtttcaacagaaaggcttgcaagccagctcgagctggctcgagccaggaaacgagccgagccgagcttaagttttagcttgtttttctaaccaagccgagccaagccaagcctagttttttgcgagccactacaagccaagccgagccaggcttgactcggctcgtttccacccctaatctcatgtatagttggcca

SEQ ID NO: 14975 - DNA, 1501 bp, Oryza sativa
taccaataattgtacttcaatcagactagctctaagtcccatacaggtccggtcagactgtcaaaagtgtgttccattggctttcaaggctgggatgtgttttgatctattaaagttcaatttttttactttccctgacgtaattcaccccctttggtaagtttggttacttgtgttcaatcttacagtaatttagatttggggataattagacttgacgaactacttggtaaagtagttaaaatttaaaaatacttcaaacacatcatcaagttgttatgcgttcttttctacaactccaaactacaatttaggcgttttccgttagcatgcttcccgaactgctaaatggtgtgttttgcgcaaaaaaaaattctatatggaagattctgaaaaggtcaaataaatctatttttcaactttataataattaatactcgattaatcatacgctagtgagtcacctcgttttgtgtgtcgctaatatgctactccaatatgaatactacggttcatacagaacccttgccttttctttagcttagatttctatacgcatttaaaagaaagcaatggtggtgcccaccaactctattatattttctttaccaactacctttgtgtacttcaatattacaaaagtctttcacatattgttaatatctttttttcatctctatttaagtttcatgcaaagacatatacaaggatgaaattgtttcaaaagccatacaattaattgttccaaacaatgttagcacatgtataatacatttttgtccactgcaaaacacagttgttttgctagtttaacaaaattttactctatctatattttaccggttttcaaatgatcttacggaaatcaacaaaatcattcaggagtgattttcgatcgggtttcgttaatcccgcgttcctagcttcctactctagcctctagaaaagagcataatactctcttcattcaagtttgatggtcatattctggcttcgcaccaagaccaaacacgcttataatattcctactaatctagtactctaggccaacacacctgtggcaacgctttggcaccaacacaaccaaattgttgttgccacatccttgatcgtatgcttcttacccatagcgcttgtgatcacacgcgaaatttaactgttttactatgccttgcagctatttttgcctactaaagatgaaaattagtaattagccattgcccatgcaacctaaaccaaaacaaaattgaaagagcagatcaaatagccctatttaaatagcacttggttgaagaaaggacttaagttttcaattcttttcctccctacctggctgcctctaccaccgaacaacgaaagtaacagatgatctactctgtaaattatcacggtgagcagacaggagcgatggtaaagaagagtttgtcgtggatgcgttgctgcacatggtggattagaaaatgagtgatagaagacttatcggtatgatctatagtcaatt

SEQ ID NO: 14976 - DNA, 1501 bp, Oryza sativa
gcctactccgccgacaccgcatctatggagtgagagccgccgccgcctccctctctagctctctctctccgatcttgatctctctctctcggttgccgccggctgcctcgttgccgacgctgacgccgacgtcgtcgcggccgaacatgactccgccgcgccacgacgccgcggcggcacgacacgccgggacgccacgacgccgccgcggcaccgccgcgccgccacgccgccgccacgcaacgccgccgtcgcaccgcgcgcaacgccgccgccgtgccgcgcgcgtggccgccaccgggccgcgcgccacgccgatgccacgcgcgccgcgcgccgccccgccgccgctcctctgccgccacaccgcctctccgctagctgccgccatgtgaacgaacgaatgtgaacgtgaacgtgaacgtgaacgagcgaacgaacgtgaacgagaacgtgaatgagcgaacgaacgtgaacgaacgaaacatacgtgaacgagaattgaacgtgaacgaacgaacgaacgttaacgaacgtgaatgtgaatgaacgtgaacgaacgaacgtgaacgaacgttaacgaacatgaacgtgaacgaacatgaacttaacgttgtatttgaacgtacataaacgaacgaacatgcgtgaacgaaccttacttaacgtacattaacatggacgcacgtgaacgaacgaacgtaggtgaatgaaacgtgaccttaacgagaacgtgaacatgaacgatcgtgaacgaagtgtgaacgtgaaatgcaatatatgctacttcgcgtttatcctaatacatctttttgtatgttgcagaaaagacgttgtcgtcgtcgtccctcaagccggagtagtagctagccctcaaaggaattcgcgcaggcaagtgacgtaaatatatatatatatgattgttaaatttttaatgcaattaggactattagatttaatatacgacacttagacttagcattatagttagagttttaatacaatattatttgagttttaatataagattattatagttttaatataagattattagatttgtaattagacttagcatataagattgtgtagggttctaatatacgacaattagacttagcatatataatcactatttgagttttagtataatattatttgagttttaatataagattattatatttgtaattagacttagtatataattattgactagctagggtcctaatatacgtcacctagacttagcatatatgactatttgagttttaatataagattattatagttttaatataagattattatagttttaatatacgattattagatttgtaattagacttagcatatacgatagttagacttagcatatatgacttcgcatatacgatagttagacgtagcatatatgacttagcatatatgattgttagcatataagattgttaaagcaaaaatgtctcatgacttagcaactgtttcctgtatgaacaga

SEQ ID NO: 14977 - DNA, 1501 bp, Oryza sativa
ctgttttgcgtccctccttctctcccttcgccgacaggtgggaccggcggtcccacccgtcagctcctcctcctacctctcgccggccgatcccaaccgccatagccgtccacgtcgccgcaaaatccggcgccctcccgcacccgagctcgcatccaacgacgtgggcacgatcccctccacgtcctccaccatttcccccactctccccgcgaaaatcggcgccggttaacccctccaccaccccacgtcggcgccccacttcgccggccgattccgccacgtccggcctcgatcccgccttcccgagcccataaaaaggcatccccgtgctcccctcatccattttccccattttccccaagccgccgcgccctccctcgctctccccgcgccgagcccacgcaccgccgctctccggcgaactccagcagcgccgcgccgccgctcccgtccgccccgcactgcgccgtcgccctccccggcaccgcagtcgccgtgcgcaccccgtccaccgctcctcttcgccaatccaccgccgcaacgccgcttccaccgccaccccgagccaccttcgcctttagccgcctccatccgctccccgccggcgagcgccgcctcgcccggccgtgcttttgcctccaacggcttcgccgcgtcgtgccgcaccccggcatccactccgtcctccccttccacccccgcagcaccattcccaccgtgcaccgagccacagccgcctttcgtcacctccagtcgcgcgccaccaccgctcccgtcgctgccgcgctgcgctaccaccgccatcggcatcgccgttcctcgccgcaccccggcccctactccgtttcccctccctgcccctggaacgccgccgccgcgttcaccatctctttccgccgccagccgcctccctgtggtcgtctcgccgtcgccgtcctcggtgagaatccccaccgtcccttctcctttttttcctcctccgccgctccccgtgcccgctgccgcgacgcgccgctgtcgccggcggtcgtctggccgcacgccgccgcgcgctatcgctcggccgagccggtttcatgccgtgcccgtgccctagccgcgccgcctcgtggccgtccgatcggcttcgggccgatctgggccatccacgtggtggacgcgcacccgaggccacgtgtggacttggtccaccgtgcgccgcccctttgtgccgctgacgtgcggggcccgcctgtcggcgctggtttccccttgctgacgtcagcgaggtccatttcctttgtaaaaataaataataattgcgcaataaatcgagtttaattctagaaattcattaaaatggctcaaaacttctaaaatccatatctaattcattcgaactccgaattgagctgttcaacttgcaaaattcatctaaaattgagctctacatgtttgtttactttttatgtactgtttccttggtttttattagagtttttcctcgttttgcgtgcca

SEQ ID NO: 14978 - DNA, 1501 bp, Oryza sativa
atacccacccttactccgtggtgttggaattggatcgtgccattgcaaattattaatttgaacaaatattactacaattcgcgatatcagctagataccattgaattttttttgcaaaattgaaactgtatcgtcgttgtcagggttatggataccacatacttaatagtagtcgactaaatctcggcaggacccaccacatatcatatcttatacggaaacaaccttaggatataggaggagttccgcataaggaaggatgaatagagttctacatgaaaacgacaaggactactcggattgtatccatattggtctctgtcggtgatatgggaccgggagtatcgtgaccagaggcttgaggcagacacaatcgcccacgtggcctggcaccttcggggacgtcgggcccgagggtgaggtgtccgccctcctcctgatttccccgagggggggtcgggtgactcctgccccggccccgagggccgaggcgccccgaccccttgtggagttagcgccacatgaatgggttgggtgaacacggtaagcctcacctaaccacatttattgcggtctggtcgaacgtgtcacgctgcatgcagcgtagtgcagcgcgttcctttatccggtctgtgaccagtcacagaccggtcagatcacgggttaggtggcgactggcggtctgacgcacgccttgccccatcccgtcaagacgaaagcctctaggcactcgtctcaagccggagctagcgtgtaatctcttagagatggcacgttagccctggttagatttataccaggcttcatcccaaccattacaggcaagatgctacatgaagaagggcaaacatgcacgttgctaagctgacacgtggtggacaaggatgactgatttgtgaccggtctgacactggtcgcgtcatcaacagacagccataatcccacgtcgcacctgtttccggcggaagtgggggtagatatgggccgtcccgtcagaagggcacccggagagcaaccgtaccgatctccgtccatttatgaagagaagaacagtccagtttggagagggagaggggcatgtggtatccccttgagatataaaaggaggaccttgcccacttagataaaaagaggacttttggacacaaggccttggccagatccgatcccagagcgattgggggctggttgacactttgttacttgttcatacacaaatccaccaaaacacaggagtagggtattacgcttcccagcggcccgaacctgtatacatcgcccgtgtctcgcgtttcttcctagctggcgatctttccacataccgagagagcttgagatttcaccctaagcccccggccgaaccggcaaaggggggcctgtgcggtctcccggtgaggagccacgagctccgtcatctggcgcgccaggtagggggctcagcgtgtgttttctgagctctcgtactcctccgtgtgcgccaagtttttcttgttcagcctaa

SEQ ID NO: 14979 - DNA, 1501 bp, Oryza sativa
cggatcttgtgcttttctttctttggatttcttttcccgaaccgatctaagccctagggttgctctgataccattgttagactttgcactaggatcacctaggttagatctagtcgggtggttctatttgggtttgatgaacgacattgtcgatgaaagggagagggtttagataccgaccggttgaggagttcgaggaggaagaggcgccggacatcgtcgttgtcgtcgcggcttgacgtagatgcggcgccggtgaggtcgacggcgatgacggctgcggcagtggtggtcgtagacgtcccggcgatgaggcgtggcgcggcggtggcgtttcccgtcactggctgcccccctctcgatcggattagggttttgtggggtggagttggcggcggcggtgaacttcgtacccagtgccgtgccggcctccacccctcttttatatggcgcagtgtgacgggggcccaccagccattgggctgggcgcccccgatcagggcgcggtcaaggcccccttgagccgttgggctcaaggggagggagatctatctaacacaaaatagataacaaagtatataccgctagtaacttaaaaaatatgttaaaaaaggcatataccgatactaactataaaaaacagtatataccgatactaacttaaaaaaaaaagataccgacactagcttaaaaagtagcatatactactactaactgaaaatgtagtatatacatgatcagtatatactactatactactaacaaaaaaaaacagtacatactactactaacaaaaaaaggtatattctccttcaatgagtatacttaaaaaatgagatatatacatctctgatgattattgtagtatatatagtacttattaactaaaaaatagcagataatacttatattaactaaaaaaggtatatacttccaaacaaaaaaaatagtatatatcaaacaaaaaaagtatatactgaccaaattaaaaaatagtatgtgcagtatatatcaaaaacttagtatgtctactgaccaaacaaaaaaacagtatatactcattcagtacggacgtaatatatgctggaaagaaaattaaaaatttgaaagcaaatgcataccaacgttatcgtttgagtgagcaccaaatccggtgtcagctgtgcacatgcatacggtggtttcaaattaataatttcactttaatttggatgctaatggatcatccattaataagggggagtacatacatctaggtgtacagaagagtcgtcatgtatatatatatatatgtgtgtatatatatatatatgtgtatatatatgtgtgtatatatatatgtacatgtatatatgtacatgtgtatatatatatatatatatgtatatgtatatgtacatgtgtatatatatatacatgtgtgtgtatatatatatacatgtgtgtgtgtgtgtgtatatatatatatatatatatatatatatatatatatatatatata

SEQ ID NO: 14980 - DNA, 1501 bp, Oryza sativa
gtcgaaaagataatcttctctcgaaccagattactccaaagccgagtgcttcaatcatctttgtcatggtctcccgagtacttttaccaaatctgaagactgtggagggctggaaaataaagtcaggtgcaccgactagatgcacctaataggtgtagcccccgacaatgtggttaattgaacaaaccaagcatatagtcaaggaataaataatccaaccaaccgagtggttttgataatcgtaatcaaccaagtgacttgatatcaatatatagcatatgcggtgtgaatcctccaaataacatgatccgggtgatataccaactgctttgtaaaatatgatgagtgatatagcaaaatagctataaagaagcttgaatgctgtgaataaagaaatttccaaagtattgggcatacgccatgcgcacactgctttaacagatgtgcttaagtccctaaaagacacatggtttcaccacacctggaaatatatggcatatgtggtataacatccgagtaagtaaactcataaaggatttaccaaccgcctgacaaatgaccataatatataatcagcctaagccataatattggtcaataaaaatgcacacttacgtggcaaaaagcaatgatattgtatccaatcaattgcttgataaacccaaacagcaccttgactatataaaaaagtcagcgggacagctatataaagctttactgtttgacaccttttaagatgcattgtaccaactcctaaaaagttaagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgataccctttaaaggatgacgcatgtaacatgctcccgggtaacaaatcttctgggtaatatagaccaagtgtagctcatatgaatagcttctgatctgaatgattatcccttatgggatactccaaaataaatataataattgaatcccgactggcgcaagtattcggttgatagcctttacggggaataataattggtccagtctttgagcatagaagatagactcatgactatgaatccatgtggaatgtatccggaacaagtcccaattggagatataatcctcacgcttgagttgatgagcccctgagcatatagcttgtcattttgtcatagtcaaaattgtctattggcaatagctgacgcagtcggcatggagatgaaatgaccaacatgaagacgaaattgctcatcagaagtaacggaagatgtcagtggtagtaaaaaacagtgacaccaatcaaaggtaatgaagttgcataaccatggaggcgaagaaacagtcggtgttgacaaaagcaaaccgacgatgaagacgtagacgcgcatcaacagtgatggcgaaatccactaatca

SEQ ID NO: 14981 - DNA, 1501 bp, Oryza sativa
tagccataaacaagagtaccgacccaaccccacctacggccggaacccccgggacaggtaggcaggactgagcccctagcagcaggacaccggccctgtgccatgacatctcgactaccgggccgctgtaacgtcccgccttcccccaggccgggcccgcttacatctgatagctttcattcataggtcatagactgccctcacagatcaacacatgtcttttctgcacactttgtcctcactcgtgtgcacccgggaagaatttcccggtcggtcacccatcccaaattgctccaggccaagcacgcttaaccctggagttctttggagattggattccggaaaaaaagttgtaacttgttgatatgagtattctattaatcctattaagccctaggccgggatgttacagccgcagctcgtgtagccttcatttgccctagagatatccatcgacccccgacttcgtccatctccatctgtgtacttttgtttataaccagactgagccacaaactaagccttacccactagacatgtggaagtacggtagtactttgcaacagaggcccgaagaccggtccttaaatggccgaggtgctactatcaaaaccatgcaccccgagcccagcctaaaaccattttgaggtgtgaatcccattccacaataatccaaccattccgtagtgtccagatgataagagtattcccaaagtctagagttgtaaaaccacctaatgttgcctaattaaccagtgaagcatctacctaaaatcatactagtggtgccatgagtagagtgtccactagttggggttttgtttattctagggtgaacaaggaaataataacaataacaataataaggtcataacaaaggtaaataggcatggctagataaacagtgataacgcgggaatttaaataaagcgataatgcaataatttaaatcaaaataattttataaactgggattcaatatgttcaaggatgatgtgactttccttgctcactttcccaaacgtcggcttcaacctccacgaagagcggatcttccgaagctgcaacgtctacacgaccaacggaaaataaaagggcttttactctaataaactccatataacaagcaggaacaaagcacaaaaatgggttcttgacttcttaaggaaaaatttgagacatgaacggtccaattccgagttcaaatggccaagttatggcaatttgaagtttatatgctctttaaatgaatatttatgaattttttcatttaaattttaatttaaaaagggtttattacgtcagccgaggggagggggcgcgcggaccgggtccacgggagtggggcccacgcggcagcctcacggtccacggtggaccgggcgcacccgggctcgcaccggccggcgccgtgggtcccacgcgtcagccgcacccgagggcgcgggcggctgacagccgggccccacgcggcggccactcggcgcgcccgaaggcggcc

SEQ ID NO: 14982 - DNA, 1501 bp, Oryza sativa
actcgatatcacatattttatttaatgtaattaagttgtgatggaaaaaatgaaagcttaacaacctctaaatgcgtgcatgcatacatgcatgcttaatttgcatgcatgcataaatcgcatcacttaacattgggtgagtatgaattatcccaagatctgaaatcagacatctttcatgctcaattattaatatcggatgaagaacctctaacttaatccggagtggttatgatcttagttggtagtcaagtcagcattttatttaaaaacaatatgcggaatccacctatcagattctctccgtttcacccctctctaacagatggatcccaccgatttcttaaaaaatgctacctagactgtcatgtaggaccaaaaccactctagattaagttaggagagttcttcacttgatattaatagttgagggtaaaaaatgtctggttttcggatctaggtgtaattcgtactcacctaatagtttagaggtgtaatttagactttctcctaaatacaatactgttgcacgtcaaaccaaagggcactggttatataatgatcaatttaaattttttagtattatatgatgatcaatatgtgaagggatcgatgatgtcacactacgtattatgttcgtttattttagaaagaaaggagcatggagaatctcttattaccatgtagcttgtctctgtcctctcctctccggcatgcatgcacgcgcttgcgttgcttcgtttcgcttggttgcttgcacgcttgtccatgcatgcacgcacgcgtggtgtaccgcgaaaatcttttggatggctgcgcctagctcgtgttcgtgcatctatctatctatctatctatctgtctatcttgcatcatcatcacgtactggatcgatgtatgtatctctttcctcctcctcctttttttgatctagcatatagcttaatttgttctcgttctcgttgttgcggtgtacgctctgctagattccaatgcagatgcgtggtagtactcctacgtgggtaacatgggacatggccgttgttgcttgctcgctttgctgatctctggtggtttctctcacgcccaatgacgacgacgaccatgatgatgattgatggaactccggaaagggggagattgttttgtagggccgtagctgtctctggaacagatatgctgcatcgatctcggaccaaccctgctactagtagtggtagtggtggtagcggagatcggtcgatttttttgggccctgttgattcaagtggacgggcaaatgcgaccctccccacacggttgtgcatgggatcgacgttttcctcctcccacgtactacctccttccctaaatgtttgacgtcattgatttttttaaatatgtttgaccattcgtcttattcaaaaacttttgtgaaatatgtaaaactatatgtatacataaaagtatatttaacaataaatcaaatgataggaaaagaattaataattacttgattttt

SEQ ID NO: 14983 - DNA, 1501 bp, Oryza sativa
ttgcgccgcggttttacctcaaaagcgtcgaaccgtcgcgcgatgctagcctggctcgcaagatcgcagttcatttcgagaaaaaaaggccgaggcttttcctcgttaacgttcaatcttgccacttatgcacaacacgcaaaacgagttacgcaaagcaagccaagattgatccaccgatcgagattgatgagcatttgaagctaggtaggaaacctagagtcgagaagcttctgggatcagttggagaggtagccctagcgttgagttaaccatccgggcgcgggacggatctgtagcacagaaagagcgcctgggcctttttttcgctcggttcggcacgcccttggccgccgaactcccgaaagcctggctccgtccggccccgatcgaaccgacgtcgtacgcacacacacggtgcccgcgccgcgcaacgaaagcaatcaaccaagcaagccacaccgatctagtaagctatagtagctacgtacgcgtcacgtgaccgcgtcggccggccgggacgagccgcgcgcgcgagctggtggaaagatttttcggaaggacggacggtcgcggtgagtctcgaatgacagcgcgggcgcgctacgtacaaaaaatgttgggctgtcagctgtgtcaaccgtgacgagcacacaatgcaggttgcagcgcacgcgacgcgtccctctccgtgctgccgtatctttcgcagaaatctatcgtggtgcgagagcccggccgttgcagcaacaaaaaaaaggcaggacaagtaggcacccggtgacatcgggggagagctctgcatgtcaaacagctgggtgcatcacccaccgcgaatcgcactgcacacagagcctctcgaaagtagaggtggaaacggccagggatactgtggggggcttaacacggaagcctctccaggtttggtgtttgacatgtcacagggcgttgccgccattaaacacggcttactctcttcgggcatagtgtgtacgcacatacctgaaaaaaacctattgcccctcgatacattaggagtacgttactacatactgtacatgcacaacatattgccatggctggtgtctggtgaggttttcccgttccagcagggtacgtatgctacacgtacccgccacaagcgcatcgcgcgacaggtcaggtcagtgtgcaatgatcgacccgtggggggcccacatgcttctgctggctgttgccacacctcttcctttctccagcatctctcctcctcctctcacctctctctccctatatataggagcctgccttcaaggctctccatgaacccaagccacatcttagcttaattacatagctcctcctcctttctccactgactgctcagtgtgttttgcatctctccattgagcaagaggagaagggaggctcagctagctagctagctaccatctatactagtatcaagtttttttgttcagatttttttgttggaggaagagttctagggagatcgatatgg

SEQ ID NO: 14984 - DNA, 1501 bp, Oryza sativa
gatcatcatttataactttatatacatacatgcacaagtaaactgtgccagagaatattgaaccttagtgatattccagaaaattaattactaccacaaatctaaaattataataagtcaaaaatataaaaattactttcatttattcatattttttatttattatgaatatattgtgatatagaattaacttcaatcactaatgctcttagggtctaatttattcgggtcatatgggctcgctgggctcactaagtgatatatgattatataatatatattattgatttatttgaaattttcatgtttgttttgatgacatgcacatagttagaatataactcgagataacatacttttacaaacttaaagcatagttaagatgggttttgaattattaatttggttttccgtctcatctatccgagaaggggagaacaagaaaaaagagggtacatacttatgtatatgcatgtccatgggaagggattgtggaagttttattgacgtgtggctttttaagataaatctaattggtaaatttaagatagattctatgatataaaattatgggtgttgactgtattaagggcttgttcgtttcgaaggaaaaccaaaggatttggattagtaaggattaattagtatgagtgtcattcagtgagtaggattgaaggaaaaccaaaggaaaattttatttcctacaagttgtatagagaaaacataagaattttttcatccactgataaagcctcttcaaaaaattcatatggattgatgtgtgcaaacattgtattcctccaattttcctgtttctaaggattcaaattttgttctttctttaccgtccattgatttgcttccattatatacatctttaaagttttcttgccggactgaagaatttacgtgaaaacgacagaaaagttgtaacagcacggaaggttggggaaataatgctcacttggtcaatcgcaacttcatctctttaacaaattattaaaatttgcaacacaaaataaattttcattctgcatgtaaaccaagattagaaaagttgcatatacaaaatgaaatttggattataaaggttatccaccggatatttcttgtacatggtagctagctaggataagaaacatgtcgtacgtagcagcatgattgctgagactgtgcctttggattgaactgaactgctggtgtgtcacttgtgtactgccttcttctcgatcagcttgtggggaatctttgcgtcaacgctgccgttacgtaagtttttgtcgcccgagcctcaattattgccacaaggttgcttttcctatcggtttcacagtgctagacgttgatgcaaaggcaaaagagccatgcctatctctctagctacctcttggaaattccctccatttctaaaagctcaggcccctttttgtttcatttgattttaccatttgcaaaagtactataatattgtacgtgttcaatcattcatttaccagtaagc

SEQ ID NO: 14985 - DNA, 1501 bp, Oryza sativa
cgtaatgagctgatgaagtaaaagcacggtcggaatcggtagtatctcttctagatgatcatatttatcatttattatactactaagtgtcgatattaatacgatgtagaaataaattaaaaaaacaaaatttatatatagcccaaaacaacaacgagaacaatattcttataagaaaacggcgctcgatcaatcaagaatttccgtggtcatttttaccccaaaaaaattatatataacccaaaacaacgagatcagtatccttataagaaaacggcgctagatcaattaagaatttttgtgatcattttcaccccggctgatgggctgatggcagccagaggctttggtccacaataatcgaccatgcaatgcatgccttaaatgctgcaggtgatacgtacaccttagttatataacactacttcgatgatgctgacggctactaatcatccactatcacggctaggctttaattaatcattgtaacgaaatggccgaacatctccatacgtcacgtcacgtctggtgatgatcgatcgatctcatttatcagttcattcacacgtcattatccatgcattcgactactcgagagtcatagtcatactgcctccgttctaaaatactccctccatcctataaaaaaccaacctaacactagatatgacatatcctagccctacgaatctggacatacatctatccaattcgttgtactggaatgtgtcacatccaattctaaatttgtttttctcgacggagagagtataagtgtaatcgcgggtatctgtgcccaaaatttaacggttcatgttatttaaaaaaattatgaaaaaaattagaaaattagttacacataaaatactattaatgttttatcatctaataacaataaaaatactaatcataaaatattttaaaataagacgaacggttaaacgttgaaaattaacaatgcagaactatatttattttgggacggatatatttattttgggacggatgaagtagttgttatatatgcccgcctttttaatttgttcaatcttgtgtactaataaactcggccgatcaacgacaaaattgttgaagagatcactcaatctcgacaccggcgaagacagaaaaagaaaaaaaaaaacctaaaaataacttgtctcttttcttcactaccaaaaataattgtttggtgaggtgatgacttgagtcaacctcttggttaagaccaatgccctacggttttgctaaaaaaaactgatgatatttttttcctggttgatgctaagtttttagaacatactacttatgatggattttcagataagcccaatgccctaagcaaccagatactccctccatagttataaaggaagtcgtttagaacaatgtttaagttaaaccttgggaatataaatcataaataactctcaagttgttgaatttgaaaatgtaaaaattatatgaatagatttgtcttgaaaaatactttcataaaagt

SEQ ID NO: 14986 - DNA, 1501 bp, Oryza sativa
atgtgaacccccatataaacaccaaacaaacttcggttggcttcgaacgggacctgatgctatgctcgtacacctatcgtcctttgttaattaggcctctttctttatttattaaactagcaaaaatacgtattgcgttaactggcaaaaatacgtattgcgttacaaagacaatttttacgattgatacaaactctgccaatttagattataaatcgaaacaaaacaaacaaaacagtagcaaaacaaagtcaaatcatatatagcattaaaccctgttgtgctcacttcgtgtgttatcgtacgtttttcaaactgctaacgtgtgtattccataaaagcattttatatagaaatcactttaaaatatcagataaattactttttaaaatttataataattaaaagagtaaagaccatcaccggtccttaaacttgtaccactgtgtcatcgcggtccctaaactcacaaatcgatcgttccggttctcaaacttgttcaactgtgtcatcccggtcactaaaattgcagatcactcgtttagattctccaacttgttcagttgtgtcacctcggtccctaaacttagatttgaatatcatctgggtcaaataggacagtctaaagactttgtatttaaaaataattcataacttttttatgtgaactctaataaagacaaactttatatcaaacttgtagccctcaacgagatctacaactttatagttgattttttttattttaagtcatttttttgtcccaaaatgtaattttaaaattaaaatttcaaaatctataaaaatgcaacaatattttgggaccctaaacagttttaattcaaaaacttatcaactacaaagttgtaggtcgcgtcgagggctataattttaatataaagtttgtcttcattagagtttacataaaaaagttatgaattatttttgatataaagcttttagaccgtcctgcttagggaccggggtgacacaactgaacaagttggaggacctaaacgagtgatctgcaagtttagggacctggatgacacagtcgaacaagtttaaggatctgaacggtcgatttgtgagtttagtgaccgggatgacacagcggtaccagtttagggaccggtgatggactttactctaattaaaacttaattaatcatgtactaattaaagcatttcgtacctcactcgtttcattttcctttttctataagagttccgtacctgcaaaccttttgcaccgacggatgttgacggcatgattaaagcatagaatcctactgtaacactaacagaggagtattactgatcccatgttgttagtgggctgatgtagcgataagaaaagcactggatgctatgctatgcccatatggctgtgtcgtgcttgtactagtagcagccgggggttacgtgcgggcgtgtggcactctcgtttttttagtggtaatccacgaaaggtgacgagcgagtagtggtggcgattagg

SEQ ID NO: 14987 - DNA, 1501 bp, Oryza sativa
gcatcgcaactttcgtgaaggtgtcgttttccgccttggggtgttgttgtagacccggcggtgactgacctcgcatagcggtggccagttcggtgttcgactctcctctctatagcttatgtttgtgcagttggtgtgaggtttcgaggcgtgcgctttgatgcacatccttcctccacaactagttgtcgatgaaaaactttcttgtaactcttttttcctctattttaataacattcggatgacctccttcgatcatcccggcaaaaaaaagtaaaaaaataaatctatagcactcaacgtagattatttctctaattattcagaggtaacactgattttgcatcaaaacactaattagtgtagctgcgtcggaagggcacgcgtgcgctagaagagcgcatgcacgcgtgtaggccggtgcagctgcgcgttgctgctcctgctcgcatgggccggctatggccaattaagtatacaactttttatttgtattttggctatacccttgtaaggctctatgcttcccttatataggttgagggcaaggttatagttaggcatacacgactttagtttcttcaccaatacaaggaaatacccaatcggggtcctatgtcatgccttcgcatgcaaggtaactccaatgaccgggttatatactactacatatatcacgatcatggcccacttcctatcttcagtcgaatattcagtctgtgtgggtatccggtactcatgtcctccacactgatgattctctcaagaagatatcaacacataggaggtgaggtttagaactcgacatctttggtaggttttgatatattagattatatccacgtacttctcccttacttttgaagttcactttgaaatttgatgcatccgatgcagagaatttagctatgttaaaagttgacgtatgagctagatgtacttatggtaaagatgccatatgagcaaaattttgtagacaatattttgcaatgatggctcgcgttcgttcatggatgattagatttggtaatactacttaaggttctaaataaatggtatatatgtaatacgagacattataaatctaattgatatagatggaatagacggatgggggctagtttttgaagtaggtaatttcgtctcgtgttattcacgccacctcttgtaagtagtgcttttaaatatagtatgacaaggccgtctggctgggagagcatacaccattatattgttggcatgtatgtgctctactatccaagctcggctagttatttcattctttcattataaattaaaaaaatccactcgatctcgtgtgtgccatatatatacatacatacatacatatatatatatacacacacatatatatatatatatacatacatacatacatatatatatacatatatacatacacatatatatacatacatacatacatatatatatatatacatatatacatatatatatacatatatacatatatacatat

SEQ ID NO: 14988 - DNA, 1501 bp, Oryza sativa
gagggaggtggagacggcaaggcgacagtggcagcaccggcggctgtcacatcctgatttttgtttcaggatttataaattatttaataaattattatttgaatttatatcaaatgatctttaatttacaagtgaagttaaatgtgggaaataaaatttcctaaatataaagcatggatggatttaatttttattaaattccccatgattaagtcaactctctgagattttctcggatttttcagagctcaattccttaaatgatacaaagaacagttcagtaattatttgatcaataatgatctaattatatttgttaagagtttttttttgtttaaaaatccttaaattataaattgttgtttaaaaggaataattagaaatgatcttaaaagcttaaaagagaagatctaattttaatttgttaaatctcaatataaaattgggctagataaaattttgttaaatactttgcttaattctataattcctagatttttctgggatttatttgagctaaggaagtatttttaataaatggaattgcatttcatgaataatttaaattgaaaaaggtttttaaatgtcttcttttggctttgggccgaaagtcggcccaaaacccctctctttctctctctccccggcccagtcagcccagtccgagccgccgctctcctctctctctctcgatgtcgctgacaggtgggccccacctgtcagggttgtcgtcaacctccagccgccgccgcccgaaaccctagccgagccgcgtccgagccgccgccgtctccttccaaatccggtcgattctttccttctccggtgaaatcttttgaggggaaatgatcttctcgatctcctcttccttttctcttttggaatcatcgtcttaatcgctttggaagttcatggattcgaggtcgaatcggatcggtttctttcctccgaaccccaagctttccatcccgccgccggtcgccgtgggcctttgccgccgccttccaacccctttaaaaggacccccggtgtctcctctacccgccgcctccctcgccttcgtctctcgccgtcggaagcgccctagcgccgtgtgacctagcgccgccgtcgtcgccgccgctccagccgtgcgccgccgccgttccggtcgtcgtcgtcgctcggggaggtcgccatcgtggtcgccaagtcgccgccgtccccgtccaccccttcgccgtcgccgaagaccgccagagcaccgtcgccgccgtcgacccgatcttcgccgccgcttcttcctcgtcgccggcgccgtccgttgcttttccgccgtggttttggtcaccggtgagttcgtcgcgtcgccttctacccgttggtgccttccgtttgcgtcgtcgtgccgtcgttcgccggcgagcatgcgccgcccgagctgccgagccgccaagccgccgccggtgctgacgtcatcgctgacgtcaccgctgacgtcatcgtcgtcgttcatccgtga

SEQ ID NO: 14989 - DNA, 1501 bp, Oryza sativa
cggggagagagagaaagagaggggttttgggccgactttcggcccaaagccaaaagaagacatttaaaaacctttttcaatttaaattattcatgaaatgcaattccatttattaaaaatacttccttagctcaaataaatcccagaaaaatctaggaattatagaattaagcaaagtatttaacaaaattttatctagcccaattttatattgagatttaacaaattaaaattagatcttctcttttaagcttttaagatcatttctaattattccttttaaacaacaatttataatttaaggatttttaaacaaaaaaaaactcttaacaaatataattagatcattattgatcaaataattactgaactgttctttgtatcatttaaggaattgagctctgaaaaatccgagaaaatctcagagagttgacttaatcatggggaatttaataaaaattaaatccatccatgctttatatttaggaaattttatttcccacatttaacttcacttgtaaattaaagatcatttgatataaattcaaataataatttattaaataatttataaatcctgaaacaaaaatcaggatgtgacagccgccggtgctgccactgtcgccttgccgtctccacctccctctcgcgccttcgccctcgccgagcgcgggcttcgccggtggacgcggagaaagtgaggaggcgagcgctcctctccttttccccggctgcgaccaccggcatggaagaagaagaatgcggcggcaatgatctcaactattgtggcggcggcgatgactggtggcaacgatgacctcgaccacggcggtggcaacaacgacgacctcgaccaccacagcgacgatggtaatgacctcgacctcgcccgcttcaactggttgctgaccggatttggacgagaatgagatttcggtcatcggatcggttgatggcgagctcctggtcgcttgatttagtggcactgggctcggcggtgacagattgggtggcgctgaggaggatgaagtttcatgcaccggtatgcttcctccagtcaccgttgtttctagcgattctctttccatccccactccctattgatctgtattgcctcgtcaaatagtgaccgcgagccgatgcttgctgaggagcccgtactttaggccttccaatcttcaatcaaccgctcaagggctcaaggtgtttacacctaaatttggcacctaggatcgaaataggaaaaattgccaaagtttgaagttctgccggtttcctccagagtgggctggtctgaccgccgtttgtcggccagtcagaccgggcggtatgtggctggtctgaccggcggtatgtagccagtctgaccggcagagtccgagtccgggtctgtttcgccgggtctcgaagtttccttgctcgggaagacatgtttcgggtttcctttggattctatcccgaattggacatggaggagagcctgttgagggcaagaccaacc

SEQ ID NO: 14990 - DNA, 1501 bp, Oryza sativa
gagggaggtggagacggcaaggcgacagtggcagcaccggcggctgtcacatcctgatttttgtttcaggatttataaattatttaataaattattatttgaatttatatcaaatgatctttaatttacaagtgaagttaaatgtgggaaataaaatttcctaaatataaagcatggatggatttaatttttattaaattccccatgattaagtcaactctctgagattttctcggatttttcagagctcaattccttaaatgatacaaagaacagttcagtaattatttgatcaataatgatctaattatatttgttaagagtttttttttgtttaaaaatccttaaattataaattgttgtttaaaaggaataattagaaatgatcttaaaagcttaaaagagaagatctaattttaatttgttaaatctcaacataaaattgggctagataaaattttgttaaatactttgcttaattctataattcctagatttttctgggatttatttgagctaaggaagtatttttaataaatggaattgcatttcatgaataatttaaattgaaaaaggtttttaaatgtcttcttttggctttgggccgaaagtcggcccaaaacccctctctttctctctctccccggcccagtcagcccagtccgagccgccgctctcctctctctctctcgatgtcgctgacaggtgggccccacctgtcagggttgtcgtcaacctccagccgccgccgcccgaaaccctagccgagccgcgtccgagccgccgccgtctccttccaaatccggtcgattctttccttctccggtgaaatcttttgaggggaaatgatcttctcgatctcctcttccttttctcttttggaatcatcgtcttaatcgctttggaagttcatggattcgaggtcgaatcggatcggtttctttcctccgaaccccaagctttccatcccgccgccggtcgccgtgggcctttgccgccgccttccaacccctttaaaaggacccccggtgtctcctctacccgccgcctccctcgccttcgtctctcgccgtcggaagcgccctagcgccgtgtgacctaccgccgccgtcgtcgccgccgctccagccgtgcgccgccgccgttccggtcgtcgtcgtcgctcggggaggtcgccatcgtggtcgccaagtcgccgccgtccccgtccaccccttcgccgtcgccgaagaccgccagagcaccgtcgccgccgtcgacccgatcttcgccgccgcttcttcctcgtcgccggcgccgtccgttgcttttccgccgtggttttggtcaccggtgagttcgtcgcgtcgccttctacccgttggtgccttccgtttgcgtcgtcgtgccgtcgttcgccggcgagcatgcgccgcccgagctgccgagccgccaagccgccgccggtgctgacgtcatcgctgacgtcaccgctgacgtcatcgtcgtcgttcatccgtga

SEQ ID NO: 14991 - DNA, 948 bp, Oryza sativa
ttaacttacaagtgaagttaaatgtgggaaataaatttcctttaatataaagcatggatggatttaatttttattaaattctccatgattaagtcaactctttgaaattttctcggatttttcggagctcaattcctaaatgatacaaacaacagttcagtaattatttgatcattaatgatctaattatatttgttaagagtttttcttgtttaaaatccttaaattataaattgttgtttaaaaggaattattagaaatgattttaaaagcctagaagagaagatctaattttaatttgttaaatctcaatataaaattgggctagataaaattttgttaaatactttgcttaattctataattcctagatttttctaggatttatttgagctaaggaagtatttttaataaatggaattgcatttcatgaataatttaaattgaaaaaggtttttaaaagtctgttttggctttgggccgaaagccggcccaaaacctctctcttcctctctccctccccggcccagtcggcccagtcaacccgcgctccttccttttctctctcagtcgctgacaggcgggccccacctgtcagggtcgtcgttctcctcgcgccgccgccgccgcccgaaaccctagtttcgcgccgcagccgttcctttccaaatccggcgttcctttccgtttccggtgaaattgattgaggggaaacaatctttgggatctcctctaccttttctcctttggaaacatcggctaaatcggtttggaatgtgtttgattcgagttcgaatcggatcggtctctttccttcaaaccccgatctttccttctcgtcgccggccgccgtgggccttcgccgtcgcctccgagcccctttaaaaggttccccaagctcttctctacctgccgccaccctcgccttcgcctctcatcgtccgtagt

SEQ ID NO: 14992 - DNA, 1501 bp, Oryza sativa
aataaaataaaaatgtagtgtatgtggaaatatgttaaggaaaataaaagaactaagtgaaatagaataaaattaaataaaatattgtagtccatgtagtcaaactcacctgtcacaggctctaactgtgaggccgtcacaggtgcccagaacgctgggcccgtcacaggtggcctcagctgtgacgaacccgctctttgcgcccgtcacaggtgacctcacttgtgacggccccacagttggcgcccatcacaggtgagtttgactagggttaacctagggttggacctcttctagatccagatccggccactctctcactctcactcactctctcgaccgccacctcgaccgccgacgctgctcgccctcgccgcctcgccctctccgccctcctctccaccgtcgccgcctcgccctctccgccgccatctctgccgccctctacgccttcctctccaccgccgcccctcgtcctctccgccgtccatccatcgacttccccgacctccccgaccccgacctccccgacaccgggatccacgatgccgtccacctccacctccacgacgccgggaccccgaccactgccgccctctccgtcgccatctccaccaccactgccgcctcgacctctccaccgccgcccactctgccaccatctccaccaccgccctcgtgtgtttgccgccgtccgtccatcaccggccccgacctccccgaccccaacctccccgacgcctggattgacgacatcggcctgcaccgccgaccgcctcgacctcttcgccgctgcctctccgccctcgtcttcgccgccgccgggatccaggacgcctacggcctgcgccgccttctccaagtacgccaccaccctccccccttcctccttttttcgatggatgaattgcattgtttagatgaatgaaatgtgatttgttgtttcgattgttggtgctgctgtgtagatgaattaaatgtgatttgttgtctgtagatgttttggatgaatgtaggggctagattttggatgaatgcaatattagaggaattattctattggtattagaggatcttagcatgaattttgctgcagtggatgttcttttctttatggataagaacagattatctacacttgttgatttatatacccttgttatctatgaataggtgaattgcatgaattattgtttatatacatgatttatatacccttgctgtctatgaataggtgatttgcatgaattgttgtttatatacatgatttatatacccttgctgtctatgaataagtgaattgcatgaattgttgtttatatacatgatttatatacccttgctgctgctgttttagaaattattgtgggctgttttattatctacacttgcccctgcttgataaattaattgtgggctgtttaagaaattattgccatgggtatgataattttttttgatgccttgctgtctatgtttgcccatgctgctgcctatggtt

SEQ ID NO: 14993 - DNA, 1501 bp, Oryza sativa
ttcaaaactacttgcgaaaagctaaggcttcttttggtttccttatttttaatagtttgtttctaaaatggttactgatcttttctccctctttcaaaattgtagatggcagtgaacgccagcttcagttcccacggttttggtgagggtcaccacgtcgctcagcttcgtgacctcgcccgcttccttggcttctcgtgtcccgagtacacggggtactccgtggaccgtgttccccctcgctgtgagctctctgtgtacctttaccctcgtggaggtatacacggagccggccttcgcccacaccactttactgtggccaggcccactctccagatcgcgtaccaggacctctcctggactgcgcttcgtcgcttggcccacgactacagccaccgtctcgggggctctgccttccggcagcttccacgccttccttctggccatgcagacgccaggtacccttgtccgtacagcgagtcttagccagtgctgactcgcatggttgagctttcggaggctcaggccactcagcactacctactccttgagacttaccgctcccttgcccgccgctacgccgctctggaggcccgtctggccgaggagggtgtcacctcagttgacactgtctcttgggactcaggccgcctctgccacgccagccacctgtcctcccacagctcccgcggctctgctcgcactcctagtggcccgcgctcccccagctcacgtgcgccgtactcaccagtgtactccccctacccacacccagttagcccctcctacacccccggacacaccccagttgcttcctcccaccgtggcccacactttatccgcactgcgcggaagcgtgttgttggttcttccaccgtgttccgattcgactacccagctcccccaccgccagcggcccgtgctgctatcggccctcgacaggttccgccggtcccttcgcgtcagccgattgacgtttcttcgactgaggagccgactacaggaggcagccagacggacgaggagtagaggaggcagtcttcagcagccgtccgtgtgttaggcccttttgtttcgccgccaactcttttggagtcgtggcgaggtagtgcgtgcgtgtgtttgttgtgggtgttgtttggtagtctggttctcctaggtggtgtgcgtacagtcaagctcggcgtagctctgtgacttgtccacacccgttgtattaggtgtttttatgattgaaaaatccagcttatgcctagtgtgtgctatctgagttgctatttactttgctccttgccctcctaagtgcttatctgattcttaccccgccctcttctgggagtttagatggctagccgcccccgccgtgctgctcgtgcgccagcccgcttcggttttgaagaaggtagagttgagccagaagaaaatcatgagtcagctaatgagcggtctcaccacagcaaccgttcgcaccgtactgcttcccgcaacgcagaagttgagc

SEQ ID NO: 14994 - DNA, 1501 bp, Oryza sativa
catatatgtgtccaaacatttgatgtgatggagtttttaaaagtttgaatggaactaaacactgccaatatggtggccaagcattttcatggcaaaaaagaaatatataataatatgtttgaatcaagtaaataagtatgtatttaaataagcatactgccaactattctcctcccactccctatctctcagattctcaccaaacttttaagcggcagccgatgggagagcagcaagcgggaggaaaaagggggaggtggccgacaagaaggtggtgagcggagaaaggcatgcggggtgctgacttggaggagggggcgatggtcgtgatggattggaagggtggtaggcgacgttcttcctcctctctctcccccatcttccctatttgtcaccatttcttcaagcagtgacgagagggtgatgagtggtggggagaaggatggctaccaacttggagggggctgatggttacgattgattggaagtgtggtagatttgtaggcgatgttcttcctcctcctgtctcccccatcttccccagttatcactaggtctccgagcagtgacaagaggtgatgagtggtagggagaagggcgacggcctatggtgcgaggggtgtgcgactggagggtggcaagcagccaccaagaggccacttgttttgtatggcgtgacggaggcgccattcgtggatagcctagtggaggggatggttggggatgagcattaggtgtctcgtcgatgatgtgtcgcgcctgctgtgcggacactccctcaccacctctgcatcataggagaatatgtcgttggcgacctgccggtccagcatcacctccacagctccacccaccctgtgtctctctgccgtcaacatgtgggggaaactcaccacgacagccaaaattagacactatactgtccccctagtgccctagattttcgggtaaatcagttttgcaaattgagaaacacactacatctcatattgcggttggaagacataattcaaagatggacctaaagcaaacttactcccactcttagtgacacggatctctctattaaaatgggcccagttagacttactcatggcccatgggccggacttagtgacaatcccgttccgaattacccgtttcttctttttttttcctttctcgaatatttacaggcagcgtagcccattacgtgggtccaccgccacgcctacccattacagagtcactgagaggtggggcccacgctaccggcgaggtcgggatgcgtggcgatagatagagaagagacgagaggttggggtgggcggccgcgggagctccacggcatcgatcgccatcctctcctccgcaacaatggcgctcgcctcctcctcccgcctcctccaccgcttctcctcctcctctctgccgcgaccctgccggcgacgggtacccaggccacgcggccacagccgcttcgccgtgcggtgggagcaccgggcggcggcggtggtgctgc

SEQ ID NO: 14995 - DNA, 1126 bp, Oryza sativa
caatggtatcagagcaaccctagtgtttagatcgtttcggggaaagaaatccaaagaaagaaaagcacaagatccgcacggatcaaaagaaccaaaaaccctaaccctaattcttacctcgtcgccggccgtcgttgacgccggcaacggagggggggaggggcaaagaggcgccgcctaggagccactcgacggccgcgcgcgcacctgcacgcgcgtgccggcgagggggcccgcggcggcgccgccatctccgtcgtcgccatctctctctcacacggtgggggttagagacggtggggggagcggagaagagaaaagaaaggagcgccggccatggcgcggcggcgcgaaggtcgccggcgatggcgacgccgtccacgcggtcgcgtgagagagagaagagaagagaagctagggttttcggcggccggccgggagaggggggtttttgatcctccgatctcggcgcccggccgtccgatcgaaaccctagctgatcggacgggcggcggcggccggaccgaaatcggcccaagtggggagcgcgcggcggcggctttcccggcccaggcccaggtttcggcctgggggaggggagggggcgctcgcccgcgcgcaaagtggccataggccgaccggcaaaggccggaaaagttcaatttaggtccctcggggccgaaaatgaataaaagagaacagtagcaatttttccattttattttgtcgatttttcatgcaaatttcaatagaattttgaatagatttttgcatgttttacctctgtttaaatttgaaccaacgggagaattttcacagagagagaattacagagattttgctactgttcatatgattttatatagtcttccgctgcaaatagatgaaattgatgaaaattagtgtttctaaaattaaatttcgaaccaacgggagaatttaattttaggaacattaattatgtgctatgatgttgtaattttctgaccaacgttgttaattgcaatattatagttatggttatatgtgttatgtctaattctgcccaacggtgatgtaggcttaatgcataatattttaatgttaattttgttctcaccgcacatgattatttcaggtggctact

SEQ ID NO: 14996 - DNA, 1501 bp, Oryza sativa; identical to SEQ ID NO: 14929

SEQ ID NO: 14997 - DNA, 1501 bp, Oryza sativa
ttcgtcggcgaggggggtgtagaaccaatcgctcttccagtcgtcccactttttgcggaggacgcagggaatgtagcggtgcagcacctgcccccgcggctggaagtagcagccaccaactaccgacggcggcgacaccggctgtacggtgaagaaccaccggaacagccagagagatgggcgcaccccgatgaacatctcgcacaggtgcgcgaagatggccaacgtcattaccgcgttgggggtgaggtgcgccatctggagatcataaaactccagaatatccatgaaaaaagaagagaatggcgggaccagccctgccattgcgaaagagaggaagaagacggaccgccccaggtagtgtggcgtcgggcgtccctcgcccagcgcgaccacctcccggccggtggcagattccggcatgaatcggcgcggcagcccggcctgcctctcgctcacgatgcgggaaggcggcagcacgctaccgtcgagcggtgcggagccccgtgccatgatgccggcggaggaggagcttgagagcgagtgagtgcggcaagggtagggcacaggaaacgaagagttagagctcaagtggcgaaggcaaggggaagaatggcgagaggaaggaaacaaatctcttcctcggcgtctttatacccttgccaacgctattcccggctcctcgtttcccgcgcccactacctcgccccctcgtttctcgcgcccacgcctccactaacccaactcgcccgtttgcggcgcacgaggcagatgtgcggccgtagcagttgagatgggacagatcgtgcgcgcattaaacacgcacgccaaacgtgaaaagcgccatcatcacgtctccaggcgaaacgaaccggctcgtcccgattcgcgcgctgcttgagtgatgtagcggtcttaaagaggccgctcattattgtcggtcggttttcccttgccgatgcgcgcgacttgcgaccgctgggttcctacccgcctgtagggaccggccccacctgtcactgggcctaaggagtggcgtcacgcccgagcgcttcccacgaaggggcaatcgccctggcgtaacgccgggggctactgtcggtgacatggggccgagggtatcgtgactagaggcttgggtagccgcggtcacccacgtggcctgaccccctcgggggggtcgggcccgagggtgacgtggcctcccctccctctgtctccccgaggggtcgggcagctcccgtttcggccccgagggctggggcgccccgaccccctgtggttttggcgccacgtgtatgggttaggtaagcacagcggggcccacctaaccgcatttattgcgggttggacgagcgcgccacgccgcatttaatgcagcgcagcgcacgcttatccggtccgtgaccggtcgcagtgtgtgaccggtcacagaccggtcagatcgcgggttaggtggcaacaggcggcctgtcacacgcctcgccccgtcccgtcggat

SEQ ID NO: 14998 - DNA, 1501 bp, Oryza sativa
tttatatctcaaggggataccacatgcaccacttctacctactcttcttttgggtggggactcaccctatcttgacccaaacttggctcgcgccttcgcctggaagctaaatcacagctagtccttgagtaaggcccagtgccgtcactcgcctgacacaggggataaccctgtcattccttcattaatgggtggagatttgcaatggccgctgtccgaatgaccctccgatgggatgggtcatacctacctccactccgccggaagcagatgcaacgtgggagcacggttgtctgcctatgacgtgaccggcgtcagaccagtcacagaccggtcactcttgtccaccgcgcgtcagtttagcatgccgcacgtctgcccttcttcatacaatgacttccttgctatggttgcgatgaagcctggaacgaatctggccgggactgacataccaactccaggagttagcacgccggctccggctagggacgagtgcctggaggctctcatcaatccgacgggacggggcgaggcgtgtgacaggccgcctgttgccacctaacccgcgatctgaccggtctgtgaccggtcacacactgcgaccggtcacggaccggataagcgtgcgctgcgctgcattaaatgcggcgtggcgcgctcgtccaacccgcaataaatgcggttaggtgggccccgctgtgcttacctaacccatacacgtggcgccaaaaccacagggggtcggggcgccccagccctcggggccgaaacgggagctgcccgacccctcggggagacagagggaggggaggccacgtcaccctcgggcccgacccccccgagggggtcaggccacgtgggtgaccgcggctacccaagcctctagtcacgataccctcggccccatgtcaccgacagtagcccccggcgttacgccagggcgattgccccttcgtgggaagcgctcgggcgtgacgccactccttaggcccagtgacaggtggggccggtccctacaggcgggtaggaacccagcggtcgcaagtcgcgcgcatcggcaagggaaaaccgaccgacaataatgagcggcctctttaagaccgctacatcactcaagcagcgcgcgaatcgggacgagccggttcgtttcgcctggagacgtgatgatggcgcttttcacgtttggcgtgcgtgtttaatgcgcgcacgatctgtcccatctcaactgctacggccgcacatctgcctcgtgcgccgcaaacgggcgagttgggttagtggaggcgtgggcgcgagaaacgagggggcgaggtagtgggcgcgggaaacgaggagccgggaatagcgttggcaagggtataaagacgccgaggaagagatttgtttccttcctctcgccattcttccccttgccttcgccacttgagctctaactcttcgtttcctgtgccctacccttgccgcactcactcgctctcaagctcctcctccgccggcatca

SEQ ID NO: 14999 - DNA, 1501 bp, Oryza sativa
gccagacgggcctccagagcggcgtagcggcgggcaagggagcggtaagcctcaaggagtaggtcgtgctgagtggcctgagcctccgaaagctcaaccatgcgagtcagcactggctgagactcgctgtacggacaagggtacctggcgtctgcgtggccagaaggaaggcgtggaagctgccggaaggctgagcccccgagacggtggctgtagtcgtgggccaagcgacgaagcgcagtccaggagaggtcctggtacgcgatctggagagtgggcctggccacagtgaagtggtgtgggcgaaggccaactccgtgtatacctccacgagggtaaaggtacacagagagctcacagtgagggggaacacggtccacggagtaccccgtgtactcggggcacgagaagccaaggaagcgggcgaggtcacgaagctgagcgacgtggtgaccctcaccaaaaccgtgggaactgaagcaaactattgaaagagggagccatctacaattttgaaagagggagaaaagatcagtaaccattttagaaacaaactattgaaaataaggaaaccaaaagaagccttagcttttcgcaagtagttttgaacttagtatccttagggtcgtcctaaatgtcgggtttcgccctagggccaagcctgtgctcttataccatctcttgtcacgccccgaactagtaccgaccggaactagcccgtgacgctctaaattaacctgttaatcgataccagtcccaggaaacggtgctggtatcacaggaagacggattatcacagcaacagaggtctctttattatagagtagaggtacagtcatgttgggctgtggacagatcccgagctcacaactgcattacaaaagggaagcggaagccaagacatggaccaaacaacacaggcgcgacttgggaactaggccgaaaccctaaaactcatcgtagccggcttgctcctggaagaactcctcatcagcaggatccgctttatcttcttcagcaactgggggggattatttatatagagcaagggtgagtacgggagtactcagcaagccatgggaaataagtgtttaatgcaggcttcaaggaaaggctgttgtttttgcaattgattttatttgaactcttttctaaaaacgactaagtgagtgcttctcaaacgacacggatgagacagtgcatctcgtccggtcggagtatgtgcaatgcatcagtctttagaattgaaacaaggttggcacccggccaacaacttttcaacggccacccgggccaacaacttttcaaacggccacccgggcctagctgatcccatcagctacagatttttcaaacatcgaaccccttttcacaacagcaatttcacaagcagtagtcaaacaaaactacggtagaaatcacctcacatccgcccatgaccgtgggcacgactgttcgaacagtttgttaacctctgcagagggggtacactttaccctca

SEQ ID NO: 15000 - DNA, 1501 bp, Oryza sativa
tctgaggacgaggggcgtagcctggctggcagttagcctgagtgaccgactggtggtattgcatgggttgaccgtagcgagggcgaggtgcgcctcgggaagaatttcattgatggttagacttgcgtttcttgtattcttcgtgtcggtgacatggggccgagggtatcgtgactagaggcttgggtagccgcggtcacccacgtggcctgaccccctcgggggggtcgggcccgagggtgacgtggcctcccctccctctgtctccccaaggggtcgggccgctcccgtttcggccccgagggctggggcgcctcgaccccctgtggttttggcgccacgtgtgtgggttaggtaagcacagcggcgcccacctaaccgcatttatagcgggttggacgagcgcgccacgccgcatttaatgcggcgcagcgcacgcttatccggtccgtgaccggtcgcagtgtgtgaccggtcacagaccggtcagatcgcgggttaggtggcaacaggcggcctgtcacacgcctcgccccgtcccgtcggaatgatgagagtctccaggcactcgtccctagccggagccggcgtgctaactcctggagttggtatgtcagtcccggccatattcattccaagcttcatcgcaaccatggcaaggaagtcattgtatgaagaagggcagatgtgcggcatgctaaactgacgcgtggtggacaagaatgaccggtctgtgactggtctgacgccggtcacgtcatcggcagacaaccgtgctcccacgttgcatctgcttccggcggagtggaggtaggtatgacccatcccatcggagggttattcggacagcggctattgcaaatcttcatccattaatgaaggaatgacaggggtatcccctgtgtcaggcgagtgacggcgctgggcctcactcaaggacaagctgtgatttagcttccaggcgaaggcgcgagccaagttttggtcaagatagggtgggtctccacccacaagaagagtaggtagaagtggtgcatgtggtatccccttgagatataaaaggaggaccttgcccaccgaagtaaggggactgagagaaaaaaaagaggactgggagacgactttgagaatacctgagctcgtagaggagagaaagaggaagaggggttctagagtttgaactctcttgctctccggctctctgtaactccttcacacacagatccaccagaacacaggagtagggtattacgcttctcagcggcccgaacctgtctacatcgcccgtgtcttgtgcatttgctctctcgcgaacattccacacattgagggtgaagaacctcacttagcgcccccggccgaaccggcaaagggggacctgcgcggtctcccggtgaggagccccacgctccgtcatctggcgcgccaggtagggggcgcgtgtgtctttctaagccctcgtcctctttcgtgtgcgccaagcttctcccgctcagcccaa

SEQ ID NO: 15001 - DNA, 1501 bp, Oryza sativa
ttccatcgttttccatcataaagctgttcacataacttcacttttgacttggattatatatcccatatatccaggtaccatattaagatgtgattggcatccctcggcaagcactggtatgtacttaccgtataataattgctccacaagtactagtatgtactacttaccgtataataatggattgatatgcatgttttttcttccttgtacatagacacccgagcacatgtcttgtgatatcttagcccaataagaattagacatgtgtagcccatgagagttgtatgcgcatgtttagtaccaccgaagggaggaccattacaaatggtatcagagccgaccctcgcggttgcgcgtatgggtcagtgtgagggcacatggcacatggcgcatgtggactttgcgtgaggcacatggcatggcatatgatgccaacactggacgttcgggcatgtgctaacagggggtgtgtttctatacctttgcttatatgcctgtgtagctatgtgggtgatttggaccgacggggacgtcgggtcctttgaggggggtgtgtgtcagacatcccgacccaataaggattaggcctgtgtaacccatgataactgtgtgcgcatgtttagtaccactttctagtttagcaagggtgcgcccttataaggcctcttccctcaaactatatcactccgggttaaccttttagacgaagtatggacaaaagtataagtgggatggtatgtgtaagtgggcccgtccgtcggatgggctggctacgcggttctggagggatgtgtgattgaggtgaagatggaatattagttcatgtggtagcttgaactactccatctaaaccataaaaactaacttctgctacaaaccgtacatagcctacatttatatttatagctaaaagttgaatttcttttatgggacagagagtatatatacgaagatagctatacatccatctaagattatatgggcacttctaagtgtgttaaatagcagaaataaatattgaggtaaatctctttgatgtacttggaagtttatataattatgtactctacttgactggaaaaatcacgcccaatgatgcaactatcaataattacctaatgatgcaactatcaataagtacaaatttgttggatgaattgaaaagtagtacactacttcacaaacgatttttccatgcgactaaaatcgattttcccagataggggatgacccgcctacacccagatgtccaaaaagtcagtatttttacatggggaagagcaactgcatgtgaaaatacagtattttcgcatgcgggcgcttaagctgtcataatgcaaaaagttaaatcgaatgaaaatgaacaatccaaaaccatagtgtaacgccccacttttcgcgagacgttaaaagctaatttattaaaaatcctaattgtgaaaatttcgttctttgagtgtttgagtctaagttgtgccatagatctcaattaaaaatc

SEQ ID NO: 15002 - DNA, 1501 bp, Oryza sativa
ttatgaaaaataaattaaaataaaattatatcgtacatattatgaaaagtataaaattggtactctttttaaataaactgattgatgcaacatgagtaaaatgctccaatgtttcttgaagttgtatcttgtatgcagatgatatagagggctatgaactagtaaaatacacccccttcccgatgtttagtgtcgtagtatccgagtcttttttttctttggtcttctatttccctcctctcttagcataagtcggtctggcttaatgtattgtgtaacaattattcttttcttctaatatattgacgtgtaatttttttacgtgttcaaaaaaaaaactagtaaaatacagatatatacttttaaacctattaaagtagtgtaaactactctatccgtttcaaaacgtaagaacttagatctaatttttctaaaatataaagaaacaattcatttgtagtatatcatataggaaaaaacagtactaatcatatcgtcatatgcgtgtacagagcgaaaatgttaagcggtcggccgatgtctgcacacgcctgttcccacttgatcgaggtggcgcccgccggtgcacgtgtccgcgcctctcggattccgttgcgacgctgtccccagcagctggtctcgctggcttcgctcctcgtctggaggcgagcgagcgagccgggtcggcgctgcgggtgagcgacgcatatgggtttccgccccgcacgccgcccgcccgcccgcgcgccacctgattcgcattcgctccatccgcttcttctcggattccagctgttcccccgtggcctttcttggattcccccgccccccggcccgcggctcccccgccccacgtacccatggcgttgccgaggtggctcccatgatgcgctctcgccgcctcgccatgtgacccgcgcgccacgccgctttttcgagaccgagagacggagagagagaaaaaaacgtagagatccacgccgcattctccatttctccccctcccgggtgcagctcgccgtatcctgctttcttgccttgcgggcgtcgtcgtagcgtggtaggagtaggggagcccggcgcgcgggcgggcgcgggtggttggtgagtgcgcgcgcaacgcgcagcagcagcagcagcgggaaaaaaaaaaggctaactaagctaggacagaggagagaaaagccgtggcgctttgcggtcacgagattcagggggtggtttgcttttgctcgcaagggaagtgttgggggagccgtagacatccgaactgttctaatggcgaccctctggggggcggtggcggtggcgttgctttgcgcgatgtattggtgaggccggtactaggggagggggtagtagtagtggtacaagtggtggttgtcgtcgtcgtagtcttgtgggttgcgtgcgtgcgttcgtgcgcgccagcgaagttcttgcgacgatcgtgtggggtgggttcgtgtgctctctcgctcctgccattggttgatgagca

SEQ ID NO: 15003 - DNA, 1501 bp, Oryza sativa
gcgaccggatcatgacctggtcggcgccgttccagtccttggtcacctcgaaccccggcctctgctcggagtaatgccccatgctcatcaaccaatggcaggagcgagagagcacacgaacccaccccacacgatcgtcgcaagaacttcgctggcgcgcacgaacgcacgcacgcaacccacaagactacgacgacgacaaccaccacttgtaccactactactaccccctcccctagtaccggcctcaccaatacatcgcgcaaagcaacgccaccgccaccgccccccagagggtcgccattagaacagttcggatgtctacggctcccccaacacttcccttgcgagcaaaagcaaaccaccccctgaatctcgtgaccgcaaagcgccacggcttttctctcctctgtcctagcttagttagccttttttttttcccgctgctgctgctgctgcgcgttgcgcgcgcactcaccaaccacccgcgcccgcccgcgcgccgggctcccctactcctaccacgctacgacgacgcccgcaaggcaagaaagcaggatacggcgagctgcacccgggagggggagaaatggagaatgcggcgtggatctctacgtttttttctctctctccgtctctcggtctcgaaaaagcggcgtggcgcgcgggtcacatggcgaggcggcgagagcgcatcatgggagccacctcggcaacgccatgggtacgtggggcgggggagccgcgggccggggggcgggggaatccaagaaaggccacgggggaacagctggaatccgagaagaagcggatggagcgaatgcgaatcaggtggcgcgcgggcgggcgggcggcgtgcggggcggaaacccatatgcgtcgctcacccgcagcgccgacccggctcgctcgctcgcctccagacgaggagcgaagccagcgagaccagctgctggggacagcgtcgcaacggaatccgagaggcgcggacacgtgcaccggcgggcgccacctcgatcaagtgggaacaggcgtgtgcagacatcggccgaccgcttaacattttcgctctgtacacgcatatgacgatatgattagtactgttttttcctatatgatatactacaaatgaattgtttctttatattttagaaaaattagatctaagttcttacgttttgaaacggatagagtagtttacactactttaataggtttaaaagtatatatctgtattttactagttttttttttgaacacgtaaaaaaattacacgtcaatatattagaagaaaagaataattgttacacaatacattaagccagaccgacttatgctaagagaggagggaaatagaagaccaaagaaaaaaaagactcggatactacgacactaaacatcgggaagggggtgtattttactagttcatagccctctatatcatctgcatacaagatacaacttcaagaaacattggagcattttactcatgttgcatcaa

SEQ ID NO: 15004 - DNA, 1501 bp, Oryza sativa
aaaaagacaaaccttggtttccgtgcccaacgtttgaccgtctatcttatttgaaaaaattatgaagaaaattaaaaagacaagtcacgcataaaatattaatcatgttttatcatctaacaacaataaaaatacgaattataaaaaaatttcatataagacggacagtcaaagttggacacggaaacccagggtttgccttttttgggacgaagggagtaacgatttttcatccaaacttttgtacttgcccaatccaatttgtttgatcgctgcaattcaggtggtgtttggatgcagggacttaactttagtctctatatttagacactaatttagagtattaaatatagactacttacaaaactaattacataaatgatagcgaaagggcctgtagcctagtggttacaagagcctcagtagcacctgaggtcctgggttcgactccccgtgggagcgaattttccaggatttaacggcgttgtgctttcagtggtaggcgacgtacccatcgacagcgaggcgcctgtggtgacttcgtcaatctctccaggatttgccggcccagtcttcgaagatgctcgtaggggtagggtttgcgtgcgcgtgcattgtgagtgtctgcattgtactgtgcctaattaatctataattagaggcgcctgtggtgacttcgtcaatctctccaggatttgccggcccagtcttcgaagatgctcgtaggggtagggtttgcgtgcgcgtgcattgtgagtgtctgcattgtactgtgcctaattaatctataattagagaatgtttactgtagcatcacataggtttttttaagcctaattaatctataattagagaatgtttactgtagcatcacataggttaatcatggattaattaggcttaatagagacacatgattaattacgctcaatagagacaatttttttaagcctaattaatctataattagataatgtttactgtagcatcacataggctaatcatggattaattaggctcaatagattcgtctcgtgaattagtccaagattatggatgagttttattaatagtatacgtttaatatttataattagtgtccaaagatctgatgtgatagggaaatttagtcccatctaaatatgttctcaatattatgagtttctgacaatcgggtccgagaacccagagagacatacctgggacccaccgtacagtgggacaggagagaaaacctccccggatcctgcccctcctcaccgtctccactcccgatctccccgctccccgcgtcccgtctccgatccacccaaacacccgcaccgccgcgctacgcgagcacggcaccgcggcgcggcgcgactccgcaggcgacaagccgaggagaatcccgcgcccgcccgcccgcatcaccgccggatggccgccggccgtcgccggtagggcgataggcgggtagatccagatccggcggggcgggatcatatacaccccgcgccga

SEQ ID NO: 15005 - DNA, 1501 bp, Oryza sativa
gcttaaaatccaactctaacacggactgtatttccaaaagcgaacgatcttaaataccgactcaaacacggatgacgtatcaaaataccggcaaaaacatctttaatttttataatagtagatatttgtagtttatcaatgtactaaataaaataatagactcatgttttcacttatgtttatatttattcgaacaacttattagcaacttataaaacttttatacttgtatccttaatgattaaaaaaatattgtaataataaattacgatgaaaaaactatgtaaatacttaagtatttttgttaaataaacgatacacaattttgttaaatagtggttttgttaattttgtgaaataaactacaatgaaaaaactatgtaagttttagaaggagttattaattaaaataaatatttatgtagtgttacatatgtgatatccttatcttcatatttgaatataattctatatgatattaatatcataggagtaatattaatggtcaaaattatctattgaagactgtcaaaaacttgcgtcttatatattttttttggttgaagatatataaattgcagaaaaaaaaactccactctttacaggaaccaatctgagttgctacctaccttgtgaagcacaggcctttctgattaataagagaattggcaatggctgagggcatgcttcggttaggaatgctcttgaatttctttacgcccacttccttgcacagctcggcatccgccaccatgaccaatggttgtcttcccatgtgaaatctacgagcaaattaaactagatccagttaaccgggtagtagaccctggtattcccagttctgagctctgcgttcgagacagagaagcaccagtaagcagaggtgccagtcacctgaagacaggaccgtacttccttgcgagcacggtgaacacgtccggcccgtgcatggcgagcaggtggaggtggccgatgaacggcaggggcacggggcccggcacgtgccgcactttccagtatggctcgtacaagtagcccaacagcaggagccccacagccatggccaccaaggtgaccgcgtactccgccgttgagcccagcactgtgctgatgatctccatctcacccttgcgtctctgccttcccctctttgcctcactgtcgcagttcgtggtgtgccaagcgttgctggttaaataggcttgcgattttgtgaacagtccaacggagcagatggagaatcaatgaggcatccttgagagaggcatatggttttggctgtattagtttctccttaatgaagtaataaaacaagcataattaaatcgcgtgcaaccaattagtacatcgtgacaaattttttgttttcttcgggagggtagctgtcagatgctaatggtggttgtcctgacgtgttacgtgtatgcaccagatgaccagaaaccccatcgttgcatgagttcatcgccgtcagatggtgaaatgagtgcctgtgtcttcg

SEQ ID NO: 15006 - DNA, 476 bp, Oryza sativa
cccccccctcccccaaacacacatacatagcttcgccactggactagaagtaacatattggaatatagcagcactatttctgcaattctatttaacgggccgctatagtgtgagcatattttatataaccactaacccataacaaattaatgacgagtttgttagttgttttgtcttccaaaacattatattcctgtgagtcataacatctaatgaatagaatatcatgtatgcttcttaatttagtttaggttgaaataatacatcaactttttgagtgctactaaatctctacttatccttgtaggttatatcattaatttatttcttagctgctttgttaatgttttataaagtcgttatttgtaatactctattggaacttagcacccactatccacgatccgctacataggcaacaatctactaccgacgcgatatacgctatttattaaacgttggaccccacaatcgct

SEQ ID NO: 15007 - DNA, 1501 bp, Oryza sativa
agcatagtatcttgagcttctcctagtgagcggtgtggaccatccatgatggacatgctcctgtgtgggtgaggggatagttggacaagcaacactaagggaggaggatggcaggctggcggcatggcatgaccatgcagaagcaacactcacagctagccgaaaccctcatctgcgggcaacgagggagcatggtccagaggaggacaaatagtggcgcaacatggttgtgtgagagcaaagagaaaactagcagatgatgacatgactatgggactgaggggaacatccgccactttgcgtctttgcaactcaacttgttagggcaacaaagtcaaagcaactggcaacgtgcaggtgttgcgggaagggatgtggggataaggttgggatgagtagggcttttctttgggttattagtaggattattgtcttttgcaatggacttgtagaatgatccaatgtaccttaccgttttagagactcgtgggtgaaaacaaaaatccaccctggtccgcaagaagttaagccccttctcgacagacctacaggtgaaaatttgccttatccccgtacgagcgggtacctggtggggacttaaccccaacagggcaattgccatctctacttagtgttgacttgaggtggcgtggtcttgtgatgtcaagtaggtaacatatcatttagttaattgtcagatgggcatggtgtgctttagcttgcttggatgcgtgagcgatgtttaacacacatgtgtgccatggacttcttttttattcatgtgagcttctttttttgtgtgttacattgtaataatcagttgtagctcgttgagcaagggtcggaatattctatttcattatcttaaaagaaaaagtgtgccatagactggttttcgcgtttgcggcactgaaacaaaacatatgaccctgtttacctgttgcttctcttggcttcctgtcctgtcacccccggcgagaaaaaggataatatgccactccatttggtgggtttagataaaatgccacccaatacattgcaaaggataaaatgccactcagtaggttactttcaggatattttgccactttgagggattttaagaccaaaatacctctagctgtggatagagaggaagagggaggagcggaaggttgacccggacgatgctcatgctcgccggcagcgggtggcgagcacacggggggcgggctgtgacatgcagacagggggaggaagatggcggcgaagagggaggaagacgagaactgcaatgggggaggaagacaacgacgcttatcgggaaggacgacgacgacgatgggggaagaagacaacagcgatgggggaggaagacgccgacgaagagggaggaagacaacggctgcgacaagggaggaagatgacgactgcgatgggggaggaagacggcggcggtgatgggtgaggagggcaatgccgacgggaggagggaggaggcaacggcgatgacgtggagggc

SEQ ID NO: 15008 - DNA, 1501 bp, Oryza sativa
actaaaataaattctgaaataagaaaaagaaaaataagagttcaagtagaaatataatttaaaactaacttaaatttcaaatttaaaaaggaatattaaatcacttgtgtgtgtataatatttgtagtgatcaattgggatttgaaccatgataattggaattatatatgcatctacgagtctattactcaagtggttcctttcaagcgaataatttattatggatcatatttttaggtcttccttatacacctcttaattaatgaattaatttatgaaacattggtgttttaactatgtctatccacgtgcggatatagaaaccgaatttctatacattattaaaaaaataaaatgttcttacaaaatgtatgatatacactaatgaccatatgactctttttaaggtttatggatttacctagtatcgatctctctacccgttgagtgcatgtaagaaaggatgcacatatgatatatgtgcatgcgtgaatggtatttgttatacaagttatgacaggatatatatgcaacgtgcacatgtgtgtataattgaaaaacatatattaatcagggatggacacacccatagggcatagggtggggcgattggccaactatatatggtccacgccgcccccacacccctatatcatcaccaattgtcatctcgcactggtgaagaaatcgtttttagttccggttcgtaacccactacaaatccgagactaaaaatctctatctttagtccggttcaaatactcaggactaaagatcgatctttaatcctggttggtgtagatgggagcggcagtcccagttagtttctttttgtttcatttattgctacttactacttaatctctaacttattttctcccaaattgggtgggatgcatatccccaaatcaaagtaacatcccaaatacacaaatcatatacatcacatatccatgcgatgaatcacatattctcaaaaatgaaattatacatctcaatccatacaatgaatcacaaattctccatctcaatccatacaatggatcacaaaatcttaaaaaaaagaaagaaaagaaagcgaagccgccagccggcttagccgttgccatctccccggccgccgccgcgcaggccgctgtccggcccgccctccccctcctcctgcgcactactcagccacacacgactagggataaggaaagaaaagaaataaggaggaaggaaagagataaggattagagatgaagagagagaagtttgtgtagacgggaaaagaggatgagtactagggattatatagtgcgttttgatatttagtaccggttagtaacaccaactgagactaaagatcatcgtgatctttactcccggttgataatacaaatcgggactaaagatcctggagggccctaacagcgtaacaccaaccgggactaaagatcgtgtagtcccgttctgcttataaaccgggactaaaaaccatctttagtccaggttttta

SEQ ID NO: 15009 - DNA, 1501 bp, Oryza sativa
gcccctcacctgcatttcacatccaggatggggacgtttcttcctccaggtcgtcactggacgcaacgacatgatatgctgcgtaccttcggtaacagcagaagacgcatctggcaggtttcatcgtgacggtttcttcttcctcctttttccggcgatgatcagattgcatatgttcagatgccaatggaagctgaagctttcgtggcgtttttgtatatgtgtgtgtgcgctacacgatcacaacgtgtggttggtggcaaactggcagggtgtgtgatggatgatgctaccaaactaaggtgcctggtcaccttctctgaatcgctggggatgccaagaaaaaaaaaagaaaagaaaaggtgatcgatcgatgcctcgtttgcttatggctcaatgctgtgactcgatcgatgggcagaaacgtgcgtttggcttgggacagaccaacctactctagacttgaacagcaattttcggttggatttgagttgataggaacgactatttgtgcaccgcaagtagaaagaaatcagttcaggactctagggatcccccttgtcaaaaagactagttttgatcggtttagctattgaactcggaatccatttcttgtaatcttgtcactgaactgaaaaaaagtggttgtccttcacttacagcttccagtaatcccgtataaacaatggcgtcctatatcaaatgtgcattatctagacttccgtataaacaatgtgcagactctagaaaattggacttccttggacgcataatctcgtcggtgtgcgtcagtcattccagtgtactaatctactccagtaatcaactggagaggacttccgtactcaccaaactaatcttgaagcaagctcaggtagaattactcgcggcaaccatgcatcaaattttaaatgccccaatattggtactactacaactatactactaccactcaccaatataatctagcccttttaattcttgtttgtttaaataaaagagcaaaggggagaaaaatgaggagatggcgggaaagccaagcatcggttggtgactgatctcgcgggttggtccgcgaacgcagcctgacaacaacggcagcagctgcatctgcagcagcagcagcagcagccaacgcacgcacgcaggcctcctctcctctcctccctcgcgccaacgcgccaccatgcaaagcaagcaagcaacacacaaccccttcgcttcacttggcggcaacggagacgccgcacccaaccaacccgccaccgtctcccacacgcgccgacgcctcctcgacccctcctctcccgcgcgcgcgcgaacaaacagccacccctcacctctcgatccctcccacccgccaaaaccccccctcccatatagcccctgccacaagcgggtggagcaagcgatcgatcgcccttcctcctcctcctctcctccttcctgcgtcgcctccctgatcagccgcagctcgttgccggccgttgttgcgcggcca

SEQ ID NO: 15010 - DNA, 1501 bp, Oryza sativa
tggcgggttggttgggtgcggcgtctccgttgccgccaagtgaagcgaaggggttgtgtgttgcttgcttgctttgcatggtggcgcgttggcgcgagggaggagaggagaggaggcctgcgtgcgtgcgttggctgctgctgctgctgctgcagatgcagctgctgccgttgttgtcaggctgcgttcgcggaccaacccgcgagatcagtcaccaaccgatgcttggctttcccgccatctcctcatttttctcccctttgctcttttatttaaacaaacaagaattaaaagggctagattatattggtgagtggtagtagtatagttgtagtagtaccaatattggggcatttaaaatttgatgcatggttgccgcgagtaattctacctgagcttgcttcaagattagtttggtgagtacggaagtcctctccagttgattactggagtagattagtacactggaatgactgacgcacaccgacgagattatgcgtccaaggaagtccaattttctagagtctgcacattgtttatacggaagtctagataatgcacatttgatataggacgccattgtttatacgggattactggaagctgtaagtgaaggacaaccactttttttcagttcagtgacaagattacaagaaatggattccgagttcaatagctaaaccgatcaaaactagtctttttgacaagggggatccctagagtcctgaactgatttctttctacttgcggtgcacaaatagtcgttcctatcaactcaaatccaaccgaaaattgctgttcaagtctagagtaggttggtctgtcccaagccaaacgcacgtttctgcccatcgatcgagtcacagcattgagccataagcaaacgaggcatcgatcgatcaccttttcttttcttttttttttcttggcatccccagcgattcagagaaggtgaccaggcaccttagtttggtagcatcatccatcacacaccctgccagtttgccaccaaccacacgttgtgatcgtgtagcgcacacacacatatacaaaaacgccacgaaagcttcagcttccattggcatctgaacatatgcaatctgatcatcgccggaaaaaggaggaagaagaaaccgtcacgatgaaacctgccagatgcgtcttctgctgttaccgaaggtacgcagcatatcatgtcgttgcgtccagtgacgacctggaggaagaaacgtccccatcctggatgtgaaatgcaggtgaggggcagcagcagcagcagctggctgaagcatcttaggacgcaagttttgattttggctggtgatcatcctgtcgttgttgcgagatctgcctcgtgttaaaggcgaagtatcactgtcgctatggaaactgtagcttactggggctagcccctccttgcgccggcctgctgttctctgttccttgtggtgtgctatatattgggcccggagttgatgtgttctctccctcggctagctgc

SEQ ID NO: 15011 - DNA, 1501 bp, Oryza sativa
gaatagtatgtctccctcatccgagacttgacctgtgctgcgcgcccaaacccagttcttgctacgttcaaccatggggtctaccagcaggggcttaccggccgcggcaaatctttgctcgatctcccgccattgatcgacgtgaccagcgtatccgctcgaccccaatctatggggatatttgttcttcttcgcgagctcggacatttttttcctcaaagccaatgcttcagctgttgtacgatccgcaacaaacgtgtcccagtcagcctgcgatatatgtccataatccgtaaacggtgggagattcttctgaacataatcccgatttagatcggacttccactgtcgccatcgatctcccatctttttaagtgcgtaatctctccccctaacctctgatccaggagggaacacaaaatacttctgcaactcattccagagaagtgtcttgatgttgtcgtccactgtttcccacaacttgacattaatgggacaacgcgtcctgactagagtgccacaggcgttgctgaacttggaccgcactatcggtggctcgatgggcttcccatcctgatcgagagcaatcacgttgtaagtttccttgggtaatttattcttgcttctctcaccacgtctttttttcccactcccgcctgcacttgtagatgtctccgtacgttcaggtgcagacgtagcggtgtccatctcaacttcttgctctgtcctgttcctcccggctttacgtttcgagcggcgtcggactaccatctgcacagaataggtaactctatacaccattaggttcatgtcacatcatagttagggaataatacatggctaacgattttcatcacttacggcctgttcgataggtatgtagtccggatcatcatcgcggggggcgacttgtgttatttccattggaaacgggtcacttggtgtgcgccacgtttcttcactagaagcgcctggatgcttattgctaccggaattttgaggagcgttaccttcttgaggcgctattggtgcgttcgatggaaccttttcgttcgacatcttccaacttgacgtaaaaaaatttgacataagtcccaatttaacgcaatttgacataagtctcaatttgacataagtcccaatttaacataagtccgaattatacataaatctcaatttaacataagtcccaattatacataaatctcaaattaacataggtcccattttagcataagtcacaattaaacagaaatctccatttgacataggtgccaatttaacataagtcacaattatacataaatctcagtttaacaaaaatcacaattatacataaatcccaatataacataagtctcaacttaaacataagtcacattttaacatagctgccaatttaacaaaagtcccaattatacataaatctcaatttaacaaagtcccaattatacataaatcccaatttaacataagtcccaatttaaacataagtcccaat

SEQ ID NO: 15012 - DNA, 1501 bp, Oryza sativa
attataggcgctcctccccaataaatatagctcctagccgctacgagaatatggccacgccgccatcatctccctgcgtgtctgcgctacattgtagtcgccatagttacattgtggtgctcccctctctatttaacagagatgctaggttgcagagtccgactctaactccagctcctaacacctattataactccaagtccaactgtaaccaaataggactagtatattcgacacatattctaacaaactccaccttggcgaatatacgccacccagaagtcgtagaatcaccatgctgatctacctgtcctccagacttgggttgttttcttttgcagcttcaccaggagccgctcgatgagtctgcgccagacacaccgctttcaagagactccgctatccctgtaatttcttccacttgattccacctgcaacagtactccaccttctctcatatcaccatagtcgtcttgccaagcgaattgaatttcttcctaactatcacataatagactccccgaataccatgttcacatccaccttccgtcttaaaatttgacttgatctaatccatggccagataaccgatgtcatcaccaaatagataaatcaaactcattagacacgaagagaaccctttcttccttgtcatcttatgaactgagctaacaaatccaacattcacgcttttcgtatccgtagactaaattcctaataatttgagaaaattcaccgttgtcttgaatcacccgaagaaattcctcttcagtgacgcagattttcatatattcccatcatgtcgatctgcatatcttggatatatcctgtactgctaaacagtatcgttgaccccatcaacgatatttgactcgctgttgcccgggattttcttcagttctagcctcactccatatatctcaacacctcatcgagtcctagatatatcatttcttcgccagatatgacgttcacctcaatccgactggctttgcccctaggtctaaccagccatttccggtccgaccgtacggccatcctcgtcggatcgaaaaccacacacttttcatgcacgaactcctaccaccgaactgcccgtcgacgtgcgagaccgcctgctgcctccgtgcaccctctttgctggtgatggtacttgtcagtcttcaacttgtgaaagtctcaaagatccttgctagacgagtcggacaggaaatcatccaacctatccaattttcttccgagtcagacccaatgttgatctccaatttccatcctactgcaacttggttccacggtgcaactcctgcgtctccgagtcgacctcttttacatgcaccagacctccatgtaccgccacctgccctttgcatgttgatgtttccaatcagagcaacacacaaagtgtgaatgcattgatttcacgtgacatccatgcccttttcacgagcccatgtacatgtatttgccacctgcatgcattaggcatctgtgcgttggtttc

SEQ ID NO: 15013 - DNA, 1501 bp, Oryza sativa
aaccaccgtactcaacaagacacacccacaagtgcaaaatagatgcaagggagtacaagggggttataatataaggggttagggtttgcagtaaacagcattaaaagacacttagttgctcaaagctattttgtcaatacgatcctagaggtatccaatgttattaatcaaggccgtgaacccacacgaacctgccttaacccaaggcctacgatgattcaaaccgaactggcaacccgaccctgggtcccagctcgtcccaagccaacccaggccaaccattccatattttagttgttaagcaggttttaagaattaaaacactaacttgggtacattgctaggcttgcccataaccgagggcgcggctattcgaataggttatactttgatcagaggtgtacatctttacccacaagacacatctttctcacgtgtaatcacgtgccacataccatcacggtatacggacggaagacgtgacatagtttccaacccatcctagccatagacaagagtaccgacccaaccccacctatggccggaacctccgggacaggtaggtaggactgagcccctagcagcaggacaccagccctgtgccatgacatttcgactaccgggccgcagctcgtgtagccttcatttgccctagagatgtccatcgacccccgacttcgtccatctccatccgtgtacttttgttcataaccagactgagccacaaactaagccttacccactagacatgtggaagtacgatagtgctttgcaacagaggcccgaagaccggtccttatatggccgaggtgttactatcaaaaccatgcaccccgagcccagcctaaaaccattttgagggttttgaatagagggggaggtgtgaatccaattccacaataatccaaccattccatagtgtccaggtgatatgaatattcccaaagtctagagttgtaaaaccacctaatgttgcctaattaaccagcgaagcatctacctaaattcatactagtggtaccataaatagagtacccactagttggggttttgtttattctagggtgaacaaggtaataataacaataacaacaataataaggtcataacaaaggtaaataggcatggctaaacaaaatagtgataacgcgggaatttaagtaaagcggtaatgcaataattttaaatcaaaataattttataaactgggattcaatatgttcaaggatgatgtgacttgccttgctcgctttcccaaacgtcggcttcaacctccacgaagagcggatcttccgaagctgcagcgtctacacgaccaacagaaaagaaaaggcttttactctaataaactccatataacaagcaggaacaaggcagaaaaatgggtttttgacctcttaaggaaaaattagagacttgaacggtccaattccgagttcaaatggccaagttatggccatttgaagtttatatgctctttaaatgaatatttgcgaatttc

SEQ ID NO: 15014 - DNA, 1501 bp, Oryza sativa
cgatgcctccggcccctatgtcttcgtcgtcgagacgcgccacacacgacatcacgagcagcgtcctcaccatcagagtgcctgcctcagtccccgccgccacgtcgcacgcgtcgtccgctctggggatctggctccagatacccagagcgaaataccccttttacaaaacataattaattattttacctgcactaattaattattttaattagtgtgggttgtcgttgaggcacgccacgcacgacatcacgagcagcacccttgccatcagagcgcctgcctcagtcgccgccgccgccacgtcgcacgtgtcgtccgctctgggtatctggctcccgtctccccgataagctggtctcccacctccttctcttacaccgtggcatcagctaactccgcatggaagctttgccgtcatcactccaccaagtcgccctcacatctctcgcttagaccagtgcaacgtgcaacacgagctagctggcttcgctttggtcgtgggtctccatcgtcgccggggctcactagagacacgaacgacatgagtacgtcgctcatggctgtgttgtgatgtcattgctgttgctccgggtggtcgccatcatggactcatggttcactcacttgaatcagaaaagtaagggctaatgggcctttttttttttgacaacttctttaagggctcatatcatgaaaaactaaaatcctaataacctaatatttttgtatttgttatatttttattttacccgttgcatctatttattaaaatgtttaaataataaaaaaattctcgatcggtcccctcttctctgtttttctctttgttcctgtctgctctttttttttaaaattttttttcccctcactgtctaatcgtctttcattttttttcatgtctactaattaatatttgacttcaaatataatttgtaactcaaaacaatactcactctcacaaaaataaaaagattgatttttacgatttgttaaactccacacattttatttcagataacatacacaggtatattcccatagtttcttgtggtgaaaccagtcaatctggattcaaatctttgatttgacacgtgtgcttgaggcttccgtggtgacttcgtcaatctcaatgctcgtgttgtgagagcgtttatgtgtttcttaaaaaaatatatattctcgaaattcaaagtacatcgagtacaaaaattccactcgtattttatcagacttacctactgtggagattatgggtaccccatacccacacggcatggttatccgactagtaataggggataacatatatgtatggaatatgtaacagatcatgacttgggtattacgttttcttttatattatggagcggcctaaagtcctgatttgataatattgtaaagtagatttaggaagccgataccgtgttggttaaggtttctatcttgtaatcctgccccccaccctatataaggtgggcaggaggccctctagggggca

SEQ ID NO: 15015 - DNA, 1501 bp, Oryza sativa
tgggtggaggcaatttggatggggttttgctgttgcaatgcgtgctgatggttgcccactttgctggactgcaatccgtgtgcagaccgtgtacgatgcatatggtattttgccgtgggttttgcatgcactttcttttgctagagccagtgccgtgcacataattaagtgggatatatataagtatgattgtatgcatggcacataattatggatgttgctggaaatctgaaacgagatcgcgatggcaaattggcagtgtcatacagtaaattaaacaatccaattaagactgtatctgtatatatgtgtagtatggtagctgattaattattttctcatcgtccatgaaaatgaaatagggcccaccctgaaattttaaattaacctgaaactaattcggctgcaagtttaatcacacgatcgaattttgcgtttagtgttgagaaacatccacgagtcttccggctagctccacgagatggtggactagatgacctggattcgaagcttcaccccttctacttatttgatattatatcattctctaatattcgtgtcttttttattttgcgtttagtgctaaaaaatcaatcagttgcaattggacggtatagacggggagggggacagcgacctaacattcttggttatctgcgcatgatcgattaatcgatcgatgttcgatggatatctatgtgcgcttgcttttcggctttgagggcatgaagatagaagtaggtaaagtgcaagtactacgtagtaggccaggccagcaaggtcgtgcgtgtatatatactcctatacatgacagccattgattaattcagcggcagtatgcatgcttgatggtgaaacgtacgctaatgcatcgtacgtacatgtacggcggcttagcagctggctatcgtcatttgcaagactctaattagcgatcgatcgggacgtgatcctttaacttactattctctgattttgagaggttaatatacggatccaatagttaatggattcacatatatcagagattcacgtcaaaaggcagtacacgagaggagctctttccgtatcgatctaggtggacatatgatcccataagctgataggcatgccaattaacgtttacgtataggcttggcattaatagccttggctatgcctatgctttgcataatagagtgagtacttactattacttgctacaggaacaccacggcacagtattatttttgggcctccagccctccaccgtgccaccgtggccgacggatgaaactccaattaggcccacaaacataggcccatttataataggctaatcagcccattaaaagtactttttcttacatgggccgaacctaacggcaaggaaggcccaggcccatctgagggcgagcggtgaggagagatgccgcgtcacctcccctcccgcccccgtcaccggcgacattattactactccggtcgaggccaacggcggcggcgccactgtccctctccc

SEQ ID NO: 15016 - DNA, 1501 bp, Oryza sativa
  unsure (1)..(1501): unsure at all n locations
cattacttatctgtatctgtgttttgttccatgtttctgtggtggttcatgcctctctcgtttatgatttgtttttacattgcatgcccattcatatgtatctgcaatgtgtctgtgttttgttggcttcttttcttgctgtacagctgccgcatggagtggtcgagatccctatgcatctgcccgcggaagcgtgcatatggtacttgctgatcttattatagttgcatgtggtgttctcatagccagcgaggctattagcgcacattttccctgttgttcactaattcatagttttgaacgtcaatagatgagtcgtcctcatgttatgctgccaatgagcgatcagtgctcgcggcaagctcatcatgtcccataggtacatatgctcggtatcctcagagttagcgagctcatcaccatgtttattgattgttcttttttgctgattcacaattttgttcggcgatagatgaaccatcctcatcctgtgcttgtgatgaacgcccaatgttcacaggtggttcatcgttctcaataggtatgtacgctcgaagtgatcatcgctatctcattgtatagttccattcctcacccattgcatatttgttctctcatatttcactacaattgttctctcgttgcgacgttgtatgctcggagcatatattcatatgcttatgttcatgtgtttgctcattcattcgtgccagcacaaatttattttgtttccattttctcattctgcctcctcatctgagtgttccacagggagtcatgggccttccctcattcatcctacccactctgccagttagttccatgttgctatttgttttgttgttcggctacctataacctttttctttcttgctattgattgccatgcctatttatgttgtccataggagaccatttctgtccaatagtaccannnnnnnnnnnnnnnnnnnnnnnggaaaaacggcgggcagctaggaaagcatgtgtcattgtacgcaaaggttgttcacctgcttatctaaacccttctttgcggtcaactaggtggatcctcttattgctttcctttctctttgtttcttatttgctatttccgttgccccgttcttgttctgtttgcacagaggctatcatgtattcaccgtcagtgaggttctcatattctataccaaaggactacatggagattcttaaaggtgataacttagtgccaaccttccttcgctctacttttctcactgtttttggactctatatctaccgttggacaaatatatccatgctcccttgcttatgagttgccccattcttgcagctacgtacccagaacgttcttactatggtggtcctgattatcaatgcaatcattgtggtgcgcttttttggtaccaagaaagagtcgttagccagagttcgcatagggctaagaggattgcatacaatttgtgttgccgtggtgggaagatctccttacctgtgcataggcctttccctccta

SEQ ID NO: 15017 - DNA, 1501 bp, Oryza sativa
gcccttaggtgtttttcttttctctcaaagataaacatggagattaagtttttttacgcaaaacgatgtggtattaacgtatgatttattgagttttaattattacaaacttaagagattgattaatatgatattttagagcaactttcatatagaaagttttcgtacaaaacgcaccgtttagcagtttgaaaagtttgccatgaaaatcttaatcttcatccagctcttattggagaaaagaacatgatcttagacttcttctcccttccctttaacatatgttggaggtgcttgccagcggccaccaaacgtcatgctcaccatcccggctcaccgacgtcggcctacgctccactgtcaccaacttaatgtaccgccactttcatcccccctcccccgccaaacctctgtcatgccacctaactacaaccaccgttgtcgtacattcgtcctcgtccgtgtccttcttcaacggccttcgccgtcgcgctgatgcaggaggagcgataaagattagaagaaccatggctgtgtagccgggcgacgcgcggctcgacaatggggtgccaacagcgggctggctagatacaatgcacatgtctatgtccctctccagcagcacgcgatgacaacggtccaagccttgaaagagaaaaagaggacaaggggcatttccgtccattcatatggcaaggacactatagcatgtaacatctatttgaaagtggcaatttaacgaagctaaaatgcagaatggcatatgtggcaaaacccatgtttgaagatagcacaatagcaatttttttgagtgggatcagatagggttggatgaatctaaacgtgtttcgattaaagaaagacgaatccaaattcacaatctcaaaaggaggatgcttttggtagatgaagtccactgacatatcttctcgggacagacacatcacatgtctagtcctatctctctgtatagttaagctaaggttgtcctctctctataaaaaaaataatgtcgtacatgatgtaacacactctactatagcgaatctgaacacatctagacatactgtccagattcgttgtattagaatgtttcatgtcttggacgaggttagtttattttgataaagggagtaagtacttcatcaatttcaaaaacaaacctacgcataaatgtgaggccctgttcagatccttttgccattttggagcactttttgctattttggatctaaacactagtagcaaaagttggcgatttgccatttaccatttgctaggccatagtagcaaattgtgccaaaaagtgctttgggacctctctctctccactaaaaagtgctagaatggcaaaagtttaggatgcatctaaacaccaactagtacttttgcaatgccaaaacttttgccaccaaaacttttgctatttgctatttgctatttcaaatggatctaaaaatgcccttgatatatcatattacaatttacaacgaaacgaaca

SEQ ID NO: 15018 - DNA, 1501 bp, Oryza sativa
tagctagacatatgtcatacgattgatacattgcatatacgcatgaaagcgaacttcaggcaggcaggggtcatctcgccactatcctacttactcatagccttatcctacgtattctctccgttcccaaaaaaaataaataaatcttaacacaaacatgttcgtttcgttgtaaattgtaatatgatatatcaagggcatttttagatccatttgaaatagcaaatagcaaatagcaaaagttttggtggcaaaagttttggcattgcaaaagtactagttggtgtttagatgcatcctaaacttttgccattctagcactttttagtggagagagagaggtcccaaagcactttttggcacaatttgctactatggcctagcaaatggtaaatggcaaatcgccaacttttgctactagtgtttagatccaaaatagcaaaaagtgctccaaaatggcaaaaggatctgaacagggcctcacatttatgcgtaggtttgtttttgaaattgatgaagtacttactccctttatcaaaataaactaacctcgtccaagacatgaaacattctaatacaacgaatctggacagtatgtctagatgtgttcagattcgctatagtagagtgtgttacatcatgtacgacattattttttttatagagagaggacaaccttagcttaactatacagagagataggactagacatgtgatgtgtctgtcccgagaagatatgtcagtggacttcatctaccaaaagcatcctccttttgagattgtgaatttggattcgtctttctttaatcgaaacacgtttagattcatccaaccctatctgatcccactcaaaaaaattgctattgtgctatcttcaaacatgggttttgccacatatgccattctgcattttagcttcgttaaattgccactttcaaatagatgttacatgctatagtgtccttgccatatgaatggacggaaatgccccttgtcctctttttctctttcaaggcttggaccgttgtcatcgcgtgctgctggagagggacatagacatgtgcattgtatctagccagcccgctgttggcaccccattgtcgagccgcgcgtcgcccggctacacagccatggttcttctaatctttatcgctcctcctgcatcagcgcgacggcgaaggccgttgaagaaggacacggacgaggacgaatgtacgacaacggtggttgtagttaggtggcatgacagaggtttggcgggggaggggggatgaaagtggcggtacattaagttggtgacagtggagcgtaggccgacgtcggtgagccgggatggtgagcatgacgtttggtggccgctggcaagcacctccaacatatgttaaagggaagggagaagaagtctaagatcatgttcttttctccaataagagctggatgaagattaagattttcatggcaaacttttcaaactgctaaacggtgcgttttgtacgaaaac

SEQ ID NO: 15019 - DNA, 1501 bp, Oryza sativa
actaatcatggattaattaggctcaatagatttatctcgcgaattagtccaggtatggtatgagttttgtcattaatttacatttaatacttctaatgagtgtctaaatatccgatgtgatagggactaaaattttagtccctgatccaaacaacccgttagattcgagggctagtttattcagtttgaggaattttaatccatagaaataggaaagtgaaaaaaaaataaatgcacgtatcaattcatatgaattttttcaaaagatttgagtgaacggaagtcttcctatgttttttctctacaacttaaaggaaaagaaaaaattcgtttggttttcctataacttatttatacaaaccgaatgggaactgtagaaattatttttgggaatccattttgtttccttcaaaccgattaaaccaatgcacaaaaatgctaattgtcagggttatggataccacatacctaatagtagttgacttaatctcgacaggacccaccatataccatgtcttatacggaaacaaccttcggatataggaggagttccgtataaggaaggatgaatagagttctacatgaaaatggcaatgactactcggagtatccatattggttttcctagttctacttggacaaggggacacttatgggtataaatacaaggccccctaagaggagaggggacacggaacaatagatcaagacataagatcaacatacaagccaacatacgccaagacaagacgctggatatcgacttaagagataagcatggctagtcccctatggtgtctacagatgctgttaggagagacatagcgctgtctttgatctcaccggatgcggattcgatgaggaaggctaccctgttgtcgactacgagtcagaactttagaccaccatattgacaacagttagataggctaccccaaatattgtactggtgtgactatggtaaataagagcaacgaccggcttcggccaacatgagtagggttattacctgacaattcaggggcccggacatatatacaaatccttgcctccgtctcttttacctaaatctcgcgtatatcctagtaccaacgatccccatactatgcaaataccggaatcgcgacatcaaacgtcgacactaatataatgttcctatgtagtcacgtgcctttgttggttgccctgttcacatcgtggttctcactaaactgtgatcttcactcaaccttttcaactccgctcactcagtttttacgcgtacgtttcctaaactattaaactgtatgctttttaaaaagaaattctatgaaaaagttactttaaaaaatattacatgcgcgagagattatttctcacctccaactaccgaacacagctttaagctacccatcatggcgttactaaactacgcatatagtattatatatggtactacctaattcaaggtcttcgtatcaaagtctttgttttttctataaaaaaaaacaaacgaagaaga

SEQ ID NO: 15020 - DNA, 1501 bp, Oryza sativa
gaagataaagattaagttttttatgctaaatgagatggtattaacatataattaattgggttttaattattataaacttgaaaaatagattaatatgatattttagagtaacttttatgtattttttttacactaaacgtgccgtttaacagtttaaaaagcgtgtcatgaaaatattaatattcatccaacttcttctgaagaaaagaacgggatcctaataagcgacggagggagtactatattggattactgtagaagtagatttgattaagatatggaatgaatggtaaagctgatttgaggtgtactgtagtagtaataaacaagagaataagacatctctggccccgagtcaccgtgtcagacagaccaacatctttattttagcttggcgccttttgtctgcccgaaacatgcattgcatatgttggccaatcaaagtgagtaccgaaccgaaccgctcgaaggattgaaacagggagggagggagatggttgcatactacattacataacagatcatcacagcatgagtacaattggagctgccgacagtacacatttcaggagtactaggagagtatagtaatgtaagtaggaagaaagaagcattagtccagaaatcaatccaggtgtctgtcctgtgtgtgtgtaataaccaaagtagtggagtaataattgtgggaaaaagaaaatcagtaacattatattttaatccggaatgaaggaagaagtggtaagatactcatcccctacatacagcacgcgctccatatgacagattttgcatagaggggaaggggaggaatgaatcagtacttagtagccagcagtgaacgcaaatgatataattagagcgtggataggtaggccttggctagcaatttgccgagcttgacctgcgccggggtggtgaggtgcgtgtagtcgttggcgatggggaggcccttggcgtcgacgtacttgagaaaaggaagcctgaccgccttctgggcctccctgacgggctcgacgaacttgccctgccccgtcgcgatccccacctggatcaccagcagctccggcaacgccaggtctcgccggacgtcgcgcaccatgccctccatcttccgggcgtacacctccgcgtcctcccgccggatggtgtccgcctccccctggtaccacagcagcgcccccatcctggcccctgcacctgcaccggcggtggccatggccgccctgccgcgccccaccatccgctcgtacagctccgtgcccctggtccagttggcgatgggcgtgcctccctgggcgcaggggacgaggccgatgacggtggagggcgggatggcgcggaagagggcgtgggcgaaggacatccccgggcccacgccgagcacgttgtggacgtcgatgccggcgtggaggggctcccgcgcttcctcccaccggagctcaggggacaaccggaggatgcgaggtgacggggcgcactccggcggcaccacgccgtccca

SEQ ID NO: 15021 - DNA, 1501 bp, Oryza sativa
caccacttgctggctgggcgctccctgctgggagtaccagcctctttctttttgtcgctcgcaggcctcccctttcgggtggcccgcggaacgccctcgacggcgaggacgtgaccctcgtcgccggaatggaccgaccttttcttcctcctcctgtcacgccgccctgtctgagcggcggatccgggggcggccgaagctgccacaccggaaccggaggggttccaggtccaggcctcctccttacgagccactcggtccgcgagctgaaaaagctctgcggtagtctggggctctttggaggcaatcttttcgagcatgcggttatgccgcacaccccccctgaacgcgtagatcaccgcgtgtgcagggatgcaaggtatagtattgcggacttggcagaaacgctgaatgtacgagcgaagggattcatcatcccctcgctgtactgcgtgcaagtccgcttcttcacctgggcgtggataagtgccttgaaagttcatggtgaactgctggcacagatcctcccaggagtggaccgacgcgggtggcaggttcattagccaaccccgcgcctgtcccttcagggccatgggaaagaaattcgccatgaccctgtcgtctcccccagcggcctcgatcccggtcgtatagacctggagaaactcggtggggttgacgctcccatcatacttctcggtgatggtgggccggaaccttgggggccaacggacattccgaagactcgccacaaaggctctacagccaacaccaccaaccgggggcacggagggctggtccttacgtccatgtggaggtgacactctggacgaggaggcgccctccgttgcacggggagtacgccggccgttacgccggcgctcgatgttgaggcgggcatccggctccccatgctgatcctcccgagtcgaaggcgtcgacgagggagtggcagccgaatgacgtgcagccgccgccgctcgccgcgccctccgccttgatgacacggaaccggtggtggcggcgccggaggtcttggtggtggcggaccgtccaccagcacccaggcgctgctgtgccgtcatgaccaagttggccacgtcgtccagccatcgctgggctggagactccgggtcagggacgacaggcgggtgacgtaggagcgcgccaacagcctggagcgcgccctgaggcgtgctgccgtcaccgtagacgaggaggcgacgctccccatctcgccgttctcctgcaccacccgcgactagcgatgctgcggatttttcgactctctcgagtgcctccccctgcttaggattttggtgtggaggaggtgggggagtacgagctcgacggcgtgggtttggctccccgtcgtcgccgctcacactcggagagaggtcgtgcgcctttgcttgctcggccattaggcagaacaagggaaacttggcgcacacggaagagtatgagagctcagaaaacacacgctgagccccctacctgg

SEQ ID NO: 15022 - DNA, 1501 bp, Oryza sativa
tcagtgaagaacactaaaccagattataaccaatggtggcacagacagtggcgctcctacatgcagcttctggtaatttaaactaaattatatcatgctgatcaatatatcagttaacaattaggtaattagtatgttggaccctgttaatttttgttctcggttcgccactaggcatggatacttaggatacatcactattggtgatgattaactggtaatgatgagaggggtgaaagccacgtctcgggttatatatatgaatcagggttcacaagctgctcttttatggccagtacaagtagcatatcttgatttaacgcaaaaccagcgttcagatgatcagatcttcagatactgcgagtatctcatgccatgaaaattctctctcaaaatttatatactctgataaattctctcaaatttatatactctgaactatgcctatgaggatagggaatcatcaaaattcagaaccacagtaaacaacagggacgtctggtccccttgaaaagtttctaacaggattctaatggactagacacgataagcgggccgcagcatgtcttcagcattagactaatcgtagtgggataatcacaatgtgttggatcgaagaggtgaattggcatgtcaaacttctcataacaaatcaatgctgcttaaaaagattcaattccttaacagtgagcttgcgtgatgtcaggtcaaatcggggaggcggggtgcgtaccaacggtgatgtcgcatcctccgaagaactcgccgtcgatgtagagctgcgggaaggtgggccagctggagtactccttgagcccctggcggagcgcctcgttggcgagcacgtcgagcgtctcgaagggcacgtccagcgaccggagtatctgcaccaccgtgtgggagaatccgcactgcgggaagtccttggtccccttcatgaacagcaccaccttgtgcgaccccaccaccttgtccagcgtcgccctcatctccggcgccagcccgccaccccccgccgccgcaaggcaccgcgtcgaccgcgcgcgcgccgagccgacgctgaggcgccatgtgggaggggaagccctagggagaagaggaaccctcgcggagacggggcgcgggagggatgccccggggagaggcgaaatcgcggctacggaggcggcggcggtggcggccatggctggtgaagctcgcgcgccggcggcgagggagagggagagttggtggctgtggtgatacgagggcaaacctgtaatttccgcagtgtttctttcttgtggcagaggagaaactgggagtgggcctatgggccctagtgggcctatgggccctagtgggccgtacggcccatttgcgcctccacgggttggttacaagttacagctacgaggtggccgcctctcctccccattcgactcctaaagccctaaacccgtctctctcctcctctcacctagcgccgccgccgccgccgccgcgaacgcgaacgcgatgg

SEQ ID NO: 15023 - DNA, 1231 bp, Oryza sativa
acgcaggggacggcacggaggcggcctgcatggcggccggcgcggcagacgcgggggaccacacggcggcgagcggtgggcggccggcgcgagcggcgcgggaggccgcgcggaggacggacggctgcggtgggcggccgctcggcggcaaccggcgcggcgctggccggccggcgtggaggggaggaggggaggcggcagtggccgccggccggattttttttctttttttttgagatgtgaatctgtgatgtatttttgtgtgagatgtgaatctgtgatgaattttttagaaccctgtgatgtaatttttttaagagttggtaatgtatttggagatgatttgtttgaggatttggagatgttctgtaatatgtgatgatttggatatgggaggggatggtgtgaaatcaatattcaatattaaaagcagaaaaaaaaagaaaaaatatctttagtcccggttggtgttatcaaccgggactaaagatgctcccatctttagtcccggttggtaaagattgatttttagtcccggttatttgaaccgggactaaagatagcgatctttagtcccggattcgtagtccccaaccgggactacaggggggttacgaaacgggactaaaaagcatttctccaccagtgatatacagatccagcggtatcaatctgtggataccagcaaagactgcatgtattgctagtttttctttaaaaaaaataaaatatgcagacgtgtgtacgtgcagtcagcgtagtggacacagcagttgaacttaattagctaatgacagcaaaataaatttgtgccatcatgttggttaattaatcgcaggtccaattaactaaggcaaaagtcatcgtctcatcgatagatcgagtagtttaagtaggtagcagatggaccgaacaaacaagtagcatcgcagatgaaacctaacaagttgagcaaatggtagatgaacatatgaatgaccaatgattcgtggcacttcgcagcagcgactacatcactacaagattctctaaaaccggcggaatcaatggatcctagctaagctactaccaccagtacacatagtactacagtactagtaaccaaattaagtagcagcactgtgcagcatttagttattgctatgctaatctaagtgcgaaccttctctgcaagtaaactgaggaactgttcatatatatgatgcagcaacgccacgtagcagttgctgtc

SEQ ID NO: 15024 - DNA, 1501 bp, Oryza sativa
cgtcgtcgtcagctagtcaaatacacaaacacctgccacgcatggcgatcgtgacggcgatctttgcttgtaattgcaggacgcgttcatcggtgggatcgggacgagctcggtgacgatcctgtgggcgatggcggagctgatgcggtcgccgcgggtgatgcggaaggtgcaagccgagatcagggccaccgtcggcgaccgagatggcggcggcatggtgcagccggacgacctgccgaggctcgcctacctcaagatggtggtgaaggagacgctgcggctgcacccgccggcgacgctgctgatgccgcgggagacgatgcgcgacgtgaggatcggcgggtacgaggtggcggcgaggacgcgggtgatggtgaacgcgtgggcgatcgggagggacgcggcgaggtgggaggaggcggaggtgttcgacccggacaggttcgaggcgaagcgggtggagttcaacggcgggcacttcgagctcctgccgttcgggtcggggcggcggatctgccccggcatcgccatgggcgccgccaacgtggagttcacgctggccaacctgctgcactgcttcgactgggcgctgccggtggggatggcgccggaggagctgagcatggaggagtccggcggcctcgtgctccacaggaaggcgcccctcgtgctcgtgcccactagatacatacaactataggagtacaaatgaaatggaatttagctagtagcaaagccgcgacttcggccttgattagttcctaaattattttttttccaaaaacgtcacctccaatctttggatatatatatataaaatattaaatataaataaaataaaaaattaattgcacagtttgtatgaaaatcacgagacgaatcttttgaacctaactagtccatgattagccataagtgttacagtaacccatatgtactaatgatggattaattatgcttaataatttcatctcgtggttttcaggcgagttatgaaattagtttttcattcgtatccgaaaactccttccaatattcagtcaaacgtttattgttacaccctaaaattttctttttcgaactaaacaagcctttcatttcatgcctctctcccctacgttttgctgctttgctgttcaacatctacatacttattgctccttcacagatgtactcctacttcataaattaagattgggtgattagaatggattggtaatttgttgagatatgatgaactaatatctgcgtgtaataacaaagtttatgctccgtcatgtcctaattacttgaagaattagctgaggttgcgtgaatccccagcaagacgagaaggtgattccacaggaggcagattagactagagtggcctgtaaatgtgttttgccacagatggaggatggaacaagaatagtaggagactgacagagtgaatcatataattgagccctcatcaatccttagataggcagacctgtcgaaagtctactcgcctagt

SEQ ID NO: 15025 - DNA, 1501 bp, Oryza sativa
tcgttgcaattcaagcacccgttgtcgcgaccctaattttagccctagggttcgccgttcaccgaaattccaaaaattatttctttaaatccttttcacccattgttgcactttgtgatactattttcttttggttatctttgtttttctgttatttattgtggtgatgattgttgcgtaaatagaaaacgctgacgctggtccggtagtcggagcgagtgaaatctccgcgataggaggagacggtttgtacgactacatcaagcccgaaggttgcaagatatgcaccctcccttgaacaatctaatcccagtagttagagagttattttggtagcgtacttgtcctttggagtacgatagactgcatgaatccttttaaattaattatattactattattgcattatattttctgttgttattataaacaccttaatgagccttagagtctaacaaatttaggataaaatttgagaaacacttaaacaaactattaattatttagcatgctatcgatttagtatggatattatcattgcatatgaaaacatgcttatggaactatttatagctatatgctaagaattgttaacaccgcttgtgagcggatggtacacatgatagagttcatgtgtttggttttatggacctttttatggttgtgatggatatatggatatatctatggttatttcttatttaaaattgatataataatcaacccccttgtgtcaataagaatgacatagtttcgcccatccacacgatcgatttgtagaacctggtcgtatattgctccaattgattaaacttctgaaggcctttcggtgtactggccattagctttcaagtgtgtgaagcaaagtgaaatggttcatgtttatatgatttatatatgtgggctcgatgggccctgagagttcagaactaccctatgggtccatgaagttctgggctgcccatcgaataacgaacaatggtaagtggatgcagaggtaggttggtacacaccttggaccggatcactccgagcaacatcccgagcatcctttaacttactaggcagaagggagagatatatggagcaatattacaccttgttacttttcagcccggccagctgtgggtatcgtgtgggtaaagctgggcagacgctgcagagtcgttgagtattcgaatacgccgtgccacctcttacaaatgttcttatatactgcagacttacagttcataatagtattatatatatcctctgtatggtgcataaattcagatttttatgagccttcagatttttttttactctctcagcttctcatgcagattaactgttgtattccatgtgcagaaaaatttacaaggtctgctccccttgtccaacaactatttgcataaatttcccttgaaaaaaataggttctagccttctaggcataatttatagcaaattgaaatagatatttgctgcgtgttgaactttttagttgatgattgaatagt

SEQ ID NO: 15026 - DNA, 1285 bp, Oryza sativa
tggggtgagagccgccgcatctcccttcatgcatctcgatctctccgatctcgatctctctccgtcgccttcgacgccgccgccttcgacgccgcgcaacgccgccgccgcatgccaacgccacgccgccgccgccgtcgccacgccgccgccgccttcgccgccgcgcgcgcaatgccgccgccgccacgccacgccgccgccgccacgccacgccacgccaccgccgccacgccacgccgccgccgccacggccccacaacgccacgccgccgccgccgtcgccacgccgccgcgccaaccgccgccccgatgccgccacaccgccgttaacgaacgagaacgagaacgatcgaacgaacgagagcgagaacgatcgaacgaacgtgaacgagctagggaacgtgaacgagcgaactaacaaggacgaacgttaacgtgaaatgcaatatatatatatatatatatacatgtatatatatatatatatatatgttacttcgcatttatcctaatacattttttttatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctaggaattgactattgtagtcttaattagacttagcatatacgcacgaaacacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttagtattagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcatgacttagcagatgtt

SEQ ID NO: 15027 - DNA, 1501 bp, Oryza sativa
tgggagcacacctaaaaaataaaaactagtgcactctgttgttgctgtctagaatgcatcactttgcttttggccaaggtcatttgagcttcagattgaacgaccaatactatatgccaattgaatgagcaagaagatacaaaattttttaaagtcatgctatgaggtggtcaggtggacactgtagtatacattctagttttggtaattttttccatggctttttgtttagcaaaatgcccttgttaaaacttgagaaatgtagctgtccatcttttgttcgaatacctattttactcttagcaatcaatttagcatatttatctattctgaactgctactatgttcacaactagttttaggaaactgggtgttcagatatattactagaggtcataccatacaaagctatataaattgctattgaatgacaaaaatataatctgttgtgctgaattaaatttcaggagaggcacaggcgtgtggggttggcaaaagtaaagctgaaggagttgatattactcaaggtatttgagaaaaaactaaatacagttgtacttacatttgcctgatatgaagcatttaatcttgcccttgcatatttactagagtaacagaagtaatttgaagttggagagagagagagagagattgtaggtacaatgttatgtgatcttgctcaggtggcagatggtctcagtttttttttgctagtgaacaggaggttgttattttcaagtaaacatcctaccctagaaggatatcctcactttattaaagttgctatctctgaggtttaaacaaaactaagtacacaaagtacttctggaactagtcaaaatctgaacacattattgatccccctcctcccattgcaatctgtttatttgctgaaagtattaaaagtatttatgcatgtagccaccttgaatgcctctaatttcatgtttaataatattgtaatacatatgcatattattatgttctcacacatagtttaaagtatagtaattctatatctcttttagtgataaaatcagttcgagaatggcggatgaaattaaaaggaggagagaagaggacgatgatatgatgctttttgtttttcctgcgatgtatatgctgtgcggtacgacaaatagtgagaaaatacctagacatatctcaagactatccggtaaagagcggcttcaagaaatccttgaaggacatgtaatggattgtaaagttgcattccgcatggagcctcatgttttcaagacaatagcgaattatcttagagaggaaaagttgttaaaggatagtagaggcttgaggattgaggagaaacttgggatatttatgttcatgctcgcccacaatgcaagctttcaagatctacagtatgaattcaagcatagtgggtctacacttcattggcatattaagtctattttcaagataatcccagctctcacctatagatttctcaagcttcctcatgccgaccaaacgcattgga

SEQ ID NO: 15028 - DNA, 1501 bp, Oryza sativa
ggtgatcgatcgatcgatgacatgtgtttaatggtttgctaatcgcaatagttaccatttcgtttcattttcagatgtacaacgtgctcaataagcttcttgtgtgttttttggaagtgaggtagatgagatgtagatgtgatgtcatcatttgcagtgatctacatctgcaagctttttaaaaatctgttggggatagcttgtttgtttttgagatcagccacaaagatagatgctcgtcctcctgtgcaagcaagaacaggcgcaatgcatttccaatgtggcaaccacttgaaataccagaaaacaaatatatatattaaaatttcagcatggaatccactagctaaaggttgtttgcaaaaccagggtattactagtagcccatagatttcgcacatatatttactgcagactgcagacttccccctgggtttcacaacaaaatttgtctcttattaacgcaatgtctgttgccttcagtagtaagaatatattcagggttttaatcctgaaaaatgatctgaacatctgatacatcttgatctacctgttcttctcacgtgccaattaaacctagtacctgatgaaaagcgatcatctgtcccatacaatacattgtccaattctttggtcattaggccagcctgttcctgaacaaacacgttctgaacacgagacaattgaattgtaccacaaagtacctgagcacgtacagaaaatcaaaactggaaggccgtgtgttggtacagtgctacaaaccaaagagaaacccaatccgtttcaggccaacttgcacacctgacgaagcacctatgttccttgtcagctttctctctgggatcacaccagaaaccaccaagaaatgcttgcacacaatctaaagaacggacacaggagaagatagtcagatacacgtcgttggatcgacatgtagacatgaccggcgagccgttgattgattgattgatgtggagtgcaaggattgaattgtccatgatggagaaacaaaaaaagagagagaaaaaaacacggcctaaggctggggatcaggaatggagatattggctccctgatatccaggggtgtcatccggggaggcagctaagattgttcagttttagttagcttagctagctaagttagcagtacaagacaaagcttgagatttttatctgtcagggtctaggggttcttgcgtataaaggcttcaggtgaggtccattttaagccaagccaaagccgcatctggataagagaggcgattcaacagtgcttgtcccaaaaagatcaaggaactccaagaaaagcaaacagtgcttgtcccaaaagatcaagaaactcgaagaaattcatgtgcccatcacaccaaggtaagatcagtagagagaagaagaaaaaaaagacagaattacattgagcttttcgtcatctgtttatctgttcttgtatttgtgctcataatgctgaggattttggttgatttgtattggagcagcca

SEQ ID NO: 15029 - DNA, 1501 bp, Oryza sativa
tacaaggagatatatgcgacgtgttgtgatgtggagggggttgagagcaaaagtgttacctacgtggcatgccacgttggcggtcaaatgcaatcaaaggacgtttggaccaaggtggtacattaaaccaagttcacggatctaaacgtgcaatttttaagttcacggacctaaggccctgtttgtttcagcttaagattattgtaatctagattatcgagccaggttactataagctagattataataagccgacataaaataagttgttagctgtttgtttctctggattattagttgcttgttagctattagccacccaataatctaaaaaggcacctttagagtagattaccatattacattaatctggcttatagattgtaataatctgttataataagatatctgtttgttttagcttacatctaataatccagattataataatcctaagctgaatcaaacagggcctaagtgacaccaccacacaagtttaggggccggccatgtatttcactcaaaaggttttatgctactagaatgttgctgagtacatagattcctattttctttcaaggaagagcgaggctggtttgaactattaatttactgaatcgagtgaagctgtgttgcgtaacaagactataggttgccaaggcctataagtacaagtggtcgctctaatggtcactctcaaacttactacttgagtgactttcgtcacttagcttctttaatagggttcaaacaatataagaattcacaatatgaagaaaaagtcaatgaaaaagtttataaattaaagcattatgattgctataaacattataattgaaaattttaatgaaaaatcttcattgttttggactgaaaaggaaggaaaaatgggtttttacccataaactaatgaaaatattagtcctcaacccgtttctctttgacccagcccataagtgaagccacggtatcagttcgaacaaccctcttcaacctccggctgaatctttctcgatctccttaaattggttgacaaatcgacgtggagacagctgcggtagagtttggcccggcagcgaaccgtgtgaactaaaaaacagcgaaaaaggaaagaaaaaaagacagaccaaaaatgcgtacgatacgaaagctttacttatttattaattcggtacggatatatatatatatatatatatatatatatatatatatatatatatatatatatatatatatatatatatatatatagatagatagatagatagatagatagatagatagatcagttcgcctgcaccgatcgatctccatatcccgcgtgcgtcgcgtacgtcctgctgcttcgtccgccgccgccgccggcgtacgcgtacgcgcgcacatatatagatcgatccgtttgtgggtgtgacatacagtacgtacagcaacgcgatggcgagcccgcgaaccaagaaaaggaagacgggcgatgagcggtcggcggcgtgtggcg

SEQ ID NO: 15030 - DNA, 1501 bp, Oryza sativa
tggggatcactcaaggcccattgggaattttctttggtgggtgtttggcccagcccattaataatattcactagccttttgtggacaaatgaaagtgtcaaaatttattactacctccatcccaaattagatatcgttttgactttttgcttgcaatattcgaccattcgtcttatttaaaaaataatgcaaacctaaaaaggataagtcatacttaaggtattttgataataaaacaagtcacaaacaaaataaataataataacataatcttttaaataagacgaatggtcaaacattacaaataaaaaactcaaaacgacgaatattctagaatggaggtagtatatttttgagcggagggaatagttaagagtactgatgttaaacctgtgtcttatatatctgtttgttattgttttttcctagttagagcagggctaaccttaccatcaggggttgagttaccgcacccaatcgtaagcacggtaatcacacggtaaaccatgaaaaactagacgatgctattagaagttcatattattatgtaaatttatttgaatttgacgggataagttactattagtgtatccaaaggtaagtccggttaccgcggaaaccgcacaataacaagcgatattgtcgatttatgacctgtttggaatgtgaagtgagaattgtcttctactcttccataaatcaaatctttaggacagcacatataagtgatatacaaaaatgattaggctcttcagacatgtaaacttaatcggataatttctccctcaagatgaaaaacaagaactagagcacatattgctcttgatgggatggagatgctacgttttgtgaatttttgggtaagctcgattagtcagacttcctttccatccagtaactttcgccttaaactctcctactcctatgtagaaacaatcagaaaattctcttactccagtgctctctgtttatctttcagtcggtttcagacaaaacatggacgcacatcatgctcctacatgaactgcacattttacagataaaataagatgtcagttcgttttcagattataaaacaagttgtcgctctgccggcaaaattgattattttgcgcggcattgcgttggggaacatctctctgcctacacggagaaccagatattgcagttgaagtcttgaggacacacgcgggcagcacgttctctgacaaatctgcatatcatccttctgaacattcgttatctatgtcagactgaccaatcgccaaacagattacaagcatgcgatttcttctcttaaaaatgcccatggtgaccaatcattacatattgtctttcttttcatttcgacaggtcaatcattgtacgtataatattgtcacaattttacaataatgtataataaaacgtaatcttaatcaaaaccaagacattttccaggacaaacatggccaccacttcgggcttcggccatctacatgtccgcacgtttgatccatgg

SEQ ID NO: 15031 - DNA, 1501 bp, Oryza sativa
taaatcaggtaagattggctgaaaccctgatgctaccctaatcggcaaccaaaagcaggctagagattgagattctaatcacgacttataaggtcaaactcaactgatggagctataagtatgaaaagaagaacaatatatagacaatcaagccgctggttgtttcatagagtggtggatatcctatataatctaagtcaacattagtatttaacctgatcggctaccttctagttgcagacgttagccgattggaggttagatgacaatattggtagagattatatagaatatatgataactcgacgaattacataaacaagattagagtatcataaagatggaagcactaatcccgagaacgcaaaccgccataacaagttttacttgtagttgaagatcgaaaccgttgcagctcaacccgaaagcaagaactcgtcgaaacaaaatgaaagtaaagggtggcgatgcgcaaagattgtattgaacgtgtgttgttatattacatggggcttggggtctatttatacccgagattacaaaatatgtccgtgtcggacatgactcttatctctaacaaactctaagataccataagtctttgcggcagacttttgcccaaacatatctctaaggaaattacatgaaatatcctaattagtagatacaattgccttctcaggactcaatccgtgcgtagcaatcctcatgaagcacgttaacccaacctgacaacatataccatgtcacattgttggattcggctcaatcggctaactttgtccaactcggactctgccgatcccagtcgcagccgattcagactccagccgatccttactctgtttccggaacgatttccatctcaaattccgctttgaccctatcttcatctccgatacttggattaccaaatttggttattaacacatgccccccaagtccggaatatttggtattgtttcggatttgccatgcccgtgtctccgagagtatcgcttattgccgtttttccgaccgttaccatggatctcccacaggctctgataccacttgtttttaaaaccggcccgaaatcacatcggaaacaaaacacggaataaacaccataggagatccaaacacgatgacggcaccgaggcacgatatttgataacggagttcagccgaggcctacatctccggggcacagattacgggcgttcctccccgatccagcatatacagcgtatcaaagttacaacgactcacggccggtcgccgccggcagccgtgcgtatcagagttacagcaatgctaagtcgccatgcggttacaacaggcacgctcctctatttatgagagatcctaggatagagtccgactcatactctagtcctaatacctattacaactccaagtcctaaattgtaactcactacgtacacatattcgacacaaattctaactgagacagagaggtgagaggcgatgccgtcactgtcgtcggccaaagtcgtgg

SEQ ID NO: 15032 - DNA, 1501 bp, Oryza sativa
ccatcctggagacgttccagtacgcgatgttcttcctcctcgtggccatgtgcttcggcgagctgctcgacgagcgcgccgtgcgcgacatcgccgccgcgcagcgcgacctgctgctccactcctccaagaagctcagggtcttcgccttcctcccggccatcacgacgcgcctcttcgccggccggatgaaggccatgatcgccatgcgccagcggctgaaggggatgttcatgccgctgatcgacgcgcgcagggcgcgcaagaacctggtcgacgaccatggcgacgccacggcgccaccaccgccggcggcgagcgccacgacgttgccgcactcgtacgtcgacacgctgctcaacctcaggatcaacgacaacggcggcgagcgcgcgctcaccgacgacgagatggtggcgctctgctccgagttcctcaacggcggcacggacaccacctcgacggcgctggagtggatcatggcggagctggtcaagaacccaaccatccaggacaagctccacggcgagatcaagggcgccatcacctccaactccggcaaggtgtcggaggaggacgtgcagaagatgccgtacctgaaggcggtggtcatggagggtctacggcgacacccgccggggcacttcgtgctcccgcacgcgccggcggaggacatggagctcggcgggtacacgatccccaagggcacactggtgaacttcacggtggccgacatgggcatggacggggcggcgtgggacaggccgagggagttcctgccggagaggttcatggccggcggcgacggcgagggggtggacatcaccgggacgagggagatcaggatgatgccgttcggcgccgggcggaggatctgcccggggctgggcgtggcgacgctgcacctggagtacttcgtggcgaacatggtggcggcgttcgagtggcgggcggcggagggggaggcggtggacgtcgacggcgagaagctcgagttcaccgtcgtcatggagaagcctctccgggcgcgcctcctgccaagagccgtcactgtttgactctgggtgagctttgacatttgggggggtttattagacatttgacactctctcgctaatgtagtttcatgctttgtaataatggtattattattagtttccttttgatgaataaaagaattccaatctattttgtcatagcacttgacttactataaaccatcatttgactcgttctatcccatgacaactttatgtattggtaaactctaatttgtgtgtgcgcttattagtcttgttgcgtgacgggtttcaatgtcgtctaatcagacgaggtgacgtgtagacataatgacttctattatacgatcattgcttattagttactctctccatcccaaaatataagaacctagcaccggacgtaacatttactactacaatggtaaatgtcatgtttgttcctaggttcttatattttgggacggagggagtactctctt

SEQ ID NO: 15033 - DNA, 992 bp, Oryza sativa
atataccttagtcaatctcatgtttttaaggctttcagcaataatgtttggtgggcacttgaaaatgtcttatccatccatccctttaagaaaaccatagaaactgtgcaatcatacttgcatgatgtgtgaaaccctctgtttcccgggggagggggggggttaaaaaggatttcctgaaactgtgcaagaactgcacataaacatggcatagcttgatcaacttgatgaggactgtgtcaaagctgctaaaaaatgaatggtgaaagagatatatatcaataaatatgtagctagtggtgaaaagcaatgcaggcccgttttctgccggggagagagaaagagagagagagagagtgattgtcaggtagcttgttgattgagctgcatctgaattccggcatatacgcatgcatgaaacgcagcagagatgttcttcttgctgtctcgcttggacttaaccgcttgggctcacctgctcctgcatcatctgcatctgcatacgcaattatgcatgcatatatatgtttgcttagctaccatgcatgcatgcagtttgtttcagactctttcagttattaatcctgcagatgttcagagaaatgccatcagcggctccttggcccacatccttttcaacgtttaactggggttttgcctcgtagactgtgctatataatctttgtctatgcgatgtaaatactgttagctactccctccgccccaaaatataacaatttagaaccggatggcatatatcctagtccaacgaatctggataagaggctatctagatagattgatatattttgggatggagtagtactcactatagctagcttcaggttttacattaccttgctttgaaaacagccactgcatgcatatggacgggagcgtatcctatgcacacaggccctcgcgtgtacacaccgtgtacaccaactaaaaattatcacaaaaaattttaggaaaattcatacatgtacttt

SEQ ID NO: 15034 - DNA, 1501 bp, Oryza sativa
cctagagacgggcaaaaccgtctctacaagagaagaaaaccgtctctacacagggccgtctctagtacacctagagacgggcaaaaccgtctctacaagagaagaaaaccgtctctacatcctgtttctgctgtagtgtccttctcattttaagtaaagacatgggattctgtgtacaatattttactgtccgtcttatttaaatttttatataattagtatttttattgatattagatgataaaacatgaataatacatttatttttaaaattttttaaaatttttttaaataagacagacgatcaaatgttaaacatggaaactcatgactcacgactgtatttaaaatgagatgggatggagagagtattactacaatggagtagtactttggttcttaatattatgctttatttgtatccattttgttggaatgagctcagaactcaagaagagctttttgttactagtacaagaatagcagtgctaagaatatttatatttgttgtggacgggggaataataaattttacgatgaatatatagtttggtgataattttcgaaaataaatgtttttttgtgcaaaattttaggcaatgaaagtttctttctgcaaaattgaacgctatacctttcttttttttttgtctgaagtccctactctttactgagctgcagagaactacagttattcttcatcatgctgaggtttggtgaaatcttgaaagcaagctgacttggatcaaagataggcatgtcttttggggtgtgcagaaagaaccaaggaaaaaaaaacaggagccagaccaaagtatccgatctatttttcgttatttcggtcgtgttcctcaggtacctgagcaaaccgattattacggccaaacttaagtccaccttcgctacgacaggtcacaggagagtccagcagactcaagttcccattaagggctcctttattcaaaggattggtataggatcttttaggattcacaatcctatggattatttcttatggaggcctttgattcataggaaatgaaagaaaacattcctaaggattgcatccctttagttcattttcacaggaaaaaaagaaagaggtctgacctctttggaaaagaaatcctgtgttttttcctatagcactatcaaagggcacatttcattttttcctatgttttttattcccacgggattgaagaatcatactacttcaattcctatgtttttcctatcctgcgaatgaaaggggccctaagtagggatggcaatagatcaagtttggttcgggtggagtaagaatatacccaacccaagacgacaaagttctcgcccacccatgcccaatgctttcatcgtaaaataaaatccatgtcaatacccgtcatgtatcgggtatccatggatttttcaacaacatgatgtgatatatcaattgatacatatatatctaaactatcacaattagacatctatgtttactcaataagtataatca

SEQ ID NO: 15035 - DNA, 1501 bp, Oryza sativa
tgaaaaggtttgcgaaaatcggtatttttgcatgtggccagcgcaatctcatgcgaaaatacgattttcgcacgggcacttaagccgaccacatgcaaaaaaaaataatcgccccgccgccgcctgagatcgtcgcagccgccgccaccgctcctgtcgtcgccgtcgccgtcaccagccgccggtagaaccgtcccgcccggatccgccgcctgagaccgccgccgccaccaccgccatcatctgtgccggatcctccggtcgagaccgccgtcgcgatctccgccacgctccagatccgccgcccaccgtcgtcatcgccgtcacatccaccgcccccaccgcacgaggtaggatcctgtagctggatctgccttcgtcgtccggatctgccgctcgccgtcattgtcgttgagggtgccgtcggatccgccacccgccatcgttgtcgtcatcggcactgttggatccgccccccacctccctccgtcgtcgccggtgccagatccatgtggggagggcctgctcccggtcgccgccgtcgttgccggtgctagatccacgcgagcccgctcctcctccggccatcaagcccgccgccgccacccaccccactccacaccgctctcggagtctcggttgctcttgccgtcgaggtgacaaggagagagagagagaggattgagaggagaggaggagaagataagtatcgacgtttgaggtctcgactacggtatttgcatggtgtggagatcgtcggtgtaccagggtatatgcgagactgaagtgaaagaaatggagacaaggatttttatacaggtaataaccctactcctattgaccaaagccggtgttgctctttattcatctggatcacacaagtacaatatttgggataacctatctagctgtcatcgacttggcggcatagataaccaacatgtagtcgacgacaagatagtcttcctcctcgagtacgaactcatcgagatcagagatggcgctagatcccttttgtcggcctccgcaggcaccatattgggtctgtctaggcttatctctgatgtcgatgtctgccggcgtgttggtttgtgtgtcgatctatcgtgtcctctctcccctagtgtcagggttatggataccacatacataatagtagtcgactaaatctcggcaggacccaccacataccatgtcttatacgggaacaatcttcggatataggaggagttctacataaggaaggatgaatagagttctacatgaaaatgacaaggactactcggattgtatccatattggtttccctagttctacttggacaaggggacacctatgggtataaatacaaggccccctaggaggaaaggggacacgaacaacatagacgccacaaagccacatgccaatataagcctacatacgccaagacaagctggcagatatcgatatcagagataagcctaggcaaatcccatatggtacctacgggaaccaaaga

SEQ ID NO: 15036 - DNA, 1501 bp, Oryza sativa
gaaaagctaaggcttcttttggtttccttattttcaatagtttgtttctaaaatggttactgatccttctccctctttcaaaattgtagatggcagtgaactccagcttcagttcccacggttttggtgagggtcaccacgtcgctcagcttcgtgacctcgcccgtttcctcggtttctcgtgtcccgagtacacggggtactccgtggaccgtgttccccctcactgtgagctctctgtgtacctttacccccgtggaggtatacacggagccggccttcgcccacaccacttcaccgtggccaggcccactctccagatcgcgtaccaggacctctcctggactgcgcttcgtcgcctggcccacgactacagccaccgtctcggaggctccgccttccggcagcttccacgccttccttctggccactcagacgccaggtacccttgtccgtacagcgagtctcagccagtgctgactcgcatggttgagctttcggaggctcaggccactcagcacgacctactccttgaggcttaccgctcccttgcccgccgctacgccgctttggaggcccgtctggccgaggagggtgtcacctcagttgacactatctcctgggactcaggccggctctgtcacgccagccacctgtcctcccacagctcccgtggctctgcccgcactcccagtggtccgcgctcccccagctcgcgtgcgccgtactcaccagtgtactccccctacccacacccagttagcccttcctacacccccggacacaccccagttgcttcctcccgccgtggcccacgctttatccgcaccgcgcggaagcgtgttgttggttcttccaccgtgttccgtttccactacccagctcccccaccgccagcggcccgtgctgctgccggccctcgacaggttccgccggtcccttcgcgccagccgatcgacgtttcttcgactgaggagccgactacaggaggcagccaggccgacgaggagtagaggaggcagtcttcagcagccgtccgggtgtcaggcccttttgttccgccgccaactcttttggagtcgtggcgaggtagtgcgtgcgtgtgtttgttgtgggtgttgtttggtagtctggttctcctaggtggtgtgcgcacagtcaagctcggcgtagctctgtgacttgtccacacccgttgtatcaggtgtttttatgatttgaaaaatccagtttatgcctagtgtgtgctatctgagttgctatttactttgctacttgccctcctaagtgcttatctaactcttaccccgccctcttctgggagtttagatggctagccgcccccgccgtgcagctcgtgcaccagcccgctttggttttgaagatggtagagccgagccagaagcaaatcatgagtcagctaatgagcagtctcaccacagcaaccgttcacaccgtactgtttcccgcaacgcagaagttgagcaaccccgccacagca

SEQ ID NO: 15037 - DNA, 1501 bp, Oryza sativa
gcactaaaaactgaaaagcataatgaaattcacacatacaagagaaggaaatggtatacaactacaagaagaacaaatagtcattcatatgtgtggatgcataacaggtaatgtaagttttattgattctagacaaatttattaaaattcgctttctctacaatccacagaaagtgaataacttaatttgaatccaacgtctcacacatgaaaaataatcattaattatttctccattgaaaatgactaataaatcgaggcctaatacatgggaaagggaattgctaaaaaattatcgcgaattcaaatgtgactatagtatacttgtactgtatagcatagttgtagtgtatagatgaattaatattaacttaccaccctacgaatgaccggttccaggttaagaacaatttgttgaattgtttccgctgccactgcccttctcaccaccctgcagaaagagcacacaactatcacacacccagttcgcttcaagtaattattgaatttgttcgaagttccagttgaactaaattaaaataagcatgcataatatgcaaatataatagatacaatactgttcatatctctacatatccagagtgatcaagagatcgagattatgatttatatatctcaatggacaggagaagaagcatggaactgaatcttgccaataaaccgtaatcaaatttgacgaggcttgcaaagtgatcgatcgatcaacatgaaaatttgacgaggaaaaaattgaagagaaatgagttgaactaacgatctgaaggagagcacagggcggagacgcctggcgccatggcgtcgctgctgatgttcctcggccgaaccgctgctcccatcctgatcatcgtcgtcgacctcctcctctacccgtggccttcgcaccgacatcgatcgatcttcagaaccaagaagtaaaatcgatcatctgcttgcagggcgtacgtgcaagaacaatattttcagaaatagttacacgagcagtaatatgtaactaatgactgaaaataagctcgattgctaattaactagacgaatatttatacacacaataattaagatgagataaaaatgaacgcaactgaaagtacctgtctgccgaactgaacaattaatcaaactatatggctagctagctaattaagcttagccataattgcacactaactatataatatggggatcctctagagaaacgggttgttggtagcagtatatataggccatggagatagagggccctggtcatttcctaggaattgttacagaggaagtgaagaagttgctgcaagttttctcctgcagtcgacagaaagactgtggatggatgagagacaggagaatgttccggggaggccgcaggaaggtagctggaagctatgcctcgccgtcgcatatgcatcccaatttctcgcgtactactagtagtagtagcctgcatgtgcggctcgcgagaggaagtagctgcagcttttgcagcagt

SEQ ID NO: 15038 - DNA, 1501 bp, Oryza sativa
tttaaattttgcatgtggtgtttgtaaccagcgcggaacactggaactgattgaccttctgatgttttggaataggtactgccgtcctggaactggcagtaggggtggagaccttggcagaattgattcatggagaagtcacttccccctgtgctgtttggaacaaatgatcaaccatgtccaatgcagtgaagtgagagcaccttggtaattgctactgttgttctcttttccaacacaagtacatatgatttaacacaggtatctctaagtttcttggtgcaaactttgcattgttttttcagagaatctcttttattttagacgtggcaaactttgcactgtttatttagagaatttctatcatttttagagaatatggagaactacgtatcttggcactaaagaaggagcaagcttgcaactgatgttgcgaactaaagctatatataacctattcagccacccataggtgctccggcaagtttctaggtcaactttgcattgtttatttccttgaaaccatcttcacattagcttttggtcttgtttatgagcaaaactggacacataattgaaatcacactactttggccattatgtctcatgcaaacttatgctaaatgtcaggccatattaacacaatataagtggaatttttgcaagaagctaaacacttgctagcttgttattcttttcaattgcattctctatagagatgacatttccttttatcaattgtaaggtgatgttcatccgagggaaaggcaggagcagagaagacggagtcagggaccttggaatagaaaggggaatgtatggggggggggggtggaataggagatggagtacatgatttattattttagaacttcaagtattttgcttggtgatgtatttgttaggacttgagatttttcacaataaccattgtacatggactgttgtcggactttgtgctgttaatttggtttcaatatttgtttaccgcatgcatgacccgttttcacaacatttggctgcagcagattgagcaaattgatacaggatgtacattaaacttgcactggtcaaccgactgtacagtattagtgtattttatgtcgtcttacggcatatatttcaggaaaactatattggaccgatctaaggcaagttcgtaaacatggacggttagtaggcccaatatgatgagataatcggccattaatgggccttttctaaccgcaaaggaataagatcactttgactccctcaactgaccaccgaatctaaatcgtatacctcaaccgcaatacctgaaatcttgaccctcgaacttgcaaaaccggtgcaatgtgactcccttggtggttttggatggtggtttcgctgatgtggtgcacacgtggtagtgttgacttggtctttgttctacgtggcattgacgtggtgcttatgtggcattaaaataaaaaaatatatgcgggacccatttgtcattcacacaaaaaaaaaattg

SEQ ID NO: 15039 - DNA, 1501 bp, Oryza sativa
agccgtagtggcatttaggaaatgttgggaccaagaaaaagattctttggtttgatcctaaattttatactcaaggctccttaagaacccaaactccaaaggaagggctcaaggagagaactcgatgagtctatctattctcttcttcttcttcctcctcccagctgtcccggtagctgtcatccagagaccagatgcaccggagagccttctcgtatatctcccgcctccgcgcctccatgggcggctcgccgacctgcgccgccacccagtccatgtactccacctgccgttcgtcgatcgtcgcggccaccaatggccggaacatggtgagctcagaggccgagacacaaaatcatatgcatgcgtaacttcgtacgtatacgtacccagtcaggcatgagggcgtgcgtgtgccgcttgggcttcccggcggcgtccatccgccggtagtcctcctccacggcggccgccatggcctcctcgcccggaagctcggcccgccccgacagcgcccgggcgacccacctcgactccagctcgaacgactggaacatgatggtctgcacagtacatatacatctcttgcctgaattgtcatggtgtttgtttgtctgaactctgaacaatcgacgaggacgtgtcgttgttataccttgactggcaggccgacgaaggagaggttcggcgcgtgcttcggggggaagacgtgcttgtacagaggcccgacgcggttgccgtcgacggtgaccccctccacgtccaggaacgggaaatggtaccgatacctgccaatgcaatcttcagtaaattcatcgaaatgcaaaccaaacgaatgtatgcagctcgaccaagtgtgatcctaccctgtgcagtaaagaaaggtatctgctgcgattgatgcagatccttcgctgaaacgcacttggccatcatcttggatgcaatccacctgattattgtatatatgatccacaattagcacattgattcagtacatgatgcctttgagcaggatttcgggatgtggattttcatccctcgagggacatcccctcgttatttgcatgttatctagatagttatcaaaaaatttgaaaaaaaattgacaacatagattaatacgaaatatatcactccacaaacatgtaagaccaaattcaacttttatactccctccgtttcaaaatgtttgacaccgttgactttttaacacatgtttgaccgttcgtcttattcaaaaaaattgtgaaatatgtaaaactatatgtgtacatgaaagtatatttaacaatgaatcaaataatatgaaaagaataaataattacttaaattttttgaataagacgaatgatcaaacacgtactaaaaagtcagcggtgttaaacattttgaaacggagggagtaagttgcaacaaaaataacaaattaaactgaaaatagttatcgcatgttcacaactatatttgttatttttgttataatttgtagaagttaaat

SEQ ID NO: 15040 - DNA, 459 bp, Oryza sativa
taaacacaatcttttttaaaaaatatatgttatagtttcttaaaaaatcaaacaaatccactttttaagttgtgctaaggaagtgaaccgagggtgtaggcttagggtgtgtttggatggagggatttgggtggataggagatggcgcccattttttgtgggtgtttggttgatggatagggataggatcgggcggcccaacagggaatattccactgatatgccggatggagggatccgggcagccgctcgagtgcagggcgagcgaggcgagcagggtctcgtcaccccccaccacgcgacaacggcgacgagcacggcggccagtgcgagaagggagcgcgacacgcggcgggaagaggcgacggcggcggcagcgggaagaggcgacggcgaccggatctagcgggttccgtcgtcatcgccgtcaaccggcgagcgagcgagcgagcgaggaga

SEQ ID NO: 15041 - DNA, 1501 bp, Oryza sativa
acgatcagaccaaagaggtttatacaggttcgggccgctatgaagcgtaataccctactcctgtgcaggattgattgaatgtagaacaccagtgcttggggttgcgagacccaagcgcgagttcgctcggaagttccccccctccatcaccaagcgcgagttcgctcggaagttcccccctccatcactaggcctggacctccttttatacctcaaggggttaccacatgggcccaacaacctaacctagctccagtggagaagtatgataatctttgcattaaatacatgtcttgtctcttaacttgggaagccaagcacacgtcgtcttgatgatggggcccatcaaatcttgccgcctgacacggggggtgcccctgtcagtcaccatttaatgggtgaagacttctgggctcctattacaccgggaaacgggagccttgctttgaccagagcgggaggaccgactccggctgggataagaggatgagaacctctcaccatcactatttgatgggacatgtcaggctgcacgccgcctgacacacgagcagcgcacaggcgcactagccagtcccatcggtcatttgaccggtcacagaccggttgagtgcactgcacgccacattaaatgcggcgtggcgcaaccgctcgggacgccataaatgcgggtagatgggcacctgaagacggacacctaacccaccgtacgtggtgacctagagagggggtcgggggagcccgacccctagtcacgggagggggcggccgccgcccgacctcgggcccgatccccccttgggtgggagccacgtggcgtctggggcggccttctccctctagtctcggccagggagtggccgccgccctacctcgggcacgacccccctcgggggagggccacgtggcattggagagcagcctcctccatccagtctctgggaaggagtggccaccgtcctacctcaggcctgactcccctcgggggagggccacgtggcatcggggggcagcctcctccctctaaacctgataccccgggcccatatcaccgacacaaacaaacaggttaattatgataaaatattaaaggaaccaagctatttttaaaataaaaaatcgaacgggatatagaaaatagggttagaattttcaacggtatggcttgtgcattgaaacatgtttgctagaaatgatatagtgcaacatatgaatgcctaatgatgaaatggtatactggcaaatctggcataataacatatgaaatagcctattatgtgacatttttctttaactttgaacttcctttttttaaaagagaaaagcaacgtgaacatctcctccatctataattagagagaacgcaactgaaccgaaaatcgtagttggtggtgtaagtgcaacaagggatggcgttggtataatattaatggacgatggacaaaaataataatgaattatgagacacaatggagcagtatgtgtgaatcttgtcgagttc

SEQ ID NO: 15042 - DNA, 272 bp, Oryza sativa
cccccccccccccccccccacgccacgctcccccgcctcgtttcccccgcgcggccgcgccagaaaggggagaaacgcttcacgcgcgcggcgcaccctagcttgggccacgatgccatccgctaacgtgcgcggggcgcagcctagcgccgaccgcaggttaagtacgctggtgcgccacctactgccttcctccgcacgaacagcaaccaccaccagcacctcctcctccgccgccgacgccgactcctccctccaagctttccccacca

SEQ ID NO: 15043 - DNA, 1501 bp, Oryza sativa
tcattattcggtatattttaatccaagaaattgaaactatgatcatggcataagcagtgtagggtgatcttaacataaccagtagcatactatgcgcatcatgaatgtcagaaacaggaacataccagtaatgcgataacatgctagaggcatcatgtagaacaggaacaagaacatagcgcacacagtatagcgctaacaatgggaacaggagtagcgctaacagcagtagaaggagaagattataccccgagaatggccctccgctggatggtgaggcagaattgcctccgttgttgtagtcgttcacggcacctcctcctggcgcaccagctccggatccagctcctgtcggcgtcggcggcggcgcagctcctgtcggcggcggcgcaccaccgccgccattgttagaataattgggctaggcccaacttataatattaaatctcaaaggcccataataaatgttgaggataataataccacctctggatttaagcgagaaatatctcaacctaaatagggagttattagaggctccctgttgaccagttgaggtgggggtcggaatgccacacgcgcgcgcgcgcgccgggccgtgggcgtggccgaggcgtggcgtggctggcggcgggcgggtgtcacgtcgctatccttttgcagccactaacccacgttcccacgattccctccgcaacaacgcgtccacgttctttctcctgatagataaggaggccgcgagtccgatccgagttcctcgcttatttcccggtgttagtttctccttctccgcgcctgagtgctctcgcttccccgcttctgatctcttgcgcgcacgagagattggaagaagcagtgcctcacaaaccacaccttcgcctgagatctgcaccgggtaggcgggtgatcaggtttttggggagtgcctcctgcacgactgctcatcgccatgtctggagttgctgccgccgctattggcggaggtggtgcgccgccgccgacaggagctgcgccgccgccgacgccgacaggagctggatccggagctggtgcgccaggaggaggtgccgtgaacgactacaacaacggaggcaattctgcctcaccatccagcggagggccattctcggggtataatcttctccttctactgctgttagcgctactcctgttcccattgttagcgctatactgtgtgcgctatgttcttgttcctgttctacatgatgcctctagcatgttatcgcattactggtatgttcctgtttctgacattcatgatgcgcatagtatgctactggttatgttaagatctatgccatgatcatagtttcaattccttggattaaaatatgccgaataatgactatatttccaacaatccaaaaacctgataggtcattttcggtagttggctttgctgctgcactgaaaccacatgcttttgatggttcaaactataagagatggaaagcacgtgcactattgtggttgacagcga

SEQ ID NO: 15044 - DNA, 1501 bp, Oryza sativa
gggaattccgctggaagtagctgttggcggcgtaggagcagtgcgccgccacgttgtttgggctgtagcacgacccgctcggcgtcaccggggcgcagtccgcgccgtgcccgcacgcgtagtccagcgccttctgcagcgccgcctccgccacgttcggcctgcacacgcaccacgccccctttgcacaccgcacgcgcgcgtcgtgtgagctcggcccgtgacaacgatatacccgctacgtagctagccatttcgatcgctcactcacctgatcctttcagcgacatgccgagcaagagcagcagcagcagcagaagccgagtcgccattgctcctctgctcaccacgcgtgtacgttctgcacttctgcctctgcccctagctcggcgaatcgtcgatgctgctggtttgggtgtaactgcgctgctggttgtaggagtagttggctagcttctcattctctttatttattggcgaaaacggcaagtcaccactcaccgacgggctggtccgattctatcgcgctttccgaccattccgcgagctgtcgcctttgcgcgtagctgctgccccggccgcgcgacgaacggcgctgtttaggccgggtttgcgagccggcgtcgcccaaagtaaaggcatgcaattgcaaagtcgcgagctgcaaagccgtcacctgtgtgctgtgccgtgctctggcagctttgctgtacttgtgttcttcgtggtggacagtgagtggtagtgcttaccagataatcttgagctttttcccccctcctttttttttttcgaaaagcaaagttatgtatacacacagtatggtatatagtagcacattcttttgaagaaaaaggaaaaggttagggagttaacatgtatcctgcacatgctgggataaattgaacgtccgcgtgtgatgtctgtcaatcatcactcatcagctgttctatctgtattttcagctcaggctgctttgcactactacattcggggactgctaatttccagcagatgcacaaagtgacaaaaccaagatcgagaaattgatggaggaacactaattggtttatcagttctcaaccaagtcagaactcagaagtcaccaggcctgttcatgtggcaaatatctccaacataagaatcatgtacttccttcgtcccataatgttgcaacctaagatgggatgagacccatcctagaactacgaatctggacatgtctccataatgttgcaacctaggatgggatgagtctcatcccattctaggttgcaacattatgggacggagggagtagtatattgtaacacatgaaaaatctcttcccccttgttctagattatctaattccacaacaaacaaacgcacacaattgcttgcactttcactttgttaagttaaagcccgatgatattctgtaaactccagaattgtatcaattttaacttcataaacatgatcaacgaatcgacgaatgaaaaattaccaagggctaggt

SEQ ID NO: 15045 - DNA, 1501 bp, Oryza sativa
gttacacaacacaatcagccagaccggcttatgttaggggaagggagaaaaagcaaatgaaaaataaactgaagcttagagaaactacggtggctaaaaacagacttcaagcagcgggaaggagccaagccacgctacactcctaacaaatcctcaaaaacggcgacgccagttaaagaccacatatggcattccgaatggatggactccagaaccacaaaaactgaggagagaacggagtcgaaaaccctagagtttcgctcatacagttgccaagagaccaggagcaccaaggagtcgaagctgtcacggaggtgctcaggtaagcaggccctggaggacggccaccagtcctggaaccagctgccacgggggagagagggcagcccagctaggaggcgacaacactcaaagccagatttgccgagcgaacacgtggtcgaggaggatgtggttcgccgtctcgagatcctgggcgcaaaaggggaaggccgagtgactatcgatgccacgtttctggaggagatcagccgtccaggagcactgttggaatgcaaatcaaaggaagaacttgcatttggcaggattctttgcgtgctagagaagatcagcacaagtaaaggaatgctggccatagaagaatgcctggtacgcctaacgcgctgagtagcgctggtcagccgtctagcgccaaacgagacgaacacccggtgagagctgtacgtgaagcaccgtatcccaaataaagagaaactagaaaatgacaggacaacgaggacaccgtggatattaaagacccataagttgttcgtcaggcggcctagctgcctagtcaactcagattcagcattcaggagaagatttctgggggttgataaacttctcggaggcacaccaggtcaccagcacgtgtgcaagctagagctactgagctaactaaatacgcctctgcagagtgtcgtagtatgccacaccggcacggttgtacatcggctggccgcaacagcgttgcacggggaaatggattagacgggcttatgtcggaactcaggaggagctctatccactggaagtcaggggtggatctacagtataaacatcggtgtcaggcgacaccgacgactttcggtaaaacctaaaataaaactggttatccatatactataacattatgttctaagtataattagcatactatgatatcgatatacacgttatgatactaacaaacagattttctggatccgccctgtaagtccacggccacctactccatcgtccacgttgcgcgaccctaaacgctctccccccccccacacctcagctagcatgctgatcgatccgccgtgcaaccgcatccacagtgcacgcacgcagctacaaagatgtcgtacgaccacgaccggtggcttgtctgctctacgttacactgtgcgtggcttgtctctgctctatatgtgtaccgcgtcgtcgtgtgcacacacacacacacacaaccgta

SEQ ID NO: 15046 - DNA, 1501 bp, Oryza sativa
ccttgtctattaatcaatcgttaccatgttacggaacatagatgtagctactccctccgtccaaaaaaaaaaaatacaaatcctgggttttcgtgtccaactttaaccgtccgtcttatataaattttttttataattcgtattttcattattgttagatgataaaacatgattaatattttatgcgtgacttgtctttttaatttttttcataatttttttaaataagacggatagtcaaacgttgggcacggaaataagggtttgttttttttttgggacggagggagtaggttgctagctgcctagctagctgacggagcgtggggctcctcaccgggagaccgcgcaggcccccctttgccggttcggccgggggcgctaagtgaggttcttcgccctcgatctgaggaacgtcagcgagagaggaagtgcacaagacacgggcgacgtagacaggttcgggccgctgagaagcgtaacaccctactcctgtgttctggtggatctgtgcgtgaaggaatacagagagccggagagcgagagagagttcaggctctagaaccccttcgccagagtcccaacccccttcccttcttcttcttttctctctctttttaggcctgggcctcctttttatctggtccggggtcaccacatgggcctcctgctgcctaagaagggaaacatgctttttacaatgagggctagtttacagccggaagtgacatctgacaagcagagcacacgcctcctgccccgctcgcccgcttttccggtggacgcccatttcaaccttcatttaatggccagcgacttccttgccatacttgcgctgaagcctggaatggatctgaccgggactgacataccaactccaggagttagcacgccggctccggctagggacgagagccaggaagctctcatcattccgacgggacggggcgaggcgtgtgacaggccgcctgttggcacctaacccgcgatctgaccggtctgtgaccggtcacacaccgcgaccggtcacggaccggataagcgtgcgctgcgccgcattaaatgcggcgtggcgcgctcgtccaacctgctataaatgcggttaggtgagcccgctgggctcacctaacctacacacgtggcgccaaaaccacaggggtcggggcgccccagccctcggggccgaaacgggagcggcccgacccctcggggagacagagggagaggtggccacgtcaccctcgggcccgacccccccgagggggtcaggccacgtgggtgaccgcggctacccaagcctctagtcacgatacccccggccccatgtcaccgacagtagcccccggcgttacgccagggcgatcgcccccctcgagggaagcgctcgggcgtgacgccactccttaggcccggtgacaggtggggccggtccctacaggcgggcagaaacccggcggtcgcaaatcgcgcgcatcggcaagggaaaaccgaccgacaataa

SEQ ID NO: 15047 - DNA, 1501 bp, Oryza sativa
tgtggaacacacggcgctaattaagacttaaaaccagtagtagatattaattagaaggtgctttaattagcttagccactccagctccaatgcctagcttaaccacaattgttctgatcacgtcattgctgcagctagctagtactacgcctgatgcctcccaggctcccacccctctactgtgttctgccaccgttgacacgggacatagcccaataaaccaacgaccagatacatagttaattagaagttaatttttttttaagacagagacaaagtatgtatctatcttgacgaaacatgtgccacttaatccttgattggagaacacatcaaaatgggcaaaataaacgtacatgcgtacgtacgttgagatagctagtgtcggtgacatggggccgggggtatcgtgactagaggcttgggtagccgcggtcacccacgtggcctgaccccctcgggggggggggggggggggtcgggtccgagggtgacgtggccacccctccctctgtctccccgaggggtcgggccgctcccgtttcggccccgagggctggggcgccccgacccactgtggttttggcgccacgtgtgtgggttaggtgagcacagggggctcacctaaccgcatttatagcaggttggacgagcgcgccacgccgcatttaatgcggcgcagcgcacgcttatccggtccgtgaccggtcgcggtgtgtgaccggtcacagaccggtcagatcgcgggttaggtgccaacaggcggcctgtcacacgcctcgccccgtcccgtcggaatgatgagagcttcctggctctcgtccctagccggagccggcgtgctaactcctggagttggtatgtcagtcccggtcagatccattccaggcttcagcgcaagtatggcaaggaagtcgctggccattaaatgaaggttgaaatgggcgtccaccggaaaagcgggcgagcggggcaggaggcgtgtgctctgcttgtcagaggtcacttccggctgtagactagccctcattgtaaaaagcatgtttcccttcttaggcagcaggaggcccatgtggtgaccccggaccagataaaaaggaggcccaggcctaaaaagagagagaaaagaagaagaagggaagggggttgggactctggcgaaggggttctagagcctgaactctctctcgctctccggctctctgtattcattcacgcacagatccaccagaacacaggagtagggtgttacgcttctcagcggcccgaacctgtctacgtcgcccgtgtcttgtgcacttcctctctcgctgacgtttcttagatcgagggcgaagaacctcacttagcgtccccggccgaatcggcaaaggggggcctgcgcggtctcccggtgaggagccccacgctccgtcatctggcgcgccaggtgaggggcgcgcgtgtctttctaagccctcgtcctctttcgtgtgcgccaagcttctcccgctcagcccaa

SEQ ID NO: 15048 - DNA, 1501 bp, Oryza sativa
ggaggacgcagggaatgtagcggttcagcacctgcccccgcggctggaagtagcagccaccgactaccgtcggcggtgacaccggctgtacggtgaagaaccaccggaatagccggagagatgggcgcaccccgataaacatctcgcacaggtgcgcgaagatggccaacgtcattatcgcgttgggggtgaggtgcgccatctggagatcataaaactccagaatatccatgaaaaaaatagagaatggcgggaccagccccgccattgcgaaagagaggaagaagacggaccgccccgggtagtgtggcgccgggcgtccctcgcccagcgcgaccacctaccggccggtggcagattccggcatgaatcggcgcggcagcccggcctgcctctcgctcacgatgcgggaaggcggcagcacgctaccatcgagcggtgcggagccccgtgccatgacgccggcggaggaggagcttgagagcgagcgagtgcggcaagggtagggcacaggaaacgaagagttagagcacaagtggcgaaggcaaggggaagagtggcgagaggaaagaaacgaatcccttccttggcgtctttacacccttgccaacgctatgcccggctcctcgcttcccgcgcccactacctcgccccctcgtttctcgcgcccacgcctccactaaccccactcgcccgtttgcggcgcacgcggaagatgtgcggccgtggcggttgagatggggcagatcgtgcgcgcattaactacgcccgccaaccgtgaaaagcgtcatcatcatgtctccaggcgaaacgaaccggctcgtcccgattcgcgcgctgctcgagtaatgtagcggtcttaaagaggccgctcattattgtcggtcggttttcccttgccgatgcgcgcgatttgcgaccgccgggtttctgcccgcctgtagggaccggccccacctgtcaccgggcctaaggagtggcgtcacgcccgagcgcttccctcgaggggggcgatcgccctggcgtaacgccgggggctactgtcggtgacatggggccgggggtatcgtgactagaggcttgggtagccgcggtcacccacgtggcctgaccccctcgggggggtcgggcccgagggtgacgtggccacctctccctctgtctccccgaggggtcgggccgctcccgtttcggccccgagggctggggcgccccgacccctgtggttttggcgccacgtgtgtaggttaggtgagcccagcgggctcacctaaccgcatttatagcaggttggacgagcgcgccacgccgcatttaatgcggcgcagcgcacgcttatccggtccgtgaccggtcgcggtgtgtgaccggtcacagaccggtcagatcgcgggttaggtgccaacaggcggcctgtcacacgcctcgccccgtcccgtcggaatgatgagagcttcctggctctcgtccctagccggagccggcgtgctaactcctggag

SEQ ID NO: 15049 - DNA, 1501 bp, Oryza sativa
actccttttttcagcagcctattagacaatgtttttgcctatcatacggatacaaaacaaaagatatgaaataaagttgaatggaacaggatgtgcagaggatacaacacaaaagacatgaaacaaagttgaataaacaggatgtgcagcaaagcggagatgcacaacaagtgaatcagacagaaaatgcagatgcacaagtgtatcagacagaaaatacagatgcatacatgctaaccaaaaccaaattgagaactaagatgaacatttttggctaatgctgtattttgccaattacagtacaagttcataacccctgagaccattcaggcaagacagaatggaaaagacgacacatcacctcttttgcaggaacagtgttcatgatgaaaaattgaaaaccactagttaattagactaagctactacctgtgatctgtgtaatggaacagcaagcaagcaagcacctccagttcatcagaactccaattcccaggcagctctctatatatatatcactatatcagaatctggtgaagcctctgaatcatgctgtaattgcacagtcaaaaagatcatacaagctatgatgatcgaagaattgactgaacgaatgatggtaccttaatcttaaagcacactccaaatgacacacaactaatgaacaaaaccagcgtgaaaaaaaaaataatcagaaaccccttctcgttttctctgcataaccagtagcgggaggacgagatcccgcgctcgcgctcgcgcgatgaaccattcccctttcgctaactcatgcagtgctacgactacgagtgatttcccccatcccgcgacgcgcaaagcggagtgatggtcggagtcggagaagacgagcacaaagagagggaggagcgtgttgggatccgaacctcgcggcgacgacgacggagcggcgatcggcggcgctcccgccggcgtcgaaccggcggcggcccgcgccacccaccctacccgcggtcgccgccgccgcgccggcgagcctcgcctccctgctgggccggatcgggccgatgctatgctggtctactcataatgggccgaaacaggtgggacccactcttaaatgggccgaatcttctccggcccaacgaactcccaagcggaggactagtcgtgtactccaagtcgtaagtcgtctcctccagtgaagaaaaataaaattaaataaaattaaaaaatattttattttattttatttttaatttgaagcccaactttaatttccttcctaaccaagcagtcaagcacttcattcaccttgctcccctccgcaagccgccgccgcagcaactccggcgaaatccccggccgccgccgccgccgcccgccgccgcgatgaacgcgtcgcagttcatggacaaacagatcctcggcctcgcggcctcgggcgccggtgcggccgccgccgccgccgccgcgtcgtcgtcccctcccgcggcgggaggaggtgggggcggcgggctgt

SEQ ID NO: 15050 - DNA, 1501 bp, Oryza sativa
atacttaaattaaataaaatcttagcaatttcagaaaaaagactattgtatactaaaagttcattgaatatcgtacgaatacgactaagccgccaaatggcaccttacaagcactcctaggttgtcaagtagcactctaatctgaccatcgatttttatttagatcgacgatccattattttaatttagaagtttagatcttttattctaaacaaaaagcacacatccggaacctccacatcacgtaggtaccaacaaactatcttcatgacaaattaaaatcacaattattttgacattaagaaaaccacaaatagacctccacctattaggtctagtagctctcgctttgtcactctaaacatactacgaatgcttctaagctgctaaatggtactattaaattaaagaaaatacaagaaaatcttaaaaacaaacaaagcattcgatatcgatttgttaattttttttaataagaaaacaacccaaacctccctccctccctcccaccttcatgtagtgttaaaatccattaaacatcttataaatacttgcaagatgtcttgtctgcaattccttatttctatcatctcatgcaaaacgaggagaatgcaaggcaagggcgagaacaataaaaggtaagctgctacatgacgttcttaaattaaagaaaaatcttagaaattttggggaaaaaacatccaaccatcgtatttgacataaatcgatggatacattattttcaatggattgacacattattttaggtcattagatatatatttttaaaaagaacaccctaaatctccttccctccctccttctttgcggcatgcggtgttaaaagttcattacacattttatatatgctcttaagaaaacaaaacatccaaccatcggtttcgacataaacatctgacacattattttaggttgttagattagtcatttagaaaaacatcccaaacctccctccctccctccctacctacctgtgtacaacgtgcaccattcttttctctctgtttttatctccttgacaattaaaattatccatatgggcaaaaaaacacaaatggacctccatctattacttatatcctgttaggcatctaacgactttatgccaacttaattaatttctcttaacatgcatatgagggctatgtacctatacaaattgaccttgatacttttagaatgatctttgtaggcgataaataaatacttttaagaaagacaatcatagtgtccgaattacacatatgatctatgaagtcactaatcatagcaggtattcatctagcaatatagacaacaggttgaaaagtgtggttggttaaacatcatactgataagcatttgggttgtacctaggaattttaacagtggaacaacattgcagtggcgttagcaataaatcaagtcagttccatataggaattaaagaccatgtccatttcttttttttttgttaaacttgctatagtacattgtaaag

SEQ ID NO: 15051 - DNA, 1501 bp, Oryza sativa
agcggcgcatggcggccggcgggagaggaggcggagcgcgccaatcgccaggagagaaggcgaggcagcggtgcgcatcggccggcgggtgaggagagagcggcgcgtgacagctggtgggagaggaggtgaggcaacggcacgcgcctgctggcgggagaagagcggctcgccggcctctccgcctccccgtctcctccttttcttcttcacaggagacagtgagggagtgcgggacggcgaccggtggtggacggcgatagcaacgggatagagctcggcgagggagcttcaatggatgccaccgcatgggccgccgccttagacctccacctccgtcgtcggccaccgacgacgccaacgacaacccccaccggtcgacttcctccacaacgtcaaacccatctcgccgagcgctgcctcaccatcgtcgactcctccactccggggatcgccactcccacgtcagctcccggcgccgctgccacatcaggtcccgccggccgaaggggagaaaaagagagaaagagagaatggaggaagaggggaggaagaagaaagagagaggatgacatatggggcccatatgccaatggcccccacaaatttttatatgtgtgaatgacaaacgggtcccacctatatgtttttaatttagatgccacctaagcgccacgttaacccatagactaggtcaacacagccacgtcagcgccacgtcagcgaaaccatcctccaaaaccaccaaaggagtcaaattacaccggttttaatagttcgggggtcgagatatccggttttgcggtttagggtcatgaattagattcaggtcacttttgagggagtcaaagtgcagttattccgagaaaaggaggaggagagttgggcctgggagagaaaggaagagaggcccaaaatgaacagtgaactttcttattttctcaaggtttgtagaattgaattttgaggatatttgagaggaatttgaatttgaattttgtctatggtttcacaggaatttgaagtgaattctaggccgtgccacgtggctcaatgccagctcaacaaaaatctcggcgccaacattatcggcgctgagacgttatacctcagcgccaaccttgatggcgttgagccgacggcttagttttggttgaagtttttggcaggggctattttcaaaataagtttttataaaggatcaatttgtcaaaaaacggcacggtgccggttctaatatagaatcgacacttgtaagggtgtacctgttttttatttttgttggtgcaaaaaacccgaaaaatatttggtcttattattaggcacatatacggtcacacttcagttcctataagtcacatgattttttcaacacatattcatagatatttgtttaagaaagaaaaaatgcttatcaatgggtgcccgatgcatgaaggaaattgtcagagtcacggataaggtataccctctattcttggatgtacgttgtatactgata

SEQ ID NO: 15052 - DNA, 1501 bp, Oryza sativa
aagcatcctagacttgttactcttggaggttgccgcctcttaaacggcttgtgtaggtgttgcccggtgacctctccgaggagattgtggaggaggcccggcaccgtttgtgagtggtttggagttcaccacctttggagtgaaggaagaactaccccgagtgatcgaggcttgggtagtcctctccgtgggccggctcccgccttgcccaccccttgacgaagggggcgtgcggtggcttcgtggttgggcgggtggagttgggctcacctcaacggggattaggaaaccggcgagtttccgaacctcgatgaaaaattccttgtctcttgtctcatttatttgttgcatttacatttgtgctatttacattcatagagacatatttgagcccatatcacctagtgacggagcgtggggctcctcaccgggagaccgcgcgggcccccctttgccggttcgaccgggggcgctaggtgaggttctaagccctcgatctgtgaaatgtttcgcgagagagcaaatgcgcaagacacgggcgatgtagacaggttcgggccgctgagaagcgtaataccctactcctatgttctggtggatctgtgtatgaaggagttacaaagagctggagagcaagagagttcaaactctagagaccctctcactcctcctctcctctacgagctccgctcttccttttaccagctccctcctccctccttcctcctttttttccccttttttcttaagtgggcaaggtcctccttttatatctcaaggggatcccacatacaccacttctacctactcttcttttgggtggggactcaccctatctcccaaaaaaaactggcttgcgccttcgcctggaagctaaatcacagcttgtctttgagtgaggcctagcgtcatcactcgcctgacaccggggatttccctgctactccctcattaatgggcggagatttgccatggctgctgtccgaatgaccctccgatgggatgggccatacctacctccactccgccggaagcaggcgcaacgtgggagcacggttgtctgccgatgacgtgaccggcgtcagaccagtcacaaaccggtcattcttgtctaccacgcgtcagtttagcatgccacgcgtcagcccttcttcataaaatgacttccttgtaatggttgcgatgaagcctggtatgaatctagccgggactgacgtgctaactccaggagttagcacgccggctccgtctagggacgagtgcctagaggctctcatcattccgacgggacggggcgaggcgtgcaaaaggccgcctgttgccacctaacccgcgatctgaccggtctgtgaccggtcacacactgtgacctgtcacggaccgaacgagtgtgctgcgctgcattaaatgcggcgtgggacgctcgtccaacccgcaataaacgcggttaggtgagcgccgctgtgctcacctaacccacacacgtggcgccaaacccaca

SEQ ID NO: 15053 - DNA, 1501 bp, Oryza sativa
agctgactatacatgcacggttacagactctagtctatcaataccgttacaaatgaagaaactgctggcccccgcgtcgcccgcgcgacagactctggtctatcaatactgttacaaatgaagaaactgttggcccccacgtcgcccgcgcgcgggcgactcggggagcgggcgactcgggggaaaacctagcgcccccaccgccactttctcctcctctctctcccctcgccgccaccagagtgtgctaccagagttccgtgcggccagccgggatggcggcggcgaggccaagactcgatggcgccccgtctctgtgcgtggaaggcgggccggcgcgcgaaggagagtccgatgacgtggggtggaggcagcgcatccgacgcagccgcggccggatctggcttcctcgtgggtggatccgacgcctccacgccggatctggctagagcgagccgctcccgtgcggtgactatgtgaggcggaggtggcggcgtatggcgactcggcggctggcggcagccggcgcaggaggtcggcgcgcacggaagacgcggtggtgactggcagcagaggtagcggtggcgaaggctagcggcggaggccacggtggcggaggttacgatggcgtccggcggcgggcctagtttcccccacccacccacccccctacggccggcggtgaaggctttggcctcgacagcttgtgcaccgtagctggtcccggctggcggtgcaccgatcagcggctcgtggtcagctctgtggtgccggcggcgggctgtggcctcgacgaatgcggtcttcggtgcctgcgaccttgcccagcaacatcttccctcctttgtccttcctcctctttgaggtgctctataactgttgacggagcgtgaggctcctcaccgggagaccgcgcaggcccccctttgccagttcggccgggggccctgggtgagattctaagctcctagtctgtatgtgaaaagttcgcgatcgtggaaacacacaagacacgggcgatgtatacaggttcgggccgctgagaagcgtaataccctactcctgtgttttggtggatctgtgtatgaagaagctacaaaatgccagccagcccccgattaagctcggatcctttttcttcttttttctctcagtgggcaaggtcctccttttatatctcaaggggatcccacatgcaccatctctccctctctttcttttgtgtggggactcatcctctcttccctccaatttgacttctcttcattaacggacggagatttgcatcgccgtcgtccgaatgaccttctgacgggacggcccatacctacctccacttccgccggaagcaggcgcgacgtggaaacatggctgtctgctgatgacatgaccattgtcagaccggtcagaccggtcattcttgtccaccacgtgtcagtttaacaatctgcatgttcgcccttcttcatacaatatcttgcctgtaatggttaggatgaag

SEQ ID NO: 15054 - DNA, 1501 bp, Oryza sativa
agaagctattggccaatgcgctagttatacattagccatatatctatatcgctaacactgttacaaattgtcttgaatctatatttattcatgtccaaattgctgcatgatagccaaactaaattgcatctttcagagccatcgtttcacttattcgcggaataagcgaaacaacatagcgatctaaaatcaaagattgaaaaataaacttcaataaaaaaccgtcaaaattagctccaaatttagggttgaaaactcaaattttggttgataattataaatataagtaaaaagatgaggcgctttttctctcaaagaacctttgccatgtctctctcatgcatattgagcccctgcacatcaacgtagtcatagcacaaattgctactactactacacaactttttcaagacatagcaagtgctcaataatatcctacatagaagcgctgaaatacttttgtatgtgtgttttaccttgctatacaacctatttatgtttcttgaatatttttacataaaacaattactactaacacacttgtaatatggacatgttactatgtagtgaagccacacgtaaacatgatgatggcataattttaattgataattaaacgtctaggtctttcaactagccgatctgggtttgaagtattacccattctaattatttgatattaagtcatttcctaatatttgtcttttaattaccaatcaatcaaacatgaagcagtagcgcagcgttaaacgtgatttgagcaatattgcaaaccaaacaagagtagtgcacgactccaacgcgaggccccgggtccaaatcaaacccgtgccagccgcctccggccccactgccagtctgcaccccaactgggtcgcgcctatctcctcacagatcatccgacggtcctcctctccccaccccaaaacggacggccacgaatccacaacaaccacaaaatcgacccacacccctccatcagcctccacgtgggtcccaccgcattccgtccccacattgtcagtcacccacccgctcgaacccacacgtgagaaagcgattccatccattaactaataatatctttgccccttaaaagaaaacgatacgaaaaaaaacccagagaaacaaaagaggaaaaaaaaagaagcgagaaaaaaaagagatgcttttggcatcatccagcccaccacgcctccacgccgcgctccccccctcctctcaaaagaaacacacgcctctcggatcccgccacgtcatcgatccgcacctcccgatccgagccctcccattggctgcgtatacaacccgcgatccccccacctctcccctgcaccgagtccacggtgcgccccgtgaaccgcctccaatggggaggtaaacacccttgccccgtatatatctctccgtttcaaatcctctcgaaaccaaacaccccggaaaaaaataatttattttttataggagaaaaaaagaggagaaaaaaaagggaagaaagaga

SEQ ID NO: 15055 - DNA, 1501 bp, Oryza sativa
agaagccattggccaatgcgctagttatacattagccatatatctatatcgctaacactgttacaaattgtcttgaatctatatttattcatgtccaaattgctgcatgatagccaaactaaattgcatctttcagagccatcgtttcacttattcgcggaataagcgaaacaacatagcgatctaaaatcaaagattgaaaaataaacttcaataaaaaaccgtcaaaattagctccaaatttagggttgaaaactcaaattttggttgataattataaatataagtaaaaagatgaggcgctttttctctcaaagaacctttgccatgtctctctcatgcatattgagcccctgcacatcaacgtagtcatagcacaaattgctactactactacacaactttttcaagacatagcaagtgctcaataatatcctacatagaagcgctgaaatacttttgtatgtgtgttttaccttgctatacaacctatttatgtttcttgaatatttttacataaaacaattactactaacacacttgtaatatggacatgttactatgtagtgaagccacacgtaaacatgatgatggcataattttaattgataattaaacgtctaggtctttcaactagccgatctgggtttgaagtattacccattctaattatttgatattaagtcatttcctaatatttgtcttttaattaccaatcaatcaaacatgaagcagtagcgcagcgttaaacgtgatttgagcaatattgcaaaccaaacaagagtagtgcacgactccaacgcgaggccccgggtccaaatcaaacccgtgccagccgcctccggccccactgccagtctgcaccccaactgggtcgcgcctatctcctcacagatcatccgacggtcctcctctccccaccccaaaacggacggccacgaatccacaacaaccacaaaatcgacccacacccctccatcagcctccacgtgggtcccaccgcattccgtccccacattgtcagtcacccacccgctcgaacccacacgtgagaaagcgattccatccattaactaataatatctttgccccttaaaagaaaacgatacgaaaaaaaacccagagaaacaaaagaggaaaaaaaaagaagcgagaaaaaaaagagatgcttttggcatcatccagcccaccacgcctccacgccgcgctccccccctcctctcaaaagaaacacacgcctctcggatcccgccacgtcatcgatccgcacctcccgatccgagccctcccattggctgcgtatacaacccgcgatccccccacctctcccctgcaccgagtccacggtgcgccccgtgaaccgcctccaatggggaggtaaacacccttgccccgtatatatctctccgtttcaaatcctctcgaaaccaaacaccccggaaaaaaataatttattttttataggagaaaaaaagaggagaaaaaaaagggaagaaagaga

SEQ ID NO: 15056 - DNA, 1501 bp, Oryza sativa
gaaataaatcacgcgattacagcagcctcggcagtacactactgaggtggacgcgatgatcgttagatcgggcactgaggaatactgtccgttagatttgatgaatgagtaatgtaggtgtaagagtgagttggtgaattatagggtagactacccacctccagtccttcacaatggtaaagtaagtagtaaggggtcttactatccacttgtcatccacattgtggatgccatcagcaaggcaaagacaggcagctgcaaaagccttcaagatgatgttggtcggcataaaacatagttgtgacgaacagagagttcagagctcatccattcttcttttcaagaactgctaatttcatctttccgatttcaaagaatctctccttcatgccgtgtttatttctaaagtttttcttcaaactttcaacttttctatcacatcaaaattttcctacacacacaaactttcaacattttcgtcacatcgttccaatttcaaccaaacttccaattttgatgtgagctaaacacataaagccaattcagcaaatgtgtcctatgtggaaacacaaatacagaggtcatggtttgattcgaagtcgtataaaaccattagtttcttgaacaaattaattttcacaatcatcatgccgacttgaatgtgctctgctcttctatctgcaggacctagtagacatgtgaaccaacatgacccgcagcatcgtacgttgccgtgtcgagtaccgttgtacctctaccaggccaagttgctgtctgaaactctgaatctatgagagtgaacaaacatgaccaaggaaggtccttgcagctcctgttctacctgtcagctgcctaaattaaacatgcatgtactccaacctgcagcatctattatgctacattcgttctaaaatatagcaacatatgagatacgtcctatgtttcatattataaattgttttgacttttttcctaatcaaacttcttcacgtttgactaagttcatataaaaatatagtagcatttttaacacaaaataaatatattatcaagatatattcaatgctagatttaattaaactaatttggtgtttaaaatgttactatttttctataaacttagtaaaacttcataaagtttgatcagaaaaaaaaggtcaaagtgacttataatacaaaacggagtgcattctaataatacgaatttaaacaggcccctgtccagattcatagtattagaatgtatcttattctatactaggctgatatattttaggatggaagaattacattaaacctcatgtgttccccatgatagatggataggctgatgcagtcccccgcgtgtgttctctgtatatacatgcattcctcatgcattcctcttacttgtccaaataaaacataaaagcatataccagcactacatagctaaaccgttactaagcatatactcctcccttctccaattcagccattattcacctatcttctccagcca

SEQ ID NO: 15057 - DNA, 596 bp, Oryza sativa
aaattttcaaaaaaattaacaagatagatcaatatgtaatatatcattccacaaacatgcaagttcaaattcaacttctataagttgtaacaaaaataacaaatttaactgtaaatatacatattaatttgagtcttgtttgttatttttgctacaatttgtacaagttgaattttaacttgcatgtttgtggagtgatatattacatatacatatatatatatatatatatatatatatatatatatattgttcatattttttcaatttttttcataaccatttagatgacatgcaataaacgggtggacgtccactcgagctgttaaaacagtttccctcgtaaaacccgacgccgccggtcaccgggtgagcgtcgttccgggttcgaattcctcctcctcttcgatcggctattatcttgagccctagcctcgatcgctgccgccctcagtccaccgtcggaattcggaaccgcaggaacacatggggaagcccgtccggtccttgccgtcctctagaccccgccggaagaggaccgtcgccgccgtgatgcccaagcgcgctgcctctcgccgtcgtggcggtcctactac

SEQ ID NO: 15058 - DNA, 1501 bp, Oryza sativa
agatcataaatatccttagtcccacgtgccagttttcccatctccctttctccttgtctcttcggcaagccattacgacgcatatagcatcgcaagggagaaaatatgttgctgcctcgtccaccaaccttgaattcaaactctactattgcctccgcaaaactttgcctcctcgagctttgtcgtttgcaacgggacacagctcgagtagaagatggaggaagccgatctcgatagcaaggcggtgtagttgcggaggaagcgaatctcaatgctgcagcgataaagaaggtggagctcgagctcgactacgagcgatgtgatccctgatgctcactgtcgaggtggttcttttttaacttaggggtgatggatatggttatccctaagctcgaatatcctgagctagaggcatcatgatcaatgatgcgccattgacaagatccctgctaagggaggtgtctaagctagagtctactggaatcatttggacaagaagactctcgtatgcaagatgctaggttatgtgtcgtcctagaagccaatactatccgcggtgtcgtattgaggtttaacctagtgctactgtactcattgttgctgcagagtttggcaaaatacagaaaaggaccgaatgccatggagcttcttaaggagacaaaggaatatacccgtcatggcttgccgaaaagattggaagaaataaagaagagagacgagaaaattggcatatggggccatgggtattacttacttttcatacaatttttcttatggacgtggcaacaacaaatagccataatttaactattaaacgtgtttttttctcaagattgacgtttactatattggagctaaaactatataagttacgatgcgctgatgttgtaaaagatattaccatattttataggctgagattagaacatcatgtacattttaatactaaaatttacaaagtttgaccgctcttcaacttcattttaactagacaaaaaaaattcaaacgatactgtggtactacagtaatatatacctactacaaagtataccaagtaccaacacgaatagcaaactcatgtttgcttattgcattgcacgtgccacaagaacaaaagaacaatatcccccatgaggtcgactccgctgtcactgacactgtgggcccaccaggaggcgccggtccggctcggccatcccacccacaccaactcctcctcctcgtattaataccgacccaaacacaaacaccggctcacacgctcgcctcctccctctatccccgactcgaccaccaccgccgccgcgcgccatcgccgtcgaccaccaccacccatggcgttcgcgctcaaggcctcaactgcctccgccgcggcggcgtccacggcctcggcctcggcctcgtccctgtccgtggctgcggccgcgcccgggaggcgcggcggcgcggcggggagggtctcgttccgcggggtccctgctcccatggtggcgatcaggg

SEQ ID NO: 15059 - DNA, 1501 bp, Oryza sativa
taagatgataggaaggattaaaaagaaggttatctagtcggttgcaactaaattctcctattctatatctagaagggcttattcactttgctaccattttcaaccttatcttttttttggcaaagttaaaaaaaagtggttgcatttagtttgttgccaaattttagtacgtacatatgaaatcttgctaaaatttaacaaccttgccaaaattttggcaacattaccaaaatttgacaataccaaaacttggtaaggttgaaaatagtagcaaagtgaacaagcccgaagatattcggaatcatcgagatgtagtatcccagtatttgctagaataaggcttgctatgagatatccggggtaccgtgtacactttgtgtcccagaaaaaactcaatcctagatatgaatatgaacatacgtgcgttcaggttcgtacctaagattggtttttttgggaccgagggagtaccccacaaatacttcatttaaacttgtttaaaaactgaatacaaatccatgttctgatgaaatctcgcaatatatgattggaaaatcgttttaaaatggaaaaaaagaaagcctaatgggccggcccgttaactggcagcgacactacttggcaacgagccacgaccacctcccgcggcttgagcggttgagcccaaatcaactgcattggcgaaaaagaattccccaatttgccgcgatagtcaagcgacgacgacgtgctgaggcgatggatgtggcgtcgtcgctgcctgacgacgtgctcgcggccgtcctccgccgcctcccgccgcgtggcctcgcgcagcgtcccgctgcgcctgcaaggagtggcgccgcgctcgtcgtcgactcccgccgcctcctgcgcgcggacctcctcccgctctcgctgggcggcatcctcctcaactgccacgactcgcggttcacacccagttcctctcccgccccaccacgggcgccgccgtctcctgccgcctcgactacaccgtgccgccgccgccgccgccatgccccccatctaatacgtcaagggccactgcaacggcctcctcctctcctacctccaggcatggggaaaacgagtacctggtgttcgaccccacacttacgcccaactatgagttgttcatagtgcccgatcatgttccttacaagctgcgcgaggaagaagaatgcgaggaatgcgaatggccgccgtggacatatattgatcctacctgtgttttcatccaagactggttcttgggaggagaggaaatttgctctggaaggggaggctgcagggatgttaccaggtcaaatccattttgtgatcatcagtgtggatactggcgaagagcactttatatatgctgctcctattgatttgtcatgaggtagatacgtactaactctccaccccttaattaattaagcatgcattgtgattcagatcatgttattctgttcttttgttgaagaatatcattgtcggacaatacgtatcg

SEQ ID NO: 15060 - DNA, 1501 bp, Oryza sativa
gagtatctgaatcattgcagccgagatagaaaagcaactagctctttcagccatggtcgatgcagcaactcaagatcaatcgtacacgcaatagcagggaaaataaggaaatttaaagtgaagagatatgaattttatttttcagggaacaatctgtgtaccacaaatatcaaaagaatagacaagagtaattaatcttaaaatagtttggaacaagagcattctaatcttctagctgaacttacaaatttagtttttctgggagctcccccaaccagcagggagtgtatgggagagatgatcgtaccagtttgtcgttgtgcatgtatggagcatgatgaataaaaatttttgtaaaaacattgcccaaatccagaagctttgagctactccaattataggctagcactctgtcaaatttatcaccaaagaaaatcatagccctgtctagttcgcgaaaagaaaatttttaactgtcacatcagacgtttaaccagatattagaaggggttttcggacacaaatgaaaaaaaataatttcataactcgcttagaaaccgcgagacgaatttattaagcctaattaatccatcattagcacatatgggttactgtagcacttatggctaatcatggactaattaggcttaaaagattcgtctcgcaatttccatgtaaactgtgcaattaatttttctttttatctatgtttaatgctctatgcatatgtccaaatattcgatgtgatgtttttgggaaaaaaattgagaactaaacaaggcccatatctttgtaaggatgaaatgcaaggaaatagacatagcaatccttgcgcagttgcgcctacttccaggttcaagaacattatcactgtcagagtcccacccgaatttctcaaatttctcttccactattggctcgtcttccacatagtaatcatcatcatcataataaaaaggcttataattataagagtgaataataatgttgtaaggcccaaggtccatcacgttgttgttcatcatagttcagattcagtaggatgtgggaaatgtccatgtcatgcttcaacacccactcggtctgaccacaccgttcattcaggaaaccaaacctgaagttggggcctcagaaatgatggtaataatgcacagtatatccccttgcttgattttcctagataaaattgaccatctcctggatcttccgtgggcgttctaatcactcgatacgtattgtccgacaatgatattcttcaacaaaagaacagaataacatgatctgaatcacaatgcatgcttaattaattaaggggtggagagttagtacgtatctacctcatgacaaatcaataggagcagcatatataaagtgctcttcgccagtatccacactgatgatcacaaaatggatttgacctggtaacatccctgcagcctccccttccagagcaaatttcctctcctcccaagaaccagtcttggatgaaaacacaggtagg

SEQ ID NO: 15061 - DNA, 1501 bp, Oryza sativa
aaatgcatgatggattctgtgaaaattcatcgcaaacatagacacaaaatccaataggacaaccaagcgaaagaggaaaaaaatcatcaccggaagccaccgccaccgtcgtagctgtcaaatccgatgcgggaagccagcgccaccgccacgcgtgtagccatcggcgcagtcggtgccaccaaatctgcggctgccgccgtcgccgtcagattcaacgcgggagtcgtcgctgcaggtggatcgggccgtgggaagtcgctagcaccatcattgccatcggatccaccgcgggaagctgccgccaccgccagactgggccgtgggaagcggccaacaccttcagtgccgccggatctacccgcgggaagccgccgcactgagaggcaccgtcaaaaggggaggggagggggagggggagggggaggaggaggagcggtgccccggtcctgagaggggaggggaggggtagaggcaccgctgggtggggaggtgtcacgcccagagattcgacatcccgaatcaccggctatctgcacatttaacctctgtccaggcatcaaccagagtacacgaacgacaatttgatacagttccacgacttacaaaaatataaaataaactcacaaacgcattggaaaaactaaagactatctaaacttaatcttcacgacaaaagcgtagcttcctccaaatccacaggcaaaacctcgacatctggcacaagcttaatcctcatagaactcaccatctgatatattctctgcttctgggggattgggaaaaataaagcaagactgagtacaaccaccgtactcaacaagtcataccaaggggaaggtatgatgcaatgatatcacgaaggaataggctataggatattttgaatgaaagcaacatttataaatcagaagttgaaagcagtaaaacaatagatataattaagcagcagtattaaccatcatcactatacaacgctaagtccagattgaaacaggcccaaccaaaccacctgaactacaccagttcaataagtcaaattattaaggtgagactaatcacggtgagctggttgactgcccaataaccgcgggcacggctattcgaatagttttactctgataagaggtgtacaactttacccacaagacatgattccacacatgttaccattccccgaagtaccgctacgatactgcaaagggggaaatcgtgacataaccctccatatatcctcctctaaccaacacatccacctccggtttcaccccatccctatataggcgatgggcagtccccgctcgtgcctaggtaaatccgaaagcagcatagaccaatatacagttccatccatactccatcatgcccacccttgccaacggtgtgttagctagaaaagattatacttagatcaaacccggagcccatcaggcttgtggatagtacgagtttatcttctagggattcccgagaaccggtccttaattgtcatgggtgccac

SEQ ID NO: 15062 - DNA, 1501 bp, Oryza sativa
gcaaattatcttatctctatgcttttgattttatccgagtaatatttagcaccttgcattatacactccatccaacgagcccccgggtgataagaattggcccaaaggcaactatccatcaacaaaccaaatggaaagtatagggaaatagagctccataactcgataggcacattttttactcggattatttcgcaagcaatcaagataaaaaaagttgaaaaatatgatataacatctgtagctccggactcactagtcaatggcgaaccagatgatgtagtgaggcagaagtaaaggaaaaatatcatataaaaaacacaattaatgatgacttagcttttttatctccttggtgacggcaaaggtggtcggtgtggagataaaagtgcgcatcaacgacggcggaatccaccatccgtatgggcaaaaacaccaatcaatggcggcgaaggcaggccggcagtgaaaacatagacgcccaacaacggggctgtgagcagccaactgtgtaggcgaggacactagttggcggcggcgaaggcaagccggtggtgaagactagacgctcatcaacggtgttgtgaccaaccaaccgtgaaggcgaggataccagtcggcggcagacgaggtggccattggtgaagacgtagacgcccaacaacagtggtgtgaccaactaaccatataggtgagggtaccagtcggcggcaacaaggcggccggccagtgaagacgcagacgcccaacaacggtggtgtgaccaaccaaccgtgtaggtgaggacaccagtcggcggcggcgaaggcaagctggtggtgaagacgtgaatacccaacaacggtggtgtgaccatccaaccgtgtaggcgaggacaccagtcaacggcggcgaaggaaggccagcggtgaagacgtggacacccaacagcagtggtgtgatcaacctatcatgtaggcgaggtcactagttgacggcggcgaaggcaggcctgcggtgaagacgtggacgcccaacaacagtggtgtgatcaaccaaccgtataggcgaggacaccagtcggcggcaacgaggcggtcggtcagtgaagacggagactcccaacagcggtggtgtgaccaaccaaccatgtaggcgaggacaccagtcggcggcgacgaggcggctagtcggtgaagacgcagacgcccaacaacggtggcgtgaccatcaaaccgtgtaggcgaggacaccagtcgacggcggcgaaggcaggctgacggtgaagacatggacgccaacaatggtggtgtgaccatccaaccgtgtaggcgaggaccaatcaacggcagatgaggtggcgttaaggcgagttgcccattagtagcgctagagtcggccagatcgatctcatcatgcaatgaatccatcgtatatgcaaaaacaaagcaagcatatagattctgttagtaaacatgaaaatatggatgcatatcatatacaggaaaacatctattgcatg

SEQ ID NO: 15063 - DNA, 1501 bp, Oryza sativa
ggattcaatatgctaaagggtgatgcaacttgccttgctcagagagaacggccttccaaaccttcgacgacgaccgcgaaccacactttgggaacctccggaacgacagaagctacgcgaagcacacaagcaaagctacaagcctataaagaagcaataataaaacataaaaagaaagcacagggttctttaggttataacaaacattaggagacttgaacaggtcgattcggagctcgtatgaccaagatatggtcatccgaagtttaatgctgtcacgtggagatttacgaattattgtaattaggctttgcaactataaaacatgtgtaagcgctagcctggaaaagacaggaaggctgcgccgttgacatgcggaccccacatgtcaatctaagggaccacggtggaccgggtacacagagacggtccacgggtcgaaggaagcagaccccgtgtgtcaaccgaggcgagtggccgacaaacggactccaccagacaccacgcgggctgcacacgtggaaaccacgcggctaccgagcgggcacacaaacacggtcaccacacgcacccacgaacactactgacaccggtacacgggtaccggggttgacaaccgcacaacgggcacggggcaacaccgaaaggacgaggacggggcagcgagaggaggcaccgttaccaccacccgaaaaggcgcggcacgacgacgacgaacgggcgcggcggagacggctcggggacgacagaggcaaacgacttcggcggcgatccttggacgaaggcgagacgcggccggcacgaggcttgacgacgcggagccgaggacgaagacgacaatagggctgcagcggctcgcttgacgaaccacaggcggcgaacgcgatcggcttgacggagggacgaacgccacgacgaccgggtacgatgggaggatgacgaccggaaccggtgaggaggcgatgagggcagccggcagcagctgcacggatgcgaggacggcgcggaacacgtcgctgtgatgacgacgatggttgcggcgcagcaagacgacgagcggggcgaccgacgggacatcgacgacgaggacgaacggagacgacgacgatggactgcagaggggtttgaatgaagggaaggcgatcccgaggacgatgtcgccggctcgccgctgcgatgccggaggttgtggtggcgcggccgccagcgcacgggtgaaggaagggccgaccgggaaaattccgtcgaggcggatggagaggccggcgctgcacggcggtgttccggcgaaattctgtaacatacccaaattctagaccttaaaaatttcctatcaaaatagttggaagctaacttttccatttttgagagctaaaaatttccatttttaacctaggtgtggtcaatctaacttgaacctaagtaaaatttgagaacaaattaaaactttttcatttataacctaggacataaatgcaaacacgagtaaaagcatgcatac

SEQ ID NO: 15064 - DNA, 1501 bp, Oryza sativa
ggattcaatatgctaaagggtgatgcaacttgccttgctcagagagaacggccttccaaaccttcgacgacgaccgcgaaccacactttgggaacctccggaacgacagaagctacgcgaagcacacaagcaaagctacaagcctataaagaagcaataataaaacataaaaagaaagcacagggttctttaggttataacaaacattaggagacttgaacaggtcgattcggagctcgtatgaccaagatatggtcatccgaagtttaatgctgtcacgtggagatttacgaattattgtaattaggctttgcaactataaaacatgtgtaagcgctagcctggaaaagacaggaaggctgcgccgttgacatgcggaccccacatgtcaatctaagggaccacggtggaccgggtacacagagacggtccacgggtcgaaggaagcagaccccgtgtgtcaaccgaggcgagtggccgacaaacggactccaccagacaccacgcgggctgcacacgtggaaaccacgcggctaccgagcgggcacacaaacacggtcaccacacgcacccacgaacactactgacaccggtacacgggtaccggggttgacaaccgcacaacgggcacggggcaacaccgaaaggacgaggacggggcagcgagaggaggcaccgttaccaccacccgaaaaggcgcggcacgacgacgacgaacgggcgcggcggagacggctcggggacgacagaggcaaacgacttcggcggcgatccttggacgaaggcgagacgcggccggcacgaggcttgacgacgcggagccgaggacgaagacgacaatagggctgcagcggctcgcttgacgaaccacaggcggcgaacgcgatcggcttgacggagggacgaacgccacgacgaccgggtacgatgggaggatgacgaccggaaccggtgaggaggcgatgagggcagccggcagcagctgcacggatgcgaggacggcgcggaacacgtcgctgtgatgacgacgatggttgcggcgcagcaagacgacgagccgggcgaccgacgggacatcgacgacgaggacgaacggagacgacgacgatggactgcagaggggtttggatggaggggaggcgatgccgaggacgatgtcgccggctcgccgctgcgatgccggaggttgtggtggcgcggccgacagcgcacgggtgaaggaagggccgaccggggaaattccggcgaggcggatggagaggccggcgctgcacggcggtgttccggcgaaattctgtaacatacccaaattctagaccttaaaaatttcctatcaaaatagttggaagctaacttttccatttttgagagctaaaaatttccatttttaacctaggtgtggtcaatctaacttgaacctaagtaaaatttgagaacaaattaaaactttttcatttataacctaggacataaatgcaaacacgagtaaaagcatgcatac

SEQ ID NO: 15065 - DNA, 1501 bp, Oryza sativa
catattgttggatttggctcaatcggctaaccttgtccaactcggactctgccaatcctggtcgtagccgattcgtactttagccgatccttgctctgtttccggaacgatttccatcttgcatcctactccgctcctatcttcatctccgatactcagattaccaaatttggttgttaacaccgccgcacctccgtgcaagctggaccgcgaggacatcgtgccgccctgcacgccgggcccgcgaggccgccacgccgctacgcctcctgcgtgctagccagcgaggccgccgcctcgcctcctgcgctctggctggcgaggccgccgcgtcactgccgccgcttgctcgccggccaccgcgcctccctgtgcatcgctgccgctgcttccttgcacgcactgccctcgatctagggtttttcgatcggggaaatgttgattctcacatgtgattgacttatttactgaaattaggggtacgttggtaattcacaaattaaaatataatttttccctttatttaattcgaaaattttgggcccacctaactaccgtcaaaaccaggggcagatggttgcttcatttcaaaatagtaggggcaaaatcacaaaccctaaaaagtaagggtaaaatcacaattgaactgaaaagtaagggcaagaatacaatttctaaattatttgatttgcattactaaatattaccgtagcgttagcacgggcacattacagatcttttatgtgttttagacggatatcgatttgccacggtgagaaagcaaattcccttggcctatttcaatggacaatacacattgtctcttaattttgagaaaactaactgttttattgactatatctctgaatctgaaaaaaatctcatcggttactgtttcctttataatgctacaatggaatggcaatcttacttattggatattggattccttgcctcactgaaattcaaagaaccgttgttgctgctcgtcagtgtagtcagacttttttttttgagaatattgataaaggatttgaaggtatgttttcagaacattatttacttgcatgatttttcatgtagagatcaactgtggtccactgctgtagaaacaacatgtgttgattaccagtctgttaactctggatatatttggtgttattatcctggacatggacaatttggttagtacaatcaaacaataatttcgtatatttctatggtaagaaggctgaaatgatattatattcgctctttgttcatgtctatctgttatatattgctgcttgtactctattatatttgctcttgctgttttatacagcgtcacctaccaaacaacaacgtttctattagctattatttctaatccaataactgtactatatagaactctattagctactatataaaactctctggacttcgtgccatggttgcttcctatttcaaattcatatgttatctacgcaaatgaccaatatacttgttgagaataaat

SEQ ID NO: 15066 - DNA, 1501 bp, Oryza sativa
aaaatgttgtgaactaaaattggtatttatgcaaattaacctatacacagcttatccttgaatatggccaacatgtagtatgctaggattgtttccgacttgctagtacattaatttgattaatgtactgatttcttgctttcttttacttgtttttgctcagacccctatgcaggtaatgactgtttggatgaggagtttgatgcagcttgtgatgttgcagatttccaggatggttctaactagggatttaacctagtcggtttgcctatgtgcttttgggtagcacgcttaccgcatgaaccaatatttatggcttgtcgccaagtactacttagaaccttattaagactaattatgcttattgcttagaaccacttattatttggatatcatgcttgagatgatttatgtgagactatgttgcattcctaggcgactagtcccacatgaggatgggtttgaaatggttgagataaccggggaatatgcctttgttgagatcgagtctttggggtatgcttttggtcgccaccatcgagtggttgacgggcgtatgacgtagacgactggtgtggctattccaacggttgtgtcttctatttcatatccgatggcttagagcctatgtagtgcactcttcaagacatgttagggtctgcgatgaggttggatggttaccgtatttatttgggctttatttgagaccccatccatccagatatttcgcgctgacatgccttggagcgttgcaccacctaggctttgggtcgtcctcacactaatgaagacaaactttatatcaaacttgtagccctcgacacgatctacaacttataaagttgatttttttttattttaagtcattttttgtcccaaaatgtaattttaaaatttaaatttcaaaatctataaacatgcaacaatattttgggaccctaaacagttttaattcaaaaacttttcaactagaaatttataggtcgtgtcgcgggctacaattttaatataaagtttgtcttcattagagttcacataaaaaagttatgaattattttttaatacaaaatttttagaccgtcctgtttagggaccagggtgacacaactaaacaagttggaggacctagatgagtgatatgaaagtttagggactgggatgacacaattgaacaagtttgaggacctgaacggtcgatttgcgagtttagggaccaggatgacacaacggtataagtttagggaccggtgatagactttactctttgggattctcaattccacttagaaaacatttcaagcagaagatgtcaccacgtggtgtctgtagaatattactacaacaaaaatatcttgtagaaatatttttctaatactacagaagcatttttcaaatgtctttacaatactatagtggtattttcaaaagtgcctcattagtgccttgtagtgaattttctataccaatgaagacataatgtgctcaacttaacttttttttt

SEQ ID NO: 15067 - DNA, 1501 bp, Oryza sativa
acgggtacaccatcgcttcattccataatccttgtctaactccaccaaccgttctcggataatcgataaggtgcaaagtctgcgacaaagccctgaaatctgacttgactgttctgatgtctgactttcctgaaatcagtagtcagaacatttgtcgtactcgcttagtcgttcccggtgtagaatcgtagagacatggagtcctcgataacgctgaatggaactttcctgaaatcaatactcataacagaatattaaatagaaatagcccctgagcaaacgctcaagggtaacatgctataatatgtatggaaaaattaaaaataagttgaatttgcgtgtgacaataaaagagtatactctctagagtcccttagcaaacggagttcggtactcctcctagcccctagctgtttttatggaaaaagccattttccacaaaggcagtttaaatcttataacaaaccagcccccagccgtgaagttgagaaaaccaattcccgattacacggcttagttaatatgcatccagtgagcactctaacatgaccagatctgacatggtcgtttggctttgcagtatctaacaaagccttatcagctctgggcgttcctagccgaaatccccttaggtttttcggaggctttgttagaatagtgtaaagggacgataggacagacttcaagacgaggcaatacaagaaaaggagatcaacggacaaatattgcacatataaacacttacagaaattggcgtagatgatgagatgaccaccacattgggcaaagaccaggtgtatagttgtactcaacaaatcgctgagttagtaggagaatcgctacaccactagtcgaagaccaattatagtcataactcgaccactggagtttaaggtgcgagagatcgctacggcctaatggttgacaaccaggagtaggcgtctctcaaccatttgaagtcgaggtacgagaagatcgctactacctattggttgagaaccaagattaggtatctctcaaccttttgaagtcaaggtacgagagatcgctacgacctactggttgagaactaggagtaggtatctcttgatcgtttgaagtcgaggcacgagagatcgctacgacctattggttgagaaccaggagtaggtatctctcgaccatttgaagtcaaggtacgagagatcgctacgacctactggtttgacaaccaggagtaggcatctcttgatcacctgaaggcaactgataggcggcgagatgtcgctacaactgtctagtcgataaccaggagtaggcatctctcaatcacctatagggatgctagagttggttattacatgtgcatctcatgtggccagcatgactcacatacccaacttatagcatatctgaatgtctgttcgtaatcatgccgggtgatcaagccgacaacatttacgaggaattatccgttaacaacctattcccaaatagtccagccatagccggtgctatatat

SEQ ID NO: 15068 - DNA, 1501 bp, Oryza sativa
aaacacaaaaccgatggtcccgcgggacgaaagcgtgggaccgcgatagtcccacagcttgaaactgcggaaccacgatgacatcgaattttttaccgcgtcggcactgttcaatcactgtttgtacactgttttgtactgttcatacgacggttctgcgtaaccacaacgcgggatcgtcgctcaaacagtgccaaacagtatgaagccgtgtcaaacagtgtgaaaacagtgcctgcacagtctcaaaaatcgctaggcagcacggtgcacgcgggacccgcattttagcggtgcggtaccacgacggtcctccgcaaccgccgccgccacgatggctggatccgccgcctccgccgccaccgatgacaacaaggaggcggtagggagtggcgccgccctccccacgtgcggcggccgcggatttggtggtaggggatgtgggtggcggcagattcggcgatggcgatggtgacggcgacaacggcttctagggtttgggttcggattttttgattttattttttttgggatttttattttacgtgcaggtgatataagcacccgcacgtggaaatcagatttttccgtgcggtccacttaacctgaccacacggaaagatgtattttttcatgtggttgatcgcccgcatggaaaaatatttattttcccagacacctgatgcagacgggtaagatctctgtagaaaaaacactttttgaacccacggaaaaatgcttttcgtagttgtgttttacgctagtcgccatgggatgcaacgaaccaggtaagcagccaacagttaggctgtgtgtgaggggaaggctgttttctccgataattccaaaaattggtggctagtggccccatctttttgacacacgacgggcaaagaatttgcatggaaagaagcaacaatattactgcatcagcacatatcttcgcgcctcattaaactttagtagcaccttaaatcctgggtttgatttttatgggagagaattttttagattttaacggttttgtgcttttagtggcatgtgatgcacccgtccacaacgagacgtctgtagtaacttcgtcagtctttaggatttatcagctcagtcttcaaagatgctcgtaggagtagggtttacgtgcgtgcgtttataggggtgagtgtacgtatgttgtgagtgtctgtgttgtactttataattattttaaaaaagcatatatcttcaagcggaacaatgtcatcagccatcagccacttgcctttctgtttctggtcaaccaaagtggccgccataagctagctctagctatagcatacttgaccaagagttatggagtatatagctgacatacatcctgacaaaagcaagagcatacatggatgcagggtcggataaagaaaacaattagggagagacatattttttaatcatagaatttattcccatcttttctttaaaaggctataatcaatcattatagagattacatggacaatga

SEQ ID NO: 15069 - DNA, 1501 bp, Oryza sativa
tttccatgcgggcgatcaaccacatgaaaaaatacatctttccgtgtggtcaggttaagtggaccgcacggaaaaatctgatttccacgtgcgggtgcttatatcacctgcacgtaaaataaaaatcccaaaaaaaataaaatcaaaaaatccgaacccaaaccctagaagccgttgtcgccgtcaccatcgccatcgccgaatctgccgccacccacatcccctaccaccaaatccgcggccgccgcacgtggggagggcggcgccactccctaccgcctccttgttgtcatcggtggcggcggaggcggcggatccagccatcgtggcggcggcggttgcggaggaccgtcgtggtaccgcaccgctaaaatgcgggtcccgcgtgcaccgtgctgcctagcgatttttgagactgtgcaggcactgttttcacactgtttgacacggcttcatactgtttggcactgtttgagcgacgatcccgcgttgtggttacgcagaaccgtcgtatgaacagtacaaaacagtgtacaaacagtgattgaacagtgccgacgcggtaaaaaattcgatgtcatcgtggttccgcagtttcaagctgtgggactatcgcggtcccacgctttcgtcccgcgggaccatcggttttgtgttttggatctgcgggactgtcgcgattccgcgttttcgttccgtgggacggatatatttttatatgtatgtatataaatgtaaattattaagaataagtatatttgcaatttttttcccaatccctctcacctttcaagtgccagccacgccgtgctgaacgcgatgagcagcagctggggcaatcgcggtccgacgtgtcattgagggtgggaggcgaagcgaactaccccatgccgatgaggacaaattgtgggcttaaagaagacttttaaggctctgaaatgatagtcactttttatttttaataaacctggtttcaagagaatttttaggggaaactagttttacattccttattcagttagcatgcgttttgagaatttgtagtgtattggcaaatatttgggcggcatgttttgcacagctcgctgagctgcttccaaacgatatttttacagaggagtgattgttgggctctaggctgattcggtgaagtgattttcggagctagtaaaaagaagtggcttctgctgattaacctagtgaatcactttcagtcgcagaaacgctcctttcagaaaatcagaagcaggaggaggagctttacgtaccaaactcaaactgacccaaagtgtgtactggcagcagtggcggaggcagctgcccgggctccatgccatcgcaacacacattgctccacagcataaacatcatttactcattaattgcttacataattaccttgcttcctggttccaaggaaggttaattagatgactagcgagttgtaccacatcctaatcttgctttcctgatgtatagtagccccgtactctaactcctt

SEQ ID NO: 15070 - DNA, 1501 bp, Oryza sativa; identical to SEQ ID NO: 15068

SEQ ID NO: 15071 - DNA, 1501 bp, Oryza sativa; identical to SEQ ID NO: 15069

SEQ ID NO: 15072 - DNA, 1501 bp, Oryza sativa
ggatttaggaattagggccggtttgcttggtgtccacacacctcactttgccagatgtgttgcattgccacacaaaatgcaatttgataaaaactaacgaagtttggcaatccacaattataccgaccaactaagcactaggctaacaaattgtgtcatgcagcgtgcctaaggtttggcattgcaacctttggctgccaaccaaacaggccaaggccattaactcgtacctttggcattgcctaaggagtacttgttagtgtttactttaattatgattatcttccatccgaaactgggaaatgtaggaaaggagaaatggctgcaaaatgattatcaacacaataaagggatctatttactttttttttcctgttctgttccttaattcagccattatgaattagtgttggcaataatattagggttaattgaatccatgccattataaattcatcagttttgatatatgccactactattcaactatttagagccatgcctttataattttttaggtattggaaatataccactacatacccttttgatgcgtttactaaaatttttagaacaaattaccctcatcttcttccttggtctccttccatctctcctgttcattttcttcctctcaattcttgatgcgggttcagtgcaaggggttgccaatcgggacaggctggctcgagtcagctgtgccaaagatcgttcatcttcttcctatcccatttcttgcacatggttggtttcctgcagctggaggatgtactgatagttagttgctttctgctcgacaagaaggtagtggaatggaatttgggatgtttgaccaactcaattaggcacataaaaaagatgttcagtttgagattatactacaacaaaaatatagagtttggaaaatctaaccgctgtactactttactgaagatagagttcacagttcctcccttctaaaatatgcttttgaaaagagcattgaaaaaaactcaatcaaacttgccttttagctgcctgagtcacttaatatgttgtattcagtacttcagtttccagacaatatcctataaagcaatttcatatatagaaatgggtgcgtagcaccatgaaatggaagtccgacaggttcgattgcttgtttagtttcagttactatgattagcacacgatattaaaaagctggtagctgctgttttaccttttcattagttttcacgtcaacaatcatatatcgtgttgagctgacctgtttttttttttttttttttactttgtttgagtgttctgtaaatttaagatccagacgtactgaatttttctccttgcaacatctccacatcatactgtgatgcttgagtttgaagttactaagattagtaattacttccaaaattttcattaaagcaccgcttaactgcttctatgatttacattcctgtagatccattattttattatctcagatttcacttattataccaatatttacctgtttagg

SEQ ID NO: 15073 - DNA, 1501 bp, Oryza sativa
cttcattgtggagattggttttatggtggcaaaatctaaacgagaatcctcatgctcagtagcttgatttgaagagaaaaaatcggcctccttgctactgctgcatgcatgcaaaatgagtaccaactagtttctttttcttttttctcatcactttaaattttttttctcctagactgcttatatccgatttacgatccgatcgtaccattgaatttgttgcgattaaatctttacaataagatatcacatgattatattttgataaaaaaaatatatatggttcagaccgttaaaatttaatgtttcatatgtgatagcgacatatttcaaagtgtgaattcactgtgtttcacaaaatttatttaactccttgcccctactctctaaccatgcatgcatgtatttagcaaccttcaaaatgatttttttcccataaactacttatctaatctacgatccgatagcactgttgtatttgttataattaaaacttcacaacaagatagcactgttgtatttgttataattaaaacttcacaacaagatagcactgttgtatttgttataattaaaacttcacaacaacatatgtttcagtccgttaatactcaatatttcataagcgatagtaacatgtttcaccgtgtttcacaaattttttaaatgctccagtgactgattatttttgttttaccatatataacttaatgtttcactggtggtcaaccgtaacttttgaccaaccgattttctttagaggatcgggcgccgatttggaggtaagtccaaatctaacggccgtagacacattgccatataaccatgagatgttgtggtagatacggcccattcttccactaaggtaactatagggtcatatgaatggagagattaggattgattaaatcatgctccattactatacccagacctcaacaattgaatagttcattcatcttaagaaaaaaaaaggaaattgaatagttcttaacaaatcctgaacatttgaatataataacattcagctcaaaacgtcttacttataatctgaacgagaactaccagcaaacaaattgcatccgtagcatttgattccttcaattatgaaatgttgcagattgaaacaaggaaatcatttgatctttcttttagatacttcaacattcaaaagaaacaacttgcagattgaaaacgagaaaaagaaaacatttgagctcccttttagatggtgcggcttgcagtacgagagatttccaggtaccataaacataatgagtgcgcctctcttttcttccattaatccgatctgaagattgtgactcaccttttgcacattacagctgcactgctgtggctgattttgccatgtactagcgattgccaatagaacagttgttatggatccaaaactcacctaggatcccattgaaacgtaagaaaagaaaacaagaaacacattgcgtttgggcattacagtacgaaaatttgaagaacgcat

SEQ ID NO: 15074 - DNA, 879 bp, Oryza sativa
ttatattattcacaaaaatcacatttctctcatctgggttatgaacatcaacacatatatgtcaattttgtaaacattggtactatcactttatcggatgaagaagtgaccaaaataaaagttgtagatcttgatatgttgtacaactttgctatttatggctttcccatttgaaatcagttagtatttacaaatgctgtttacatttgtcatattgtcaaaatcaatttcaagctgttggaaacaaagttatatagacaaatgaccaaaagaaaagttgtagatcttgatgagaggatcaactttgttgttgaccatattaccatttgaaataatttagtatttacaaatgttgtttagatttgaaattttatcaaaaacaattttaagctgttggaaacaaagttatgtacacaaatgaccaagataaaagttgtagatcttggtaatctctacaattttgttgttcaccatatttcgatttgaaatcatttagtatctgaaaatatattatgactaataaaatgaattattatacagcagctatatattttgtacgcataaatataaagacttgtttggaaaaatggaaaaataatcatcggtgacgggccttagttaaagcccgatagagattaatctatctctatcgggcattatcttagggcccgtcacagatgagtcatccgtgacgggcctaaatgtcatctcaatcaggcattagtatggagcccgtcaccgatgagtcatctgtgacgggccctacggcaaagcccgatagagatgactcatcactctactataactagggtttctcagatcggatcgaaaattttttctaagtcccgctacagtttcccgcctccttagaaccctagc

SEQ ID NO: 15075 - DNA, 1501 bp, Oryza sativa
atttaaataaaacggacgataaaaattagacgcaaaaacttataactgcacttgaagacaggggagtaccggagtgccatttaaaattgggaaaacggaaaagtgaaatattgagctgaatttccgggcgctggggagtaggggggtcaaaagagtcatttccgcgtatttctcgcccgttcgccatctcttgtcgtgtagtaccgccgaaaaggaatttccctttccgcccctgcgctgtgcgctccactccactacttgagtcccccatccccagactccgccaccaccacctccggctccccaccccgaccagcggcgccagagcagaggcagtgaggccgagctcctcgcctcgcctcgccgtctccgcccgcgcggcgctgccgccgagccgccgccggcctcctcctcctcctccttcccggttcggatcgggcccaaggtatatgccactcgtcttctctccctcctccccgccgcttcatgagccaccggagattgccttgaggggatttcttcccgctcggatcgacggatccagtcccgtttcttccgggttcttgcggtgtagagtcgtagtcgtagtggtagtgttggtagcggcttgtttttcgagggagggatttgggggggtttggttggttcgggttcttggggagggtttagctgaacccgtgaggtttctgaggtccccgcctgaacagatctgtggtgtctccgtgtgggagcatgttttgctgcgtgcgtgcgtgcgtgcatgctagccatggattggtgctcacgccgcatgcgtgagctttggggggggggggggggttcagttgttgttggattatgtgagcgagaacgcatgatacgatgcaatgccgcggtcctttttgttgtgatgggcagcctcacagcatgcgtgctgcggcattcacatggacgtcgacaccgtgtcgattctttttgtgtctcttgttgtgttgtgaaatttttcatgaatggtgcaaggtggcggttggtcttggatgtggatgttgagctgggaggatcagttatcctacaaattgcatcttagtagtacatatgttgacatggcattactgattcaccctcctttttttgcttctgcatgtcattgccctgttaccccttaaaataggttctattatggtatacctatccagtgtgcaagaatgatatgcctttgacattgttgcgtcatctttacttggtactttagatggtaaaatggaagtgtgatggatgtaactgtgtcaatacagcggagaagatattaatcaataatcatgtacatttgttgtttttggcatcttctcatgtaaaatcttttgggtctgttcttgttatgtgcttcactttcacttttactgttttttttttaattttcaagaaacatacagcttcagtgtggtgattgataaaaatcattactctaactaattctgttttctcctcgaactgttctgttcctagagccggactgcagcca

SEQ ID NO: 15076 - DNA, 1501 bp, Oryza sativa
ggaaacaaggaagcaaagctataattttatacattggagattaagcatatgtatatccaacggttggattccaacctcgaataggtaacgcatgtttggctgcatgattaatatagcagcaaagctttgatcaaagcaacaaataataagactgaatctttaagttgagatgcaaacttgatgcgcatgtatatatggatattgtagtttgatagattatataaatattgcagctagctagcttgtaccctgaaatttctttatctaagtaccctaaatttttggactgaaagcaaagcagaagcagtaagcacacggccatcgtctatatattatggtaggaaagaattaaagtgagaaatgcatgaaagagaattaaagacgctaatcccaggtcccaacctatcttaagatatatacatgattccaaactagcaaactaaactgatcgatcagtaaacaggtcgctgctaaagcaataaacgagtggagctagagaagaagtaatgaagtgaatgagaaggtgatcgacctgcggcctgagggagagaagaggcgtgccgtggccatccatgagcagcaggtcgccggcgaaagctttgcggcggcgggagtagttgtcgacgcggaaggcgagcttgccggcggagtcgtagacggagaagccatcggtgccctggaagcctatgctggacctcttccacaccgtgtacaccaccggctgatctgccgcctgacgacgtgcacggccgccggtgccgccgccaccgccatgagaggggtgtatctgtatccttctcatgctagctatagcttgatgaggctggtggaagtaattaactaagtttgagagggagggaggaagctataggctatagcttatgttacctaggggaagcacaagctagcaaagcaagatttagttgggccaattagatagctaatcggtcgatcgatgggcgatgcaacgtatggacgtacgtggttgcctagctttgcctgcactgcagtctgcagattgggttaattattaatgcaagagagtgagagcagctgaaatgggccggcgaaaaggacatgcagcttaatttgctactagctaggaacgaatagaagtgaaggtgtagacaaacagtgcagggcacgttggattgggatttggcttagcgtgagggagctggcatgcatgcatcgccctacttattattcacaaagcagaagatcgcagggtgaccaggtcaattcagagtggaaatcagatagagaaagtgacaaaattaatgggcctgatttgaatagtagtagtatttctgatgggctttctttgcttctactgtgggagggagagcccatcaagatcattgacttgacttgacccggccccacagtcccacaaccattgaccatttgacccaacgcaactcaactgcttcttcctcttttccatctccatcgccgtcgccgtccaggaagagatagaagatggatacggtcgcgggaa

SEQ ID NO: 15077 - DNA, 1501 bp, Oryza sativa
gctcggcgctgttcctccgtttcgttgtcagccatgaatacaccgaagaagaggggcgtgtagttatcctcatagctgtcgtcgaagttgtcgaggtcgtcgtggtcgtcgtagtcgaggatctcggttggtcgagaactgacgccgggggagctgaggtagccatccaaatcttccgtcgagactgtcccaagaagttggagtataacgccaacctccctggatctagactggatcagggccgatgccggagctcgcctagatctctgagtgggagatgttttgactgtgaagacggcgtccaagtcatcaggaagtttcatcaagattgaaggataggacccgtcgtcttgatctggtcgcggaggagtagattggatctcgtccgagtggtttgaagccgactcggaagatatgatcttggagtaggcctcggccgagttcggaataccgaacggcacggggacctggtctctccctgactggttcgaatccgagtcaaggagagagatcttgctgaagtcgttggtgatgaagttgaggctgccgaaccggaacgcctgcccgggagggaaggcgaagtcgtcgatgccagaaatggaacccatcgcacttagtcggcaaaaacttgacgctgcccctacctggcgcgccaactgtcgaaacaagatttcggcaataataaaagggggtggctatcaagctaggaaagtggatgggtttggagacaaggaattttatacaggttcaggccttcttattcaagaagtaataccctactcctgtccggggatgattccgccgagtatgttattgattgtatatattggaaaaaagaattgcgccccgagaggcacacggaccctccttatataggggaaggagtccgctttacaaaatacagtccatatcctaacggaatatgggattatagataaaatacaatcctaaccgactaagatctcgggtatttccttgacatacaagtaaaaaacaaacccgagtcttcataaagatattctatctatatttggtaccgtatatccgactaaattataactgtcatgtagatatgggatatccatattctccacatggagtgtactgggtgcgtccgtgtcgaaaattcactctgtgattcgcgcagcgaacttttgtcacttaatgccaatattggcctatattagcatacatgggtgcgatgaattttagcggaataaaaaagttcagaaagcaccaaaacatgtttttggacatactgtagagaattgggtgcgtccgtgtcgaaaaatcactccgtgactcgcgcggcaaagttttgtcaattaatgccaatattggcctatgttggcacacgtgggtgcggagttttacaccggaaagaataacttcaaaaagcaccaaaacatgatttttggacatattggaatatgctgggtgagtccgtgtcgaaaaatcactccgtgactcgcgcggcgaacttttgtcaattaatgccaat

SEQ ID NO: 15078 - DNA, 1501 bp, Oryza sativa
acgtgtgccaatataggccaatagtggcactaattgacaaaagttcgccacgcgagtcacggagtgatttttcgacacggactaacccaacatactccaatatgtccaaaaaatcacgttttcgtgctttttcaagtttttcattccggtgaaaaacatcgcacccacgtgtccaacataggccaatattggtattagttgacaaaacttcgccgcgtgagtcatggagtaatttttcgacacggacacacccaattatctacagtatgtccaaaaacatgtttgtgtgctttctgaactttttcattccggtgaaaaacatcgcacccacgtgtgccaatataggccaatattggcgttatttgacaaaagttcgtcgcgcgagtcacggagcgatttttcaacaccaactcacccaacatactcaaatatgtccaaagatattggcattagttgataaaagttcgccgcgcgagtcacaaattaatttttctacacggacgcacccaatatactccaataagtccaaaaatcatgttttggtgctttttgaagtttttcattccggtgaaaaacattgcacctacgtgtgccaatatatatctatattggcattaattgacaaaagttcgccgcgcgagtcacggagtgatttttcgacacggactcacccagcatattccaatatgtccaaaaatcatgttttggtgctttttgaagttattctttccggtgtaaaactccgcacccacgtgtgccaacataggccaatattggcattaattgacaaaactttgccgcgcgagtcacggagtgatttttcgacacggacgcacccaattctctacagtatgtccaaaaacatgttttggtgctttctgaacttttttattccgctaaaattcatcgcacccatgtatgctaatataggccaatattggcattaagtgacaaaagttcgctgcgcgaatcacagagtgaattttcgacacggacgcacccagtacactccatgtggagaatatggatatcccatatctacatgacagttataatttagtcggatatacggtaccaaatatagatagaatatctttatgaagactcgggtttgttttttacttgtatgtcaaggaaatacccgagatcttagtcggttaggattgtattttatctataatcccatattccgttaggatatggactgtattttgtaaagcggactccttcccctatataaggagggtccgtgtgcctctcggggcgcaattcttttttccaatatatacaatcaataacatactcggcggaatcatccccggacaggagtagggtattacttcttgaataagaaggcctgaacctgtataaaattccttgtctccaaacccatccactttcctagcttgatagccacccccttttattattgccgaaatcttgtttcgacagttggcgcgccaggtaggggcagcgtcaagtttttgccgactaagtgcga

SEQ ID NO: 15079 - DNA, 324 bp, Oryza sativa
atgccaatattgcatatatattggcacacgtgggtgcaatgtttttcaccggaatgaaaaacttcaaaaagcaccaaaacatgatttttggacatattggagtttgttgggtgattccgtgtcgaaaaatcactccgtgactcgcgcggcgaacttttgtcaagtaatgtcaatattggcccgtgttggcacacgtgggtgcgatatttttcaccggaataaaaaacttcaaaaagcaccaaaacatgatttttggacttattggagtatgttgggtgagtccgtgtcggaaaatcactccgtgactcgcgcggcgaacttttg

SEQ ID NO: 15080 - DNA, 1501 bp, Oryza sativa
gtcccttttctgttcctataaggagctgccttctctccatctatagttataggaatgtgagtgccatcaatagcccctatgcaattctgcagcaaaaagggaagaaaaggacagaatatgcatgagttatttaattggagaaggaatagatattcatttctattttgagtgccagattcaccttgaagtaaggaaagaagcgaggatttgttctaatcttccaatgcgtttggttggcatgaggaagcttgagaaatctataggtgagagctgggattatcttgaaaatagacttaatatgccgatgaagtgtagacccactatgcttgaattcatactgtagatcttgaaagcttgcattgtgagcgagcatgaacataaatatcccaagtttctcctcaatcctcaagcctctactatcctttaacaacttttcctctctaagataattcgctattgtcttgaaaacatgaggctccatgcggaatgcaactttacaatccattacatgtccttcaaggatttcttgaagccgctctttaccggatagtcttgagatatgtctaggtattttctcactatttgtcgtaccgcacagcatatacatcgcaggaaaaataaaaagcatcatatcatcgtcctcttctctcctccttttaatttcatccgccattctcgaactgattttatcactaaaagagatatagaattactatactttaaactatgtgtgagaacataataatatgcatatgtattacaagattattaaacatgaaattagaggcattcaaggtggctacatgcataaatacttttaatactttcagcaaataaacagtctgcaatgggaggagggggatcaataatgtgttcagattttaatactttgtgtacttagttttgtttaaacctcagagatagcaactttaataaagtgaggatatccttctagggtaggatgtttacttgaaaataacaacctcctgttcactagcaaaaaaaactgagaccatctgccacctgagcaagatcacataacattgtacctacaatctctctctctctccaacttcaaattacttctgttactctagtaaatatgcaggggcaagattaaatgcttcatatcaggcaaatgtaagtacaactgtatttagttttttctcaaataccttgagtaatatcaactccttcagctttacttttgccaaccccacacgcctgtgcctctcctgaaatttaattcagcacaacagattatatttttgtcattcaatagcaatttatatagctttgtatggtatgacctctagtaatatatctgatcacccagtttcctgaaactagttgtgaacatagtagcagttcagaatagataaatatgctaaattgattgctaagagtaaaataggtattcgaacaaaagatggacagctacatttctcaagttttaacaagggcattttgctaaacaaaaagccatggaaaaaattaccaa

SEQ ID NO: 15081 - DNA, 1501 bp, Oryza sativa
acacctaaaaaataaaaactagtgcactctgttgttgctgtctagaatgcatcactttgcttttggccaaggtcatttgagcttcagattgaacgaccaatactatatgccaattgaatgagcaagaagatacaaaaatttgagcaagaagatacaaaaatttttaaagtcatgctatgaggtggtcaggtggacactgtagtatacattctagttttggtaattttttccatggctttttgtttagcaaaatgcccttgttaaaacttgagaaatgtagctgtccatcttttgttcgaatacctattttactcttagcaatcaatttagcatatttatctattctgaactgctactatgttcacaactagtttcaggaaactgggtgatcagatatattactagaggtcataccatacaaagctatataaattgctattgaatgacaaaaatataatctgttgtgctgaattaaatttcaggagaggcacaggcgtgtggggttggcaaaagtaaagctgaaggagttgatattactcaaggtatttgagaaaaaactaaatacagttgtacttacatttgcctgatatgaagcatttaatcttgcccctgcatatttactagagtaacagaagtaatttgaagttggagagagagagagattgtaggtacaatgttatgtgatcttgctcaggtggcagatggtctcagttttttttgctagtgaacaggaggttgttattttcaagtaaacatcctaccctagaaggatatcctcactttattaaagttgctatctctgaggtttaaacaaaactaagtacacaaagtattaaaatctgaacacattattgatccccctcctcccattgcagactgtttatttgctgaaagtattaaaagtatttatgcatgtagccaccttgaatgcctctaatttcatgtttaataatcttgtaatacatatgcatattattatgttctcacacatagtttaaagtatagtaattctatatctcttttagtgataaaatcagttcgagaatggcggatgaaattaaaaggaggagagaagaggacgatgatatgatgctttttatttttcctgcgatgtatatgctgtgcggtacgacaaatagtgagaaaatacctagacatatctcaagactatccggtaaagagcggcttcaagaaatccttgaaggacatgtaatggattgtaaagttgcattccgcatggagcctcatgttttcaagacaatagcgaattatcttagagaggaaaagttgttaaaggatagtagaggcttgaggattgaggagaaacttgggatatttatgttcatgctcgctcacaatgcaagctttcaagatctacagtatgaattcaagcatagtgggtctacacttcatcggcatattaagtctattttcaagataatcccagctctcacctatagatttctcaagcttcctcatgccaaccaaacgcattggaaga

SEQ ID NO: 15082 - DNA, 1501 bp, Oryza sativa
gaaatctcacagtgaatttcatcttaactaaactatataacaataataagattaaaataaacttcacccgttgtaaagtacgggtattttttctagtatggataaaattaaaggtggtaattacctcttctataaaatttgctccaagtcctctagtaagccggccgggctgcaggactgtagttagccttgatatgccataattgtgttttacgaattgttacaagctttggctgtttgcgtgaatatgtttctttcaacgggttcacgttccaatcttatctaataaaccgatttcagggttagaactctagttcttgattgggacaggtggcaccaatcttagaacaccgatcgaattcttggctggagaagcgcaccacgtatcccacccctccagcagcggtacgatagcatatcgacggtgaaaaagacgtcttgcggacttaaatgtatattgaaacttttaagaggtcttttttacaaaatgcgtgatctcatctagaacagcccggaagtagaccaaaatatcctctgagaaaaaaaagaatctaataaaaaaatcaacaagcggttagccccatcacgtggcctaattccatatatagttttgtcactacgcatagccatttgattaaaaatctggcaaaaaaaaaaaaactgcccccattgcaagctttgagtctttgttcgaattgaagataaatctggaattaatacaaatgaaaagatccgaaaatgtggtgcggattgtaaagaaaataaggataaaaataaaaaagccaatcctgcccacgagccgctgccatctcccctcccacaagacgctatcgtcaaccaccggattcgtccgtcactcaccgtgagatggtgctgtcctgctggccgtcaaatccgaggaagtcgacgcggagcttcgctgcaggaggtgaaggtggagaatattagagagaaatgagcagctcaacatctgcctgcatgcctgtgggcagcggggagaaaagaagcaaaggaaaggaagaagaaaggtagaagaatgacagcgtcttctctctgtccgcccgtgaggccgtgacgacagaaaaaaaaagaggaaattaggaagagcggtgaaaaatgcatcaggaggactgagtagaggtggccaaacgggccgggccaaaacgggcggcccgaggcacggcggaacctgtagccggcacggcccggcacggcctgctacagtaacgggccgtgccggcacagcacgagtagccgtgccgtgcttgggccgccggccgagcccgcgggccggcacggcacggcacggctactgtagtaagtccgcatctcatccttccgcaagtccgtatctcatccctcccaactgacggcccagcccgctagccgcctccgcaagtccgttgagcacccctcctagctgatggcccagcccgccagccaccttcgcaagtacgcatcgcatccctccgcgccatttcggtttctgggccaaccgtgc

SEQ ID NO: 15083 - DNA, 1501 bp, Oryza sativa
caagatctgtttttctgtacagaacaaattccagaatgatcatcacaaaaatcttgaaacaaagtcaggttcattctggtagttctaataattattccacacatacaaaaccttatgaaatgttcaatgtttgttgaggaaaaagtattcaattagctccttgttcatactgtaacctgattctagcatccataacatacccaaacaagggtttagaagggaaacaaattctggtgtaatacaagagttattttggggccccaataaattaccagtggaaacaatctgtaggtgcaaaagatcaccaaacatccaagcaggcaagatcaaaggtaagcatttcagatcttagggcgaggagattgagatgtaccttcatggcgagcatgaactcgcggcagtggccagcgacgccctcggtgcggggcccagtggcgttccccagctcctccatgaccgtcccggccagattcaccgcccggactatcatctgcacgcgcaaatccccccctcgccgcatcaagatcaagatccagtgaaaccccccacaagaagacggtccagggaacaaccaaagggaggggaaatctcgaggggagaaatggattgattacctgctcgacgtggttgagccgctgcagcgagctgctctggctctgcgggagcatcgccgccgccgtcgacgaggaggacgagggagtagggttttgggtttcgccggagttggaagcttcgagaggatggctaagctggtatatagggtccttcgatgtatatgggcctcgcgtttgtttcggcctgtttacctttctccttatccttggattactttcaggtttcagaccgtttgttattattaataagatttatgttcaaattattttgatatttttgaactttttaaaatatgattttaagatgaaatgctcaaaattttaatttttttatatggttttcaaagtgatttttaattttgcaagcatttggattaatatgatatgttacaaatttatttttttaaaatatagtttttaagtgatttttttattttacaaggatttggatgcgggtctcgagcttgtggcatggctaaaatgtttatttatacattctaaatgaaaagctacatggttaattttaaattttcaaaaaaaaaaagaaaaatgttctgttcattagtagtactctgcttggcggcttccttttgatcattttgctgtcaaattcctccggaattctcgtgaaattagtcaaattactttccaaaaaaccgtcctaattaatgtaatcctgaacgatacgacgaagagcaaatggaatggaaagcttccaatgcagtctccatcagtagttggcctgaacccggtaaattaagcttgcttcacctctcttccccggccggtctccggtagctcgccgacctctccaaaagcgactcatggcgagccaagaaaacctgcacgccaccagcgagctcgctcaacgatcgatccgatgcgtt

SEQ ID NO: 15084 - DNA, 1501 bp, Oryza sativa
cctacttaaagctcgtcatcaaggaaaccctaagactgcaccccgccgcaccaatgcttgtcccaagggagtgtggggagtcgtgcaaggtgctagggtacgacgtgcccaggggcactaacgtgctcatcaacgcgtgggcgattggcagagaccccaattactgggatgacacggagacgttcaaaccagataggtgtgagaataacaagtataactttagaggcaccgatttcgagtacataccgtttggatctagacgaaagatctgccctggtccggcgttcacacatgccatcttggagctcgcgctcgccgctttgctgtaccactttgactgggagctcccctgcggagttgctccaggggaggtggatatggccgaggagacaggcgtcgtcgttcgcccgaagaacgacctctacctgcgtccggtcgtccgtgtgccgccgggagctgcctcgagcggcaatggtggcacctagccgtgcaccgcatctactacctagccttaattatgtgaaaatgtaacctggttggatcgaatggattaagtgctaaataaaatggtttatgtgttcatgtttgtttgtgttcgtcacatgtcacatgcataagagagagaatcagactatcagagaaggcgaggtccagaagcaggatcaatgttatgcaccttgcaatgtcgatagcaattggcattagtcctaaactgctcagtcatcgtgcaggatattggtgcaggtatcccatagagtcatactctggttctgtaatcaccaggcattcagaaatcaaaaccgtgaaaactaaagacaggcatattcatgctccacataattctccaagaagaaatttggataaaaatattgatataaatttttaaaagtacggaacaatggaaactttcatctgataagcattcttttatcggaataaatatatcagtggatacgtacgatacaatgaacagatcctctcatgctttgtataaattgtattacatgctactacaatacagtgaacaggtcctttcatactttgaattacatgctacaatacatctcaccatactttacatacaatcaatggtctgagagaagggtcaagcactcaagcttcctggtgcacacattaatctacacctcaattgatgcttcaccgttgcttgcctttctccattttgaggatcgttgcttgtttatgatttggacgtaagggtgaatagtctaagtgtctaaccacaccatgagcaataggtcaaccccttgcatcatatgatatcttggtatgattgagtataagactatgagagggaatattgccctcaagatctgttaaaagacatcaggagggaaacgcccaggcatagaattgttctgctgagcttgcttcagatgcactctaagtgcataattatttatctgcaatgttaaatatacttatgtaagaacaatcaaaatcaccgggagtagtgttcgggacaaaagaatcaccagga

SEQ ID NO: 15085 - DNA, 1501 bp, Oryza sativa
taaaaaaatcactcgtcattcatatgaaaatttagggcatatttactttgatgccattttcaaccatactattttttagcaaagttgtcaaaaaaaaacatacgtttaaattgttgtcaaatttggttaatacataagaaatcatgccaaaattttagcaatattatcatctgaacaaccccttagcattcattcaagaggaaattttaacatttattttttgggaacatacgcaaatgataagtactagtactataataataaaaatcaaagcttaattttatcctctctttttctatcatcctcagttgaccatgaaccactcgtgctgttgaaggttggcatgtcccagtctctctcttcacagacagccgttcagatgacgtatccgtgacgtcaccagacatggcaagtgggccccacccacctaccgcgatgggcccggccaccaaccccggagtcgttctctgcaacttttctcccctcccggttagtccactcagccactggcacagtgccacgtcacctcgcttcgcatgcgaagcacgcgtgccttgcgtgcctcctccttttctccaaacgagatcttctacaaggacatgatggctactgtttgtgaggtaaaattaatcactgcaaaatcatccataaatccacgactaatccacgataggtgtgacagtttagaggggaagtagtcaagctactaactaaagtcgctttttcatggttatgtttgttctgactttcgagcattttgaattttcgatttgtaggtgtgagcaagagagagatttgtgactcaatctgtattttatttttgtcctgtagctcactatataaggttgagactaatagcacggagataatatcaggagtaatagtcaagcatacaaatggtgtagggcgacttatttggttacaccctattaataaatatgatattgtttttattttataggagtttaccctatggtaacaaggttatgttcttttctgcttattaatcagattattaaatcgaattatttgctccgtgttctgaaaaatatgctttgtatacaacttgtttaagctatttgtaaagttacttttacaaaatatagtttattttgtagtcaaattgataatctgctcaaaaaatctaaattaaattgcacctctatatagagtatatccatgcttttgtataaagggaatctgttagggttatggataccacatacctaatagtagttgactaaatctcggcatgacccaccacataccatgtcttatacgggaactgacttcggatatgaagggagttccggataagaaaaaacaaccaaagttctacatggaaacgacaagaactactcggattgtatccatattggtttccctagttctacttggacaaggggacacctatgggtataaatacaaggcctcctaggaggagaggggacacggaacaatagatcaagacagaagatcaacatacaagccaatatacgcc

SEQ ID NO: 15086 - DNA, 1501 bp, Oryza sativa
tttgttaatttattttcaaaaatggattaatataattttttaagcaactttcgtatagaaactttttataaaaaacgcatcgtttagccgtttaaaaaacatgcgcgcggaaaacgaggacatgggttggtaaccccttgagccgaacacagccttactaaggaatttagtattaattatgtaaagagaaaaaaggttaatcgttcaggctttattgttggtatctctatttctaaacctaaaaagataggatatatactcgggaaggaatttagtgtcgtttatattaaaaaaaagatatacacttaggaaggaatttaatatcaattattaaaagaggaaaaatggtgagaaaattagtgctaaaggaaatagaagattggccaactggagcaccttgtagttccccaccatcagaccacgatgtcattaccggtatttatggcgaaagtgtatgtaaaacatggctaatgaataagaaataattcctccgattcacgatgtaatactttatagcattgcccagattcattaacatctatatgaatatagacaatgctagaaaatcttataaattacaatatgaaacggagggagtgctacttattgtgcttgctcggcggcgtcgccaggtagggtttacattaccggttgatcactaaatttcgagccccattagtatcacggttttcaataaatttcgatcggttttcgataaatttcaactgaatctactgtttaaccttcgaaattccaatcgaaagttaattccgagccgtgtcgaaacgttgaaatttcacggaattcgaccggttttcgtcggaattgacgctaggtccgttaatatagaagaatttgcatgaatcaaatagttaagaaaaaaaggttattaattttgaatttgcaaaaagaaaagttcatgtacatgatcttgaggacacgcatcccaaaattcatgcggtttgaatctagtctcacatttccgtgtttcttccaaaactgaattcttgtgtgctgggtaggttttgaaatggactgaattgtctatacacgtagcacgtagccatcaaaccttcgtggcccgtacgtctagtatgcaatgaaaatggtaacacgtatatatttttaactcgtggttgaaatttgcaaaccacggcggacaccatcaatctttttctcttttaccattttgcttacgtgtcagcgtgcattgtgtatgcctaactacaaaacgacgaattaaatcaaacaaaatttggacgaaaatgacagcgccactatttttatttactacgacgcttaggtaaaatcaaaccggtggcaaaatacttgtagcaattaattacgccaatggcacagtttgcatataaattgcgagacgaatcttttgagcctaattacgtcattatttgacaataagatgctacagtaaccatttgctaataacggattaattaggtctaatagatttatctcgcagtttacaggcgaaatctgtaat

SEQ ID NO: 15087 - DNA, 1501 bp, Oryza sativa
tgtgcaattaagggagattagtacagtattaatcagcaagtacttgtctacttaccaggacgacggctttgatattgcccatggtgagaggcatctggaggctcccatccttctgaaccctgagaagcacatcgacgaggtcctcgtcgtcgtccacggcgccggcggccctccgctcctcgtgctgcctcagagcgcactctatcagctcgaagttcttgcggggttcgcctccgcccgccgcgtcgtgccgccgacgaagctggccagcctcgacgacgggaacaggtcgccgaggctgaacccggaggtgatcttgatcgcctcggcgagacccttcaggaactcgtcccgcctctcgaaccggtcgccgatgatggtgcgcaccgccgagtcggagatgagcgccgcgatccgctcgctgacgttcacgggctgcgccgccggggcggcggcgacggcggcaacaaggcggccgaccttcgtctcccggatgcggcggaacgactggacgcggcgcgcgctgaggagctccaccacggcgatcttgcggagctgccgccacagcgcgccgtagggcgcgaacaccagcccaacgccgtcgctcatcaggacgcggatggtggaggtccacggccgcgtcgcgaacgcgacgtcgtgcgtcttggtgatctccctggcggcgttggcggatgaggcgacgacgacgcggagctcgccgagcctgagcgacatgagcggcgcgtccagccggcgcgccaggtcggccatggtgcggtggacgagcgggccgcccatcgcgacctggtggaggttgccgatgaccggcagccgccacggccccggcggaagcctcggcttgccggcgccattaccggtcgccttcctcgccaccttgtggaggacgagagtgagcaagaggagagccaaggagaggcacaggtagccggtgatgtcttgcaccatggccatggtttgagctgtcgagcacttcatggaaatggtataaatagggagaagttcttttattttgggggggaacataaatagagagaagttgattcatttattatttgttgtctggctgctatctctagtttgaaaacataggcaagagaaataattgcaaaatgaaaggcgcatagcgatttggaattttggactaccatcccattggcattaatacagcttgcagttattagtcaaatattggctgtggagttcagagcatgaatagtgattgtaggcaactttcgcagttaagttcagagcataaatactgtgatttagacgactattatctgtataatcattttaattacaacttataggcctcatctttttgcgtatgcttatgcttatcaaccaaaatttcaaatttcaatattaaatatagagtttattttagggatttttcatcgtagtttatttttcagcctttgcttttagatcgttaagaacatgtatatataagttttattcacaaattacttttcatttg

SEQ ID NO: 15088 - DNA, 1501 bp, Oryza sativa
gcttcctgctgttcgcctccgctcgccgcgccctgccgccgatggcgctcgccagccacgacgacgggaacaggtcgtcgaggctgaacccgccgaggagcttcatctgctcggtgagctcctgcaagaactcgtcgcgccgctcgaacctgtccccgatcatggcgcgcagcgccgcgtccgagacggcctccgcgatccgctcggtgaagttgacggccgcctcctcgccgggcgacgcggcggcggcggcgagcgcgcccacgaggcggccggcctcctcctcccggacgcggcggaacgaccggacgcggcgcgcgctgaggagctcgacgacgcagatcttgcggagctgacgccacagcgcgccgtacggcgcgagcgccaccccggcgccgccgggccgcagccgccgcgcggtcgggttgagcgcccggtcggcgaacgcgaggtcgtgcgtccgcgtgacctcgcgcgcggcgccgggcgacgaggccaccacgacggggacctccccgagctgcaggtacacgagcggcgcgtcgccgagccggcgcgcgatgcgcgccatggagcggtggaggagccggtcgcccaccacgtggtgcaggctcccgatgaccggcagccgccacggcccaggcggcagcctcacgccaccactaccaccaccaccaccatcaccactcctcgccagcttcacccaaagcatggcgaagacgacgacgacgacgacggcgacgacgcaggcgacggcgtcgtacatggtgatcagatgatcgacgacgacaacgtaagtacgcgaacgcgagtgcaatgcaatgcaggatagctagctagctaggctagggaacagatatatacgaggcgatggagatgagatgacaaagagagccgtttcatctgcaagatcgatgcacggcgcacggcggcgccgtcttggcgcggggcgccattgcagatgagctcgaggctggctgctgctgctgcctgctgctacacgccacggaaaccgcgttgtctcgtcatgcggtggcgccgcgagcggtgcccactgaattgagatggcaacggcagatatcataagaggctaagatttttgcaacggcccggacactgtacttatccttgtgttttcttgctgcttttgaggccatgtatttacatctcataatttggggaatttgaaatatctcgttttcatgtgggggaattgaactgtaaacatagtaccgctcgaaaatctaattctcaatcccatgtaatgtgccacaaatggatgctatatatatctccatctcaattaatcaaacagagagaaaaacatacaaattgcttacttcatatatctaaagaagaaaaaaatgaacaaaaggagagagcagtaatgcttgagttgccttgctaaagtccccataaaatacattttatttgatgtcgttttgaggtggaggtgccacatagaccatctcttatctatctttttttttttgtgtatatc

SEQ ID NO: 15089 - DNA, 1501 bp, Oryza sativa
gaatacaatttagaagtaactgaaattcaaaattaaaaattagtttagagtccacatagaaatacaattagaaataataaaaattctgaaataaaaataaataatattggaagaagagcatagagtctatatagaaatacaatttacagaaaattcggaaattaaaaaagaaatattaaaaacgagtcaatatatatatatatttacaaataactaaaatttgatattaaaaataattaaaaatacaatttacaaataactaaaattcgaaattaagaaaaatatgggaaaaagagtttaaagtcaatataggaatacaatttataagtaactgaaattcgaaattaaaaattagtttagagtccacatagaaatacaattagaaataataaaaattctgaaataaaaataaataatattggaagaagagcatagagtctatatagaaatacaatttacagaaaattcggaattaaaaaaatatattaaaaaatgagtcaatatatataatttacaaataactaaaatttgatattaaaaataattaataactaacacgtatataaaatacaatatggatattacatattagtagttttgtaaagttattgcaaaatttaaaattaagttgtcattttaatatatttgaataatataatgagaaaacatactattgtcagggttatggataccacatacctaatagtagttgactaaatctcggcaggacccaccacataccatgtcttatacggaaactgacttcagttatggagagagttccggataaggaaagacaacaaaagttttacatggaaacgacaaggactactcggattgtatccatattggtttccctatttctacttggacaatgggacacctatgggtataaatacaagccccctaggaggacagggggacacccaccatgacaggatcaacacagtcaccacgatcgacacagacgaccacctcaatcaacaaccaccacaatatacggaacaacagaagccacaacatacaagccaacacatgctaagacaagccgccggatatcgacttcagggatagcatggctattcccctacggtgtctccggataccgtcaggagagacgaaagcgctatctctgatctcgccggacacagattcgaggaggaaggctaccctgttgtcgactacgagtcagaccttcagaccgacatgtcgacaacagttagataggctaccccacatattgtactggtgtgattatggtgaataaaagcaataccggctccggccaacaggatgtagggttattacctgacaactcaggggcccgaacctgtataaaaatccttgtctccgtctctttcacctcagtctcgcgtatattctagcaccgatgatccccatactatgcaaataccagaattgcgacatcaaacgtcgacagtggcgcgccaggtagagggattttggtgcttcaggatttcgacgagatgggtttaagaga

SEQ ID NO: 15090 - DNA, 1501 bp, Oryza sativa
caaggctccgtcgcagactctacgccttctcgatcgctcgagaacggttgctggatctcgacaaggaatacggaatgaagagatggtgtaccagccgagatagaatttcttgacttcaatccaaattctcgattacagcaagacgggagacttagtcgtacgctctgtacttccttggttgacatcagagattgacttagacaaacccttttggtgcccgcacgaggctgataaagaaagtctaacgttatctctaaactcaccgagaacggtaacgtgagcacgacaacagttactccagggtctgcggttgagaatatgaattcgttcatttgcattgaagtcgggggctactgtcagggttatggataccacatacctaatagtagttgactaaatctcggcaggacccaccacataccatgtcttatacagaaactaacttcagttatggagggagttccggataaggaaagacaaccagagttttacatggaaacgacaaggactactcggattgtatccatattggtttccctagttctacttggacaatgggacacctataggtataaatacaagcccccctaggaggacagtgggacacccaccatgacaggatcaacacagtcaccacgatcgacacagacgaccacctcaatcaacaaccaccacaatatacggaacaacagaagccacaacatacaagccaacatatgccaagacaagccgccggatatcgacttcagggataggcatggctattcccctacggtgtctccggataccgtcaggagagacgaaagcgctatctctgatctcgccggacacggattcgaggaggaaggctaccctgttgtcgactacgagtcagaccttcagaccgacatgtcgacaacagttaaataggctaccccacatattgtactggtgtgattatggtgaataaaagcaataccggctccggccaacaggatgtagggttattacctgacaactcaggggcccgaacctgtataaaaatccttgtctccgtctctttcacctcagtctcgcgtatatcctagcaccgacgatccccatactatgcaaataccagaattgcgacatcaaacgtcgatagttgcgtatcaagtagggggattttggtgcttcaggatttcgacttgatgggtttaagagatggattctccaataccatgctagttttcattatcgacgaggatttcttgtgcacgtacattcactgacgtgctagtaccaagtaataacaaactactcttgttttaaaatatactcctagtactcgattagacactagctatctagtagtataaatctagactgatttgatagtactatatgatgtttttttcgagtacaaggttttctgtattttagaacgatgagatataacaagaaaacatatggctacgaccacatcgtctgcatgcatgtacgtaaccccctgcataagtggccgaattagctcttgctgtgg

SEQ ID NO: 15091 - DNA, 1501 bp, Oryza sativa
tggttgagaaccggtgagtaggtgtccctcgatcatttggagtcgtggtacgaggaccactacgctgccggtcgaagaccagtcgtagctgttcctcaaccatctgaagtcatggtgcgaggaccgctacgatgccgtagtcatacctcgaccatctgaagttaaggtgcgaaagattgctacgtactggtgcgagaaccagcgtgcgagcagaattatctctcgaacaccaatggaagttgcggtgtgagagattgctacgtattggtgcgagaaccagtgagcgagcagaattacctctcgaacaccaatggaagttgcggtgtgagagattgctacgtactggtgcgataaccagtgagcgagcaaaattatctctcgaacaccaatggaagctgcggtgtgagagattgctacgtactggtgcgagaaccagtgagcgagcagaattatctctcgaacaccagtggaagtgctagagttggtttattgcaagtgtatctcatgtggccagcatgactcacgtacccaacttatagcatatccggatgtccgttcgcaatcatgtcgggtgatcaagccgacgacgttcgcaaggaattatccgttaacaaccttttctcaagtagtccagccatggccggtgctatgagataggtcgtcggtctttgttggtaggttgggtgcgataactccgcatttgtcgagaatgttctcgataatggagtatattcgaccataacctactcgagtgctcaattgttcctgaaaaatattttctagaaggcaagatatatagcagataatatcgagtatgtactcaaagaactgcatggatcttctagtattatcaggatacaataagcagatgtaaatatcagggcattatgtaaaccgtaaacaagcatgatttatacataagagaacggagtgagcccccagcgttagaccgtagttggtctatcgtcggaagtactcgcacaacggatgttgtataagaaacatgctctaggtaaacataataaattgctgatatgataatgttgtatcatctgaataggtacgataaattgcatataaaatattacgtacctttgtagatacatgccggatgtatctacgaaattagtagatcaatttgaaaaaccaatctaccaattaccttattgcgtactcgttcgacatcatatgatctgacatcttttggtacggcgcggagcttgaggcttgggtgatctcgatagaccaagttgtcgatgacgatgatggttctgatcttgtcggaagacatgttccggtcgggttagatctccacagccgaagtcgtcgagtagtttgctattggagaatccatctcttaaacccatctcgtcgaaatcctgaagcaccaaaatccctctacctggcgcgccactgtcgacgtttgatgtcgcaattctggtatttgcatagtatggggatcatcggtgctagaatatacgcgagactgaggtgaaagaga

SEQ ID NO: 15092 - DNA, 1501 bp, Oryza sativa
ccggggatgtaggcttcagctgaaccttgttaacaaatatcgtgtgttcctgtgtcgtcatctggcgtgtcttgggtgatcaatgattgaagcgatcgggaaggttagtcgtcgttccgctatatcggctaacttttataacaagtggtatcagagcagaaggtttcagcattagatcaagaagacatgtggaggaggaaacacgaggtggggatcacgcatcgacatgagatcgtcagccgtggcgatgagatcgatggcgacaacgaggatgttgcggaggcggtgacctcgctcgcgatcagaccggcgatggcggaaaatgaccggaagacggggccgggcgtggccgaaggcgactggagagatctgaggggtagcgccatggacggcgcgcccgacgcacgtggtgatcgcggatccgcggcggcaggaggccagtgatgaaagggcgaaaccggcgagcgtggcgcggcgcggcggacgtggagggccgggacgacggggtcatggacggtgaacacgagggctgcgactgcggtgcgtgcataggcacggacagatagcacaggtgctgtcttatacgtatggcgtgcaaagactaacgagcaaaggcaagaagcaaaaccaaatcgagcaattgcatgcaaacaagggcagggaagctgcagctttggaactcgtgcatggcttgagcatattcacgtgaacatgagcatgcagggcatgcatatcgtgcgtgcacaagggatcaaggggcagcagtaccaacagtggcgaacccagaacaaaaattaccgggggtccaatacatactaattatctaattattgactaatatattaattaatatagtgtaatttatataggatttgaataatctacccggtgtcctatgacaccgggtagtataacgtaggcacgcccttgagtactaatgcttcatacatatggaaacttttgtaccgtgggagtctgacagattgatgagccaaaaaagaaatcgagtagaggagttggatgataaaatgacttgtcggagtcggacaaggccgactcgaccgcagttgctatggagtcggattcagagttatgtatggatatggactcgtgatcgcatcagactcgtattgcttgccctttaaataggcagccgaagagagagccgaaccaaagcaacaaagcggcagcgatttttgggcggctcggcaggacattggtcaaacatggtacaaggggctcaataggcttgctgtgcagaggctcgtgacaaagtgcgcgcgtatgggtcgaccaagccaggccgacgagatcatgcggagtagaggcacatcgagggtggaagattggtcacatcggattatagcgaacacggtttgctattgaatgtctgagatcggatcacaagacgggattgtgaagacgaatacagacggttctgagcagggcgagtattctggtggcgacagaccagtcaggtcgtgggttggcaagatggcgc

SEQ ID NO: 15093 - DNA, 1501 bp, Oryza sativa
ggctttgtttgacaaatgtgattgagaaataacatctcaccctccaaaagacaatattgcatcatagtcatccattcttcacacctcatttaatcctagccattcatccatttcactttcccaatcccacctctcaaatcccatttaataaacataccctagccattcatctctcaaatcccatttgccaaacacacctaagcttgttaggttgttaaatgaatgttagtgtaaagtttagggaattgaatgttcggttttaaacttcagaatgctagatggactttcaaactaattatagggagttattttgactttttttttctattttaaaataggagggagtattaaaacaacgtactcacgtgtattcccagtacgccattctatcaaagttgtatcaatttttacagttgtatgtatatcttattttgtgaagtgtcctatgaaagatactttatcaacactttgatccatttcggatctattatgtagactagcctagatctatgaaaacattgccaaaattgtctgcctagcaacttttgtttgtactagttcttttccggcaaaaccagtcttcaaaacccttcttgcagcctgtgcttagagcacaacttttctagaggaaatttgcagtgcgtatatgcagattgaaaatcttgggtaacttcagtgtaaaatcacattcaaaatagcgccactgtgtccattagataacctacgtcttacacgacatatttctcatacagaagtccaaacatggtatacactgggtatctagtcgacaaaaaccacaaacatggcacaagatgacccaggaggtatcagtgtatcatatcttgccgtcgtaccttgtaggatgaggatctccttacgactcacattgcgtcgttatcgtgcagaacatgtttacaaatcaacatggttattacctgatcaagtaaaaaagagtcaaatcagtatagagagtagagagtatttgtataaatccactaaaaagtgtttacatcaaacctaagaaggaacgtgtagcgcaaagcagagcagagctaggtgcaatcatgaaaccaaattggttttacaacatcaaacaacaaagaaactgccaactatatagttcttaattctcttcccttaattgtttttgatgttggcagcaaaaacaggacaaaataaaattcaagtaaatgggaagggaagaattcactcaagattaaaaggtgacaacacttcgtgagctgtctacacaaatatcttctgttctgagttctgaatttctttctagctgtttcgatgcccaaatcaaagttgttgcaaacttgcaattggatcatattctgcagtagatagtactacccaggatgggtatatctacatttcacttgacataacactaccgctgaattctttatctaaggagcaaacagtggcggagttctttttcatttcttccagcagcaataagtcaaaacctttgggcatattcatttcagatggt

SEQ ID NO: 15094 - DNA, 1501 bp, Oryza sativa
ctcctcaatccggagccactcccccaacaccttgcctggttaactcacggagtgaactatattttcattggtaacatgcgataaagaaaaggtgatcaactgaatatctgaacacaagcacatgccatgtggcactgaataactgcatgcatggaatcaaatggtacgtcgttcatccttttgtgatatgcatgatgatatgttttggtccataaaagggcatgcagggtggagaagcacacaaatgctgcaagcaatgagaggaacatacattagcccatgcagtctgctagctcctatggcttttgcagtggtaggcctaggaggcatcaggaactcttgtgctaattttgtcaatctttgattctaccaaaatgcatggtcgctgacattgaactgacgaataggctatgtcaattgagtacagatggtgagtattaatttgatctcatggaatcatgtgaccacaatactagaaaacctattttgccagacgggcgaaaaccgccttcataggcgaactgccaatccacctgtagaaaaaggtctgcgaaaatcaatttttttcacaggcggatatatggtgccaaaaaaacttatccacctggaaaaatggaagggcctcgtccacaaaaatcgttttcctcgtagtcccatttttagcttactaggtggcagattcaatttactagcttagggcgtgtctaatttggatagggtttcaatatattgcatgttttgagagatgagctcccatgtttgtttgttttttttactgaataacattgatttggatataaggacagttcatgtcatcaagaattcgtggatgactattaaatggaaattcacaagctatgaaaatagctgttgccagtaaaaaaacaaacaaacatgggagctcatccctttattttattctcttgaatatataatttcatctccatcttttaatgctcactcgaatgatcctgaatctagaaggcactgaaaaaccatcttacaactgattttttttacaaaaaaaataattaaacactcaatggtaggtgcacattgaattactgttatccctgaaatgtttcttcttttccctattgctcttgtatcttccctattggacaccctagaggatcatcactactatcctttctggtccatgaaagagttgagacaagctctgacaatgagactggtgagtgcacatctgaaatctgtttggacaagagttgagacaagctccactttcttttcggccaaattgggcctccaatgtagcccatgcaaatagtccagcccaacaccctgaccggtgtagtacccagaagcgcgaattttttttatttttaattttttttattaaaagttttacaaaaataatttttcattttgaaaattgacagaagtggtcgcctaccgccctctgggagggcgatttttaaaaatcaccatcccagagggcggcgaaagtgacgtggcagacggccgttcgctctcgggc

SEQ ID NO: 15095 - DNA, 1501 bp, Oryza sativa; identical to SEQ ID NO: 15094

SEQ ID NO: 15096 - DNA, 1501 bp, Oryza sativa
cctccgacatggctagctagctccaacctcgtcctcccagatggcatgcaagagtggcatttggggttgttcattttcgaaggatggcatatagtaaattctcctcgaaaccccttctcttcttaatttctcgtttcattgacatataatccccactcaaccatgtagtacaaaacaaccgtcgaacccacttgagaaaacaaaatggaccagtattgataattgaggaacattgtatacccggtttcacggttaagagacaccgattgaaactgatcctcaaatcgagggatgcaatatagaattttttccatatcatttttgcatttccttggatcctgggttctacttctacgggtcaaaaacaattgtcctgaaaacgcagcaagtttcttgtactccgtgcaacaaaaaaccacacgcatatgtctcacgttgctgatccacctaaagtctcttgccacttttaaacatcacacacttggagttgagcagttgactctctgacaggtgcgccccccgacgcaatccaagtccaaaaataatactacctccgttttttaatagatgacgccattgactttttctcacatatttgtccattcgtcttattaaaaaaattacgtaattataatttattttgttatgagttgttttatcacttatagtactttaagtgtgatttatatcttatatatttacataaaatttttgaataaggcgaatagtcaaatatgtgagaaaaagtcaacggcgttatctattaaaaaacggagggagtactaacaataacccaatggtggaatattgaatacgtactttccttttccacccacggaaatattctacgcacgaaagccgcacacgtgtttcccgcgaccgcgccacgtcaccgcaaaaacaaaaccggggggagccacgtgtgcccacttccggatagattcacgccgacccccctacgtcacccccgcgggccccaccacagccactgacacgtgggccccacgagtaaccacctgttccgctactagaagtatagtaggcttcgcggcggtggtgggtaaaagcatagtgagctctcccgtgccaccgacaggtgggccccacccgcgcggcggaaggttctaggctctccggcgaaggttctggaaggttcgggaggaggggggagatgattctgtcggcgctcgcgacttcggtggggatcaacctggggctgacggtgctcctcgcggcggcgtacacgctgctccggcggcgcccgccgtacgtcgccgtgtactcgccgcggcggccgtacgcgccgccggagccgtggctgcccgcggcgtggcgccgcaccgaggccgacgtccacgccgccgccgggctcgacggcgtcgtcttcctccgcatcttcgtcttcaggtcccgcttccccgctctcctctcctccaatctcggcatacacgctgctcgctttactatgggggatggagattgacgaggtgatgggggattt

SEQ ID NO: 15097 - DNA, 1501 bp, Oryza sativa
ctgcacttggtttcatccctgccgaccagttcatccaacggcacacatccatcttccctcctgcataccctattcatattgggctacccagttcggcctgcaactgtggccatcggcttgcccatcaggccacattgactttgttgcctgctaccacatgcgcgaatgcagattttctttatttttaattttatatttattaaaatattttgaaaaataattttctattcgaaaaatttatacagaactagtagcccatcgccccgacgattttatcgacgtggcagacgaccattagccctcgcctaacgaccggccaccgagagcaccgaaaatttacaggcggtcccattgccaccctcccagagggtggtttttggctctaggtgcccgcctataaaagggctaggagggcggcttggagtcagcaaaccggcatggcttcgccgcttcccttttgctctctctctctcgcccttccctccttttggattttgagtgaatataatgtaaaatcggagaggtacaaggggttttataccccgagggcataaaatcaccctcccagagagtggcaagggggccacctacaagtgccatgccatcctcgccacccttttgcaggcgacctcccgcacataaaaaaaaaccctctggaacgggacaaggggtccacctacaaaaatgctgggccgagcacctgcacattaaaaaatcgtataatcgaccgcgttgaataattcaaaataagacaagtttcaagtaacatcattcatgcactgtaaatcgacaactaagttttggacaacactataaggcaaatggctattgtgactaaaacaagaataattaactatttaccacgtttacaagtggtgataaagaatttgtcactggacccatatatcatagacacatgaggacccacatgttatagacagtgtcagattatgaataccgcgtacctaatagtagttgactaaatctcggcatgagccaccacataccatgtcctatatggaaacaacctgcggatataggaggagttccgggtaaggaaagacaaccagagttctacatggaaacaacaaggactactcggattgtatccatattggtttcccctagttctacttgaacaagagaacacctataggtataaatacaaggccccctatgaggagaggggatacgaccacctcaatcaacacccaccatagaagacaagaacaatagatcaagacacaagatcaacatataagccaacatacgccaagacaagacgtcggatatcgacttcaaggataagcacggctagtcccctacctggcacgccactgttgacgtttgatgtcgcgattctctcgaactagtacgtagcaatctcccgcaccgtaacctccattggtattcgagagatgattctactcgctcgctagttctcgaaccagtacatagcaatctcccgcaccgcaacctccattgatgttcgagagatgat

SEQ ID NO: 15098 - DNA, 162 bp, Oryza sativa
atgcggcagcggcgcggggcgcgagtcgacaacgcgatggcgaacggggcgcggggcgcggggtgtgagccggcgcgcggggcgcaaggcgacggtacgggtcgacagcggcgacacgacagacgcgcggcgtggcgacgggacggtcgcgcggcgatggaa

SEQ ID NO: 15099 - DNA, 1501 bp, Oryza sativa
ctcgcgcccacgcctccactaaccccactcgcccgtttgcggcgcacgcggcagatgtgcggccatggcggttgagatggggcagatcgtgcgcgcattaactacgctcgctaaccgtgaaaagcgccatcatcatgtctccaggcgaaacgaaccggctcgtcccgattcgcgcgctgctcgagtaatgtagcggtcttaaagaggccgctcattatcgtcggtcgtttttcccttgccgatgcgcgcgatttgtgactgctgggtttctgcccgcctgtagggaccggccccacctgtcaccgggcctaaggagtggcgtcacgcccgagcgcttccctcgagggggcgatcgccctggcgtaacgccgggggctactgtcggtgacatggggccgggggtatcgtgactagaggcttgggtagccgcggtcacccacgtggcctgaccccctcgggggtagggggggtcggtcccgagggtgacgtggccacccctccctctgtctccccgaggggtcgggccactcccgtttcggccccgagggctggggcgcccctgtttcggccccgagggctggggcgccccgaccccctgtggttttggcgccacgtgtgtgggttaggtgagcacagcggggctcacctaaccgcatttatagcaggttggacgagcgcgccacgccgcatttaatgcggcgcagcgcacgcttatccggtccgtgaccggtcgcggtgtgtgaccggtcacagaccggtcagatcgcgtgttaggtggcaacaggcggcctgtcacacgcctcgccccgtcccgtcggaatgatgagagcttcctggctctcgtccctagccggagccggcgtgctaactcctggagttggtatgtcagtcccggtcagatccattccaggcttcagcgcaagtatggcaaggaagtcgctggccattaaatgaaggttgaaatgggcgtccaccgggaaagcgggcgagcggggcaggaggcgtgtgctctgcttgtcagaggtcacttccggctgtagactagccctcattgtaaaaagcatgtttcccttcttaggcagctagaggcccatgtggtgacccctgaccagataaaaaggaggcccaggcctaggagaaagggggttgggactctggggaaggggttctagagcctgaactcactctcgctctccgggtctctgtattccttcacgcacagatccaccagaacacaggagtagggtgttacgcttctcagcggcccgaacctgtctatgtcgcccgtgtcttgtgcacttcctctcccgctgacgttcctcagatcgagggcgaagaacctcacttagcgcctccggccgaaccggcaaaggggggcctgcgcggtctcccggtgaggagccccacgctccgtcatctggcgcgccaggtacggggcgcgcgtgtcttcctaagccctcgtcctctttcgtgtgcgccaagcttctcccgctcagcccaa

SEQ ID NO: 15100 - DNA, 1501 bp, Oryza sativa
taggcgaggcggcgacgcgccccgtctcgccgtcctcccccgtcgcccgcgggcggcgaagtcgcggatcgttcgacctccccgagcgcctccccccgcccaagatttcggcgagagggggacggtggggtgcgagcccgacggcgcgggttctgctccccgtcgtcaccgctagcgttcggagagaggctgtgcgccactgcccgttcggccattgggctgagcgggagaagcttggcgcacacgaaagaggacgagggcttaggaagacacgcgcgccccgtacctggcgcgccagatgacggagcgtggggctcctcaccgggagaccgcgcaggcccccctttgccggttcggccggaggcgctaagtgaggttcttcgccctcgatctgaggaacgtcagcgggagaggaagtgcacaagacacgggcgacatagacaggttcgggccgctgagaagcgtaacaccctactcctgtgttctggtggatctgtgcgtgaaggaatacagagacccggagagcgagagtgagttcaggctctagaaccccttccccagagtcccaaccccctttctcctaggcctgggcctcctttttatctggtcaggggtcaccacatgggcctctagctgcctaagaagggaaacatgctttttacaatgagggctagtctacagccggaagtgacctctgacaagcagagcacacgcctcctgccccgctcgcccgctttcccggtggacgcccatttcaaccttcatttaatggccagcgacttccttgccatacttgcgctgaagcctggaatggatctgaccgggactgacataccaactccaggagttagcacgccggctccggctagggacgagagccaggaagctctcatcattccgacgggacggggcgaggcgtgtgacaggccgcctgttgccacctaacacgcgatctgaccggtctgtgaccggtcacacaccgcgaccggtcacggaccggataagcgtgcgctgcgccgcattaaatgcggcgtggcgcgctcgtccaacctgctataaatgcggttaggtgagccccgctgtgctcacctaacccacacacgtggcgccaaaaccacagggggtcggggcgccccagccctcggggccgaaacaggggcgccccagccctcggggccgaaacgggagtggcccgacccctcggggagacagagggaggggtggccacgtcaccctcgggaccgaccccccctacccccgagggggtcaggccacgtgggtgaccgcggctacccaagcctctagtcacgatacccccggccccatgtcaccgacagtagcccccggcgttacgccagggcgatcgccccctcgagggaagcgctcgggcgtgacgccactccttaggcccggtgacaggtggggccggtccctacaggcgggcagaaacccagcagtcacaaatcgcgcgcatcggcaagggaaaaacgaccgacgataa

SEQ ID NO: 15101 - DNA, 1501 bp, Oryza sativa
tttccctaattcatgcataacaaattagtatatgaaaccaaagaaactggtaaccctgaaaattactgtattaagttctatataaaattcaagactcaccagatatatatcaacttttagttataatgtatgctacttaaaaaaactccatctcataatataaggcacaacatatttcatgaaaatttttaattttatttaggctaatataaattaaatttcatttgaagaaaataaaattgttgaattggcatttgaatttattttaactaaatgttaaagataagtggtagacaccatgacggagcgtggggctcctcaccgggagaccgcgcaggcccccctttgccgtttcggccgggggcgctaagttaggttcttcgccctcgatctgaggaacgtcaacgggagaggaagtgcacaagacacgggcgacgtagacaggttcgggccgctgagaagcgtaacaccctactcctgtgttctggtggatctgtgcgtgaaggaatacagagacccggagagcgagagtgagttcaggctctagaaccccttccccagagtcccaaccccctttctcctaggcctgggcctcctttttatctggtcaggggtcaccacatgggcctctagctgcctaagaagggaaacatgctttttacaatgagggctagtctacagccggaagtgacctctgacaagcagagcacacgcctcctgccccgctcgcccgctttcccggtggacgcccatttcaaccttcatttaatggccagcgacttccttgccatacttgcgctgaagcctggaatggatctgaccgggactgacataccaactccaggagttagcacgccggctccggctagggacgagagccaggaagctctcatcattccgacgggacggggcgaggcgtgtgacaggccgcctgttgccacctaacccgcgatctgaccggtctgtgaccggtcacacaccgcgaccggtcacggaccggataagcgtgcgctgcgcagcattaaatgcggcgtggcgcgctcgtccaacctgctataaatgcggttaggtgagccccgctgtgctcacctaacccacacacgtggcgccaaaaccacagggggtcggggcgccccagccctcggggccgaaacgggggcgccccagccctcggggccgaaacgggagtggcccgacccctcggggagacagagggaggggtggccacgtcaccctcgggaccgaccccccctacccccgagggggtcaggccacgtgggtgaccgcggctacccaagcctctagtcacgatacccccggccccatgtcaccgacagtagcccccggcgttacgccagggcgatcgccccctcgagggaagcgctcgggcgtgacgccactccttaggcccggtgacaggtggggccggtccctacaggcgggcagaaacccagcagtcacaaatcgcgcgcatcggcaagggaaaaacgaccgacgataa

SEQ ID NO: 15102 - DNA, 1501 bp, Oryza sativa
ttccctctcccttttcccccatttttccctctctctctcgcgttcaaacgggcggatttgcccccgcaaatctcgtcggtgccattgatggcggccgacctcccgcgccggtttccttcccctccggccgctctctcccccttccaaccctatttaaaccctccccgcacttccttcgcccgtttccaccctttgccgcgccttctcctcgccggaatcgagctcgcgccatcgctctctctctccgccgtcgcagccgagctccggtccgccgccgtcgtcgccccggaccgcctcccacctcggcgccgcctccttcggcttcgccgcatcctcgccgacctcgtccacccctccgtttcggtcgctgaccgccggagcgccgccgtccccgtcgacccgagccgcgccaccgcctccctccgctccggccgcctcctccgtcgccgccgtcgccccggggtgagccgtggaccgtcgcctcctttcccccttccctcccctctctcggccgctgctccaccgcgccgcctcccgccgaccgcgccggcgtggccgccctcgggcgcgccgagtggctgccgcgtggggcccggccgtcagccgcccgcgccctcgggtgcggctgacgtgtggggcccacggcgccggccggtgtgagcccgggtgcacccggtccaccgtggaccgtgaggctgccgcgtgggccccactcccgtggacccggtccgcgcacccctcccgctcggctgacgcaataaaccctttttaaattaaaatttaaatgaagaaattcgcaaaaattcatttaaagagcatataaacttcaaatggccataacttggccatttgaactcggaattggaccgttcaagtctctaatttttccttaagaagtcaagaacccatttttgtgctttgttcctgcttattatatggagtttattagagtaaaagccttttcttttccgttggtcgtgtagacgctgcagcttcggaagatccgctcttcgtggaggttgaagccgatgtttgggaaagcgagcaaggcaagtcacatcatccttgaacatattggatcccattttataaaattattttgatttaaattattgcattatcgctttacttaaattcccgcgttatcactgttttatttagctatgcctatttacctttgttatgaccttattattattgttattgatattattaccttgttcaccctagattaaacaaaaccccaactagtggacactctactcatggtaccactagtatgaatttaggtagatgtttcgctagttaattaggcaacattaggtggttttacaattctagactttgggaatattctcatcacctggacactatggaatggatggattattgtggaattggattcacacctccccctctattcaaaatcctcaaaatggttttaggctaggctcggggtgcatggttttgatagtagcacctcggccatataaggaccagt

SEQ ID NO: 15103 - DNA, 1255 bp, Oryza sativa
cctgcagccccccatcgcctcccgctcgctgtgttactcgctagcacccgtaggaggcgtcacctactccaccatccccatccaacagccgccgccgctgctgtcgaaggccgtcggtcgcagcggtggaggtggcggcgagcgcgcacggccgtagcctggcgaaaggaagagcggtggcacgacggtggcacggcggtggcgccagactcgacgaggccgcagacaccggcgggcgacgcgtggaactcggccagtgacgctgccgctacgtcgcactccttggttgccgccatcctcattcccatcaccgccgccgccgctcccaccgccatcgtcccgaccgccgccgccgccgctcgccactgccatccccgcagccgctccggccaagagaaaggacagggggagagagagaagggagagagggggaggaagtagggaaggagagggaggatgacatgtgggtcccacatttttttttttgtgtgaatgatatatgggtcccacattttttttttgtttttattctaatgccaagtaagagccacgtaggacaaagacttggtcaagaccgccatgtaggaccacctcgaaaaccaccgagggatattgtctgcaccagttttaatagttggaggaatcgatatacccggttttgtggttggaggacatgagtcgtactcgggcgatagttgagggagccaaagtatactttttccaaacataaataatgttgagtgacccttctattctgattgcttctgggctagtgagctgtgggttgggcttcttttgcctactttagagctgggatgacatgagccgagttcgttagagtctgggttttgcaaccttttcgtttacattatgttttttaaaccattaaactgtattttttaatatattatataaaatttattttaaaatcaaagaaacatatattttttaataattatatttaattaatcatgtgctaatggtttgtttgtcatctaaccgtatgctgtgattctttaaagccttctttaaatctgtatacaacctgtagtttaaatctgtatacaaactgtagtctgtactctgtagtttcagttgcagtaggttgtgtgattctgacagctgaagcatgtgaacatatgttagatactaaaactcttttaaatatgaatctaccgaatctattggtccaggtgctggcaatataacacatggataacttagtattttcaaagaacaaggcaatggcttgaga

SEQ ID NO: 15104 - DNA, 1501 bp, Oryza sativa
gtgggcaacggctgggcttgtagtgtagctttcctctagccgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagaggggggttatgcgaatggtcctgtcacagcctctttccgggatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatctgatgaatttggatagtttaggtggatggttgggcctgtcgcaacgtgggttagcgttggacagcggatgtttaatactgcttaattattacaaccgttttcgcattcaattcctgtttataaatgccagtatttatgcaaatgaaccactctagctcttctttgttaattccctgcatcatacccctattccggtatgacttgctgagtacagtgggtagtactcagtcttgctctactttttcccaaccccagaggacgggtatgtgtcagatgaaggtttccccgaggagtaggcttcgtccgtgccgtcgaggatgcctgtggagtggtgttcccgctgcagtttagtcaaggcttagctccagttccttttgttttccgctgcattttttgtaagacttttatgatgtttgtaagacgtggatctgaatgtcaacattgtcgtttgtgtaccccggctggtcctggacggggattttaatgcacattctgcttggaattctattcgggaatttctgggcgtgacaagttggtatcagagccgaccttgaccgtaggacaagccaaatggaaacctaagagccctctaaacctaagagccctctgaatccttttcattgcatatgctctttgcaattggatttgttccgggaaaattgggatctgttcttgtggttcaagggaaaaatcttggtcgctcgtttaagtggggtttttcaaaacgagtcagtctagggttttagtaaaattattgggatttattcgtcagtcagttggggtttgatgggtgaaatgcattaggtcctagctctataacatgggttgcaaggtgtttatgcttcgtttgttattattaatatgtatctaatttctcattactttgtcgttatatgagtctgtcttatttattcgctctcatgcaaaatgatctatgcataaaatttcgcttctattcgattctcttatttgagtcttttattgctttatttaaatttggatttgagcatgcattgatcctactcctttgtcttctctagatggccggtcacccacccaaccaccgcggagaaggcatgatcgatttcgtggcagagttggcacgta

SEQ ID NO: 15105 - DNA, 1501 bp, Oryza sativa
ctacccaagggtagatcggacggcggcgggagctcgcggtcggggcgcgcgggcgcggcgcaagccgaaccggcgaccatggcgccggcggcgcggcgctcacgcggcggcggcgcgcatgcggcagcggcgcaaggcgacggccgacggcgaccgaccggcggcggagagcggcggctagaggaggagcggcggctacacagctaggcggcggtgcggcggttaaacggtgcgggagagagagagaaaacgaggaggagggtctcaccgacaacggtcgacgacggcgggcgtcggaggacgatgacgacggcgggacgagctccggagcctcctaacgaacaaaaggagaggggttagagagggagggaagggcgcgagagggcgagggcgccggccgaaggcggcggccatggcgtcactcaccggcgcacgacggggttgggtctccggcggcgaacctcagcggaggaggggtggacgaggtagatctcgaccgcgcgaagctaacggcgacgacggcgcaaggcggcggcgagcctagcggcggctagcggcggccgaagtagcaaaaacggcggcggcgggtggttgcacggcgcgggagcgatggggagctcgggagaggtcggcgcaatggggaaaaagtgagagggagtgccggcgatgcttaaatagggggagagagggccggacgtggccgggagcggcgggaatcgccggccgacgcgggggagtggggaggagagagaggcgggattcggttttcgaatcccggccatctcgggcgcgggcgcgagcgggagagagaggggaatgggcgcggagggcgcggcgcacgcgcggacgtggccgacgtggcccgggggaggcggaggcgtgggcgcggcggccgttacgggtgcggcggcgcgagcgggaaaggcgggaggtgggagacgggtccgacaggtgggtcccacctgtcggcgaccccagaagggagggaggcgggcggccggctgccgggctgggcctcggcctgcggccggcccaacagagaggggggggaaaagaaaggagaaatgggccgacggcccatttgacaaaaaggaggaaaaaagaaaaagaaaaaggaaaaaggattttccctggaataaaatattgcttgctcaattttaattggttaaaattatttctagagctctgaaaattccactaaaaatcctgttaatgaattttgacatgtagaacttaagaaaaattccacatgtcaagtccgattattatttgcattactttcttagggttttctcctgatttcacctgcattttcttggggtcatttgaaaattacgattttggctagggaggaaaacttcggggtgtgacaggatcgacgtcagcgagctttggaagcagggcgccgagcgcgtgatctcatcggccagcaagatgtcgaagggacaccggttttccgcacccctcaacagaatgcggttgccgcgatcacccttctcga

SEQ ID NO: 15106 - DNA, 1501 bp, Oryza sativa
gatagttaatattgattaattattacaactgtttaaatctttcaacttctgtttataaatgctcgctttatgcaaatgaaccactccagctcttctttgataattccctgcatcatacccctattccggtatgacttgctgagtacagtgggtagtactcagtcttgctctattttttcccaaccccagagctcgagtatgtgtcagatgaaggtttctccgaggagtaggcttcgtccgtgccgtcgaggatgcctgtggagtggtgttcccgctgcagttctagtcaaggcttagctcctgttgtctttcttttcttccgctgcatttgtgtaagacttttatgatgtttgtaagacatggatctgaatgtcaacattgtcgtttgtgtaccccggccggtcctggacggggattttaatgcacattctgcttggaattctactcgggaatttctgagcgtgacagcaacacagtgcacaactcatcttctctcgcattcccttctctcctggctgagcaacacagcgcacaactcgttttctctcgcattcccttctctcctggctgagcaacacagcgcacaactcatttctctcacattcccttctctcgcatccttctctcgcattcccctactcatcttctctggcactggtaccggcgccgtcagccactagtacatcacgtcgccgcttactgccactgctagtcatgacggaccaaacaatttgaggcgcactctgtgaagtgcattgctatagtatatgcctatccctttattgggccttgttgtatcctcatgatagaatgggcttacccatactgaacacacacaatgtgtctgagtggagtactggttgctcagatggaagatttggagagttaatttttctactggaatggcttcatgtgttccagccttccaggtcgaatgaatggtcgatccaatccctattgaatttttccttccagggaacatccatgatatggggtgaaagttgacatcaatgtgcgtcgttctttaaagtttgaatgacgataactttttacgagaaatacaccatatagcaagtactagtatatattagcagtataaacgatataacaatatatattgatttgatgttccacttgatttttgcggtataaattcaaaaaaaggtatatttgtaatttttttaatgttattcccaggcggcattttcattcgcattggcactagtagcgttcccccactcccggtcgatcgaaatccctgttcagccgaaccccattccttcgtcagcaaccgctgtcaccagtcatccacgcgcgccacaccacccgctgacacccacccagaaggccacaatgatatgggagctacaatgtgtcaacgatgatgccctctattgaccttcttccctagtgccatcggctgcctccaccaacctggttgcacgtacgaggccgggaaggggtatcggcgctgacgaagaagtagtaaggcatcgcccca

SEQ ID NO: 15107 - DNA, 1501 bp, Oryza sativa
aagatgaaggactgaggagtgaggactactctcgccgcatccaccgcgttgatctctctccagataagatgctctccggccggtgaggggacctccaccgcacatctcctcccagcctccaactcatccccgcgcaaactggatgtgggcactgggcagtgcctctagatctgcaagggcggctccaggaaggggatctggcggtggtcgttgggcacctcctcctggtctccaccacatccgtggcagcgtcttggggcgatgccttactacttcttcgtcagcgccgataccccttcccggcctcgtacgtgcaaccaggttggtggaggcagccgatggcactagggaagaaggtcaatagagggcatcatcgttgacacattgtagctcccatatcattgtggccttctgggtgggtgtcagcgggtggtgtggcgcgcgtggatgactggtgacagcggttgctgacgaaggaatggggttcggctgaacagggatttcgatcgaccgggagtgggggaacgctactagtgccaatgcgaatgaaaatgccgcctgggaataacattaaaaaaattacaaatatacctttttttgaatttataccgcaaaaatcaagtggaacatcaaatcaatatatattgttatatcgtttatactgctaatatatactagtacttgctatatggtgtatttctcgtaaaaagttatcgtcattcaaactttaaagaacgacgcacattgatgtcaactttcaccccatatcatggatgttccctggaaggaaaaattcaatagggattggatcgaccattcattcgacctggaaggctggaacacatgaagccattccagtagaaaaattaactctccaaatcttccatctgagcaaccagtactccactcagacacattgtgtgtgttcagtatgggtaagcccattctatcatgaggatacaacaaggcccaataaagggataggcatatactatagcaatgcacttcacagagtgcgcctcaaattgtttggtccgtcatgactagcagtggcagtaagcggcgacgtgatgtactagtggctgacggcgccggtaccagtgccagagaagatgagtaggggaatgcgagagaaggatgcgagagaagggaatgtgagagaaatgagttgtgcgctgtgttgctcagccaggagagaagggaatgcgagagaaaacgagttgtgcgctgtgttgctcagccaggagagaagggaatgcgagagaagatgagttgtgcactgtgttgctgtcacgctcagaaattcccgagtagaattccaagcagaatgtgcattaaaatccccgtccaggaccggccggggtacacaaacgacaatgttgacattcagatccatgtcttacaaacatcataaaagtcttacacaaatgcagcggaagaaaagaaagacaacaggagctaagccttgactagaactgcagcgggaacaccactccacagg

SEQ ID NO: 15108 - DNA, 1501 bp, Oryza sativa
agttgtaatttctctgggaataatcaatggatgtgtgaatgtctacttcagtactattcagagatttctggcctttcgatcgataatgactagccatgtgagccgactgatccaattcatcgtctacaactagctagcgccggccactgcagctaaatagctccacgtgcaggatgtgacgtactccacaaataattggtcttctcatgctcctatttaaataaacaataagtttctttagagagcacccaagaatatgctttaattggcactgatatttattgaaatgatgaattatttaccgaaaagtaccggtggtacgattaaatctcatattgtggattcatgatttatcaatatccgtgtgcaattcacctatgagatttaaattgtaatgcacacggatattatatacttacacacgaataatgttttccttttttttccaaaaaaaagagcagattagtaaaattctgtttcttacctttgacataatcacgcgtatcatctactacatcattttttaatatatgacaccgttcactttttgataagcgtttgtctattcatcttatttattttttttgtaaatatataaaaaaataagttatgcttaacgaacatataacgataaatcaagtcgcgataaaataaataaataataagttcataattttttaaaacaaataaaatgaatgattaaatgtatctttaaaaagtcaatgctattatatattaaaaagctacataggagtatctatctacatatttctccagtcttataaaagaccaatctagtattggatgtagtatatgtaatacattctagtcatacgaatctagatatacttatgttcagatttcgttatactaggatgtgtcacgtttagttttagtttgtattttatgggacggatggagtatatgatatgatagtagtgtatatctgtcctatatttatgggacagatgaagtatatgatatgataggagtgtatatctgccctatatatgatcgatcgattccctgtagctgataacgatcgatgaaactgtatgcgagatatcacatgagattgatgagcagtgaggacggctagagatagcttagcttagcttaactagttagatatagatagatagatatagttagttgcagctggagacggatgagcatgagcatatgcgttgcaacattgctgacgccatagacgaccacgcacgagcccatgccgagtcatgccggacgcgaggaataacgaatcacccgattggccttccgattctacccctggtgaccccgaagaattacaaacatttgccactccgcgccacgtcacgctaactgacaaggtcgctcgtgcatataagtggcccttccctccgctgctccggaggatcgatcgatcgatgagcactcgctttgattcgatcaatcgattgatcgagctataggtagccaattacaagctaattaaagcagtaaccgtattagatcgtcg

SEQ ID NO: 15109 - DNA, 1501 bp, Oryza sativa
atatgcattaaggtttttgcagaattaagctctgtttttgtattgcatggatgcttttatagcaaatggccagtttgatcattaaggcaaatctcgagtgtgaaaagtgttgcaagaagatccagaaagtccttaacaaactcaaaggtatgtatggatcaatgcacttgctgaattatgtaaatttaatcccataactaagttgtggcgtaaggccaaaaaggtggtacagtatatgattaagctgtggtttgaattgaacgaacatgaagcagacaaggagaagatcattaacatcgtttatgagaactcgaacaatagggtgatcatatcgggccatttcaagccagaggagctcgcccataagctaagatgcaaggcctgcggggtcatcaaagacattgaatttgggaagcttgcagaggcaaagaaggaggagaagaagccggatcaggccaagaaggaggagaagaagcagcctgaggaaaagaaacctgaggagaagaagaaatccgaggaggagaagaagaagggcgacgagaagaaaccggaggaaggcaagaaggaagagaagaaggaggagaagccaaaggtgaaggaggagaccaaggccacgccggcgccgtcgtcgacgacggtgaacctgcagttcaccaacatgtgcggcatctgctacccgtggccgtgcagcgaccccacccactggggcgccggcgtcgtccacccgcagtggccgcagtgcgaagccccggcggcggcgttgccagcgttcgtccctggccaccaccaccaccagctcccgccatggggcggcgttccggcgccgaagtggccatgcggaggcccctcgtactgcggtgggtgcggcacctgccgcggcggcgggtggccggcggcggcgccgatgcaggcgatgtgctgccctgggccgtcgtcgtgcagagggtgcaagggttgccggctcgttcaggagggcaagttcgtgtacgaggagtacccggcggcgagcgcatgtgccgtcatgtgatgtgatcatcttcccctcgccgcaatgtcatcgttgacattctctcgatctgtctctctttctttcttccatctgcatctgatctgaagctactagtggtttgttcggtcatccaactgcagcgaagaaactcttccagctgccatgttcgcatgcacggcagtttcttttttcctcctaagttaaactatttttgctggagcatttaaccctgtaaatttttttcagtttgttctacactttattttactctgtaatagtatttctctctttcttcctcctatgtaagttgtatttttcgtagaaatttgataaagatgatagatgtattatactatgtttcaatgttttcttttagatctttttaacattgtttacataggttggaagtacttaaaactgatttaaacaccaagttcaagcaaacatccataaacaaatgaaaatattttcgactccaaaataaatgatgtg

SEQ ID NO: 15110 - DNA, 389 bp, Oryza sativa
gggggatacccctaatcggcgcggcgaccagagccactcccacctagtatagtcctagtactactagtactatttgtctagtagtactactgctgctgccctacacagtggcgcgctttagtactacggtactactggtacagtactactttactctactactactaatattatacaaacttgtatacaatatgtacaaactttgtatgtgacatgtacaaactttatattacgatatgtacaaactttgtatacgtacgtattaaaaaatcgaaaaaacaaaaaaaatcacgtatataaagtttgtatacgtatgaatataaaatttgtatacacgtatataaagtttgtatacatgaatacaaagtttgtatacgtacgtatacaga

SEQ ID NO: 15111 - DNA, 1501 bp, Oryza sativa
tatacttaaaataaagaagaagtagctatgcttgcaatgcatatttattttagaataatatttttccacttgtacttggagtattatttgtttgcagagattagcacataaattaatggagaagaaaaaaaaggaaaaactcactcttaagcaagctcaaggatagagaggcccacatgcaggtgaaaccatcctagaaaccgccataactgtcacaaccgtcatgagtacccatctgtcagcccttgtacaaagtttggaggcctgctgggccgctcaggttcggctgaaccaggggttcagccaaaccctggcaatgtcggttcagcctggccttacacgtggatgtccaggattgcttgctgatggccgttgcgggccatttccgacatttcgcatactctacaaccgtcatacctgcctatttaaggaggagctcattcacactccaacacacactcaagcaagaagctttgatctctctctcaagtttagttagtgctctagtgctaagtggaatggaataggatagttctcggagtcctcgagtctttggaagatttcggtatggctctagtagtttttccttccttttttgtaagaccctcggaattaatggaatattcttctttgtatacctacggtactttgcattgtctgagtactggttttactttatgtttgtgtcaatatagttgaatgactagcccaccagagaggtgcaatagtttgggtttaatgttcatgcaaatgattgctctatgttattctagaggacatagagtagtatttgataatgtatatatgctgcgagacagtagattattaaatatcattaattaggcatatatgctgcgagacagtagaggtggactattgatggtaacagttcagtacgtgtattcctacacgttagtatatatttctaagacaatttcctggggacggcactcctccgtatttaccccggttggacggccatgacagattgtcataagaaacttgacaacctagggtggtctctcgaagcaccaggagggcactgttacggggtattggtcagtacaactgtatactaacagatgtaaacgaaagttgagtctgtattagaattatatgaatgattacttttctatttcttcttccacattagtctagaattatttaagtgagagaatctaagtctttctgctctgtgtcactccacccatatgattaaagtaacccctgcatagactttgacatatatatatatatatatagatatatataacatatataagatattggcagagttctctcttttataaatcttcccttgggatcaaataaatatgatacattggaatacttctgggtgaaatgctacaatagtatattcatgcgcttgcggattacttctgtaaccataaatatatcagtgctattctgtgccattgctaggaattcgtatttttagtaatgtcattaagaaataccaacaatggtcacgttgcgatat

SEQ ID NO: 15112 - DNA, 1501 bp, Oryza sativa
gcagcgtgcctgcccaccgccggccggccactccggcccgcgtcgttgcccgcttcgcccaccatttgcccggtcctccggcaggccggtgcggctgccgcatcaccggtcgtttccgcgtggcggtgggcgacggcgcgcggtgcctgtcgctccggtgcccggacccgtcctgctcggtcgccggcgaaacaaacaacaaaactctcgcatatcaaatttggcacgagctctcgcatagccgctgaaaatttacaagcacaaagatactatccggcaatccaggccatagatgacgacgattaatttatgagcagattaagaaccaattaaacagtacacgaagaaacggggagagaattcgaagaacgatgaaagcgaacaagtccctagaccatgcggctagctgggcaagggcgccggcagctggaacggctccggcagccggacctcgcctcctgctgcgatcgaccggctgcagccgaagcagctccagcaagccatcaccccaaccccttcccttccttcccaacccgccggccgacctgcccacccagacgaggagaaacctgagagagaagaggcgacgggcggagcggcagcctcgccgtcgcgtgcctccacgctcgcccacgccgtcgccttcggcctgccctcccgcgtggcagccgccgccgccgcctcctctccgccacgacgctcgcatccgccgccatcgcctctccgccgcagctaccgcctccgccctctccgccacgacactcgcacgcctgctgccgcctctccgccacaacgctggtccgctgccttccccttctctcgtgtctcagccgccacgttgccgccgccgcatcgcccgccggccgtcggacctctcaccctggcaaccccctccccaccgccggccgccctgctgatgacgttgcatcctaacaagtcgagacgaaaggaggggacaggaaaggaagggagaggctggccgacgtggcatcctgacatatggggcccacgtgggttccacgctgagtcagccgccatgtcagctaaaaccgggatcagtatgcactggttttataagttgggggatgcgttgtatccggttttgtggttgggggacgattttgtaactcgatgccaagttgagggaccttcggtgtacttttttcctcgagagaattttgcatcccaaggaaattcaaattcaggcccatatagaaagcccaaatgcaacccaagttcatccaaatcggcccattccaatctaaccgggccggttggtgcggcccacatgacgggatcgccaccggccggccaggctgtagcctctctgaccttcggctcgtcatctccccctttcaccgtgcgctgcttcggtttgctcgggcggagaaaggaagggcagcgtcgcggttgcttgcttcctcccgaatcctcgcctcgatctcgctcgcgggcgggcggagggatcgtgatcgggatcgggatcgggggcgcgcgaaga

SEQ ID NO: 15113 - DNA, 1501 bp, Oryza sativa
ttcatatcagatgccatgtttttcagagtttccagcccttcaccgataatatccaaaccttcatcctgcagaatttcaattccatacacaggtcaccttacataagaaatcccacttccagcagtagccaaaaatgaaaaggaagaaaagcgtgttcggggaattaatatattacctgtttcattttgcgcatctcatattcccgacgaaactgatttgattcttctgttcccttaaagtactcatcatcaaagttgccatctgtatgtggcaagcgggaaagtaggtcagctcatggctccttcaagaggaccaacaaaagcatctaacaggatcatgcccgaaatgatgagaaaagaaacagaaaaaccattgctcaaacaactttaggcatgactgcacgcatggttaatcagtcagctcatgactccttcaagaggaccaacaagagcatccaacaggagcatgcccgaaatgatgagaaaagaaacagaaaaccattgctcaaacaactttaggcatgatggcacgcatggttgatcaaaactctgtcaatctgatggttgtatatttcaacactgtcatactgatatagaaacaagagttacctaatcaaaatatacactaacatagtgtactaaaaagtagaagttggcacgtgacattgatgatggtgcggtaccaaaaatgacgtcgtaaaaaagcacatgtgcatatggaagcatgaacctaatattaggattccttcataaattggaaacgcgacctcatacacatgcaggatacttataaaatgaaccgacaaatgcaaaatgtacagcttactgcaatctagaacaaccgatgcgtaggggaagtagaagttggacacatctttaaagaaaaaaaatatgcatattttgtatatcaatatacagaacacacatgtgatatgttgaatgatgcttactaaccagaagtgtcaaacttaatggctccaccagtacgggatcctgaggcgccccaagtcccatttttctttgcacttgaactaccatctggtattgattgtattctatcgggtaaggcagcaaccagatcactacgggtcgcgagttcctcttttgtgagccctttgacctgttgcaagttgcaacaaaatattgaaaaccaattcttcaaaattctaggtgaaaaactgttatgtacaatttatagatatcatataattgaataatgtaaaagcatgttttaaaaatatagtataaccaacacaggcatgtatgaagaaagagtgtcaaggacatcacattgcctagtgcaaacatgcaggtggcgtggacagaaatctttagcaagggaacaacaatcttacaaagttaacactatggcaatgtcaagttaaaatgtagagtacattaagttctgggtcaacagaaaatattggaaggcttaacatcaactgcatcacctttacccaatagcctaattaaaataaataaatctagtctttaataaacac

SEQ ID NO: 15114 - DNA, 1501 bp, Oryza sativa
caccttttactaccgatggaactgagttttactggtgggtccgtccgagtttcattttttactactaccttttctttgccataaaaaaataaaaggggaaaatggcgagccaccctgccgcgtggggcgtctactattctttctctcctctcgctgttcccgacggaggaagggtggcagtggcacgcacgcacgccggcctcgcctcagcctcgcctcctcgcgcgcgcgcggccggacgggaggcacacggtgcgcggccggccggcctcattcgctcacctcgtaagccttcctcctccctcctccgtgcggttccatgatgcggcgaggcgaggcgcggattggggttggattggtttcttttttttttctcttccaattattgacttcgatgctgcgtgctcgccgtgctgtgctgtttcttccggatttctttgatgcgcgctgcagtgcttaatcgagagggttttttttttgtttttcttcgaaagggtttcaaccgaaataccgaatccccctctgcccccaaagctggtttcgtttgaggtgtagccgcatcttcctcttttctttccttttttatttttgggtgagggtttggagtgaatcttctatcttgcttttgcttcctgtgtcgaatgcttggagttcttttgctggaaaattcttcatgaatatctagcaccatttgcagcttcaaagcagtacgggctctgttcatcggtgtaatgcgttcgtattttgcttccttcaaatcttcatcctgtcttgcattttatatcgcccgcattttctgaagttctctgagctaatgtggagtcggatatggatttagggtgatctgatttgatgacggtttttatggtttttttcttttcaatctgatgcgcacaatagtttgtgcacggacaataattaagctaacggttagcaattatagcatttggtatcaacattttcattacgagtttcatgccagtctagatggtactgtgtacttgtaagttctcagtgacaacgagaaacagcagaaggatgactacttccagtaaaccacttaatcatttagattcagtccgatcaaaaaaaatcatttagattcagtgattttctgtctgcttcgatgagatttagtaaaccacttagattctgtattgcatcgccgttaatcattttatttgttaatcattttatttcataatttcttgtagctatgctttttttcttttcatggttcatgtgattatgtgaaggctcttgaatattttggtttcttgtttcaacaagttgtgtgtgttagctcttcctctactattgctatccgttgcttgaagttctggcaattgtgatgttgactatcagcaagttcctttactatacacactatttgttccttttcataagtcttaagcagaaggtacgattgctcatttgtatggtaagcatttcaatattctgaaatgcaggtcattgaactatataaaaaggttgtttgtca

SEQ ID NO: 15115 - DNA, 1501 bp, Oryza sativa
actttacttgaaaagcctttatggctatttgtgtacttcctaaatatagtttagagcattttaacaaaggccctacatatctcgatctactccttgaaaatagaaggaattaatggcgactgtgttagcgtgctctacgtattcgcgatagacttatataagaattacagtggcttgtatttgcatatatgtgtgtgtacactagctgtttttaatttggtcaatacatgattgagtttgaattaataacttttaaatttaaattcagtttaaatttattgacaatgaggtgggcatattcctagatctctaaaagctcacataagtcatcgccggccttccatccacttggagtcggatctctacgggtagctgtcatcacttgcacggtggtgtccctcttcctgagaaaaccagagagagagagagagcagcagtcagcatagcaaagaagaaagcccacaagatcacaaaaaataaggatggatacatggaaggaaggatggtggtacatgacatgttcaccttttttttttcctctctctctctctctctctctttcctttctttccctgctaattgctacctcatctatcccttccacctcactctcactgatcttgtctctctttctctttctctctctctcacctgttattagtcttggctagctttcttctcttctgattccctccactatctctccaactttggccacatacaccacaaacaaaatacaaggtagctagctatagctgcagaagagaagggaaagcaatcaggcatcagcagctagggagagagagaaaagaaaaacacaaggccttgccaaaccctagcactttaattctctatcttctctccagagtcaccagacctcagctcagctcagctcagcatcacttgctacccaccaccatgatcttcccccctgccttcctggattcctcgagctggaatgataacaacaacaacaaccacaaccagcagcagcagcaggtaataatcaatttccagtcatcatcttcttcctagctcatcccctttctttctttctttctctttcttttccgtcaagagattttattcattctcttttgcgcaagagcacaaataaaagctacaaagttgtggcgatatatatatattaaaatttggaaaagaaaaatttaaagagatgtgagaatacttgctagggctagctcaatattccgatccggagcactgtcttggtatatacttactgcccaaataatcgtcttcttcttccatctttcttgctagctagatgcttctcttgtcgatctctagctaatatatatatacaattaagcttgtgtttaattgatttggtttgattcattaattcagcaacatgctcacggccaccaccagcatcatcaggtcgccgccggttgtggaggcggcggcggcggcggcgacggcaatagccatgagcttctgcagcagcagtcaatgattccgggcacgcttgccgatg

SEQ ID NO: 15116 - DNA, 1501 bp, Oryza sativa
tggaaggagtacctcgcaagcaagtgcatatggagatggttaattacaaaatataactatatgagtcataaaagaaaatatacatagtaactaatacatacaacccctcatcctctctctagataactttttctctttcctccctctcttccccctctcaagtaaaggaaaaaaaaggggggaattttactaactctcttcaagttctacaggatgtccaagagacaggacacatgcaactaccaacttcagagcctcaatctcatgttggccggctagctagctaccatgtctagaccccacagtacatccaacatttttgtgacattttgcatgcaactccaagcaactggggagagaaatagtcttgggccttaatctaactagcttactatagcttgagtattatacttgcactatttttatgtacacaatgttataggatcaccaggtgaataagattcaatttttaagtttgtagtatagtgttaatacatcttgttttgcctgctgccggaaatctaacaaattaaaagtttattcgaactaagccttattgttcttattaatgagaacagtgataacaagttgattcgtctgctcgtacgtcgctaattgcttgttagctaggtactatataccaggtacgtaaaattaagctttgcacaggagcgattagctagcaattagtacgtaaaattaattgcttgttaggaaaaaaatagggtcgcttagcaactacagttccaacaagaaattaatcaattgtttaactaaaattgtgcattttgatcgtggcctataactaataaggacgtacgtacaatgcaacttgatcaaatatatagtcgcaccagcaatcaactgcacgtacgaagaaatcactgtataaaatgggcccagatttttgacaaacttgcagtcatttttatgtttacaggtaggatatgccaatcattcgttaactcacgtgcggttaataatttggaccatttgctttgagattcagcggtacaatatttaattgcaaaactaaatatgatttccctaattttttcctttttagctgttgtaccataattggaaacctagaattttagtgaaaattactatttcaatcaaatactagtatagacgtcctttcaacatactgtaggtaagttgctataggaaccgtcatatcgatcggcttatcttaagcagcataacttaactggttagattcctggtgatggagccagcccacccggattcaactcttagatttgatatgcacccctttgacagtgaagcgtctatgatgacttcgtcaaccctcacgataccgttggcctagtcttccaggatacttatagaggtcgaggagtacgtgtatacgctcatagagggtgagtgtgagtgagtgtgtgtgtgtgtgtgtgtgtgtgtgtgtgtgtgtgtgttatgacttatgagtgtgtcggaggatgaactcctccggcgggggaccatgagagcactc

SEQ ID NO: 15117 - DNA, 1501 bp, Oryza sativa
catttttaaaaaagtcaacggcgtcaaacattttgggatggaggtagtacaaaatatatactttctccttttctttattaatgtatgtatgacatcttgccttttgacatgacgtttgatattttttttttattaaaaaaaatttacataaacattatttattacaaatatagttacaataaatttagaaaactaaggatagttgaaactataaaccacacggaacattttaactgtttaactccaaattatttatgtgccatttatcgtaggacatgtttgaagctggtacagatacatcacacctagttctagaatatgctatggtcgagctcacacgcaaaccacacattctaacaaagctacaagatgaggtgagacgcatcacaccgaaaggacaacatatggtaaccgaagatgatatcgtcggcatggtctacttgaaggctgtcatcaaggagacacttcggctacatgcaccgggaggtttcactattccccacctcgccagagaagattgcaacgttgatggctacatgatcccagcaggaacacgtgtacttattaacttgtgggcacttagtagggatgctaattactgggacaagccagatgagttcttacccgagagattcatggatggaagtaataagaacaccgactttaaggggcaagacttccagttcttgccatttggatcaggacgaagaatgtgccctggaattcattctggaaaggtcacactcgagattatgttggcgaacctcgtatactgtttcaactggaagctaccgtcagggatgaagaaggaggatatcgatatgacagatgtgtttggattggccatacatcggaaggagaagctcttcttagtcccgcaaattgctaattattgaggatagatatatatgctgtgcaacattgtgtcgatatatatgcatcctgcatatatagccatgcatgcggtacaacattgggtcaaggtctacagtatccatctaaattaattatcagtgttagatgttatcgtgagtacagtcctgtaagtgtgttcaactacttgtagaataagctattcttagcacatgtcaacttacaatgtttgcataaaagtataacatttgtgtcgcactccatttgtacttttggatgtacatcaacaaaaccttcattggcccttgttggaatcctaactaccgtggtgaatttttttttaaaaaagaatgatatgattggctttcacttttaggtcatagctcaattcgtacatgtcgaaatgcaagttaaattcagaatccaaacaaggccaataatcgcctaacatttgcagcccaagctagatacactggacttcatgttagcgtagtacatgtacacagtgtagcccatccaatacggcccggcccatctactgaccatcattttgcttgcattttccttccaagaaacgaccaaattaaaagaagttaacacatactgtagtacatatgtatgtactttt

SEQ ID NO: 15118 - DNA, 1501 bp, Oryza sativa
aaaacacaaaggcaaataggtaaatgctatggaacgcatggtgaacaacccgcgggagtactgtaataccgattagttggatctagaggaactcaggcaaattaaagtactacctccttgattggatctcatgtcaactagcttttcagagacctaaaaagatagaagcccctctcctctctctgcaactagagaggtaggcaaacctgagttgatatgtcgaaacaccaaccggatcagaaacctcatcctaaacttacttcgaaataggttcgagagcttccatttcaatgtgtctttcgacaattatatatgttgatcctgaatgtaggccgatgcactgagatattaattaaagcttatcaatattcgcgaagtttgtgattatgatcattagcaatataaatctattaatcacaatcttgattgaacaattaaatttttataacaagatgtcacactattatacatatttctaatgccattgaaattcaaagtttcacgtgtaagaagaatttaattttaatttgattgtgttgcatattcaaaattttaactttattaatttttctatgtttctcaatgtatcatgtactagtaattgatactgtagtcaatatatttttaatgttacattgttttaaaaaaaataaaagtaagtttaaacatttaagaacgtgatgcaatattatatttctctaaagtgataaaacaatgcctgatttttggatccccggccctataattattgaggagacaaagaaccttttttaaagatacaagaactaattggtgaacggttgctcgcagaaccattaattgaattcaccgtaccccgctagcccttgttacttccagtctcttcaaaacagacgacgccgaacacgacttggtatatttattttcaaggtagccggccggaatatatgctagagaagtaaagtaaagtaaaaatcgtaacaaacaaagtagtttgacaaagtttgtgtcaagtatatctttctctttctaaacataccagcatcgttatcttcaggacttcagcgtgataatccgacgaacagttaattggttaattccattgtttcgcgctcgtggtttcttacttgacgcacgtgcaatcgcgtgcttgctaacgcgttctagctacccgtacgtactgtcgtactccaggtctccagcatatagctagcatcgcgtgcatgctaatggcgctgtacgtatagcacggccagttgtacggtgaaggtgaaaaggtaattcgtcgttgtcgttggatgtatcgccacgcattgacgcatccatgcctgcacgccacgccgccgacggcgcgcacccaacacaacacaatacgtccgcgccgacgcgcgtgcacataccataatacccatctccctatatatatccatgcaatacacctcgcatcaatcatccatcgcggctagctccgtcgtgtaatctcgagaggtttgcaaagccaattaagcgtaagatcgatcaa

SEQ ID NO: 15119 - DNA, 1501 bp, Oryza sativa
aacttttccgtcctgcatcagtactcctcctagtccttgcctcgatgcatcacaatatataagaaagtctttcctgttgtcgggaagaaacagaataggtgccgaggtcagcttttctttgagctgctcaaagctttcttgacactgttctgaccatacaaacttcttttctttcttgagtagttgtgttataggtcgggctatcttagagaacccctcaatgaacctccggtagtatccggccaaacctagaaaactccgaatcttagtcacagatttgggtgccttccattccgtaatggcctcaactttagcaggatccactgctactccaccggctgagattacatggcctagaaaagcgacttcttctaaccagaactcacatttactaaactttgcatataatttatgcttccgaagtttctcgagtaccaatcgcaagtgttccgcatgctcttcctcatccttggagtagattaaaatatcatcgatgaatactaccacaaatttgtccaagtaatccatgaacaccttattcatgagattcataaagtatgccggggcgttggttaatccaaacgatatcactgcaaactcatacaatccataacacgttgagaacgcggtcttaggtatatccccggtcctaattttcaattggtggtatcctgatcgaaggtcaatcttagagaacaccttagctccttcaagttgatcgaagagatcatcagtccgtggtagtgggtacttgtttttgaaagttacttcgttcagtgagcggtagtccacacacattctcatgctaccatctttcttcttaacgaataacactggggctccccaaggtgacgaactgggacgtacaaatcccttttcttgcaactctctgatttgctttttaagttcttccaactcattgactggcatccgatatggtctcttggatatgggagcagttccgggtatcaggtcaataatgaactctatgtcacgatctggtggcattccaggtaaatcttctgggaacacatcaggaaatcgcttcactacgggcattccctttaggggtagcttggtaaatatgcctctggcacgttcggttagtctaggatcttgatccacggtcgctgtcatatccgatccccaaggtgtggtcagggtaacttccctacgtctacagtcgattactgtcacaccccgaagttttccccccaagccaaaattttaatttataaatgaccctataaagatgccggtgcaaagcaagagtaaacccttttaaatcaatgcaaataataatcggaattggcatgtggaatttttcttgagttctacatgtcgaaattcactaacaggatttttagtggaattttcagagctctagaaataattttaaccaattaaaaaagagtaagcaatattttaattccagggaaaatccttttaccttttgcattatcttagtcctctctattgccaactttttttcgaatgggcc

SEQ ID NO: 15120 - DNA, 1501 bp, Oryza sativa
atttccacatttatagagtgatttcccctaaaagtcacttcgtacggtgtcctacagttaacaccgcgaaagtcacgattcctgtagtgttgggatgcgaattctttcgttctgtgtccctgccgtctccatctaacagctcatccctcagatgccattgtgtgtcaggccgtcccaagtgactgtagccctctgccccaatcaccaacttgatcaccgtactcacaactgtgaggcactgctcttcaccatcgaggacgtccatctcatctcctacatcattgctatcatcaccaacaaacatatgcaagaaggagctcatgttggggttgtccataccgtactagctcaagccgccgtcaatggctcctaaattcaactcgccacctatcttagtctcagctttgcctcttcctcgctttcctcccggtggcagccccactacacgccactgtgcctcgttgcagtcacacacttgtatcattgccacacatttccttgccaccgacggtctgatctgttagctgtgcttgcactttcactgggatgcaaacgacaacgtcgtgccgtggaagagacccgcccggccaccacgttgcctcattgcctgctaccaccaatgaggctatctctcattgtgcacaccttgccaaggcaggggttgagagttgaggctgcctcgcgatgggcttgcatctagcgcgaggcaacaaagtgggacaatctcattgacgtcctcttagcaggcggccacgtgcgcggccgacaatgtccgcctacacggtgtgaatttatatctttggtgataatttttaaaaagttagtgaattggattgcaaatttcggaatgtcatgaagcttgaaattttcaagagcccctaaatgaagggtaaaatatgtgcttgtcaattatcctagctagtataaacataatagggttaaaaaaaaggagcactacccataatccataaacttccccaaacacaaacaaatcacgccgccggcggctctgctcaccgccagccgccttccaccgccttcgccatgcttcactttcgagaactcctcccgctcctccgctccgccatcgccgccgtggcctctaaccctgccagccacacactaccctctctccacctccgcaccctccgcttatggactccgcaactgcgacatcgcatcgaggctcgagttcttgatccctttgttgggctcctacgaggtgcttctcaagaccgtcaagcgaagctaccgcatcctcacctccgacatagaggaggtcatcaagcccaacttcgcgcagctccaggagtgcgggctaactgtttgtgatattgtcaagaccaacccgaggctgctctcgttcaatccagagcgaatcaagcgctatgtgcatcgtgccgatatgcttggcgtgccccgttgctcgccggcattcaggatggccgtgtgctctaccaatgaaggcagcgtcactgcgaggatggagttcttgagcagg

SEQ ID NO: 15121 - DNA, 1501 bp, Oryza sativa
gtttcaaatttgatccaaattttggtaaactttcacaaaaatttgacaaattaaattactgctatagaatggcattgagatatttgtattttgattatgtcaaaagtgcgagaaaatatctaagagtatacctatctttttacccccacatttaacaccgttagccagaattaacggaacagaggcaaacggttgattcgtttcaaaaaaagtggggataaaaacaaaaacctaaaaaaacatgggcaaaatcaatattggacatcaaagtaggggcaagaataaaattgtccctaatatgaacatgtgctctatgtaccgaaacatgattcaagaagattcagaaatagttgcgctactgaatcatgataaaaaaatcagaattttttagaaaggttacgtgtgtatatatattgggtttaatatatatagtataactagtcagtcatttggattgatactaatttttacccaaatcaacagagttgatactactcttccctattatagtaaaaacttactcaaaggtttaacactaccaattagggtttcgaaccaaacatatccttactactaaaagtattgagtaattgatttattttgtaaaacgtgcgcgacccatgtttacaaaagaggtgaatatggtcaatggataacccacataacacacatttgatatgattttgtaatgtcaattcaagatgaactactaattaagttattatacccaccttgcaatttattatattattagttaatttagtagaaaggtactaagaacctgtttagtttgctactactactttcaaatctatcagaatttagtggtactaaacggtgatagaataacaaactaaacatatgtatgctaatgtcattctatcatcatttcgcatttttggaagtttgtccttacgaaaaggctagcaaaatttagtgaggcaatgaatgaaaagacatctagcgatactaaaattaaaatttgataaccctaaaatgtgtcaaactttggcatttcgtgaaaatccttcaatgcgaattttttgtgggaagtttgatttttttttcctttgattgatcatgaggtgggctggggctgagatgggccttaatttgcagtggatcagataggcacacggaccagaataatccaaatcggaggactcgtttctgaaagcattatccctcccacacaaggaggaaatatatatatacatccccgcaaaaaaaaaagaaatatatatatatatatatatatatatatatatatatatatatatatatatatatatatatacagaaagagaaaaaaaaaactttgatctggaaggaagggagagagaaaccgaaacgagtcaaacagaagaaacaaacagacacgtaaggaggagaaatttcccctcccttccctgctcttttcgtactacttgcaaggaggagaaagaagaacacgaggaggaaatccaagccaatcgccgcctccgcctccgattccttccga

SEQ ID NO: 15122 - DNA, 1501 bp, Oryza sativa
ggcgagcaagacaaagaggcggaggaaggagatgaggaggaagaaggggatgaggacagagaagaggaggcggatgagctcggtccctcgcagctagaggacgcaccagagtcgtcacagccagatatctcgcagcccggcccgtctcgaccacgacgccggcgggctccttcgcaggactggaggtacacccccgacgtgcctcgtcctcgcactagaggtaggaggaggtgagtgcatggttcaatggatggatggatagatggatggacttgatgcatggttcgatggatgtatggactggatgtatggactcgactggatgtatagacgaggatcgatgggatgtttttatttcttatatatatggacttcatatatggatgtattgatggattctatggatgtatggaatgatgttgggattgatggatggatgtatgttttgtatggttctctggatatattactgcctgtaaatttctatgatttgatgtttgcctctgttgtgtgcaaagttttgctaaagtttagcagggctcacctggcgctgaggtcccagcccagccatccagaaggcttgctgggctgggccacggccgaaacggccaagtcccacctcagcgccaggtgggctggcgctgagtttccaatagtcagcgccattatggctggcgctgaggtcccagcccgcaagccatccagcaggcttgctggtctgggccttgggggttgcggccaagtcccacctcagcgccaggtgggctggcgctgaggtcccagcccgcaagccatccagcaggcttgctggtctgggccttgggggttgcggccaagtcccacctcagcgccagtccggttggcgctgaggtagctgccacgtcagctggggatcggcccggccgccacggtggcacaatgtcagcgccagtcccgttggcgctgacacggccaacgtcgctgaggcgacggcctattttttgttgaagtttttggcaggggttagtttcgaaataagttttccaaaagggtcaatttgtcaaaaaaaaaaaaaacggacccaattagctgtcccttcttccacgattcggttcccatgtccatgtacggcacaaatgccgaacagacgggcaaccaaaaccgcatttacttgctgacattgtggcaagaaccgaaacacgtccctttcattgtgccacactcatacaccattaatcctctcaagaaaagaaaacgaaaaagaaagaaaaaaaagagagaggagtgcattgcccgcgtgtccggcgtgcgcgagggtttaaacaaccaacccccctcctcaccgctctctcgagcttcgacataaaacggggaggaaatcaatcctcctcccccccttatcccctcttccttcttcgcttcttcttcttcctccgcattaattctctcttccattccgcctcgcctcgcctcgcctctcgcggccaagcagatccggccaccgcctgcccaccgacgacga

SEQ ID NO: 15123 - DNA, 1068 bp, Oryza sativa
gaatatctctacgaagactcgagtcagattctaaacttgtatgtcaaggaaatacccgggattttagtcggttatgattgtattttatctataatcccatattccgttacatcccggcctagggcttaataggattaatagaatactcatatcaacaagttgcaacttcttttccggaagccaatctccaaaaaaactccagggttaagcgtgcttggcccagagcaatttgggatgggtgaccgaccgggaaattcttcccgggtgcacacgagtgaggacaaagtgtgcagaaaagacatgtgttggtttgttggtttgtgagggcagtctatgacctatgaaagctatcaaatgtaagcgggcccggcctggggtaaggcagcatggcacatgcgctggcactggacacatgaacgtggccaagagaggacgttcctggcctagggttgatcgacggggcgtcgatctctcttaagggggtgagggtgtaacatcccggcctagggcttaataggatgggtggcccagagcaatttaggatgggtgaccgaccgggaaattcttcctaggtgcacacgagtgaggacaaagtgtgcagaaaagacggatgggtgaccgaccgggaaattcttcctaggtgcacacgagtgaggacaaagtgtgcagaaaagacatgtgttggtctgtgagggcagtctatgacttatgaaagctatcagatgtaagcgggcccggcctggggtaaggcgggacgttacagatatggactgtattttgtaaagcggactccttcccctatttaaggagggtccgtgtgcctcttggggggcgattctttttttccactttatacaatcaataacacactcggcggaatcatccccggacaggagtagggtattacttcttgaataagaaggcctgaacctgtataaaattccttgtctcaaaacccatccactttcctagcttgatagccacccccttttattattgtcgaaatcttgcttcgacagttggcgcgccaggtaggggcagcatcaagttctcgccgactaagtgcga

SEQ ID NO: 15124 - DNA, 1501 bp, Oryza sativa
gcgccgtcgtcgtgctcgacatgcgcgcgcccggggtgccggtggccgaactacacagacaccgggcgtgcgccaacgcggtcgcttgggcgccacaggccacgaggcacctttgctcggctggggacgacggccaagcgctgatttgggagctgccagcgacgcccggcgcagtgccggccgaggggattgatcctgtgatggtgtatgatgccggtgcagagataaaccaactgcaatgggcggcagcttacccggagtggatatcgattgcctttgagaacaaggtccagcttctcagggtctgacgaggttggttcctttggcccttcatggttcaaatagtctattgattcatagcataatatttttaagattgaataatgctgattctaaacattagtattagattttgggattgttgaatttgatttatcagaagcttctacattatactgcaaaagtaacctcattcatcagtcctataaaggttagaatttcctaatattgttgggtgaactcaatttgtgatgaactgtctggtggatatgtttctggaatgatcgacaatacaagatgcctcatttccatacaaactagaaggcatgattattatagtggtgttgtacttgcaccaactgaacaaaggttatcggttcaaaccaaatcgaaacatcaatcagcacacaagcactttttatgacactttgtcaccttcatttgtccattatttcatcctgtgattgtaccacctcctctgccccttccctcaatgttagtcagcactgaccaggattagatgaaatcttcttattttcttgatgtcctggacttgtgtctatttatgatcgtaagttatattctgactgttgatggaaaaaaaaaacagatttagactatgctccattcttttcattattctgtttacaaggtgtaaattcccatcacaacaagagccaacaaggtattttgttcaacatcaaataagaagcgctaactagaagcagaacctagtatgtctgactgccatttatcctaccgtactcgcacttcagatactgtttctggatattattgtctatgtcagtgtccttgtaatatatatgtttcttttaatcttagtcccaacagttctaattctatattgagtaatttgatattttttgcagcagattgtttaatctatctgtataaacataaagcccatacaacaattcctaggcctccctgcttactcttctctggtgcaagctgcattttatttgcttagatgatatattctttaatgccagcatgacataccgccaaatttcgcaatccaagcaatgttcaaatcgcttcacaactgggacatcaatggaacatggcatggaatttgattatgttctacttcgaaaatatttaacttctccttcagctgcctagcatttctaatgtcttgtgaatcatcttaacctttgtctattatcgatgtagtaaccctgtacatttgatatgaaac

SEQ ID NO: 15125 - DNA, 1501 bp, Oryza sativa
cttggtgcaaagatcatgtggccaaaaaaacatcaaatgccaggaaaaaaatcgcgggagatgtttagcaaaatcggctttgtatagtccaaaaacttcctatttcgaacatgaaatgggcccgtcattatatgtgggaataagttcatctgaggtctcttaacttgtcaacgaatccgattttcgtccttgaaccgaaaaaccagatacaacgggtccctcaactatcaaaaccagtgcagattaggtccttcagcggtttagatggcggttttggatgacgtggcgcctacgtggctaatttgacttgtcttcatctgacgtggcattgacgtggcgctgatgtgtcaattagatttgaaaaaataataaaacccatgggacccatatgtcagtttcacatataaaataataataaatggtgggacccacgtgggccccacatgtcatatctatcctcttcacctttcaccttccccttccacttccccttccccggcgtgtcgacgacggtgcggcagaatgggcaggagcggggtgcggcgccagcctcgagccagggagtgcgcaggcccagtgaaagtggcggccgtaggggaggtgggccatggcgtcgccggcggagaactcctctaggcacacgtgcactccgcctgctccgccgcgtcccaccgcagtcgactccaccgcatcagccgccgcatcacccctttcttcgagtacaccgccctctgcacccccatcgccgccgtcactgtcgatctcccccctccactgctggctctgttcagcttgatgcttcctgtgctgtgatgcctgcagaaacgaaacgacgaaaaacaattcagcaaaatttcaatccatctttcttcttttcaaaaaaacaaatgatttgatctttgcatcatcagttacctcttgatgacggcttccatctggttcctcagcttctggtccagccgctccttcgcctcccaggcattgatgtccatcgaccaccgatggatgagctccatcacactgctcctctgctgcgagtcccccaacaaaccaaaccaaccaattcatctcgtcggtcaaccaatcaatcgaacaatcaatccgtcgtgcgtaccttgccggaataattcgcggcgccatcgacgtgtgcttctccggcgccggcgaccggcagcaaattcacgtagtgaacggtgatccttctcatggcaccaggctgccccacggtggccacccggacaagacaagtgtcaggcaagaaccagtttacctgcagattatggcgcaccaattaatcagtcaagaacaagatgcaaccttccttgatttaacctcttctctacagatgtggacataagaggagaaactttctccacccccgtgtcgctccagggcaggggcgaccgccgccggcaggccaccacccccgcgcccctccctcctccgcctcgcgtgccgtcgctgccatgcacgagagagaaagggtaaaggggaaggtgaa

SEQ ID NO: 15126 - DNA, 1501 bp, Oryza sativa
caccctccctgtggcgtcagcccataccactagagcacaccgtgccctccctgtggctcccgcgatgctcgaagccctcctcgtgaggggtgcacaaaagcttgaaactcatgagctaactcaactcgagtaaaactcgggtcgacttgagtagttaatgagtcgagttgagtttgaacttttacttgtttgcttaacgagccaactcgagctagctcatgagttacttggttagctcgctgagctcatgatgcattaagatagaaattgattgttcatattttgcaggtgtaaaagtcgtgaactcataattatacattatagcacaatcttatgagtcatgatacatagcatggcaatcataatctttggtcataaaatcacaaattatactgcatatgaattttaaaccatgtatttcggtgtaacgagtttagtgagtttaatgaatcaactcagacttttattgtgtcgagtcgagttccatttttaacttgttatgttaacgagtcgagccaagatagctctttaacttaacgagtttttacgagtcgaggtaagtcggcttgtgagccacccaacctcgtggcgtcggcccaggctgccgaagcacgccgcatgctccttgtggccgctgcgttgctcaagcaccgtcacgttgaggccctctcacagtctggctcctttccccgctgaccaccacccactgccctggagaaaaagagaaaataaaaaggaatgaagaaaatgtgacactaacactgagtcagccgattggactgggtctaagcaccatgtcagcgaaattaaaccacactccaaaacggttaagggagtcaaattataccaatttcaatagttagggtagtcatccggttttccgattaaggggtacgaataggattgtacctacttttttaagggagttaaagtagactttttgcatttaagccttggaatggcctacgtactcacatataaggaataagttcatctgaggtcccttaacttgtcaacgaatccgattttcatccttgaaccgaaaaaccagatacaacgggtccctcaactatcaaaaccggtgcagattaggtccttcagcggtttagatagcggttttggatggcgtggcgcctacgtggctaatttgatttgttttcatctgacgtggcattgacgtggcgctgacgtggcaattagatttgaaaaaataataaaacccatgggacccatatgtcagtttcacatataaaataataataaatggtgggacccacgtgggccccacatgtcatatctatcctcttgtaacatcccggcctagggcttaataagattaatagaatactcatatcaacaagttgcaacttcttttccggaagccaatctccaaagaactccagggttaagcgtgcttagcctggagcaatttgggatggttcccgggtgcacacgagtgaggacaaagtgttgcagaaaagacatgtgttggtctgtgagg

SEQ ID NO: 15127 - DNA, 1501 bp, Oryza sativa
acctatctgtttgactaaaatatcttagtttatttcacttgcaacaaaagttaaacatgtaatttgcatactaattcaactatgttagtggtgttccaagcaagcatgctgcactgctcaacacacaaaaccacccaaaaaccaggagcaagtgatgacttctagaaacaaaactattctatccatcaaattggacgggccgtgtgctacaaagtaaaggggccgagaaatggaaaggggcgaacgcatagaatataggggtcgtgagcccacgaggtgtagctgctccttataatatcatcagaagaccatgccaattgccaccctgcgccctggttttgctcttgctcggccacctgattcgccacatagcactcaaaggagccagctttagatttgttgccacttggccagctagatgcctaacctggtaataaccacaattttttttctgtcttgctttctttaatttggaggatccaacctttcgttggaggatggatgtattcttacatcttactccccatgcttttaacaaagacttcaattgggacaatgagtttacgattagcttgtcgttttcctgcagcaatataattttcacttttggcaagggaagatcatagtaacgccacatgcatacgaacgtggttgtttttaatatgataataaaatgttcagctatgcgttatgcatgacctcaggattgatttttaccatttctacgttaatgcaaagtctccgcggacgtaattaataatttgtctttttatcattcttctgtactatctttaattttatcgtcactctggtaatgatacacgttcacggatcaaatgtatttaaaacaagttcagctaagaagagcatcaatgatataaaaactgctggagagatgatcgacaagagcaatctattgttagtccaagggttttttcaaaaatagtgatagtctgatggatggtgaatgaaaccgagtttataacaattatctaaaagaaaaaactaatgagctgtatatattgtaaattaattaagttgataagttgattaaaaacgtttactaagaaactgatgattttttttaaaaaaaaagaagatcttaccgtttaaaagcttagaaaacataccggcaataatccgttgtccataagccattcagaacaggggttatggattattgtgggtgcacttctcgacctattgaatgtcacctttttaaaaaaatatatatcttcagcactttttagattatttttaaacatatctctcaattttctagtatttaattttttcatctgtgtcattaaataattgatttcatccgtaattcatcgtccgccaaaattttagaacacactaacaaaactagatgagaacagactcagaggaggcaaactgaaactccggtcactcctctcctctatataaccacagtcctcttcagcccagagatctcaactgtctctgtctccccccttgcaaccaattaagaagcagc

SEQ ID NO: 15128 - DNA, 1501 bp, Oryza sativa
gaacgagttcatttcatctgcgtttaccgccgcccatcgcaagacgactctaacctcctcacccccactccctcaacgaagaaaatcggacatagctaaacagtgaggctttcgacagaggaagggggggaaagatttgattgacctgcgatctgtatctggacctcctcatcccggttgctaccgccgtcgctgttgccgctgtcaccggccatgcccgtcgttgggggcgctgctccgcgcgagcgcgagcgcgatccgaggcaagcggagcggtggagagagagggagttgataggaggagaagatgagaagaggtgtggcgccgcacgggggaagacaagtggggaaataaaaagagtaggaaagggtggggcgctgcagtcgtgtgaaaattgaaaactgcctcctccttctttcgcttcgcgagccgccgaccgatcccttgttttactatcgtcaggggctaaaacgagccgatctcgaccaagcccacataggggtggatatcgagccggctcggctcggtctggcttgctaggataacaagccaagccagctcgttattctaacgagctagaagactggatcagctcggctagcttgagctagctcgttcagctcgcgagccaatacaacaaaaccaaaaagtttgcaataaaaattcagattatcaaaccagcgttcaaatccaagtatgcaactgtatctaagtatcaaagtaatgaggcaacgaatcacagagtcaagtgttcaacaaatgaatcatcagttgaacaaatcacaggaggatgttagtacgttacacctacacggctgcacctcgtcttcctcctccgtgatgcacagggacactcggcatgggttgctcatcgagaggccgacagcgaccagtgagcatcacggcgtgggtagctccgcagttggggaccggccatctggttcctgggcatgaaccggcaagcagcgagcgtcggccactggacgctggacgggcgacggcgaagcaggatggagggagtgcgcaggcggctcaggatggagggagcggcgtgggatgtgcggaggcggcgcagacggctcaggcggcgcacgggcggctgttgccgatgccgaatctggatctatcgagaatgaggggaaggggactgattgaccaagtctactagggttttggacattcctattgcacattttctttgggcctagcacgggatggactgatttttctctttctgggccagcaagttgagttatacttatgggccatgttttgttaatgtctctcctatctagctcattaagctcatgagcagctcgcaagctcgatcgagctagctcgttatacgtggcttggctcttttaaaaaatacaacgagcatagtcgagccaaaccgagcgagcgaggtaacgagtaacgagttttttgtccagccctaagaccacatgcctgagctcgagcttgacacagcatcgagccgagcctagacatttcttttcc

SEQ ID NO: 15129 - DNA, 1339 bp, Oryza sativa
atcggcgcagcagagcacccgcgcctccgccgcatcggccgtcggccgccacgcgctcgcccgcctgctccagccgctctccgctgccgccaccccgctccactccgcctccgtcgccgctctgctccgcttcgccagatgcgttccgctttgccggccgcgcgctcaccgcctcgctgcttcggacgcgcgcttgcccgacgccgttgccacccgctccactccggtggtcgccgcgcgctcgcccacctgctccggccgctctcggtttccgctacccgctccacaccgccgccgctgtcgccgctccgccaaccgcgctctctcgccgctgccgttccactttgccggccatgctctcgccgccgcgctgctccggacgcacactcccccgccatcgccgccacccggctccactctagcggtcgccgcgcgctcgcccgcctgttccagccgctcatggccgcccgctgtcgctccccctctatggcaaagataagaacgaaaagaggagagaggaaagaaaagagaaaagaggagaagatttagaaaaagaagatatgcgggtcccatatttttttttccttttcacttacatgtgggctccataacttttttattttttattttgttgactagaatgccacgtcagcgaaaccaaccatatatactgccatgggacaaactttgaatggtttgagtaagtttaggggtatacctttctggttttgtagttaaaggactaaaaaaatctcgtggttaagttgggggacctctggtgaacttattcccaaaaattaagcccagtcaatagtccaaagttccagtcagttaggttgggccgtctgcgcaattgctagcagaaactgagtaaactgggccgtgtaatctgtatgtccattcaaaatcaggcccactatatgttctataccgcagcaagacaatggtaagcgagtagcgacaggaaacgaccactcacgaaccaaaatctcctccactactggacattatccagccgaacattatccctggctactggctagattcttcattcttgatttgtgaataacacatcatcatcctgaacctgcagcatccgtgtctcggtgatagaatggctgcctggatggatggctagctcttcccccaacatgtcacacagccgatcagttcctgcatcgatcccgaatatgatgccaaaagcaaaaaccgtccttcagcattagcatcccccctgcaacatgctcgtgagcacggcatgtgttttgatgtcaacttaccacggcatccgtccgctagcgctagtatttatacgcctagttagtctccgcgatcttct

SEQ ID NO: 15130 - DNA, 1501 bp, Oryza sativa
cggcggaacaaaagggcctatcacacggacggctgctgaagactgcctcctctactcctcgtcggcctggctgcctcctgtagtcggctcctcagtcgaagaaacgtcgatcggctggcgcgaagggaccggcggaacctgtcgagggccggcagcagcacgggccgctggcggtaggggagctgggtagtggaaacggaacacggtggcagaaccaacaacacgcttccgcgcagtgcggataaagcgtgggccacggcaggaggaagcaactggggtgtgtcctggggtgtaggaagggctaactgggtgtgggtagggcgagtacactggtgagtacggcgcacgcgagctgggggagcgcgggccactgggagtgcgggcagagccgcgggagctgtgggaggacaggtggctggcgtggcagaggcggcctgagtcccaggagatagtgtcaactgaggtgacaccctcctcggccagacgggcctccaaggcggcgtagcggcgggcaagggagcggtaagcctcaaggagtaggtcgtgctgagtggcctgagcctccgaaagctcaaccatgcgagtcagcactggctgagactcgctgtacggacaagggtacctggcgtctgagtggccagaaggaaggcgtggaagctgccggaaggcggagcctccgagacggtggctgtagtcgtgggccaggcgacgaagcgcagtccaggagaggtcctggtacgcgatctggagagtgggcctggctacagtgaagtggtgtgggcgaaggccagctccgtgtatacctccacgggggtaaaggtacacagagagctcacagtgagggggaacacggtccacggagtaccccgtgtactcgggacacgagaagccaaggaaacgggcgaggtcacgaagctgagcgacgtggtgaccctcaccaaaaccgtgggaactgaaactggcgttcactgccatctacaattttgaaagagggagaaagatcagtaaccattttagaaacaaactattgaaaataaagaagacaaaagaaaccttagcttttcgcaagtagttttgaacttagtatccttagggtcgtcctaagtgtcgggtttcgccctagggccaagcctgtgctctgataccatctcttgtcacgccccgaactagtcccgaccggaactagcccgtgacgctccaaattaacctgttaatcgataccagtcccaggaaatagtgctggtatcacagggagacagagtatcacagcaacagaggtctctttattatagagtagaagtacagtcatattgggctgcggacagatcccgagctcacaactgcattacaaaaggaaagcggaagccaggacttggaccaatcatcacaggcgcgacttgggaactaggccgaaaccctaaaactcatcgtagccgacttgctcctggaagaactcctcgtcagcaggatccacttcatcttcttcagcaactgggggagg

SEQ ID NO: 15131 - DNA, 1501 bp, Oryza sativa
gaaaagctaaggtttcttttgtcttctttattttcaatagtttgtttctaaaatggttactgatctttctccctctttcaaaattgtagatggcagtgaacgccagtttcagttcccacggttttggtgagggtcaccacgtcgctcagcttcgtgacctcgcccgtttccttggcttctcgtgtcccgagtacacggggtactccgtggaccgtgttccccctcactgtgagctctctgtgtacctttacccccgtggaggtatacacggagctggccttcgcccacaccacttcactgtagccaggcccactctccagatcgcgtaccaggacctctcctggactgcgcttcgtcgcctggcccacgactacagccaccgtctcggaggctccgccttccggcagcttccacgccttccttctggccactcagacgccaggtacccttgtccgtacagcgagtctcagccagtgctgactcgcatggttgagctttcggaggctcaggccactcagcacgacctactccttgaggcttaccgctcccttgcccgccgctacgccgccttggaggcccgtctggccgaggagggtgtcacctcagttgacactatctcctgggactcaggccgcctctgccacgccagccacctgtcctcccacagctcccgcggctctgcccgcactcccagtggcccgcgctcccccagctcgcgtgcgccgtactcaccagtgtactcgccctacccacacccagttagcccttcctacaccccaggacacaccccagttgcttcctcctgccgtggcccacgctttatccgcactgcgcggaagcgtgttgttggttctgccaccgtgttccgtttccactacccagctcccctaccgccagcggcccgtgctgctgccggccctcgacaggttccgccggtcccttcgcgccagccgatcgacgtttcttcgactgaggagccgactacaggaggcagccaggccgacgaggagtagaggaggcagtcttcagcagccgtccgtgtgataggcccttttgttccgccgccaactcttttggagtcgtggcgaggtagtgcgtgcgtgtgtttgttgtgggtgttgtttggtagtctggttctcctaggtggtgtgcgcacagtcaagctcggcgtagctctgtgacttgtccacacccgttgtatcaggtgtttttatgatttgaaaaatccagtttatgcctagtgtgtgctatctgagttgctatttgctttgctccttgccctcctaagtgcttatctgactcttaccccgccctcttctgggagtttagatggctagccgcccccgccgtgcagctcgtgcaccagcccgctttggttttgaggatggtagagttgagccagaagaaaatcatgaatcagctaatgagcagtctcaccacagcaaccgttcgcatcgtactgtttcccgcaacgcagaggttgagcaaccccgccgcagca

SEQ ID NO: 15132 - DNA, 1501 bp, Oryza sativa
gtagaacgtgctcgtccgcgggctgcggatcagcggcgccgtcacctccgcgtcggcggcgtcgccgaactggagggttgacgaggagggggagtcacggtcgacgaggcagtaggagaaggtggtggcggagatctgggacgggaaggagagtggcccgccgccgagggcaagcagccccgccgcgccgacgaacagcccctcgttgtcgtggccgcagcctatggcgacgctggagaccggggcggagtcgccgagcgtgagcgtctcggtggcgaagtcgccgacggtgtaggagccgtcgccgtacgcgacctcgtagaggcaggcgccggtggagttgcggcaggcggcggcgtcgaggtcgtggcagcgcgggttgtcgcaggcgacggaggcgtaggaggtggagagggaagggtcgaacaccgggtcggactgctggtagcagtcggcgcacggctggcattgcacccaggtgacgtcgctgccggtgtcgagcaccatgtacagctgccgcgcggggctgccgacgccgacgcgggagaagtactcgccgctgccgagcccaaccccggacaccacggggccctgtatctccgccgccgacgcctcgaacgccgtgacgttggccggcaccaggtcgaaccgactcaccccgtccgccgccatcgccgcgcgggccgacaccgcggcggcgcgggcggagtcgcggcggaggcgagccagcacgagtgacctgtagctggcgtgccgctgccgcccctgctcctccggcaagaagtcccgggagtggagccgcagggccaggcgcccctcctcgtgctcctccccgacgacctccgtggacacggcggcggcggcggactggtggagcggcacggcctccgcggataccgcggcccgcgcccgggacagcgacgcggcgacgtcgagcgtctcggtggcgagcggcggcgaggcgtggcggcgggagagaaccggccgtggcgaggcggcggcgaggaggaggaggaggaggagaagcgggaggaggatgggaggctgcattgctgctgatgctgctgctggtggtgagctggatggagtgaggagagtgaaggggaatttaaggggagaggagacgaagttgcagtggtcagtcaaggtgaacgaacgaatgaatggatcacgtcactcttcttctttcttctccagctgctctcaatgaaatccatgaattcatccatccatggcgacaggttaaaaagaaaaattaaccaaacctaacaaactgagcaaccccaatctgtacagtacgattgatgtgcatccttaactaaatcgaatcaccatttgttaacacatgtaagcatcgacgaggtgaaggggattaaggaatcatggtgagcaattgaaaattgtgtggcgccagatgtgttgcgaaactaacgacgcgtattatcaaatttatcatcagtcagtcacggatgctttgttacacagttatcagactatcagt

SEQ ID NO: 15133 - DNA, 400 bp, Oryza sativa
actctccttcctctcttcctctctttctatcttcactctctctgtgtcacggtgacggggagtgcgagcggcgcgtgggggcggactggcggtgtgcggcggcgcgagcggcagagacggcggtggaatggcggcgagcggcgcgcgggggcggacgggcggtgggcggtggcgtgagcggcgcgcgggggcggactggcagcgagcggcggcgcgagcgaggcacgggggcggactggcggtgatcggcggcgcgagcggcgcgcgggggcggactggcggcgagcggcagcgcgagcggcgcgcggggtcggactagcttctcccctccgccgcctcctctcctagcctcccttccgccgccgccgccgcctccacgctgccatctgccgtcgagagc

SEQ ID NO: 15134 - DNA, 1501 bp, Oryza sativa
gaaaatcaaaatatagaataaatctaacatctataaaaggtgggagtatgatcgaactctgtcatcaaatatcatggtgtttatttctttatgatgttgtcatcattcatatcacagtatctatatatataactactcaacacacggaggtttgagatactaatttatttctttccgtaaaaaaaagataagatattagttatgttattttgcaatttgtcggtgacatgggaccgggagtatcatgactagaggcttgaggcagacacaatcgcccacgtggcctggcaccgtcagggggcgtcgggcccgagggtgatgtgttcgccctcctctttaccgggagtatcatgacttagagacttgaggcagacacgatcacccacgtggcctaactcccttgggggggggggggggtcgggcccgagggtgatacggccgcccttctctttgtctccccaaggggtcgggccgctcccgtctcggccccgagggccgaagcgccccgaccccttgtgggctttgcgccacgtatatggggtaggtgagcatggcagggctcacctaaccacatttattgcagttttgacgagcgcgtcacgccgcctgtatcgcagtacagcacgctcgtttatccggtctgtgaccagtcacagaccggtcagatcgcgggttaggtggcgacaggcgatttgacgcacgcctcgccccgtcccgtcaggacgagggcttctaggcgctcgtccccagctggagctagcgtgttacctcccagagatggcacgttagtcctggtcagatatatgccaggcttcatcctaaccattacaggcaagatgttgtgtgaagaagggcgaacatgtagattgctaagctgacacgtggtggacaagaatgaccgacgtgactggtctgacaccggtcatgtcgtcagcagacagccacgattccacgtcgcatctgctcccggcgaaagtggaggtagttgtgggccgtcccatcagaaggtgactcggacggcaactatacaaatctccgtccatttatgaaaagggggggtaagtccccacacaaaaaaagagggaaatggtgcaagtggtatccccttaagatataaaaggaggaccttgcccacttagagggggattggacttttccagattgggaacctagaacgagggagaggctggctcatactttgtagttccttcatacacaaatccaccaaaacacaggagtagggtattacgcttctgagcggcccgaacctgtatacatcgccggcgtcttgtgtgcttcctgtctcgcgaaccttccacagattgggagcttagagtctcacccagagtccccggccgaaccggcaaaggggggccagcgcggtctcccggtgaggagccccacgctccgtcatctggcgcgccaggtagggggctctgcgagtgatcttctgagctctcgcactctttcgtgtgcgccaagcttttcctgttcagcctca

SEQ ID NO: 15135 - DNA, 1501 bp, Oryza sativa
ccctctaagtgggcaaggtcctccttttatatcttaaggggataccacatgcaccatttccctctttttttgtgtggggacttaccccccttttcataaatggacggagatttgtatagttgccgtccgagtcaccttctgatgggacggcccacaactacctccactttcgccgggagcagatgcgacgtggaatcgtggctgtctgctgacgacatgaccggtgtcagaccagtcacgtcggtcattcttgtccaccacgtgtcagcttagcaatctacatgttcgcccttcttcacacaacatcttgcctgtaatggttaggatgaagcctggcatatatctgaccaggactaacgtgccatctctgggaggtaacacgctagctccagctggggacgagcgcctagaagccctcgtcctgacgggacggggcgaggcgtgcttcaaatcgcctgtcgccacctaacccgcgatctgaccggtctgtgactggtcacagaccggataaacgagcgtgctgtactgcgatacaggcggcgtgacgcgctcgtcaaaactgcaataaatgtggttaggtgagccctgccatgctcacctaccccatatacgtggcgcaaagcccacaaggggtcggggcgcttccgccctcggggcctagacgggagcggcccgaccccttggggagacaaagagaagggcggccgtatcaccctcgggcccgaccccccccaagggagttaggccacgtgggtgatcgtgtctgcctcaagtctctaagtcatgatactcccggtaaagaggagggcgaacacatcaccctcgggcctgacgccccctgacggtgccaggccacgtgggcgattgtgtctgcctcaagcctctagtcatgatactcccggtcccatgtcaccgacagtagcccccggcgttatgccagggcgatcgccctcctcgagggaagcggtcgggcgtaacgccacttcctaaggcctggtgacaggtggggaccggtctccacacttgggcagaaacccaacggccacaaatcacgcatatcggcaatggtaactcggctgtcaataatgagcggtctcttcaagactgccacattactcgagtagcacacgaatctggacatggcgattcgtttcgtctagagatatggtaacgtcgcttcggtcggcgagcgtaattaacgcgcgcacgatatgatctatctcgactgccacaaccgcatatccacctcatgcgccgcaagcgggcgaatgggattagtggaagcgtgggcgcgagaaacgagggggcgaaatagtgggcgcgagaagcgaggagccaggcacagcgttggcaagagtataaaggcactgaggaagggatctgtttccttcctttcgccattattccccttgtcttcgccgcttgcgccctaactccttctttcctgtgccctaccttcgccacacgtgctcgctcttaatcttctcttcctccggcgcca

SEQ ID NO: 15136 - DNA, 1501 bp, Oryza sativa
tttattgaataggtgtaagtctagtgtcaaccttctcatatatatacatatatacatacatatatatatatgtatgtatgtgtgtgtgtatatatatatgtatgtatgtatgtatgtatgtatgtatgtatgtatgtatgtatgtttacatagcatcctaatcaccccctaaatcaataggattagtcatatagtgtcctttttgacttccccgcacgcaccacacaagttcatgcaccaaaacaagcattttacaagtttgtgcactagattgcatccacctgacaagttcgtgtactgacgattcaatttactctttttttttcctgtttcattttttctttccgtttttgcggttttcattttaggtttctttttttggttttttcttttcatttttttatttttttaaacatatacgtatacatattttttatacgttatacaaagtttatatacgtgtatacaaagtttgtatatgtatatataaaaactttgtatacgctgtatataaagtttgcatacatatatacaaactttgtatgcgtatgtatatgaagtttgtatacttgtatacgtatacacgtgatgtgttttttggttttttcgattttttaacatttacgtatataaagtttgcacaaatagtacacaaagtttgtatacatcatagtttgtacacatcgtatacaaagtttatacacatcatatacaaagtttgtatatgtgtatattttttatacaacaaaaatatatatttgtttatagtagtagtatagtagtattagtagtaatagtgtagtagtactactagtagtaatactggtagtaaatactccatccatttactttttatagtcatattttatcttggcacacagaccaaggataagtaattctatttatcatccatttaaacatgctaatagttatatctcgtaaacaagcgattcattaaaatttacatttttcgatgcccatgtagccaatcttgtgtggaagaatagagagtcatgtattaaatccgaaaaagtcattaagagtataggttgttagattgaaatatgactatctaaattaaattttttaaatttagaaatataactattaaaattagatggagggaataactggttcctagtgtactactagtagcagtagtactgggggcgtcgcgcgcctgccgtcagtcacgcattaagcgtccccgtaagtgcgtggatggacacggagatagcaagcccaggaagtgtcatatgtgggccgtgctggagtactcatcttcgatctgaatgggccgtatcaaagagaggagacgtcaaagtctaaacggcaaaatcatcagtgctcaatgttttctctaaaaatgggaaaaagaatcaaagcttggtatttgtagcccggaattttttttttaaaaaaaaatgaaaacggccacccttccagaaaaaaaatgtattagatggaaaaggtagtcaagtactacttgtcatcagaaaaa

SEQ ID NO: 15137 - DNA, 1501 bp, Oryza sativa
taattggctggtcaggaaatatcgtgcgtacgcatgcgtatatcaaattattcattcaagcatgcatgcatgcatgattccgagacgacggggaccgggcgatggatggatcgatggagcgagttttaggcggacagttgggtgcccgaccgcgttctcggctttaaaatctgccgctttccgcatgcatgcatgcgccgatccgccgatcgatcgaagccgtgtgtgcattgcaaccgcgcgcacgccatgcaaaccgcccgccgcttcaggcgtccgcgcgcggagacgatcgactcgatcggcctcgtttactccgcacgtacgagccgtctgcgtcgtcgcgcgaggaaataatatatattctccggtgtcgtgggcatgtgatgctcgatcgcgactcgcgagtggccggagatgtgggctttttccggtgtccttgggcgagacttgggcagtgggcaggcaacgacgtcgacgcatgcaccgatctggtcactgccatagaaaggaggttggccaacgcgcgcactgggcatgtatatatattcagtgtcacctagtgcacagtgatttctactctacgggccggctctacggcgtttgatgacttgatcgatcggccggccgtgccatgatggggcttctgctgcatgcagtgggcgcaacggcacacatcacatatggatctcgatcattcgagtctagagaacaaaagcacggaggattggaggaatgaaggcggtcgagagaggatttgggggagttcgagagcaataagtagctagtgccgacttgcatccggccaccgatgatgcgctagtatgtgtacgtactacggctgttttaccaccggttcgtatagtacgacgcgatcatgctcgaccctatggccgaaacaatcacgtcgttcgttggcgacccatgctaagtgatgctgccaaggacagtattattacgcgccgctgtgtgctgtccatccgccgcccgcaaggtcaacttttcacgccgcctccgcaacaaattgacccaccttttcttatgttccatggaacctgggccgtgtgagcttgtccctattttttttaaggctattagagtaggttaacgagtcacgttagtaaaaaccactgttaaaatagataacaattatttggttttgctagaaatttgtcgtcaaatttttttcttaatatttgtcgatttttctaacggtgcagcgcgccgttcgtacgtgatatcctcgttggtggcagcggttcgtgacatgcatgtaagtgatacatacatacgtacggggaagcagtgcatgtatgtgacccagtaatgtcttgcacgtatctttttatgtttttactatacaacaaaagcgattaaatgttaactctacttagatacggatgagagaaatcccgtgacctccactgagcacgagaagcgtacagttacgtgcaaattacaatgtaattacatataattatactgtattcacatttgaaac

SEQ ID NO: 15138 - DNA, 1501 bp, Oryza sativa
ggacccacgtgggccccacatgtcatccacgagcggctggccggcggatacgccgcacacgtcgtcgacatccccgaactccgccttctccctcgtcggccacggcggcggcatcatcctgctctggaatgcggtgaccgcgccgcgctcctccttgtacgttgtggcacggatgccgcagctctgcacccgggactggatcccggcggcggcgcccctctgcgcctccacctgcccttgccgccttgacggttgccgcttggcggctgctactgtgctacagaccgcaccccgcagctgctcccaggaccccggcgaccggcgaccggcgccccttggctgctccaacctgccgacttgctacttctgcctgccgccatgctctgtccggaggagtacgagaagggggtagggggtaggggcagagggccacacctcgccataccgagccatttgcccctgggctcaagacgaggcgcgcggcgaagacggaggagatcctcgccgccacggagaaggcccaacgccgacgatgccctcctccacggcgccgcttccaccctatggccccgcgcgccgacgccctcctcgacgccgccgccgcttgcgccctgtggccccgcgcgccgccgacgccctgctcccgcgtgcctccgccgccagtcacggccgcttgcgccctggggcccagcgcgccgccgccgccctgctcccgcgcagctgacacccaatcgctgcaccggtggcatcctcaaacccgtcgccatcggcgtcgtcgtattcggcggcggcggggaagcaggtggggaaacgggagctcgcccgccgccgcccatggaagaggccgcgccttatctccgccggtgatagagagagatgggggagagagatgaagacggcaggagatggcgcagagaggaggaagaagaggatgggtgatgatgacatgtggggcccacgttggccccacaattttttattaatttgtatgagaaactgacatgtgggtcccatagttttaattgtttttccggatcaaattgccacgtaagcgccacgtcaatgccatgtcagatgaagaccgagtcaaaatagccacgtaggcgccacgtcaatgccacgtcagatgaagaccgagtcaaaatagccacgtaggcgtcacgtcagctaaaaccgctctcaaaaccgccgagggatctcatctgcaccggttttggtagttgagggacccgttgtgtctggtttttcggttgagggacgaaaatcagattcgttggcaagttaagggacctcagatgaacttattccgtcacaaaaacaagcctgcaccgagaagccaaccagccagcccaatgcatgttgcatggcagtcacattccacatcacatgcttcaccaccatagccggaagcaagcaaccaaggaaggaataccagatcccgcactggcgtggcgtctcaaaaccaaggcgaccgaggcgagcaagcaagccccacactcgc

SEQ ID NO: 15139 - DNA, 710 bp, Oryza sativa
aggttggggttggggctccgccccggggagggctgatcgccgggcttgggcggcatcgccattgcttccttctacctgtgagaagagaaccacacacaccacacaccagtggttgaagagaagaggaggagagtgagggggtggcgtggcgtgtgtgcgagtgtggggcttgcttgctcgcctcggtcgccttggttttgagacgccacgccagtgcgggatctggtattccttccttggttgcttgcttccggctatggtggtgaagcatgtgatgtggaatgtgactgccatgcaacatgcattgggctggctggttggcttctcggtgcaggcttgtttttgtgacggaataagttcatctgaggtcccttaacttgccaacgaatctgattttcgtccctcaaccgaaaaaccagacacaacgggtccctcaactaccaaaaccggtgcagatgagatccctcggcggttttgagagcggttttagctgacgtgacgcctacgtggctattttgactcggtcttcatctgacgtggcattgacgtggcgcctacgtggctattttgactcggtcttcatctgacatggcattgacgtggcgcttacgtggcaatttgatccggaaaaacaattaaaactatgggacccacatgtcagtttctcatacaaattaataaaaaattgtggggccaacgtgggccccaca

SEQ ID NO: 15140 - DNA, 1501 bp, Oryza sativa
ctgtcgttagcaaatgtctactgtagcacacattgttaaatcatggagcaattgggcttaaaagattcatctcgcaatttacacgtaatttgtgtaattagttttttttactatatttaatactccatgcatattttcaaacattcgatgtgacggggtgaaaaatttttgcgtgggaactaaacatggcctaacactagccttctcccctatcctttactgacattgaggaggtggagagtagtagagagaaaaaagaaggcggagagtgggctgtgtttgagggtgaggggattgagaagattgggaagatatgcaaaacgaggtgagccattagcgcatgattaattgagtattaactattttaaatttcaaaaatggactaatatgaatttttaaagcaactttcatatagaaatttttttgcaaaaaaatacaccgtttagtagtttgggaagcgtgcgcgcggaaaacgagtgacaatctccccaatctctccccaatctcctttgaggaggaggggattgaggagattgggaagatacgtaaaacgaggtgagccattagctcatgattaattgattattaactattttaaatttcaaaaatggattaatgtgattttttaaaagaactttcctatagaaaatttttacaaaaaacgcaccatttggttgtttgggaagcttgcacacggaaaacgatgtgctaagtacataggaggaagagggattggcaggagtttctattactacaggataaatttctactattacatgtgtcacatgactcacatgtagggtttaaaaaaaagtagatgtaactcatccatttttttaaaaaaaaagagttgaaggacattaaatgtctaggtttgaagttcatgataaattccatcatacatcattttttttccctctacgtgagcagcatttaaattataaaagctattaaactatatttatatccatgttttctaaaccttttaaagaaattctctttcgccataatgacaatgctgagtattcacacttgaaacacaaacaaacaaataaacaagagtggtgatggcggacaagattaagaaatggcatctataatggcactccttaacttacttatcatatccattgccatcaaggagttggagagaggtagagaggaaagtggagtgggagagaatatattctaggaagaatatggatgtgcttagttatttagaagccaacgctaaaaaacaaattgcgatgaaaaaaatatcataaaatcaaattttaaaatttaaattctggtatctgtttataagctatgaggcaaacgatgtaaccttagagttttaaagagaacgatgataatttgtccgattaaatattcctatctaggtttagagttcgtaataaatttgtccataaatcaaactttcccctttctgtagcatcactggagttcaaattgtaacgcagatatttaaccatatttatgttgtgtacttaaagtttta

SEQ ID NO: 15141 - DNA, 1333 bp, Oryza sativa
ttcctgcagcccattggttctaatggctttgttggattagtgacaccgctttggtgttggttaattaaaataaaccacatggtgggctgtgggtgcatggtttagcaggtcgcacccatggcagttaaggaccggttcgcgggatgccctggaagaacttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgttgcccgctggggacgggggtgaaacctgaggtgtggtgtgcttggctagagggggttatgcgaagggtcctgtcacggcctctttccggtgtgtcgtggtggcatgtcggcgcacggaaacgtgtcgaggggctgtgtcttgtgggtacagttgtacacctctgatcagagtaaaaactattcgaatagccgtgcccgcggttatgggcggtcaaccagattcaccgtgattaggctcaccctagtgtaatcttttgaatttggatagtttaggtggatggttgggcctgtcgcaacgtgggttagcgttggacagtggatagttgatattgtttaattattacaactgtttaaatctttcaacttctgtttatgcaaatgaaccacttcagctcttctttgatgattccctgcatcacacccctattccggtatgacttgctgagtacagtaggtagtactcagtcttgctctatttttcccaaccccagagttcgagtatgtgtcagatggaggtgtctctgaggagtaggcttcgtccgtgccgtcgaggatgcctgtggagtggtgttcccactgcagttctagtcaaggcttagcacctgttgtctttcgtttttccgctgcatttatgtaagacttttatgatgtttgtaagacgtggatctgaatgtcaacattgtcgtttgtgtaccccggctggtcctggacggggattttaatgcacattctgcttgaaattctattcgggaatttctgggcgtgacatttcttcatttaaattttaatttaaaaaaaagtgtttattgcgtcagccgaggggagggggcgccggaccgggtccacgggagtggggcccacgcggcagcctcatggtccacggtggaccgggcgcacccgggcttgcaccggccggcgccgtgggccccacgcgtcagccacacccgagggcgcgggcggctgacggccgggccccacgcggcggccactcggcgcgcccaaaggcggcca

SEQ ID NO: 15142 - DNA, 1501 bp, Oryza sativa
aggccgaagcccagccaggccgcccgccgccctcctctcccggggtcgccgacaggtggggcccacctgtcgggtccttcccccacctccggccgacgctgcgccagcaaccgacgcgcccgaaaccgccgccgcgtccacgcctccgcctcctccgggccacgtcgaccacgcccgcgcgtgcgccgcgttccccgcgcccactcccctctctctccagctcgcgcccgcgcccgagatggccgggattcgattttcgaatcccgcctctctcgcctcccccactcccccacgtcggccggcgttgcccgcctctcccggccacgtctcggggagggccatcggttcggccgccgcgtggcgcgccgctcctccccggtccgtggacccgatccgccgtggaccgccctccccgagccgctgaccggtggggcccgcttgccggcgcaccttcctccctctcccgagccgctgaccggtggggcccgcatgtcggcgccgcgccccgccttgatgacgtcagccctggaatatattgtgcaataaatgatttaaggtttttcttgtatagtaataaacacagtgaatcttctaaaattcataactaattcatccgagctccgtttaagcccattcaagtctcagtaaatcaagaaaaatgtgtagaatccattaaaaatggttttgttccctgtttcagtagtcttatagcctgtttgcaatgtttgctttgtatgtcgctagattccgattcctccgacgctccggtgtacttcgaaatagtcgctgaggtttctccagcagcagagcaaggcaagtcatgcttgtcacttgaacatgttgatcctatattgcaaatgctctattgttttctttcaaatattgcattgttttataatgttactatgggatgtttacctattgttacagccatgctattttgataccatgctcctttgttagcttgggttataacatgaatagactttggactaggaattgcttagccatgcttagttcaactagttcacaatggggaaaatcacattaatgtttagactgttggttctaatggctttgttggattagtgacaccgctttggtgttggttaattaaaataaaccacatggtgggctgtgggtgcatggtttagcaggtcgcacctatggcagttaaggaccagttcgcgggatgccctggaagaacttatcgtacttatcacaagccagcgtgggcaacggctaggcttgtagtgtagctttcctctagtcgacgcatccaggcaagggtgggcgtgatggagcggggcgggcccagcgacggcctctgtcgctttcggattcacctaggcacgagaggggactgcccgttgcccgctggggacgggggtgaaacctgaggtgtggtgtgcttggctagagggggttatgcgaagggtcctgtcacggcctctttccggtgtgtcgtggtggcatgtcggcgcacggaaacgtgtcgagg

SEQ ID NO: 15143 - DNA, 1501 bp, Oryza sativa
ccggtcagcggctcggggagggcggtccacggcggatcgggtccacggaccggggaggagcggcgcgccacgcggcggccgaaccgatggccctccccgagacgtggccgggagaggcgggcaacgccggccgacgtgggggagtgggggaggcgagagaggcgggattcgaaaatcgaatcccggccatctcgggcgcgggcgcgagctggagagagaggggagtgggcgcggggaacgcggcgcacgcgcgggcgtggtcgacgtggcccggaggaggcggaggcgtggacgcggcggcggtttcgggcgcgtcggttgctggcgcagcgtcggccggaggtgggggaaggacccgacaggtgggccccacctgtcggcgaccccgggagaggagggcggcgggcggcctggctgggcttcggcctgcagccggcccagcagggagggggggaaaggaagggaaaaaatgggccgacggcccatttgaaaaaaaagaggaaaaagagaggaaaaagaaaaagaaaaaggaaaaaggattttccctggaattaaaatattgcttgctcaattttaattggttaaaattatttctagagctctgaaaattccactaaaaatcctgttaatgaatttcgacatgtagaactcaagaaaaattccacatgcccaatccgattattatttgcattactttcttagggttttctcttgatttgcacctgcattttcttggggttgtttacaaattaaatttggcttgggaggagaacttcggggtgtgacaagaaattcgcaaatattcacttaaaagagcatataaacttcaaatggccataacttggccatttgaactcggaattggaccattcaagtctctaatttttccttaagaagtcaagaacctatttttgtgctttgttcctgcttgttatatggagtttattagagtaaaagcttttttccttttcattggtcgtgtagacgctgcagcttcggaagatccgctctacgtggaggttgaagctgacgtttgggaaagcgagcaaggcaagtcatatcatccttgaacatattgagtcccagtttataaaattattttgatttaaattattgcattatcgctttatttaaattcctgcgttatcactgttttatttagccatgcctatttacctttgttatgaccttattattattgctattgttattattaccttgttcaccctaggaaaataaaaccccaactagtgggtactctatttatggttccactagtatgaacttaggtagatgcttcgctggttaattaggcaacattaggtggttttacaactctagactttgggaatattcatatcacctggacactatggaatggttggattattgtggaatcggattcacacctccccctctattcaaaatcctcaaaatggttttaggctgggctcggggtgcatggttttgatagtagcacctcggccacataaggaccggt

SEQ ID NO: 15144 - DNA, 1501 bp, Oryza sativa
tcgacaagaacaatcagacaaggattcaggattttgctttacctcccgtaggagaggcgccgggaaatttctctgccaaggaaaaagagatcgaattatatacatagacaaactataaaattgatctataactaggtactactatataaagggaaatgtaaaaggtttactaaccatagtcacccaaaaagaagaacaaagcgaaaaaatttttgaagaaaaacagagacgaagaaacaaatcggagtgagttggttgtactgactgttgcacttgctcagggcggagaagttgccgccgcaggcggcagggagggcggcgacacgggtgtagttgatcttgatgccgaagtccaggccgagcgcgccgcagaggcaggcgacggcggccgggctacccagcgtgctcttcacgccggcacagcagtccttggccggtctcgccttggggctccccggcgtgatgtacgtcaggcaccccgccagcgccgtgatcgtctacccgcagtctgacgacggcccgcagctccggccgccgctccctcctctcccatctcccgtctgccgccgcgcacagctcctctggcatcagcggcccggctgtcgccccctgcgcttctccccgccggctggcctccccgatcgatttttgtcgtgccccgcccttctccccgccgaccggcagccgccgcgcttctccctctcggcgcgcctagagagaggagaggggaagagaggggagatgggtagagaggaggaagaagagaacgggtgagaatgacatgtgggccccaccatttttttattaatttgtgtgtgaaacgggtcccacggggtttattgtttttaccgaatcgaattgccacgtaagcgccacgtcgatgccacgtcaaatggagaccgagtcaaattagccacttaggcgtcacgtcagccaaaaccgtcttccaaactgccgagggacttcatctgcactggttttgataattgagagacccgttgtatctggttttctagttgaaggacgaaaattggatccgttgacaagttaaggcacctcagatgaacttattccaccgttagatcttcatttcactaccaggcctatatatgaaggaaaaagtacaccaaaggtccctcaacttgtcaacaggatacaaaaacatccttaaacagcaaaaccagatatacggggtccttttaactatacaaaaccaatcaccagaggtccttcggcggttttgatcccggttttgatctacgtggcggctgagtcagcgtgggacccacgtgggccccatatgtcagtatctcttttccctcctctcccttttctgctgtttctctctcacacacactcttctctcctacggccgacgatgcagcacgggagaaggggagggcggcggcgggcgaacacggtggcgggctcgccctccccgatctcactctccggcatggggaaggggtggcgcaggcggcggaccggcgggagaccagcg

SEQ ID NO: 15145 - DNA, 808 bp, Oryza sativa
cgtaaattttttgaataagacgaatggtcaaacatgtgagaaaaagtcaacggcgtcatctattaaaaaacggagggagtagctgggtgactgggtcaatccaactgctagcacgtgttcaatatcctctcaaattcacaaagtttatctttatacgaaatttatcatcaaggcggcataattcatatatccattatatatgtctagcacaaatttgatctagtccgtccacggaagcattcgacactgccatcgccgctcacctgactactcggccacgatcagacgccattgccggcggcgacggcgacatggacgctccggccgaccaacaagtcgccgacagcacgtccacctgctgcgcgatccacctgtggagcgaactcgacgacatgctcgacgtggcgaggaacgtccgccgcctggaggagaccgtcggccagctcgccgcgcagcgtagcagcttgcacggcgctatcgtggacgcccgcgtcgtgggcgtcgacgacggcgaagacggtggcgccgccgaccggctgcgccgcctggggtgcaccgaggaggcggcgaactggctggggcgcgcccgcgtcgccgagaagcaagggaacgccgtcgcggcggactacgccgcgctgtccatgccacgcctccgcctcgtcgcgcgctaccgcatcggcaagcgcgcgtcgcgcgcgctccggcaggcgcagcagctcgtgcaggagcgtggcgcgatctgcgccgcgcggcgcggggtcggcagcttcgccgccacgacgcaccagtcggcgccgacgcccgcggc

SEQ ID NO: 15146 - DNA, 1501 bp, Oryza sativa
gcggcgccagtgcgggatgcggcggcggagcgggtcgcaggccgccacctcgacggccacggcggccgccctgccgcgcgccatgttgacgaacgtcgcgaacagcgcctcggcggccaccgcggcgtcggggccgtcgccgccgaggccgtacacgaaccacccggagaacgggcggaagaagtccggcacggacgggacgcgcatccacctcgccgcgcggtccagcgcgcgcgtcgcggccgccgcggcgcggcgaaggcgcgacgcgccgcgcagctcgaggcggaacacgcccccgcagtcccagaggctcgccagcgcccacgacgccggcggggacgccaggaagcgctcggccccgcgccactcgccgtggcgccacctcccgtcgtcgtcgatgacggcgaggaacgtgccgatggagagctggttccccagcacggcgccgatgtcggcggggaagaactcgacgtgcgcgaacctgccgtcgtacagccgctcggcgtcgcgggcgccgaggcggaacacggccgcgcggcgcgggacgcggcggcggtgcgcgtgcacggggtgcaccagcagcgacggcgtccggaacttggagtagccgcaccgcaccgtgaacagccgcagcgacgcctcgttggacttgtcggtggccatgtacgcgtactcggctcccatccgctcgaaccacgcttccatccgccgcaccatccgcagcgccaaccccatcctcctgcacacacagccaggaaaaccccccgagcgaatcacgcgccatttccctttcccgaaacgatacgccacgccacgcgacgccgcgcctccgcggacacaagaaacgaccaagtccgctgctgttacctgtggctcggcgcgacgcggagtccgagaatgtagccgacgctggcgacggcgggggcgcccgggcagctcttgccggtggcgaccgacttcacggtgcctctgatgatgccgacgatgatccgtccgccggtggcgcccgacgtcgtctcagctacctttccatcccaagacacaacacacactacaaaatgaaaacacaaccaccaaaacagcgtacgtactgacacgatatgatcgtagtacgtaccaacatgaggtagtcaggggagtggcgaatgcgggcgacggggtcgccgagcaggtcggcgtggagcgacatgccgccggtcgggccgacgtcgcactcccggtcgacggcctccgtgccggcgcggtctctcgatgggtcgtactcccggatgatgatcaccaccccttcctcctcctcttcatctctcatcatggcatatatccgatcgatcgatcgatcgatcaatctcgcaaccgtatcgatctctctctctctctctctctctctctcgactctgctgctctgcataggaatgtagcatatatatatacaggcacccggctgcagtggggttccggccttctattttctcgcagggataacaataaaactgtgaga

SEQ ID NO: 15147 - DNA, 1501 bp, Oryza sativa
gtgacataggagattgttgggcccgatgtgtgacgacggtggagattgttgagtttagtctcacatcggtaattgatgatgggagagcacgacttaaaaggtgggggcaatcctcacccatcaaactagtcttttgggttgtgtaggctcaagacctagagttgtggcttcggttgagcctgtggtggagcaaactcaatgtgacctgagtggcccatggttggtgggctaggttgcgcactctaacaaagtccaatcacaagattaggaagaagtggtgccccattaacaaaacgagttctcactctctagatgggtgcagtgttatgctgaaggacaaaactggatgcaacggttgcaaacttgatgatactcaacgcatctcctcatacaaattatgccccatcgacaagacctgagtggcccatggttggtgggctaggttgcgcactctaacaaagtccactcacaagattaggaagaagtggtgccccattaacaaaacgagttctcactctctatatgggtgcagtgttatgctgaaggacaaaactggatgcaacggttgcaaacttgatgatactcaacgcatctcgtcatacaaattatgccccatccacaagacaaaatgcgtactttgacagggtttaaggtattcatcaaagttgtcgaatccatgacctcgtctacgtcggccagttcttctcccaagcattgtctgatccactcccgatgacatcaatccatcaatttgggatcatacgatgatatgtcagatgacttagcttgtttggtcggctatctgggactagacccccatgaaccatctattctccatagtctggatccgctcgagtcctaggtctcaattcataccgtagggtgaacatcgttgagatcgtggacctagcgtcccgtgacgacattgttgacggtcgttatcgattagtttcgaccgtcaatattactaaaatagaggagaactagtggtgcttgcaatgcatatatttgttagaataataatattccattagtattaggtatactaaccttttgcagagaatgacaataaagtggaggagaatcgacatcaactcagacgataaatcaatcggacgatgtcgagaaccagacttatgtatgaatgggccaagaactcaaaaataacacgacacattgggccaaaattcacaagtctacggaggaggacaacaaaggaggccgccagccaaagatgggctgggttgggccagcccatggtgtttcgaccgaaccccccatagctccgtttgatccagggttctcctggacggctgagatggctccccaatgacggttagagggtattaccgacaattccaaccgtcacaaccgtcattgggaggctataaaaggagctctcatcctcacttcactcacacacctcaagcaatagctctctcatttctctcaagtttagtttagtagtatctagctggtggaataggaatagagtagaaat

SEQ ID NO: 15148 - DNA, 1501 bp, Oryza sativa
aatccatgcatgcatgcatagatagagaggagaaagagttggggcaagtacttcaataaattctgtgaaatatagcgaatgcacactttgaaacatgtcgttactacacaggaaacattaagttttaacagtctaaaacatatatttttattttatgaaaatataatcatgtgatatcttattataaagatttaattgcaacaaattcaatggtatgatcggatcataaatcgggtaggtagtttaggagaaaaaacatttaaagtgatgagaaaaaaagaaaaagaaactagttagtactcgtcttgcatgcatgccgtagcaagtatgcccattttttctcttcaaattgggcaaccgagcaagaggattctcgcccaacaagcggtagtagttgttcagtttgtcaccaaaacgaacctcttgctaaaattcgaaatctgcattggtaaattttggtaaattatagcgtaattaccaaatttttttaacgttggtcatgcttggtttgtagctttaccaaattccggcaatgttttataagaagaattaccagaaataataaattttggtatggtgataatgacaagagtatgttttgttcccctagcaaaatctggtgatgtaaaaattcataaggatgaaagtggtagcaagctagctaaacaatccctgaaacactgggaatcaaatttcaaaatatactgtttattctattttttctcagaaatattcgggatacaaaaatttttacagaaatataatgtcggtctcacataacaattacgtgaaaatgacgcaggaacaacgtcacgggcggtataaagcgcgagaccgaaatggaagagcgagactgttcggtcttgcggaagcaacagcgataccgtgtcatgccgatttaattagtgattaattatctgattagtaattaattaattattacttaatcgctaatcagataattaatcactaattttttattagttaattgttaattgagtaattaatcactaatgaaaaggagccgttagacagtgtcgctcattgcttcagcgagaccgaacggtctcgctcttccattccacgagaccgtgcggtctcgcacttattggaattaatagatgagccttagcccattcgaagattaattctttagaaaatcacaaaaaaccagctcatgggatggcatgcatagagagtttagtaccaccttgtttattctagaagagggggacctccttaaaagggaagataccctcctagctacatgaagcatgtgaggtggagggaagagggggaacacatgcgcgcgctcgctcgcctcgcctggccaggcagggcaagtggcgcgcatgcacaacgtacgcgtcgaatggtccgcaaaattggttcctcacccttgcgcagattcagcctccttttgtagttttgttttgctacgggaaattcagttttgtttgttttgggtttgcctcctactctgtgctgcgccgtcgctcgt

SEQ ID NO: 15149 - DNA, 1501 bp, Oryza sativa
ccgcctccgaccagcaatcatcgccgtcttagccgctgtcgtcgctcgccatcacctccgtcggcttcgccgtcgagtaccgcacctcggccacctcctggccctagtcatccaccgctggagtcctcttctccccgtcgaggtgagttttttccccgtcgccggcctccggccgctatttcccaccgccttgtgcctcccctttcccgtctaacccctcccttctcctcctcagctcgcggccgtgcctgtccgccccttcccaagcgccacccaccgtcgtgcacttggcgaggactcccacctccttttccttttcaccggccgcgctgcgctgccgctgcccacgtcatcgccgccggtggccgcgccgccgcgtgccgtcgctcggctgggctgtcctgagctgtgcccatgccatgccgtgcttgcccgtggccgcccgatcggccgccctcactaatctaggccatccacgtgttgccatggtgccaccccatgtcggtgccctcgtggcaccacgtcggccttcccgtctgccgtggtcaccacgtggccgccacatggtgtgcccgcggaccggtccaccgtgcacccgcttcccttgagccaccgacaggtggggcccgcttgccggtgccaccaattcccctcggtgacgtcataattcacattaattgtgcaaattatagaaattcatttaaaatgtctcaaaacttctaaaattcataactaattcatacgaactccatattgggccattcaacttgcaaaattcatctaaaaatgagctatacatgtttgtttactttttatgtactgtttacttggtttttattagagttttttctcattttgtgtgccagcgcgtagattccgccggttcagaagtttgctttcgcctcagataagagttcagaagattgttttgaagaagcaaggcaagtcacacattccccttaagcatttttagcctaatttataaatgttttatcgtttacaaataaatatgcatgtttttctaattacatgggaatatggtttacctattgttggctgttgttaaacaccgattctataccaccaacatctgcataaagttcaaataataaaacattcagcatagtgataggtgcttaatctcacatattccacaagtgttggtgtatatttgtatgcagatgataaaccctgaagttgaaaggaaaatcagactaaagtgagaagaaacatgtatccatacaaggatgggttgtgaaattcctcaaaatatcaaagactcagcccaaaactccgagaaatggataaaggaggaccaggggaggagatgggccgaaggccaggccaggtgggcccagcccaggttcgagcgaaccccttggttcggctgaaccaaaatctcagccgtttaggctggggtttggcgtggacggtcctggtcatctcctgatggcggttgctgggcatttctgacaattcgcattgtgtaagcgtcatacct

SEQ ID NO: 15150 - DNA, 1501 bp, Oryza sativa
atccggcggcccccaagctcagggtggccatcggctagaacttaggagccgtttgagatatagttaccaaatacgggctagaacttaaaagagtcgtttgagagatagcatccaatgacgggccagaacttaggagctgtttaggagatagttaccggtgatgggccttcacctgtcagaggtgaggtggacttaccactaaccacttatctctaacgaggatagtacccatcacaaatgaccatttgagcctgtcagagatgatatggaccagtctagtgagtacatttatttcgataggtaagttgtgcattcctgtatagctctgccaaagggaaccattgcacgtgcttccttgccgaggttgaattcttacgtatgcaaaataattttgtaccacattttatcatcgcactagtcaagttattatatcagtacgctttttttaaaaaagtttttgatggatcgcacgtagctattaaatcttatatcgtgagcataatttacgccctttttattactaaagatattaggtttcattcgccataaaagaaatatttctttgtgtagacgaattaaagtaatctacctgtactgatcttctgatgtatacgtacgtacgtatccgtcattattgtgctatcaattagtctcaccaatggtacagttggcaatttcggggggaccaaatcccaaaatttttgaaagttcgaagcaaataaataatatttttgaaattgagatttgaacatattttagctaaatttactcgtaataacttttggctaaattcaaagattatggggtgagtataactcaattggttatgttctttatagtgtaatcaatccacccgaattttatttgtacgtgacatcgtactcgttgattgtgaggtgtctattgaaacttcgtcaattttaagttatgtcggttcgttttctcaaatgagagagtgtgtgtgcgcatcttgtgtttatagtatgtttctaaaaaggaaaaatcaaagattagcttaattagccacaattctaccgggacccaccaaagtgtgatttgcgaaccctgaccagtacactgatcgactgtacatctccctaaagtcaagctagctgcctatcatgtcagagaagaaccacattccatatgctttcgttctagtacaagaagaaactggagaatttttcgcttcataattttaattttactcactataattcactacgatccacggatccagcattgatgacaagcagtgaattcggcgcgaaagttggcagctccatcgatctacagatctacgtactctgtacctttcaccgcccgcagatcaagtgagctgtatcatcaattcaatttatcaacatccatgcacacagttgcagctagcaggcgatcgatcgatcgatcgatgaagcctatataaacccatgcatctccaaaccatcttcttcatccatcacctcactcacctagctcgatcagatagctactctttcca

SEQ ID NO: 15151 - DNA, 1501 bp, Oryza sativa
gggcggcccgaggggtgcagactcggcggcggtgtgttaaccttcggctgcttgcctttgatgagatggcgacaggaagaggctgacggcaaaggccgccgtggagcaccggtggttggttcacggggaggcgcctcgccgacttcagattcacaattttttcacattcttttgaaaaaaatcaaaaccaactttaaatgtcaaacgagacgatgtaaatgtttgttggtcgacttaagtttatttattcagattgattgccttaaaaaaattataccaaatttgtttgtaccaaaaattatacctattgccttacatatcggcaagcacgctacaatactcttcatggacagaggagcaatgatgaaaaaaaatttactaatatacttattttttcaataatttacgtttatatatctgcattgtaaggatttgtaaaaatatacccatcctgcgacggtcccacagctctaaaacacgaaaacgacggtcccacagatccaaaacgcgggaccacgacggtcacgcgtgaccaaaacgcggcagcgccataacagccatttttatcaatgtgttgacactgttcacaaactagttggcactgtttgcatgccggttccgcacaataatgggtctgcgggactgcctaatgaacagtgctaaacagtgtttaaaacagtactaaacagtccgatcggataataaattcgctctagccgcggtgccgcgttttggtcgcgtgggaccgtcagcggtcccgcgttttggatctgcgggaccgtcccgcgggaccgcgcgttttggagctacggaaccgtggcaggagggtatatttttttcaattcctttctatgcatgtatataatggtaaattattgaaaaaataagtatatttgtaatttttttccgagcaatgatggggtaaaaaggagcctcatcattcgtcctatggcttatcaaaacttgattttaaagttggttttgaagttttgtttttcaatgtagttttattttttagctttggtttttaagtcacactaaggacacatgtagtaatttttacttgcaaatcattttttatccctaaaaataagccgttactggcttactgcttatataatcagcaaccaatgagcccaaaatcacaagaagaaaaactggcaggtaggtccaattgtatgcagataattcttccatcccatcggtttaccactacagacgctgccgcgaccgcgagatacaaaacttgaacacgactgttttcaattcacaagcaccacatgcgtaacacataagtataactgaaagaagacgacggtacatgtcttaggctattgcaggtgttatgctggaacagcgtctaagcttttatcttgtttcataattagttaaacaaatccatcacattgcgtgatggctggattggcggcaccaagggaacggaaatgaagatattgtatatggtaagacttgtttgcgactctagggcagcagagattat

SEQ ID NO: 15152 - DNA, 1501 bp, Oryza sativa
gcaatattgaccgagtctttcttacacgtggcaccaacgtagcgatagaaataaaaaatatgcgtgggacccattagtcataaatatgggcccactgacatgtggggcccacatgtcatacctgctttctcctccctgtttcccttctctctctttctctccccttcttccccttagggcggtagcgtgcggtgacagctagagcgagcggtgtcatcattcaccaggcgcgttgatgcaaaaaatgacgtttgaatacctcgcagattgttcatagggactctgggtaacacaacctcggtgaaaatgtaaaaagttcgttcaataactactggagttgtggtatatctaacatattcacagtctgttatttattgtgatgctagcgaactatacagatttttttttttgtattgctttaacccttctttttgcaatgagactggtttcattttgcccagtctatttttattcactgtgtttacaaatcaatatcttatacagcaaactatgtccattcaccccaaaccacacacacgcacgtgaaatgtataatcaatttaagccaccatgaatacttaaaatgcttcttctattcgatgttattagctagaggggtggatctatgatgcaaggacatagatgcgtcaacacgacacaataccgatctgcggattcaccattttcagaaaaataccgatacggcgacacgtctacatattttaataaaaatactttcaaattctcaattatttacaactaaaataatcaataatgtattgcaagcaagtacaatgtacctcaaggacaatccttagctcctaaaaggatggcgctttggtgggggtgtgtagggggatgtgatttatcatgtggctatgtgggccgggccatatcgcatatgtcatatgtgccggagatgaatcgaccatgtatcagaacataaaactaattatttttttctatttaattttacaatacttggtcgatacgtatcggaggcgtattgaagatgtattgatatcggacatgtcattggtcactggtgcataacgtttccatattattatgtttacaagctaataaacaagctaaccaaatattaagtactaaactaatggagacgcaatccaacaaacagttggtagctcctctgtcatgctgctgacccactgcatatgcatcttctgtggcttttgtggctttgatgcatcagagtaattagtgtgttattgttgaatattaattattgcttttctcatctacttggggattccacttatatagcagtgaagaaaataatgcaaaaaaatataaatcagagtaattagtgtgttcacttctctgataataacatattaatattggcagtataaatgctgctgccttggtggtgctttcgtttgacttattttggactactatccttttttcttccacacagctattcgatcctttgatttctgaagctgagttcatgtttttaatgattccatgcagt

SEQ ID NO: 15153 - DNA, 1501 bp, Oryza sativa
ccgcgcggacggtgaccacggcgtggtcgaagtacttgtgcgcctccttggacagcgccgccgccgtattctgctgctgcggcggcgcctccctggccctggtcgcgcggcacgcgacgttgttccgcctccgcctcgtcgcgtgtagctcggggaggcgaagcgcgggccgcgcgtcgcggtgggcggcggcggcgcggtgggcgcaggccgcggcgtgggaggaggggaagcgcgggtggaggaggagcggcatggcgcgcggcgcggtggcgtcgctggctcactggcggtggcgcggcggtgtgcccggtggaggagacgataagccgcggaggcgtagcgcgtggctgcgaggaggacgtcggcctaatgggccgtggagttggcctgtcggctcggcccagcatgaagagagcggcgggcccggcagcaggttgggccgaatataggccgtggagcgcgcaatttgtgtttggggtaagtctatatcggcttcctcatttcatgtcttgctcttgaatcttgatcgaaccgcatcccttaggtggtaatcttttctcctgaagattaagattaagtttttttacataaaatgaggtggtattcacgtatgattgattgagttttcattattacaaacttgaaaaatagattaatatgatattttagagcaattttcatatagaaagttttcgcacgaaacgcaccgtttagcagtttaaaaagcgtgccacgaaaatctaaatcttcatcggagaaaagaacaggaccttaatcgccattcaaaacagatatctaatgtaaatttagaatttttggccttcgtgtatccctagaattttgaggcaatttcgtttttgcccctatttcaatgttcaatattgattttgcctatgttttttagggttttcgtttttgcccctatttttttaaacaaaacaaacgtttgcccctattccgataatcttgctagcagtgttaaatgtgaggtaaaaagacaagtatacccttagatattttccggtatttttgtaccactttcaaatttgacccaaattttggcacactttcacaaatttggacaattaaattactgctatagtatggcatcaatagatttatattttgattatgccaaaagtacggaaaaatgtctaagggtatatttgtccttttaccccccacattttaacaccgttaacaagaattaacataataggggcaaacggttgattcatttaaaaaagtaggggtaaaaacgaaaaccctaaaaaaacaggggcaaaatcaatattacacatcaaagtaggggcaagaagagctggtaatcgcccatttacctaacattggagacctttttcgggtcaattttttctttcaaatacaacttttcaaatatcaaaaccaggaaacagaacgaacatgaactgatgaacctctcaaagtaaaaaagaaagggaaaaaaaagaacgaacatggagacgacgaacagagaggc

SEQ ID NO: 15154 - DNA, 1501 bp, Oryza sativa
gttgtccatcaataataccttgacgacttgctacctgcctctctgttcgtcgtctccatgttcgttcttttttttccctttcttttttactttgagaggttcatcagttcatgttcgttctgtttcctggttttgatatttgaaaagttgtatttgaaagaaaaaattgacccgaaaaaggtctccaatgttaggtaaatgggcgattaccagctcttcttgcccctactttgatgtgtaatattgattttgcccctgtttttttagggttttcgtttttacccctacttttttaaatgaatcaaccgtttgcccctattatgttaattcttgttaacggtgttaaaatgtggggggtaaaaggacaaatatacccttagacatttttccgtacttttggcataatcaaaatataaatctattgatgccatactatagcagtaatttaattgtccaaatttgtgaaagtgtgccaaaatttgggtcaaatttgaaagtggtacaaaaataccggaaaatatctaagggtatacttgtctttttacctcacatttaacactgctagcaagattatcggaataggggcaaacgtttgttttgtttaaaaaaataggggcaaaaacgaaaaccctaaaaaacataggcaaaatcaatattgaacattgaaataggggcaaaaacgaaattgcctcaaaattctagggatacacgaaggccaaaaattctaaatttacattagatatctgttttgaatggcgattaaggtcctgttcttttctccgatgaagatttagattttcgtggcacgctttttaaactgctaaacggtgcgtttcgtgcgaaaactttctatatgaaaattgctctaaaatatcatattaatctatttttcaagtttgtaataatgaaaactcaatcaatcatacgtgaataccacctcattttatgtaaaaaaacttaatcttaatcttcaggagaaaagattaccacctaagggatgcggttcgatcaagattcaagagcaagacatgaaatgaggaagccgatatagacttaccccaaacacaaattgcgcgctccacggcctatattcggcccaacctgctgccgggcccgccgctctcttcatgctgggccgagccgacaggccaactccacggcccattaggccgacgtcctcctcgcagccacgcgctacgcctccgcggcttatcgtctcctccaccgggcacaccgccgcgccaccgccagtgagccagcgacgccaccgcgccgcgcgccatgccgctcctcctccacccgcgcttcccctcctcccacgccgcggcctgcgcccaccgcgccgccgccgcccaccgcgacgcgcggcccgcgcttcgcctccccgagctacacgcgacgaggcggaggcggaacaacgtcgcgtgccgcgcgaccagggccagggaggcgccgccgcagcagcagaatacggcggcggcgctgtccaaggaggcgcaca

SEQ ID NO: 15155 - DNA, 1501 bp, Oryza sativa
atatgactttttatgaatgttcccgataaaaaaacattaccctattaatatttcaaatattttttttaatttattatatttgttttattttcaaaatttatgtcaaaattttctgctctaattatttactctcattagtttcataaaatgcatatactgtgcactcaaataaaaatttcaacctttttcaagcttatattcaaacctaaattaatcatcaagagcataacagacattcaccaccaaacgtcacagtgaaaagaaggaaaatgtaacggtagggacataaaggaatcaagttaaaattttaggggtatagaagggatcaggtaaatttcaggagtacgaaagggatcgagtgaattttcattggtacacagagaatttactcatagcaaagcgctagtgactgacctgtctctcccccatgtcaggcaatggaaagcaaggagcgatgttgtatgaaatggattgcttcaatgcataggttttttttgaaacaaacccgaaaacataagctagatattgtgatatttactttatattatcctctggagtataggaacagaaacaggtgagaaaaggatcaaactatgtcagcaacctttttttttgtcggaatatcacagtattttaaaagcagggtcgtgctcctccttctcctccattatagtttcccatgtaaaatcaaaggtgttttttattattattctgtgatgaataattgggcattggagattattgattttgatatttggaatttattcacgaagcggttttggagatgattggatttcacaggtgctcgcaggatttgttatttcatgtgaccggtcagaccgggcgctggtagccggtcagaccggcgtgtattgcgcggtcagaccggctagcccacggtctgaccggccgacgctatgtcggtttcggtttcgagttgtttgtttggatatccgtgattatttcatgattatggcttctagatggatactatacgtatgcaatactgttatttgctactaatgagtcaagttagagatagcttggtctcggaatatggtttctttgtttatttcatgtgtaggtgactcgatgtctcaggagagtatttgcggtgatggaccaggagtcgacatggggataagacgacgtccgtggtggtcagagatcatgcgggatacttaggctagagttgatgcacgtggttgatggagattccatatggcatacgatggaggtattgtgtgtgtatgggatgcgtagtcgaatttggaaggagtccaaatttggttcgattggttatgtaaagtttctttcttgtactagagggtttcctaaggtgtttaggactcttagtatgagtttggttcgtggctttaggctgcctacccttatgtataaatagagggggagcgtgaggcttccctgtatagctttagagagcaattgagttgagttttgagttagggtttcgagtttagtcgaaatttttgaaaggagt

SEQ ID NO: 15156 - DNA, 1501 bp, Oryza sativa
ggtggataatcagctgagtgtgcatgtaggtggcaaaggtattaacaagaatccatattgttatagatgctatactaaaggccatacgttgcaggaatgtacatctaaattttactgtgaggtttgtgaaagtgaggaccatataggatccaggtgtcctatttttaggtctaataataaaccctcagctgagttgtgtgggtatgcagtggatggtcttggtttttttcatatccctctttcagctggccagagaataaaacatgattctaaggctgccctagttaaagtaactagaggacaaatgacggtgcagaccgttgtttctgaattggagagattgattcctggaaattggaagtgggtggtggaagataatggagataacacttttcgtactatttttccttctgctgcggaactgaaacgcatggtagaatggggaatagtacatactaaggttagtgatgcagaaatgaagataattgaaaggggagttagtaatgaggtgaaatatgtgttgccaaaggtatgggttcaatgcaaaggcttaccttctgagttaagggagtttttaattatttgggcggttggttcaatgttaggtattacaaaaatggttgatatgaattttactagaagatatgacattgctcgtttacaagttctggttttagatccctctcttatccctgatgtggtggatgtggttattggggataatttgtatgagctgtgttttaaggtggagccagaaaatgggcttgatgtgcctgaacccatggacatggataatagtggtgatagagaagatggtaaaaatatggatgggagtgatgtgcaagataagggtaagggatcagatggaagtaattttaaggatggttccctactgcaaggtggtggccagtttagtggttctgtttcaggaaaaggaacgtcttctgagccatctactcaggttttgtcacctattattaaaggattctcaggttttgtcacctattattaaaggattgacagtatctgatgaggagtttgatgggcttgtggaggaatctgttggggcaggatcagttaagtctcatgaaagtctagctgttaagttagcggcagtacctgacacgattctctcccctactagacaaagcaagagaagagcaagtgatagtgatcaactcactttgcagagggctgaaaagattaaagctggggggaatttggaggttcagaatgttaaaggtaatttgcattttaatgattccttttttacatttgtcagataaagttatttcgtcctctctttctaaactgggttttatcgatgcaaacaatgatagtaattttgtgaatgctattaaggatataaggagtttggaagaagctaggttaagtgattgtattagtttgaaagacaagcataattctactgtttttcctgaaaatgaattgaccgacgatcagttggaggataattcagttttggaaaaactttgtagtg

SEQ ID NO: 15157 - DNA, 1501 bp, Oryza sativa
tgtcagctcgagtcactaaattacagattgtgcaatagttaataaagtgtcggtttagggggtcaaacggtgtccgattaggctgttttttgacagcttggaagggaatcatagaccatcatttctgccaagtttcgtgcaactgtggtttggagatctcagctgagaaccgaaaaggacagaatctgctatttctctacttgttagttgatatacctcttgttagctttgatggttgagatgttgataatgccatgtaacttgatgttgtagctgttgtgatgtgtctttagatattatagagaagactacatttgtacctattgttgattatagtggaagcttggagtggaccgttggtcccgtggttttttactcctcacaccgaggaggtttttccacgtaaatcactgtgtcttgtgtgcatgtgtttattgttattccgctactgatttgccagttgaaactatcctcaaagttcatgccaagatgaagggttgattgtgtgaaatatgtttgccggttggtgaattgtagtttgcacactaaaagtgttttttgcgcagtcccaacaccattttcttgctgcacttaaccaatgcatttctggctaaatttaccatatgattaattatctaaacagcgttttcttgttgttcatgtcatatatagagtttctagacagggatcatataacagtaccgaaagaagttcctatatggtgatttattaatgttatctaaaataaagatcatactagtaaatgagtttctactaacagaccatgttatatgaagatccttaatattctttacccaatcatcagtaattaaaccatatcatatatatcatatatcctcactcaggtaggcgcgtcgcgcgatacaactgaaacgagaggcctctcgctttagattttacgttagacagaacattgcatccatgaaagtagatgcatgcatggaaggagatgatattcactttcgggcaaataaatcaccaaatatttagggtgtatctatacaacttttaaaaatttgagtcaaatgtaaagtacattataactagtattataagtagtatatgtaactcgtactctctccgttttacaatgtaagtcattctagcatttctcatatttatattgatgttaatgaatctagacaacatatatatctatctagattcattaacattaatataaatgtggaaaatgctagaatgacttacattgtgaaacggaggaacggaggaagtatatactaaacaaaacatgggttcgattcttcccgctaatgtccattctattttctaagctatgcagctctttccttaagtttctgtatatgtttgctccgatctgctgcagccaagggcaccacttgggccgtgctaacatcgctaggccagggcgaggctgggctgcagcctgcagaaacctcaaggtccgaggaacttagtgctctctctgcacatcattatacttgggcctgcatctaga

SEQ ID NO: 15158 - DNA, 1501 bp, Oryza sativa
ggtggataatcagctgagtgtgcatgtaggtggcaaaggtattaacaagaatccatattgttatagatgctatactaaaggccatacgttgcaggaatgtacatctaaattttactgtgaggtttgtgaaagtgaggaccatataggatccaggtgtcctatttttaggtctaataataaaccctcagctgagttgtgtgggtatgcagtggatggtcttggtttttttcatatccctctttcagctggccagagaataaaacatgattctaaggctgccctagttaaagtaactagaggacaaatgacggtgcagaccgttgtttctgaattggagagattgattcctggaaattggaagtgggtggtggaagataatggagataacacttttcgtactatttttccttctgctgcggaactgaaacgcatggtagaatggggaatagtacatactaaggttagtgatgcagaaatgaagataattgaaaggggagttagtaatgaggtgaaatatgtgttgccaaaggtatgggttcaatgcaaaggcttaccttctgagttaagggagtttttaattatttgggcggttggttcaatgttaggtattacaaaaatggttgatatgaattttactagaagatatgacattgctcgtttacaagttctggttttagatccctctcttatccctgatgtggtggatgtggttattggggataatttgtatgagctgtgttttaaggtggagccagaaaatgggcttgatgtgcctgaacccatggacatggataatagtggtgatagagaagatggtaaaaatatggatgggagtgatgtgcaagataagggtaagggatcagatggaagtaattttaaggatggttccctactgcaaggtggtggccagtttagtggttctgtttcaggaaaaggaacgtcttctgagccatctactcaggttttgtcacctattattaaaggattctcaggttttgtcacctattattaaaggattgacagtatctgatgaggagtttgatgggcttgtggaggaatctgttggggcaggatcagttaagtctcatgaaagtctagctgttaagttagcggcagtacctgacacgattctctcccctactagacaaagcaagagaagagcaagtgatagtgatcaactcactttgcagagggctgaaaagattaaagctgggaggaatttggaggttcagaatgttaaaggtaatttgcattttaatgattccttttttacatttgtcagataaagttatttcgtcctctctttctaaactgggttttatcgatgcaaacaatgatagtaattttgtgaatgctattaaggatataaggagtttggaagaagctaggttaagtgattgtattagtttgaaagacaagcataattctactgtttttcctgaaaatgaattgaccgacgatcagttggaggataattcagttttggaaaaactttgtagtg

SEQ ID NO: 15159 - DNA, 1501 bp, Oryza sativa
ggctcaagggggccttgaccgcgccctgatcgggggcgcccagcccaatggctggtgggcccccgtcacactgcgccatataaaaggggggtggaggccggcacggcacatggtacgagattcaccgccgccgccaactccaccccacaaaaccctaatccgatcgagagggggcgcagccagtgacgggaaacgccaccgccgcatccacgtcaagccgcgacgacaacgacgatgtccggcgcctcttcctccacgatctcctcaaccggtcggtatctaaaccctctccctttcatctacaatgtcgttcatcaaacccaaatagaaccacccgactagatctaacctaggtgatcctagtgcaaagtttaacaatggtatcagagcaaccctagtgtttagatcgtttcggggaaagaaatccaaagaaagaaaagcacaagatccgcacggatcaaaagaaccaaaaaccctaaccctaattcttacctcgtcgccggccgtcgttgacgccggcaacggagggggggaggggcaaagaggcgccgcctaggagccactcgacggccgcgcgcgcacctgcacgcgcgtgccggcgagggggcccgcggcggcgccgccatctccgtcgtcgccatctctctctcacacggtgggggttagagacggtggggggagcggagaagagaaaagaaaggagcgccggccatggcgcggcggcgcgaaggtcgccggcgatggcgacgccgtccacgcggtcgcgtgagagagagaagagaagagaagctagggttttcggcggccggccgggagaggggggtttttgatcctccgatctcggcgcccggccgtccgatcgaaaccctagctgatcggacggccggcggcggccggaccgaaatcggcccaagtggggagcgcgcggcggcggctttcccggcccaggcccaggttgcggcctgggggaggggagggggcgctcgcccgcgcgcaaagtggccataggccgaccggcaaaggccggaaaagttcaatttaggtccctcggggccgaaaatgaataaaagagaacagtagcaatttttccattttattttgtcgatttttcatgcaaatttcaatagaattttgaatagatttttgcatgttttacctctgtttaaatttgaaccaacgggagaattttcacagagagagaattacagagattttgctactgttcatatgattttatatagtcttccgctgcaaatagatgaaattgatgaaaattagtgtttctaaaattaaatttcgaaccaacgggagaatttaattttaggaacattaattatgtgctatgatgttgtaattttctgaccaacgttgttaattgcaatattatagttatggttatatgtgttatgtctaattctgcccaacggtgatgtaggcttaatgcataatattttaatgttaattttgttctcaccgcacatgattatttcaggtggctact

SEQ ID NO: 15160 - DNA, 1501 bp, Oryza sativa
ggaagaaaatcttgctcacttacatgtgagtcaccagtccaatatgcaagtttgggtaatactaaaacatagtgtaaatgaaaagaaatgatattacctagtgcaatatgtaacttagttaataaaaaggggtccaaagtacagtttactctcaattaaatattagctattgtaaatattgaaaatggatttattttttttaaaaaaactattgtacatattaaaaatattgtaaatatttacaatatgtgtttgtaatgtcatattttcaaatagacaaatttataatggctggatccaattaaccctacttagtactaatcctatacccaaatcaagtttcaccataatgtcatccaaaagaaaacaaattaactaattctccatcaatcgcattaattttagatgtatgtgttggcgacgtcggcgaggtgcccagccagctcctccggcgcggagagcatggccatgtggtcgccggcgtccatcaccctcacctccgccacctcggcgttggcgaccatccaccgctggtgctcctggacgatggccatgtcattctcgaccaccacatacacctttctcacggcgccgtacctgtcctccctgaacgccgcccgccgccgcagctcatccacgtacaaggagctcgctcgaaccaagctcttcgcaagcgtgtaatcctgtgctgattaggttatgaactgattagatcatggttaatttaatcaggagttgtgcgattagtgattaattaacagtttagcagacgcacttccggtgagcttagctggtagagcttcttcttcaggaactccggcccgaacaggatggaaggtgggacgtggcttggatcgatcacggtgtccatccaatctgattcttgatactggcagtggcagaaattcatggcgaaaataagaggaaaagaaagcgtaattttgtcatcatggtatgagtttattaccgtgtcgatggggtgggagggtgggttggcgcagtccggcaggaaggcggcgacgaacacggcggcggcgaccttgtccgggaacgtctccgcggcgagcgcgacgctcatgccgccgaagctgtggcccaccagcacggcgcgctcgccgtcggggagcgcgcggacggcgtcgagcagcgggcgcgcgtggtccgcgaacgacgacgccggcgcgccgcccacgcccaggcctcgctgaccggccgcgccgaggtccggcgcgtccacgcggtgccccgcggcgcggagcagcgcggcgaccttgtaccagcaccacccgccgtggcacgcgccgtgcgccaggatgatgcgccccgccgcgccggcggccggaagaggagccattgctttcaagaggaacagacaattacgagcagaggtcactaactcactatagtgaatcgattgaatgattgagcctagtgcatcatgaatagcggaagcagccagtgttgacaattatttgccttttgaggaaagatggctttgagc

SEQ ID NO: 15161 - DNA, 1315 bp, Oryza sativa
gtcactgcgcccgtctcggcttggtagtgccaccctccgttcccctttttcgctggtcctctccttccttagctcgcgtggtagctcggctagcccccccgaacacgcatggacgctgccccaggtctcgccgccgcccgccataggcttgctgccgttgccgcccgctcccggaggccgccgccgtcgccagccctcctcggcagtcctccgccccatccggtgccggaaatgagttccccgcgccccggagatgctccctcctccttgaatcgacctctcgtcgccccgccgcgatttccccttttgatcgccgccggccgccaccgtcgaaatccgtcgccgtcgaatccccccggcgaatccgagccggaggctcactccctcttatcctagccatcgttccggtgtgctccccttggccctagacctccgcatcaaactccggtgaactcggccaccgtccgccgtccatctcggcatcccccttcttcctcctctcgccgcccacgtggcctggcataggtgccacgtcggcttgacccggtcaagccggtcagccgctcgccctcgccccttcatccccgtgcgcgcagaccccggtgagccatgaggctgcacgtgggcccgccgcctccttgtcgaccagcgcaccgcatccgcacccaatccaccggtccgtctcgctcgtccccgcgtgcgccctccccaccatacacccgaccgcccccatgtgggcccatctcgggaccccgcgcggaggaccgcgcccaccccgtcgggcctccccctctccccgcgcgccctaatgggccgcttccccgtggccgcgctcggcccaatggccggccaagccttgagaatccctcgggccgcgcctaagtcgcccgaggaagtctaaatccgatccctccttccttttcttttccaagggaattaataattccttttccttgtccaggaaatccatttagacctccaaaattcatatccctcgatccgtagctccgatcgcctccgttccacttccagtaattccgtaaaattgagatctatttaatggcactactaataggtctaaataggatatttcttttggtcttttgtttaggttttcgattgtttgcgtatagttgcggttatcggttttcgttgatcgcgggttctctcgaagattcgtgaagcttcgtgaagaccttgagcaaggcaagtcaccctttgatcaattgcccctataattgaaaagtcattattattttgtttgcaacttgcattattagaatcacacacttaacttgcttggcctcggtttgcg

SEQ ID NO: 15162 - DNA, 1501 bp, Oryza sativa
tgtacacctctgatcagagtaaaactattcgaatagccgtgcccacggttatgggcggtcgaccagattcaccgtgattagtcccacctcaataaatcgacctaatacactgtagtttaggtgggttggttgggcctgttcaacgtggtgtagcgttgatcagtggagatttaatgttactttaattactcaacggttttactgttttgctcaataaaatgttttacaaccgcctttatgcaaatagccacaaaccgtccttgtgttccccttgcacgtctgcatcgttggtgtggcttgctgagtacggtggttgtactcagccttgctattatttcccccttttcagaagtgtagtgcttctgagctgaagatggagttagaggaccaaggctcagaccccagttgagttttgcctgtggagtggagctgaagccccgctaggatcgcctttttccgctgctgctgcttttgtttcggtgtgaggactaagtgcctcttctgtaagtattttacgctttatttacgttcggaactgtttattacttgtcgttttgtgtaccctggctggtcctggacagggatttaatacacaaaatagtctggaaatttgggctaaatttctgggcgtgacaagcatcttcctcaagctgaaatctgggaggggtcgttaccggcggggtcccggatgcgacgacagtgggaagtcgaaccctgtgcgcggcggtgctccaggacaggcggcggcgttaagaccgaagtggttttcggcggcgtcgcggatagaaggtgaggcgggcagctccggagctcggcggtcaggcataaaccggtgcgacgcagcaggtgggcggcggcgcttgggccgagagaaaggagagcgaggggagcgaggaggacgcagaaagaggaagaggaaggggaaaaggagagaggagaggggagaggaaggagaaaggatgaagatgatgacatgtggggccccactatttttatgtgtgaattacatgttggtcccacgtatttttgtttttgtttttattctaaaatgccacataagtgacacgtcaacgacacgtaggacggagaccgggtcaacactaccacgtaagcgctacgtaagccaaaaccgcttccaaaaccacctgggatatattttgtaccggttttgatagttggaggtgtcgatatacccggttttgtggttggaggtcatgaatcatactcgtgccatagttaagggagtcaaagtatactttcgcggtcacgaaaagtttgggccgcatggcccacaatagaggatgacacggtttatctgtgggctgaattgggcctttttggttgactcgaatctgcctttccccgtcctcccttcctgtagcagagtagggagagcgcagacacacaccccccatactgccacaagggccgccgccgccgccgggagcgatggccgccgccacctccatcaacgccgtcccctgctccgctggtcggccga

SEQ ID NO: 15163 - DNA, 1501 bp, Oryza sativa
cgtcgaggagcgaggcggtgtgcgccgacatgggatgccgcaagaagatcaagatggagtgcttgagcgaggaggatgcgtggaacctgttcgaggccaacgctcgcgaggagacgatccatcgccaccctcggattcctgcactttcaagacaggtaatcacttgatctgtctttgtttgaaatcagattggttcaaaacaagcgctacgtttagcattttcagttttccttcaaaaaatagatatcttccatccgttagatcatacaatggtacatgcttaagtttcagtctaggtttgatgctaactgtaaggatttatttcgattgagaaatgagatggtcaaattctcatgtctccgctaactgaatttccttgtatatttttttataaatggattttccgataaacattagctacctttttaaatcaggatcatctctgtgatttcctgttctttccagctactaccaaattgcaaatcacaaattgaatgctatcagattattatcacccaatggttatggtacaatactaccctttgcagaatggtcttgcagaagattttaaaatgtgttccgttttacacaaaggcaatcgaacaattctgtttctctattttccatgataatctttctgtttcttcaatccttttgcactggcttgttgcacgacttatcaacgtgttatgtacttatgtgccatcaagtttagttgatgtatttcatttacatttgatctgttccatcattgacaactgctaataaattcgttctacaactaaacaggttgcttcagagtgcaagggcttgcctttgtccctcgtcaccgtcggccgcgccatgtcgagcaagcgcacaccgaaggagtggggcgacgcgctcgacgccctgaagaagacgaagctctcgagcgcgcccggcccggacaagatcgctcaccctctagtgaaattctgctacgacaatctggagaacgacatggcgagggagtgcttcctggcctgcgcgctctggccggaggatcacaacatctccaaggacgagctcgtccagtgctggacagggctcggcctgctcccggagctcgccgacgtcgacgaggcgcaccggctcgcgcactcggtgatctccgtgctggaggcgtcgcggctggtggagcgcggggacaaccaccggtacaacatgttcccgtccgacacgcacgtcaggctccacgacgtcgtccgcgacgcggcgctccggttcgcgcctggcaagtggctggtccgcgccggcgccgggctgagggagccgccgcgggaggaggcgctgtggcgcgacgcgcggcgggtgtccctgatgcacaacggcatcgaggacgtgccggcgaagacggggggcgccctcgcggacgcgcagccggagacgctgatgctccagtgcaaccgtgccctgccgaagaggatgatccaggcgatccagcacttcacaaggctgacctaccttgacatggaggaga

SEQ ID NO: 15164 - DNA, 650 bp, Oryza sativa
aaagatattttcccactatttcgaaatttttttaaacccggttagggttaagaaccgggactgctgacaagcgcactgaatattaatttccattacatatgtgtttctaaaatagaaaataatgcattaaaattatttgaagtagaaaaattaatgacaattacttcgaaaaattattgttgtctgtaataaattaagtggataaaacgtaataagcaaatatatgatttaaaagtaataaaaattctaataatcatatatacttagcatatgaatgatattaaattgttaaaaactctaattaacatatgtatatacatacgccatgcatgatttagaattaataaaaattgtaataatcatatataattagcatatgaatgatattaaattaattgttaaaaactctaattaacatatgtaaatgccacatgcatgatttaaaaattttaaaaattcgaatagtcatatataattagcatatgaatgatagtaaattaattgttaaaaactctaattaacatatgaaaatgacacctgcgtgatttaatacttttaaaaattataattatcgcatataactagcagcatatacatgatataaaagtgttaaaacctctaataatcgtgcgtaattaacatatgccata

SEQ ID NO: 15165 - DNA, 1501 bp, Oryza sativa
gcgggtcgtcgaacttgagcctcgccgccagcgcgttgaggccgatgagcacccacgccgagacgaacccgcagatgatcgcggcccacgggtcgacgacggagcaaccggcggtgatcgccgcgaagccgccgaggaggccgttgcagacgtcgatcacgttccagtgccccgtctggagcctcttcccgaagagcgtcgtgagcgccgccgtgctgccggcgagggtggtggtcacggcggtgcgtcccaccgccgaccactgcccgtggatgctaccgggcgggccgtaggatttgaggatggtgaggaacgagccggggttaaacccgtaccacccgaaccacagaaggaagctgccgagcacgacgagcgacgcgctgtggccgcgcagcgccaccgagcggccggcgtggtcgaaccgcccaatgcgggggccctcgatgagggcgccccagagtccggccacgccgcccaccatgtggacaacccctgacccggcgaagtcgatgacgccggacccgaagagcagcgaccccgacgtccgggaagccgaggcccacccgtcggcggaccagatccagtgggacaccaccgggtagacgaagccggtgaggaaggcggagtagatgaggtacgccacgaactgggtccgctcggcgatggagccggacgtgatgcccgcggcggcgatggcgaaggcccactggaagaggaagaagctgtagtcgaagccgacctgtgggacctgcttgaggccgaagaagtgcttcccgatgaagccgttggacggcgccccgaaggcgaaggcgaagccgaagaggtagtagaagagcgcgccggcggcggcgtcgagcacgttggtaagcatgatgttcatggtgttcttggcgcggacggacccggcgcagagcatggcgaagccgagctgcatggcgaacacgaggtacgccgagaagagcaggtacgtcgagtccacggccgacgtcgtgtccgcgaactggttgcacaggtagtccgtcgcgttcgccgccgccgtgcccagcagcgggccgagggtatccgcgcacgttgccatcctcgccgcctcgacgcgcgctcaacacagactgtagaggagaggggaggagcaatggaagtgtgggctgtgggtggagtggggagcggccgcgtcggatttataggcgacgtggagagggagcgagaaggaatccatgacttggggggtgtcgttgttgattccttcaaagtgtgaagggcccacctgccagtgaatctttggctacctctgaaatgtgggacccctatgatttgcttgttgatttgtccccctcctgttcgtggtcgtagttcatcgaatcccgtggaatctctctataggcctactgtaggctgcggcctggaggctgtgtttagttttttgatataaagtttttgaagtacacgcatacatattttgaagtattaaatatagactaataataaaataaattatagattc

SEQ ID NO: 15166 - DNA, 1501 bp, Oryza sativa
taaggcttgctgccaagatattattatcaagattcctgtttataatttgcttatttgcacacgctactttatcctggcaaatccattttattctgactgtgatttagtgatgcctatattttgttggcgcctacaatacaatgtagatactactagcatatctgcttatgaactacagatctgcaaatgcaatggatctcaaataattatgcccacggttcccacattagatgcgcacgagtaattaaactctctgcaaaatggttccagaaatgccaacaggacaatgaacaaagcctagtcagtttagcttcaaattcaaacacaaccaatttgcaaggaatagttaatttcggagcaaatactatcgaacaacagaactgcgcagaacattcttcagaggtagtacatggctgatcacaaaggacaatgatgtgaccatgactactatagatacaaccgtcgttcacatcaagatcaagctgtccaagttctgcaatccagttcggtcacctgctacagtgtcgacttcaaacggccgccaaatatgcatgcgagctccattttaggtccatgagtacttgatggaaagctctcggagtcatctttccaatggatccagcttcatcgccaaattccatcccagtcgggcgaaatcacaaagagaaggtgttgcgtcacctataatgggcctatgggcttgtaacttcgtctgggaccccggcccaagtggggcccatgtggggtgcgccccaaccaggtggagcacgaccctagggtccccttaggtcgtcctcccacctccttaaatagttaggtacccctttacagtttattgggttttgatagattaaagtttagccattgctacttgcttgcagcgcgcgtgtcggctagaccgtccgtctgcttgttcttcggaaccccaacttatcattcgtatttaattcttatttgcaattcagattacttttatcttgttattgcttgtgtcggtgatatgggaccgggagtatcatgactagaggcttgaggcagacacaatcgcccacgtggcctggcaccttcggggacgtcgggcccgagggtgaggtgtccgccctcctcctgatttcccccgagggggggtcgggttgcgcttgccccggccccgagggccgaggcaccccgacccccttaaggaagtctgcgccacatatatgggataagtgagcacagcagtgctcacctaacagcatttattgcagtctggtcaagcgtgtcacgctgcatgcaacgcagtacagcacgctcttttatccggtctgtgaccagtcacagaccggtcagatcaagggttaggtggcgactggcggtctgacgcacgccttgccccatcccatcaagacgaaagcctctaggcactcgtctcaagccggagcaagcgtgttatttcttagagatggcacgttagccctggttagatttataccaggcttcatcctaaccattacaggcaagg

SEQ ID NO: 15167 - DNA, 1501 bp, Oryza sativa
cagggaagaaaattacacaggacttctttgcgtgacagctgtataatacgaatctcaaagcaacatgttttcttccctgatttccccagagacttgacgagtaaacgtgttctcctgctgtcgccgcacgccggtcccaagtggtctcactgcgtcccctgcaatccttggcggtgccccctcactctggcccttccttgtgtccttgtgggctgtggccctccgtgcctctcgtcgcgtggccaacggtgctagctgcagctcagtggcttgcacgtgtcgaccagctgactctttgttagactgactatgcaggtggtggggattatcacttagttctcgccaacacttacgttgtctcagatgaggcggaccaggaggttttttcggagctgtcaattggaaagaagttcgacacctaaaagataatagagtaggcatacctataagacttcaccatggtcttggtgatgtgctaagcaatggtggttgcagggctagagattggctcatggcggagccaagagcatctcactaacactagtatcgacaattacgagtttgcgacgatgccaagattgtgcacaccttatcgacaaaatcatcacttgggtgcttgatagagctctcgacactttaatttcctcatccttgtggcatcatttttgcagtttcgtccatgtccgacgtggaggataaggcaaaaataccaaaatgaccttgtagccacctataaggtggtagcgctcttgttgttgctagtccagtctaacttccatgttgctagaggcccaaagggcacctccgcataaacaaagctagagcacagctctgcatggcatcctccctatggctctagttgcctagagtttggtaggtaatctttcctgcacgcccccctgactttgcattgcatccttcggtgagctccgtcccctgcttttgacgtggcatccacctttgagctctccaccgttgtttgcatactcccactgtcccacatctcatcgtcctcgacgtatccaagaataattacatcatgccaaaaatatctacacaaattagatgagttagcaagcttgtcctctaatttgatatgcataagttgatataaatgaaattggatggatgccaaacttttgagctaatctaattacatagtagtagaagggaaaaaaaaagaaataacaccataaagaaatcatcatacttgtttctggtttcaatacaaacttttttcctctaaacttatacttcctccgtctaaaaatgttgctaactaggatgagattctgaacggttaaattcgaggacctatattttcaattttctgcgcttgagaaaataaaagggaaaatgtcatgtctcctcccgttaaaccctagcttaagcccccttcctcttctccgcgcctccgcctccgcctccgcctccggtctcccctctcctcacacgctccggctccgacggacgattcccacccagtaatggcgatggattt

SEQ ID NO: 15168 - DNA, 1501 bp, Oryza sativa
gctggattcaagcagcagctggttgactttggttaccagcacacaattaacctaaaatttaattaactgttggttctggccgattaattagttatcttacggttgcagcagcaatggtgttaccattaatttttttaatttctacgtaatctatcggtgggatgtacgatggattaataaacttcaactaccttttaaaaaaaaaacttcaactaaataattgttattactgtcatgtactctgacttatttttcgaggggacaggcagggagttcctacaatttaatccagtttataaggaaaaccggaccaaaaaattttacaacagcacggttaatttatgaaaaactggcgaaaaccccggcattgacatactgaacctaaaaactaagaacagcagtccgacaagggataaaactcctaaaatgaatccttcaagaaggatacgccgacagaacaacgacatcgtccgatcctaacgaatctaaggttttcatccggagaaatctcttgaagtggggtttgaaccagggctccaatagcaacgccttcaagaaggtaaacggcacccaagggtgtcgccgttgctagcatcggcaagttgagcaaggctttcgcctcggagtcccatccaaacatagcatccgcgacggaagccaccaaataccacctgcacaccgggtactgtttaagaagattgacagcaactgcagcaggtggcaattccaacttggattggtgcagctatacatgatgtaacatgggaaagtttattcgtcgctcgaggaaacactcctttaattttttatactatttgaaaaatcataaaaatattaataaaaagtatatcaataatacaatatattgataaataaaatacaagctcaaatttaactagaaatgaaaataataaattaactcagaataaaacatgtcattcatagttaaatttattttttaagttatatatattaaattgaatttacatatttgtcgagtgacacccccacatatttaatttattttattatcttttttattaaatttattaataattttttaagatgacataaaccgacatacacaagtaaagaaacatagcctccaacaacaaaagtccatcatataatcatatactatttggacaacggaaagcctgtttcgacttgtcttctcccctccggcttttctgttccatgcgttttctgctctgcaactgcaagcaagtccctctgctagctgcgagcctcacgtgcccattcactctctttatttattgctgattcccgatcgatcgatcgatcgatcgatcagcaggcaatagttaatcgatctcaacaactacccatcagttattcaatacaatacagccattcagacagaagcaaggtctatcgagtcagagagatcgacatctcggcgagcgagatcggtgaattgatgggtgatcatggacgccggcggcaggcggcggcgccgctgctggagaagaagggcagc

SEQ ID NO: 15169 - DNA, 1501 bp, Oryza sativa
aaggggccttcatgcatgaccagtcagccaaatcaaaattaaaaaaataatatggatcccacattcatgcgttggaggagcaattagttatctacatgatttgaaagagctcaagcaataaatctcattgtgcaaattacaattgctgtggaggaagattttcagcgattcgagcattgtcgccagggagaagataagaggacactaccagggaagaaaattacacaggacttctttgcgtgacagctgtataatacgaatctcaaagcaacatgttttcttccctgatttccccagagacttgacgagtaaacgtgttctcctgctgtcgccgcacgccggtcccaagtggtctcactgcgtcccctgcaatccttggcggtgccccctcactctggcccttccttgtgtccttgtgggctgtggccctccgtgcctctcgtcgcgtggccaacggtgctagctgcagctcagtggcttgcacgtgtcgaccagctgactctttgttagactgactatgcaggtggtggggattatcacttagttctcgccaacacttacgttgtctcagatgaggcggaccaggaggttttttcggagctgtcaattggaaagaagttcgacacctaaaagataatagagtaggcatacctataagacttcaccatggtcttggtgatgtgctaagcaatggtggttgcagggctagagattggctcatggcggagccaagagcatctcactaacactagtatcgacaattacgagtttgcgacgatgccaagattgtgcacaccttatcgacaaaatcatcacttgggtgcttgatagagctctcgacactttaatttcctcatccttgtggcatcatttttgcagtttcgtccatgtccgacgtggaggataaggcaaaaataccaaaatgaccttgtagccacctataaggtggtagcgctcttgttgttgctagtccagtctaacttccatgttgctagaggcccaaagggcacctccgcataaacaaagctagagcacagctctgcatggcatcctccctatggctctagttgcctagagtttggtaggtaatctttcctgcacgcccccctgactttgcattgcatccttcggtgagctccgtcccctgcttttgacgtggcatccacctttgagctctccaccgttgtttgcatactcccactgtcccacatctcatcgtcctcgacgtatccaagaataattacatcatgccaaaaatatctacacaaattagatgagttagcaagcttgtcctctaatttgatatgcataagttgatataaatgaaattggatggatgccaaacttttgagctaatctaattacatagtagtagaagggaaaaaaaaagaaataacaccataaagaaatcatcatacttgtttctggtttcaatacaaacttttttcctctaaacttatacttcctccgtctaaaaatgttgctaactaggatgagattc

SEQ ID NO: 15170 - DNA, 1501 bp, Oryza sativa
aatagcaagtactaacaatgtttcttcaagtatatcatagattaagcatactgccgcttgaggaaaaaaatgttacgcccacataagaagttatcaatagccaacttaacattttgtggctcctcatttttctaaagaaatgtgcagtaagtacagcgcttcgtttcctttctccattaagtacaacctcaaccagatgactgtgatatggctaatgcaaagcaacgctcttttgaagcttctagaattatcctaattttagagaaataacttgtatgatcataataacataactctgccttccatctcctagggtaagcttactcagatcagcttactcttgatgggtcaaaagcagatagagtaattcactgttaaatctttttacaaagatatgaaaatacgcatttatttttcacataggaaatatggaaattcaagatccccttgaaaaatcaaagtgttcctgcggcttcttttgagaaacagtatactaacaaaagataatttaattataagaggttggcagaagggggataaattttgtcaattctgtgatacagcagaatcaatgcaacacctttttatcgaatgccgaattgcaaaagtgatctggaatgttgtttgtagcaacttgaaaccttttagagatataaatcatctttttggtagttggatggagagctttcagaaaaacatgaaacatcccatttgggttggtgtggctgctattttatgggtcatttggaaaacaaaaaattctgcttgttttaagaaacaacttcctggagatcccacagatttgatttattatgcttgtcattggattacatgttgagctggtttgcagatgcaggaggaagagcgaagagggctgctgtggggggtccagctcctaaagcaatttgtaaatgacatcttcaacacaaggttcgggtggagggtggggatgaagcggctaccagctagaaggcttcactctggagtttgatttcacctgaagcactgacccggttcttctcactgttgacaaaaaactggaagtctctcagtagggtgggcttttgatcaggttgggctgctgggttctgtttggctgagtccctagagtggctccctgtgtctttactttgtgctggctgctggcaattaggaggttgtgtgttgacacccaacccaaattgaccaatgaaaactctatcaggatagttggtggtttccttttatgttttcctgaaatctgtagctacatttctgttaatggaaatgtgggaactgggaatggcccttgctctaaaaaaaattcctaggctaggctcctagtcatgccacattaaggtccaggtgagttggaaccccccatgtaataacgaaatgagctagggcaatttagtagtgttcaaaatgatgctaggcgagtgacggggtaacatggtggtgtctagttcctagttagcaatagttggcctgaatggcaaccgtgctaggtggcaggttggtg

SEQ ID NO: 15171 - DNA, 1088 bp, Oryza sativa
ccgccttcttgtctcgcgccctcatcctccccacgcgcacgccaccgagagggaggggggaagccgcgccgagctcctcatcccccgccgccgccgcctctgcgtcacgcgccgccgctccatgtcccccgccgacgacgacgagagggagggggaagcggcgccgagctcctcatcccccaccaccgccgcctccacgtcacgcgccgcggccactgccgctccgtgtcccccgccgccgctgaccccgtgagagagagaggaagagtgagagtgagagagaagtgagagagagtgtgtgtgagagagaagagagagttgtgtatgacaggtgggtctcacaattttttttaaatagaatgctgactgaactgtcacgtgtagaccaaaaccaccgcggattgggtcgaggggggtaattcgtccggtattcatagttgggggtgaagaatgtccggttttgtggttaggggggtaattcggacagccgcgatagttcgagggtaattcggacagctgcaatagttcgggggtaattcgtacttattttccttctagtaaagtatgttagaaaaatcattctttgattatatcccattatttaattagttccgttagaaaattcattctttgattctatcccattatttaattagttcctggactttgtgtattactagtactactccagcacgttagccgatattaatcatatccttgttccaacaaccaacgatgtagctcgctgacctttaaataggcggttgaggtcttctttttttttaaaaaaaaaaacaatgaaacagatcatggggtctatttagagttctgaaaagcaactggttggtagctagcttctaaaaatatgaaaaatctgtgtttcccaacttttgttttctagtttattttttaaattttacaactatatcttcttaaaatctaaataaaaaactagaccgtttgagagagtttctaattctagaaggagctgcatcagctataacctccccaaacaagcccaatatatatgatccggctttcgagagaaagccaagatagcaagagagtccacggctgaaatagcgaaa

SEQ ID NO: 15172 - DNA, 1501 bp, Oryza sativa
acttgtggctctatgggcttgtggcttggacctggacttgtgggtttgtggaacacctggacttgtggaggtgcacctggacttgtggctctatgggcttgtggcttggacctggacttgtgggtttgtggaacacctggacttgtgggcgcacctggacttgtagctttatgggcttgtggcttggacttctggcctggcctactgggctggcgctagagaaaagtgaaaaaccgaacaaaatcggatccgtgaaaaaagcatgtacgggcgaaaaaaattacgcacggacgaaaaaattggtgactaaaggaaaaatccgaatatttatattagttaagatgttgttaataaaggagagaaagtaaggggggagagagagagatacataagtacgtacgtgcacattcatacatacatgacgtgaaggggtgggaggtgggtattttcttttttttatattgctaagataaattaatggtagaaaataattggtctaccatatttaagttgaaatcaatgttttttttgttttttcttcgtaatttctgttattttctctaatttattagtgtgttaattgacggctaaggagctcatttagttcccggttattgaaacacaaacgaagtaatcattaagacaatagtttcacgtgacaacttcttttaattaattaaaatatagttgatatggatgtgacatttttatagataaaatacatcatatgctttataaaattttaacatggaacaactagagaaaataaaataaaggtgtaggattggttgctttctttaccgtaggtgaaaacgtgcatacatatatgttctttttttatttttttcaaacaaatagtctttttttgtttttctttagcacaaatagtgcgtagtttttccttacgtaagtttgcacgtgcgtgcatatgggctggtggggatgccctgacgtgggctgatgggtgataggagagggaggtgaaaaaaaacaattctaatggtaattaaaatggtgggtctaactatttgttaaggtgacacacggtggtttaggagtatttgtaggacttccacatggttgtttatgagtatttgtaggaagttttatgaactttagtattatttatgatataatagaagataatagatgtcaaatttttaagttgaaaaatcaaacaccctcccaacaaaccttgtactagtgtgtaattatccgatggcgatcagaaataattcagaagggtgaaccacacgcgttaggtcctgtgcctagtaacatttaagtcgccaactaccgctgagaaatgacgctattatttaacaaaatagaaatatactccattcgtcctaaaaaaaaagataaaccctaattttcgtgttcaatgtttggccgttcgtcttatttgaaaaaattatgaaaaaaattaaaaagacaagttacgcataaaatattaatcatgttttatcatctaacagtaatgaaaatacgaattataaaa

SEQ ID NO: 15173 - DNA, 1501 bp, Oryza sativa
cacataaaactgttatcagatgcatatttcgagccgcctcaaaatattcgaaattaacagaatccattcagatttcgtcgagactgcgaaacctcgatgttagcataagagcatagacataagaatgaattgtctatgaaatttgtcatagtaaaggtgtgtagaaaattgagcgatgaactggatagcagtatatataatccatgtcacatggtatatttacacgatattttctaaataagaatggcatataactagctctataatagtaatatatgtcctggtcccacatagagtgttttctgattccgaccggccgatagtgttattattatattcgtttttgtttccgataaaaaaatttgaatcgaaaaaagtctaaacagacgaaaagtatccataccagttgcatcccctagtcacaacaacactttgagcttatgatctcaccatgaagctgcagttacaacatatctcactttgactgcttgttgttatcgttcttttataaaaatttccttttcatgtgtgatttatattgtgaaaaagcacaataaattttaaatggatttatgtctcgtgtgatgtgttatgcggatacgtctattgcacgtgcacgattagagggtgtctggttgattgcttcattttactacgtcacattttagtcatgctacattttctcaggcatgtgtttatttcgctaccacaactgtatcataccacactttcttacccttgggactcatacatcacaatctcgaatttagagctaacatgtcacacttgtgaccaactactccctccgagctgataatatcagccgtttcgaataagggtaaagtcaaactttaaaatagttgactataaataatttctaaaaaaatacttcaagaaaactatatatttgttgatatttctatgtatattataataggaaatagttgttaaagttacttttttttttaagatcgtactcttatccaaaacgataaatattattaatccggaggaagaatttcttagccatccttgcgcaaacaaatcataacttatacttatgttatagtcccgaataggttgagggtaaccaagacattgagacttgagagcataaaaaaccactcattttccgcggaattcggtgtgctttttgcttaaaccttggaccctgttacctgtttggctgacttggtcaaacacaactcacaactgcgttcgtccaggccggctgccgccgaacccaccaccatcccacgatcccatcccatctcatatcgtgttcgggcccgtctgcactctccacttccacactcccatcccacctccaccgaccgcgtccggtccatctccactccccccacactcctactcctttaacctccccgcgccgccgcctcccctccgccgagacacccaactgtataccagcagcagccatcctcgcgcgcgcgcgcggcgtcggcgatggcgggcggctcaacctcctcctcctcgtcgt

SEQ ID NO: 15174 - DNA, 703 bp, Oryza sativa
ctcatcccgtcgccggcgtggacctccgccgccgcgctcgctttgccgccgctgccgcccttccgccctgcctcgctgccgatgccccttcgccctgcctcgccgccacctcgcctcctccgccccgccgccgccctgcctccgccctgcctcgccgccacctcgcctcgttcgccgccgcgctcgcctcgccaccgccgccctgccttgccaccgcctcgcctcgtccgccgccacgctcgcttcgccgccgccgccgtccctccgcccttcctcactcgccgccgccctgcctcgccgccgcctcgcctcctccgccgccacgctcgcctcgccgccgccgcctcgcctcctccgccgccgcgctcacttcgccgccgccgccgtccctccacccttcctcactcgccgccgcgctcaccgctgccgccgcccctccgccctactcgccgtgggcgtgagagagaggttgagtgagacagagagtgagagaagagagagaggaagagtgagggagaggagagaggaagagtgggaggagaatgacaggtgggtcccacatttttttaataaatagaatgctgactggactgccacgcgtacgccacgtagaccaaaaccaccgcggatttaggtcgaggggggtaattcgtccggtttgtatagttgggggtgaaaaatgtccggttttgtggttcagggg

SEQ ID NO: 15175 - DNA, 1501 bp, Oryza sativa
acaattgaacatttgggatttcatttctgtttcattagtctttccctgaccattccgtgtaagctgcagtgtctgaactctgaaacacttccataatcttcccatcccaggcttgcacagaagatttcaaccggaaaacacactgaacttgcagtgctgatcattctccgaaaacgcagcggttcagttcagatgttacaaaaaaacccacttgtttccagtaggcttagccaaatcatcatgccgaggcaatcgaacagcactaatctactagagacgagacgaaacaaaaaataaagcaccagaatattttatctcaaaagagcattcaacttgccatattgcatattcgggttgctgtctgaaccatccctgtcatcgtctgccgcccagcccgccccgttacatacgttgtagaaaaacgaaggaaaaattctggtaaaatcgacggaaaactaacggaaacatcaccacactgcatgaccaagaggcttcgtttgtttgaaacaaaatcatcaatttaaatcagcctttcacacagcaagtgcatggctgatcgcattctttaaccccttttccctgcttcatcctcaccttggttatcttgagaggcacgaaagcatcgaaaatacgcaaatattgtgtacgtacgtctcgatcaaccaggatgaagcttccaagtaatacctggctaaccagcgcataaatatgccgatctcgcgaggccgctgcatgcaaacctgcaacacacaagaacaggactgagttgctgatcatgcgcttctcccgtctcgttttttttttattgtttggtgagacgagggattagcgacggtttcgatcgttttgttttgttttgttttgttctacagtgagccaagtacaggtcgatccgttggtgttgggtttaggccctgtttctttcagcttgggattattataatctagattatttggactaaactgaaagaaacagacaacttattgaagtagcttattataatttggagcccagcttattataatctgataagctcatttaggtgagctttttccagattattgggtgaaaaattatccaccatgccaccccactctctctttagacttgcaaacccaataatctaggctctaataatctagaaaagaaacaactaaccgcttattctactacagattataacaatctagtttatagtaatctgactcaataatttagattataataatcccaagctgaaagaaacatggccttaatataattaagcggcttattcgtagcacttctgccgttaatttgctagtggtgatattgccgcatgcttcatcaatttaccagtgaatcatcagctctgcgcttttcagcttcttaggtcccggccgtttgaactagggcggctgatggattatggctgaaattgatttcgtgatcattatttgagggaaaaagtatgaattacccccctaactatcgcggtcgtccgaaattcccccctgaacc

SEQ ID NO: 15176 - DNA, 1501 bp, Oryza sativa
gaggagaaatgcttaaacgtagaggtgagagcttttttttacgcgtgttacgttttatagagatgtgtacacatgtgtatactgggagtgggggaggggagggtgggttacacattggtatactagcgtccacgtttgtcgtgtgtttagggaaaaaaatatcacattggacatctgtgtttgtcccgtgtttcgaaaaaaacatcatgataagtgcaatttaggaaggacgagagatgcttaaacgcaaaggtaagggctttttcctttgcgtatgttatgtttatagagatgtgtacacgtatatatatgagcatccgcgtccgcatgttctgagaagaaaaagaaacatcgtggtgataaatctacatgagtgtactgtacacatatgtatactagcatccacgtttgtcccgtgttttgagaaaaaaaatcatagtcagcaatctatagaaaagtgtacaagtatatatattagcatccgcttttatcttgtgtttcgaaaaaaagtcatgatattcaacgaaagaagggcaaattagggaggacgagagatgcttaaatgcaaagacaagagtttttttttctttttgctcatattatatttatggagatgagtatgtacataactacataaatattcgagtaaccgcattcgaaaataaaacattgcgatgataaatctagatacgagtgtacacgtatgtatactagcatccatgcttgtctcatgtttgggaaggaagaaaaaacctcacgatgatcgatcaatctacaaatgagtgtacacgtatatatattagggggtgtctgggtgagagggactaaactttcacccaaacaccctcttagcattcgcgatccatgcttgtctcatgtttcggaaggaagaaaaaacctcacgatgatccatcaatctgtagatgactgtacacgtatgtattctagcatccgcgtttgtcccgtgtttcgagaaaaaaaaatagaaacatcaagataatcaacaagagaagtgcaaattagggagggggagaggtgcttcaaagcaaaggcgagacctttattttggttcctctacgaatcacgcatcaaaaattcctttttccttttctttcccactgttttataggtagagctggaagaagaagcagcgacccccaactcctccctccattcgcgcaaaaacaccgaacccacctgctctcctcccccaaccaaaaatcccttcctttttttttcttttttggtttttcttttattggctctcccctcgccggcggcgatgagccccaggagggagcaggcggaggagcagcagcagcaggggtggagggaggaggcggtgtcgggcgcatcgctgaggcaggtggacctggagaggggcgccaatgggtgggcctcgccgccgggggatttgttccacctgcgcgcgagggggtacttttccggcggcggcggcggcggcggtggcggtggtgggggtgggaggcgcgggaaggcg

SEQ ID NO: 15177 - DNA, 1343 bp, Oryza sativa
gcggcggaaggcggcggcgacggggatgtcgtcgcgggcgaaggacgtggtcgaggcgggagtggctccttaaccagtcgacgccggcggggcggaggagccactcggcggcggagggcgccttcccgcgcctcccacccccaccaccgccaccgccgccgccgccgccgccggaaaagtaccccctcgcgcgcaggtggaacaaatcccccggcggcgaggcccacccattggcgcccctctccaggtccacctgcctcagcgatgcgcccgacaccgcctcctccctccacccctgctgctgctgctcctccgcctgctccctcctggggctcatcgccgccggcgaggggagagccaataaaagaaaaaccaaaaaagaaaaaaaaaggaagggatttttggttgggggaggagagcaggtgggttcggtgtttttgcgcgaatggagggaggagttgggggtcgctgcttcttcttccagctctacctataaaacagtgggaaagaaaaggaaaaaggaatttttgatgcgtgattcgtagaggaaccaaaataaaggtctcgcctttgctttgaagcacctctccccctccctaatttgcacttctcttgttgattatcttgatgtttctatttttttttctcgaaacacgggacaaacgcggatgctagaatacatacgtgtacagtcatctacagattgatggatcatcgtgaggttttttcttccttccgaaacatgagacaagcatggatcgcgaatgctaagagggtgtttgggtgaaagtttagtccctctcacccagacaccccctaatatatatacgtgtacactcatttgtagattgatcgatcatcgtgaggttttttcttccttcccaaacatgagacaagcatggatgctagtatacatacgtgtacactcgtatctagatttatcatcgcaatgttttattttcgaatgcggttactcgaatatttatgtagttatgtacatactcatctccataaatataatatgagcaaaaagaaaaaaaaactcttgtctttgcatttaagcatctctcgtcctccctaatttgcccttctttcgttgaatatcatgactttttttcgaaacacaagataaaagcggatgctaatatatatacttgtacacttttctatagattgctgactatgattttttttctcaaaacacgggacaaacgtggatgctagtatacatatgtgtacagtacactcatgtagatttatcaccacgatgtttctttttcttctcagaacatgcggacgcggatgctcatatatatacgtgtacacatctctataaacataac

SEQ ID NO: 15178 - DNA, 394 bp, Oryza sativa
aatgcattatcgctttatttaaattcccgcgttatcactgttttatttagccatgcctatttacctttgttatgaccttattattattgttattgatattaataccttgttcaccctagaataaacaaaaccctaactagtggacattatattcatggttccactagtataaatttaggtagatgcttcgctgattaattaggcaacattaggtggttttataactttagacttcgggaattctcatatcatttggacaccatggaatggttggcttatgttggaattggacacacacctccccctcttttcaaaacccccaaaatggtttaggctgggctcgaggtgcgtggttgggttttgttagtcgtacctcgggtactataaggattaa

SEQ ID NO: 15179 - DNA, 1486 bp, Oryza sativa
aatgcattatcgctttatttaaattcccgcgttatcactgttttatttagccatgcctatttacctttgttatgaccttattattattgttattgatattaataccttgttcaccctagaataaacaaaaccctaactagtggacattatattcatggttccactagtataaatttaggtagatgcttcgctgattaattaggcaacattaggtggttttataactttagacttcgggaattctcatatcatttggacaccatggaatggttggcttatgttggaattggacacacacctccccctcttttcaaaacccccaaaatggtttaggctgggctcgaggtgcgtggttgggttttgttagtcgtacctcgggtactataaggattaagcttgggcctctgttgcaaagcactaccgtacttccacatgtctagtgggtaaggcttagtttgtggctcagtctggttataaacaaaagtacacggattggagatggatgaagtcgggggtcgatggacattctccagggcaaatgaaggctacacgagctgcggcccggtagtcgagatgtcatggcagagggttggtgccctgctgctagggggctcagtcctgcctgcctgtcccgggtgtcccggccgtagggggattgggtcggtactcttgtttatggctaggatgggttgggaactatgtcacgtcttccgtccgtataccgtggtggtatgtggcacgtggttgcacgcgaggaagatgtgtcttgtgggtaaagatgtacacctctgatcagagtataatctattcgaatagccgcgccctcggttatgggcaagccgagcaatgtacccaagtcagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgtttaataatactgcgtagctctaggatcgtctttataaaatggctttgggcaactaagtaacttttaaatgctgttcactgcaaaacttaacccctatattattaccccttgtacccccccttgcattaattatgcatctgccggtgtggcttgctgagtactgtggttgtactcattcttgctcaatctttcccctcttcagtaagagaagctttgaagaagatgtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtatggtgtaccccggcttttcctgggacggggattgatacactagcgttcgggaaaaggcaattttcccggtcgcgaca

SEQ ID NO: 15180 - DNA, 411 bp, Oryza sativa
gtacgactaccaaaacccaaccacgcacctcgagcccagcctaaaccattttgggggttttaaaagaggggggggtgtgtgtccaattccaacataagccaaccattccatggtgtccaaatgatatgagaattcccgaagtctaaagttataaaaccacctaatgttgcctaattaatcagcgaagcatctacctaaatttatactagtggaaccatgaatataatgtccactagttagggttttgtttattctagggtgaacaaggtattaatatcaataacaataataataaggtcataacaaaggtaaataggcatggctaaataaaacagtgataacgcgggaatttaaataaagcgataatgcattaatttaaatcaaaataattttataaactgggattcaata

SEQ ID NO: 15181 - DNA, 1501 bp, Oryza sativa; identical to SEQ ID NO: 15104

SEQ ID NO: 15182 - DNA, 1501 bp, Oryza sativa
tgccactgggagtagcagacaaccaacctccggtaccactggctgaacctctggcggctgatgctggagcgaaggagagagtgaacgcgggagctggaactggagctgcaggaactgcgggcggaactgaaggtgctgcgggagctgctgctggaggtgggttcctgggcgcaagctggatgcgcacaggtgcagtcgtcgtcttgcggggcatggtgcggatccggactcctcctggcgctggaagaccctttagctgagcgttctccttcttcaggcgcgctatctcgtccttcagggcgacgatcctcatgagcttcccatcgttcaaggccttggtcgccttgtgcaggtccgagtgcatcctgtccaatcccctcatcacagcacacatgtgaccaaaggtggtgtcgttctcgccagctgtcggacggaaggagctgacgccatcaccatgggctcgacgggggtggtagcggtacgccgtgtcgtggaagatgtagtcgtggcgctcccgtagtctggccatcatcaagtaggccgcctcctgacaggcgtgatctgctgtgcctccagatgcctcgaccgccatgttagcgaggcaagtccccacgtagccatggacctccaagcggacacggtgaggaagctcgccactgagcggcggaatcgtcgtgtactccggcgcgttgaggtagcccaccaccagtgtcatacgtgccaactctgccacgaaatcgatcatgccttctccgcggtggttgggtgggtgaccggccatctagagaagacaaaggagtaggatcaatgcatgctcaaatccaaatttaaataaagcaataaaagactcaaataagagaatcgaatagaagcgaaattttatgcatagatcattttgcatgagagcgaataaataagacagactcatataacgacaaagtaatgagaaattagatacatattaataataacaaacgaagcataaacaccttgcaacccatgttatagagctaggacctaatgcatttcacccatcaaaccccaactgactgacgaataaatcccaataattttactaaaaccctagactgactcgttttgaaaaaccccacttaaacgagcgaccaagatttttcccttgaaccacaagaacagatcccaattttcccggaacaaatccaattgcaaagagcatatgcaatgaaaaggattcagagggctcttaggtttagagggctcttaggtttccatttggcttgtcctacggtcaaggtcggctctgataccaacttgtcacgcccagaaattcccgaatagaattccaagcagaatgtgcattaaaatccccgtccaggaccagccggggtacacaaacgacaatgttgacattcagatccacgtcttacaaacatcataaaagtcttacaaaaaatgcagcggaaaacaaaaggaactggagctaagccttgactaaactgcagcgggaacaccactccacagg

SEQ ID NO: 15183 - DNA, 1501 bp, Oryza sativa
agcttgaatgcctgactgttccacatttcgtatttactcaatcatgtagtgtggagtagctaacttcatttgccaatcggcagactaagacctcgtttatttggaaaaaaattttaggtttagttatcacatcgaatatacggatacatatttaaagtattaaaagtactctaataataaaataaattaaaataaattacagattcggccaggaaactgcgagacgaatttattaagcctaattaatctgtcattagcaaatgtttattgtagcaccatattatcaaattatggcgtaattagacttaaaagattcgtctcgcaatttacacgcaaactgtgtaatatatatattttttcacatttagtacttcatgtatgtgtccgaacattcgatgcgatgaaggaaaggcttttttttttaactaaacgaggcctaaacaaagatgcaaaaggaacataggtggagccagtagcacaacgcatgacacacacggtgatgtcgttctgaaaaatatcaacaattgaacacgcttgggaggccttgtcctgccactatataccatatctccgtcccgtgaaattctcgagccgaaagatggatgcatatgctatgtttcattttgctaaatgatatcaattaaacggtgtatcaattccataaattggatatagcaataaataaatcagcaaaattcttttattttagatagaagaaacttttcttcttgaattcttgactgcttatcagcttatgtactactatttggccaactatttctcgtctgacacctgcttagtgtcactgtcttcgccaactaccccaaattaacatgtagtagtagaccggcttcgccctcgccaaatgataattatatgatccctccgttctattaaaaaacaaatatataattgaatatgatacattctaatattataaatctgtacaaatgtacatgtatattcatagtactagaatatatcatatctaatactagattagtttttttatgagacggaagaagtatagagcattgaaactcattgtaatcaacaggatcagggccgatcggtggaggtcgtgctcctgttttcctagagatgaaatcttatctctgcttcccaagattcagggccgatcggtggaggtcgtggcctatttccgtcggttgtttgtcaaaaaaaaaaaagaaaaggtacagtaaattttggctcgagtgcgtgttacacgtgaacgcggcagaattgatttccttgcaccgtttggttggataagaaattttttttctctgtatgtatccagaaggatatgccacctggatgctcctcctagctagtgtcactgtcaggtgggccccacccggttccccttatggccttatggtactactcctacctcgttcgcaaaatcctcctcccgatctccaccaccactttcccattgaccgcggcgggaaagggccttcgagacttgggaggttggagcgagcaagctcggcca

SEQ ID NO: 15184 - DNA, 1501 bp, Oryza sativa
gagccactgctcgacggtgaagagctgctgcgcgcagccgaggtggggacccgtgacggtggcctcgaggtagttgcagtaccagccgtggtgcgggccggtgccgtcggaggtgaggttcatccggcacggcgcctggcgcatgcaggggccgcggccgctgaagatgtcgaggttgccgcgctcgtagtagtcgtggccgtcgcccatgaggccgccccaccgctccaggtcgcggatccgcaccccggagccgtcggcgcccagcagcgtcacgccgatcaccgagtccgtcccgcccttccagatcgtccccgtccgcacgtatatcgtgtacacgcacttgttctccgggtccgacgacgcctccgccaccgtgatcccctcagccgccgccgccgcgtcgtcgtccgtggccgccaacgcctgtacaacatgcatgacatacggcgccctatgacgatgagaaggggggtttcgcgtacctctatgttgttagggagcggacgggacttaccgcgacgacggcgaaggagacgatgagaaggcaggagagcttcgccatggccgagcttgctcgctccaacctcccaagtctcgaaggccctttcccgccgcggtcaatgggaaagtggtggtggagatcgggaggaggattttgcgaacgaggtaggagtagtaccataaggccataaggggaaccgggtggggcccacctgacagtgacactagctaggaggagcatccaggtggcatatccttctggatacatacagagaaaaaaaatttcttatccaaccaaacggtgcaaggaaatcaattctgccgcgttcacgtgtaacacgcactcgagccaaaatttactgtaccttttcttttttttttttgacaaacaaccgacggaaataggccacgacctccaccgatcggccctgaatcttgggaagcagagataagatttcatctctaggaaaacaggagcacgacctccaccgatcggccctgatcctgttgattacaatgagtttcaatgctctatacttcttccgtctcataaaaaaactaatctagtattagatatgatatattctagtactatgaatatacatgtacatttgtacagatttataatattagaatgtatcatattcaattatatatttgttttttaatagaacggagggatcatataattatcatttggcgagggcgaagccggtctactactacatgttaatttggggtagttggcgaagacagtgacactaagcaggtgtcagacgagaaatagttggccaaatagtagtacataagctgataagcagtcaagaattcaagaagaaaagtttcttctatctaaaataaaagaattttgctgatttatttattgctatatccaatttatggaattgatacaccgtttaattgatatcatttagcaaaatgaaacatagcatatgcatccatctttcggctcgagaatttcacgggacggagatat

SEQ ID NO: 15185 - DNA, 1501 bp, Oryza sativa
gctcactgtcgctgactgctctctctgcttggcgtgtcgatcgatcttgtgcttgtgctgatcagctagctgctccaacttcgcgttggtgctttagtgacggattcaccggcggcaatgaggaggtttagtgccatggcgctagcgtttgcagtggtcgtgatgagctcgtgcgttgctgatggcgtcaggacgataccaggtaattcaccagagcttcccactggagtacgtactaatctgactaggaatacacgtgttcatgtagtaagcttttagtgctactcctgtgtagtgtgcactactagtaaagatggcacgtcgtacggcggatgcatcatgtggcatgtcccttcacggcctgaatcacctgcatttaacttgtgcccacatttcgttcattatgtacgtactacgtttttatgtatacgtaatgcagcaggtgtgcaaggttcagccggtggcctacacaacggcggcacggctccatctgctgctgctgcgaacgggagcaccaccaccgcctacgacgacagaggcaccggcggccagacggcgacgttccaggtgcagcagggcgcacagccggaggaagagacgacgacggagatgggcaacgcggcggaggcggcgacgggatcgcggctgccggactgcacgcacgcgtgcgggccgtgctccccgtgccggcgcgtgatggtgagcctccggtgcgccgaggccgcggagtcgtgccccgtcgcgtaccgctgcatgtgccgcggcaggttcttccgcgtgcccaccctctagccagccgagttcgcgtcgcgcggccgtgcgcccgtgcgtgcgacgccgacacgttgatgggtggataggtagagagaggattttctaatgccgcgttgtattttgtactcctaggccctagcacgcgtgtgggcaggtaggctgccggccagcatctacgcgagcacgcttgctgcactagctctcgtccctttcttttgcacttttgttttggctagttatagttttgcacttttggctgtccttggtagagtacgtaattaacctgggcgtgaacttttgtcgatcattttgttcctttgttggtatggcctaatatttaggccgttctggcgttctctgatgcagaacactaacggtttgtatggctaatcgggaggcagaaaatgccgaaaaaacgggacgctggctgaacaccgtgtcaggcagcagtggatttgtttatgtgtagcggttctggtgatggtctggcactctggcactcgcatgcatgacaccatgagagagcgcacacaggcaacctgcacggctgcatgatcattgatccagcctgcaacctcaatacaccagctcgtccgtatcagccgttgcatatgccatggaccttgtttttttcagataaagagttgagtttgctaccagtatagtttttcaacgaagagtaacaaagtacaggcggacacggtgtgacccgggagaccaaaaaaga

SEQ ID NO: 15186 - DNA, 1501 bp, Oryza sativa
tattgctgagtaaagaactattgtgccgatatggcggcagagagaggagagttgcgacatcaagctaacaacaatctatggcatgggctacaccgagttggaggtggagaacctgtgggaaggaggtcaccgccactggtattatagtttaggggaataaatcagatatttacgatggttaagagtagcaaatcgaacttacctttttttcccctcaacaactcacatggttcacgcttaaagttagttggcaaaattcattcatgacattaaagacgatttttacccttggagaaccttaccgaatttaaatttgaaaaacttgtggctgattttaaacactttgtacaattttaaaagctgtcccaaattgtagaaatcaaaaaaatttacaaaaaaaatcaactatttttttggaaaaaaatgaatgactattatttccaaaatttgggacaagttctgaattttgtaaaatatgtttgaattcagccaaaatgggaagagttgatgggaagagattggacgtatcacatcagatctatgtcatctttcatgaacaaggatagagacaaaaatgactatggccaagtttagttacaaactttttcttcaaacttccaactttttcatcacatcaaaatttttctgcacacacaaacttctaactttttcgtcacatcgtttcaatttcaaccaaacttctaattttagcgtgaactaaacacaccctataagcaacaacaaaagaaaggttgttttgaccacgatcatacacatcaacaaattgaggatgatgagtcgaaaagacttcaacaaatccttacgtagattgtataggagcaaaaaaataataaacaacatattgtggatacactaaataaattttacagcggcaaaaaataatcaagaaattgttgtcatgcatgaaaagttatatatatcatgaaaggacatcaacatttgtggatatcctaaataaattgtacagggcaaaacataatccggatttggataggggtttgtacatgggcaaaataaaatgatcaacaaactgctatcataaaaagacgtcaacaccctgaatatattgtacagggacaaaaaataattaacaccagattgtggatacactaaatacactgtacagcggcaaaacatgattgacaaattgttgtcatgaaaagttgttatcatgaaaagacatcaacatttgtggatatcctaaataaattgtatagggcaaaacataatccggatatcaacaaaaactgtggatacctaaatatattgtacagggcaaaaaataatcaacaacagactgtggatacattaaataaattgtacagcggcaaaacatgatcgacaaattgttgtcatgaaaagataacaacaaattgtggatagactaaataaattgtgctgggcaaaacataattcaaatttggattggggtttgtacagggaaaaaaaagatcaaacaaactgctatcatggaaaggca

SEQ ID NO: 15187 - DNA, 1501 bp, Oryza sativa
ttgggcaatatggctgagtaggaatgatatggtttttgacaaatcaccatcattttcctatatgcaggtcattttcagggcaactcattggctccggttttgggcacaactacaaaggtgtgatgaagatgaagagtttctgaaagttgcatgccgaaagttggagaccacggttatgcaactatttgccaattatggttggagatttacaaatagactttaataattgtgatctccttacgttatgttggtttctttgtttttctcttcggtgtgttctattcatttagatttatactatgttcataaaaactactatgtaataattggttgtagctcttttaagtaaagaccgggatattatattccattatctaaaaaatgtataatccatagtaaggtgaagctttcagtgttaactgaaacaacgtccagacacaagagccggctgcttcgcttcggtcagccttgactcctcgtactgttcctaccttactactagcatggtagcaacccgtgattaacacagggccgcacgtatttggcgtgcttaattcgtctcgttttacctaatgacttggttgatcggaccattcttgccaccaacctcaccatgcatgccttctgcttgccgttcgcctggtcgatcaggtcatggccgtggcatgcacaagtttggacttcagttgtcgccgccacaccgcgccggccccgacgatggaacgctgacccacggctcgccgatcctgatcatcttgatcggccgctcgctggcagccgcctcctcgcaccgcgccctcttcctcgtggcggcgccatgggtgtcgtcgaggagcacgccgaacagcttcacgcacttctcctcccgggcgtgctcttgcacgcgctgctcgccgccgacgccgccggccgccgctcgcatgtcttcctgcatgagcagccggagatcgagctgccggacgtcgaggaagcgcgacaggaagcccagaagctcctcgcagtgccgccgagcccgcgccagctccatcgtcagcgtttggttgtccttcctgagctgctcgttctcgctggtgatgtccgcccgcggcggcgaggacgcggaggaggagctgcggtcgttgccgctggacgtggtcgccgacggctccgggggcagagggggcagcggcggagggaacgcgacgttgacgccgctgccgcaggatttggaggactgaggcgtcgtcgccttgcggcggcggatgccggagaggaggccttgctctcctcgccggaagttgccgttggcgaactcccaccgatcgggcaccaccttccggaaaccctgcatgaatagtcgccatctctcgttagccccggtcagatcgtgtgaacgtattgaggggcaatcgtaacatgtttctgtcctaatcaacacaagacaataaggacatgtttttggcagaaagacactaagaacgtgtttgttatcacacatcgttaattcggtgaatgcacaagt

SEQ ID NO: 15188 - DNA, 1501 bp, Oryza sativa
ctgaatcactgtgcgcatgtgctgcttggacgggacgataacacgcagctcgacgttcaagcagtaatgcagatgctgcagcctgcaggggacaaacatccatacctaattaactgtagccctagcttaaagtagccgtacgtgtgcagaatgccactgagcggatcttacgagtaggagtatattttttatcagatcgatttgcgtggttggtgtacgtgtgatgattgagaagtatgcagaacattacagatcagatggatcgccattcgccacatgcattgtacgcatccaggggattcgtggactttttggagggacaagctgcgatgcatcaccacggctgcattactatatggcctatatatgtacgtgttgttaaactatcaaccaagcacgcgtccttatagctcaaataaaacaagggactatctatacaacattcgactaaaaattagcccaaaaatctgtcaaatgtaattgtaacataattacaatatattttttataattacactatatttatactataattacatatgtaattttcataattacactatatttgtactataattacatatataaactcgcatgtaattatagtataagtaagatgtaagtttaatctagatcataaaaatatagtagcccaatggggcagtcacgccttcatcccatgaggtcacatgatcgattcctaaatatgattttgtttttcttcctaaaagtacatatcttgatgcgtattaaactgttagtatgaatttaggacacatccaacggtttagaaagtgaaagatttagccataaaaatatgtcaacaaatatttagcaattccgataaaacaataacctaagttggtggaatctagcttcctgtgtcaatgagaactagagagcacgagggggtcgatgcccttccctcctgatttggcgagtcgttactaaactaggataaacttgtaccaaaacaagctggtgccaactaatccctcttttgactattacgacctccctaatcaagtaaccggtctacacagaaaagagcaagagcttttgccgcattggatatcttgtatatctaggctcctgtttgtgttcctaaaaggagcttcacgcatataattgggagcaacgagatgcctcgatcatgtgctaacccgccctgatgatgatcgatatatcgccaggccgccagctgccgatgcaaccgcgcacccacaaatcgcaattccaggatagtcagtttgtttcgattgggccctcgcatgcacgatcaccttcacacacgagcgcacgtccaatccggacccggcctcatgcttcaagtgcaactgatgaatggatctgcactctcatccgttcatagctaatcagccaacaaaagatttaacacttaattataaagttgattttaggattaggttgtttttatcgtagtctacttttcagcgtatacttatatggtacctttgaaacgtaagactaagaaaataca

SEQ ID NO: 15189 - DNA, 1501 bp, Oryza sativa
gagggggcgcggagaaggctataggccgcggcgcggcgcggcgctggcgaggcggcgtagcgacggcataggcgcgcacggcgcggtgcggcgccggtcgctggcggcgggccggcggcaaggcagcgcagcgaaggcgtagggcaggccggcggcgaggcgacgcagcgacggcgtggtcggggcggccgggtggcgctgcgatggggattgggttttgcaagcggcggcgcgtttggagggggagaacgggagatgcgttttgttctgtgtgatttagggctccccgtatcatgtacgtatcccgccgtatcgaaggagtatcggtatttttttaattatctgaaaaagagaaaaatgagggatacgtatgggatatgtatccggccgtatcccgcacgtatccgtatccgggcgcgtatcagatactgatacgagggtcagctgccatatcggggtaacgttgatgaaagggtacgtaggccttgtaggtccttatgaacttcaattagtactatgatgaaactgaaaacgaagtaaaatagtcaatactagcaacgattattgttattctcccatctgtgaaaggccgaacgagactgagaccacgacgagcacaaagctctcatggtaagtcgccatctcacggtacagagaaccagtgaattaaagctccccgggaatgcacgcatatctgatcttctctggctgctcgatcgccatctgacggtaccgaaaaccggtgagtttaaagcctccgaggaaagcacgcatcgatcttctccggctactcgtatagcgatcgattggcgccgcaggcaacgctgtcacttgattctcgaaagatcaagccatggatgcatcaaggcattgtgtgattgccggtccacttccatcgaccaagttcagattccccggggagatatgtgacaaaaaggaggagctagccagatcgatcgaccgagatcgaggcagctagtggccgttggttcgcgaccgctccccagctttctttttgggcgcatcttggggcacgcgtgcgtgagtacgtacatcctgcccagatacctaactctcgcagcagccggccggggccggggccggcgccgatctcgcatcgctttcggcaagagcggcacaggcattaggggctgtttagttgctgaaataaaaatttttgggtgtcacatcggacgtttgaccggatatcggaagaattttttttgacacgaatgaaaaaactaatttcataactcggctggaaactgcgagacgaatattttgagactaattaagccgtcattagtatatgtgggttactgtagcacttatgactaattatgaactaattaggctcaacagatccgtctcgcgatttacatacaaaatgtgtaattttttttatctatatttaatgctacatacatgtgttcaaagatttgatgtgatgtttttgcgaaaagtttttgggaactaaacatggcctaatctctagtaatct

SEQ ID NO: 15190 - DNA, 1501 bp, Oryza sativa
acatgttgatcccaattgcgaaattgttttatttacaaataaaattgcatgcaatgatgaacatcctacttgtgattatgccatgccttgattattgtttacccttaaatctttgtaaccatgtttacgtatgagtccctagtcaactatgacaattgcttagaaatgctattctagaatcatgcatactcatatttatcaaatgctatatgcttgggcaattacctttgggaaggtaattgagatgcggcatgtggagacatgagcgccacattgccatgatgttgatgacatgatttgtgaaaggagaaataaaattaaacaactgttttcgactggggcggacagaggatttgggtggtatctggaaaaggctagtaccgtccccggtcaattaaggaccgtgtcggtgacatggggccgggggtatcgtgactagaggcctgggtagccgcggtcacccacgtggcctgaccccctcgggggagtcgggcccgaaggtgacgtggccacccctccctctgtctccccgaggggtcgggccgctcccgtttcggccccgagggctggggtgccccgaccccctgtggttttggcgccacgtgtgtgggttaggtgagcacaccgggctcacctaaccgcatttatagcaggttggacgagcgcgccacgccgcatttaatgcggcgcagcgcacgcttattcggtccgtgaccgatcgcggtgagtgaccggtcacagaccggtcagatcgcgggttaggtggcaacaggcggcctgccacacgcctcgccccgtcccgtcggaatgatgagatcttcctagctctcgtccctagccggagccggcgtgccaactccaggagtgggtatgtcagtcccggtcagattcattccaggcttcagcgcaagtatgacaaggaagtcgctggccattaaatgaaggttgaaatgggcgtccaccggaagaggggcgagcggagcaagagacgtgcgctcggcttgtcagaggtcacttccggctgtagactagccctcattgtaaaagcatgtttcctttcttaggtagctagaggcccatgtggtgacccctgaccagataaaaaggaggcccaggcctaaaaaaaagggaggacgaaaggggagttgggactctggcgaatgttggctagaacctgaactctctctctcgctctcgagtctctggattccttcacacacagatccaccagaacacaggagtagggtgttacgcttctcagcggcccgaacctgtctacgtcgcccgtgtcttgcgcatttcttctctcgctgacgttcctcagatcgagggcgaagaacctcacttagcgcccccggccgaaccggcaaaggggggcctgcgtagtctcccggtgaggagccccacgctccgtcatctggcgcgccaggtagggggcgcgcgtgtctttctaagccctcgtcctctttcgtgtgcgccaagcttctcccgctcagcccaa

SEQ ID NO: 15191 - DNA, 1501 bp, Oryza sativa
ttccggtggacgcccatttcaaccttcatttaatggccagcgacttccttgtcatacttgcgctgaagcctggaatgaatctgaccgggactgacatacccactcctggagttggcacgccggctccggctagggacgagagctaggaagatctcatcattccgacgggacggggcgaggcgtgtggcaggccgcctgttgccacctaacccgcgatctgaccggtctgtgaccggtcactcaccgcgatcggtcacggaccgaataagcgtgcgctgcgccgcattaaatgcggcgtggcgcgctcgtccaacctgctataaatgcggttaggtgagcccggtgtgctcacctaacccacacacgtggcgccaaaaccacagggggtcggggcaccccagccctcggggccgaaacgggagcggcccgacccctcggggagacagagggaggggtggccacgtcaccttcgggcccgactcccccgagggggtcaggccacgtgggtgaccgcggctacccaggcctctagtcacgatacccccggccccatgtcaccgacacggtccttaattgaccggggacggtactagccttttccagataccacccaaatcctctgtccgccccagtcgaaaacagttgtttaattttatttctcctttcacaaatcatgtcatcaacatcatggcaatgtggcgctcatgtctccacatgccgcatctcaattaccttcccaaaggtaattgcccaagcatatagcatttgataaatatgagtatgcatgattctagaatagcatttctaagcaattgtcatagttgactagggactcatacgtaaacatggttacaaagatttaagggtaaacaataatcaaggcatggcataatcacaagtaggatgttcatcattgcatgcaattttatttgtaaataaaacaatttcgcaattgggatcaacatgttcaaggaatagtgatgacttgccttgctcaggatagtccttattcttgatataattcttgatcaaccttcacctcctggaagttgctgacgttgcctcacgactaaccgatacataaattctataacacgcaagaaaaaccaatattcaaataacaaccaaatatgcacaacaaaatatactattcatgtcttctaatggattccaatcacgctaggggctaaggtttcttaatctttctattgtcaacgtggcctatttaggagttaaccaacatagcatttataggatacatatatatttggctaatcggtggtttagtctatcaaatggctatggaaggattatggctaagcatgcatctatctacataggacggttatttactagaggttctgttgttagatggatttaggatcaatcaaataattacagtgaatcatttgtattatttattttattgatggaagctttactttaattatgaacatattttacttgtcacaataaattataaaaggttaataattatcca

SEQ ID NO: 15192 - DNA, 1501 bp, Oryza sativa
aaaactagtgttttatggcaagtgtcctagaatcatttgcagctaaaccatatataaataaattggtatccagttgctgatggccctgtacactcggaatccaagtgcttattaggtgcattgcatctctaccaatcgatcgggccatctgattggggaatgcgccatgaacaccaggagattctgtctcgagcgagggggccccaaattttgttggacagcttgatttgttctatgtatttttagttcgattttgtcctcaacaagatgggtttactgtttcagagcatatatacttttactttccccgaaataattgtgtgtctgtttctgaatttttggatgtttgcgtcctagctgatgagacatcgtacgttcatagcatatataattaagtacatatatagttaagtccgaacttaaaattgaattaaacctgaccaaatatgctctatgttcttgacgaaaaaggctatacatactaaaactttcttactgaacttttaataacactgatgtgttatatatgctgtgggtacatcactagatatccactcatctatgttaatcaaattgttgaaattattatttgtaagagtttttgttttttaaaaaaaatatgtgtagtagtgctccacgttcttattccaatcggctattgttgggagttggttgacacgtgggtcctctaaccgacatgccattttcgctctaaaagaaagttgggaattgatggtcgggtggtgacagaacaatcatcaccgctagctactcccttttataaggagtatagatagactagcaaacatacaacaagggaaaaaaatcataaggttaaaagagtaaagataaagtcacacaatttgctattgaaaacagggatagaaatgcaaatgccatgtttcttgggtcggtttagtcctaaaatttcatttgtgcaaactcgtccctctcaatgttgatttgcaccaagccaactcaatgtgaatctagcgtaaatagtaaaatccccgattaaagttcaaattgatatctcacatgggtaaatgtataatttgtacttcctctgtcggtgacatggggccgggggtatcgtgactagagacttgggtagccgcggtcacccacgtggcctgaccccctcgggggggtcgggcccgagggtgacgtggccacccctccctctgtctccccgaggggtcgggccgctcccgtttcggccccgagggctggggcgcccccgtttcggccccgagggctggggcgccccgaccccctgtggttttggcgccacgtgtgtgggttaggtgagcacaacggggctcacctaaccgcatttatagcaggttggacgagcgcgccacgtcgcatttaatgcggcgcagcgcacgcttatccgatccgtgaccggtcgcggtgtgtgaccggtcacagaccggtcagatcgcgggttaggtggcaacaggcggcctgtcacacgcctcgccccgtcccgtcggaa

SEQ ID NO: 15193 - DNA, 1501 bp, Oryza sativa
ttcactaaaagagcttacacaagccacactatacatacccttaatgaattatcatgttatctcatctattcatctaaggtcagagtaccaacaaacacattatcatctcatgacaacgatgagggagaagggaacctatctttcgttttactcatgtaggtcttccatccctaagatcttttagtgtttctttttttagttctttgccgccgacgactacatttatgaggtatacttgcataataaaacttgtttattgatgtgtcgattaaccaatattgacacgatcgagttcggattttgatgatccaactatagctactttaactagttttgtttttttttcggatttaggcagctagccggataatctctactaagaaattagaagtgtttccgtcgtccgttcatgaaaaaagagcggaaaaaatcgaatccgattatatgcgacatggtaaaaaaaatgtgacacggtaaaaaaaattaaatccgattccgtcgacgcggtaaaaaaaagggcgaaaaaaacgaatcttttcgattttaaaaaaagaaacaaactcccgtctgtttccaaggaaaaaaatagaaccgctggccatatccttttgggccgaataggacttggtttgaattataccaagtcctattcggttagcatcaccaggaaaacaagtgcatatatacacacacacgtagtataaagaatcacaacacataacaaagaatcacagacaaccttatagcacttagcactgaggaatattagtttataaggttgctgatgaagattttgccctaagtgaggaaaattggtctcattgtattaacccattaaccaaggtaataaatagcaaatagcaagctggtagaatcatagatagcaggtatattattatgggcacaaatttcaacagaagaacgaaaaaaatatcaccataagtttagattatatatcaatactaacatcgggtttcacataatagcataagaattacaaattaacataaatgaatgcaatataaagaagacacacgatgttaagttcttgtatatatccatgcacgaatcaagaacatcgtttatatatgtatcattcgactataacgtctatacgcgttcgttacatgtgagagacacacgtttttcaagtttttgaatgcagttgatatgatcaacttaacggtgagcattgacttgtttttttcactcggttatgcatgcattcatacacaccataattgcatatgcatgcgtactgattgaccatatgatcgagatgcacatgagctttttgcatcgttgccctgctgcagatgactgcagctatcagctgctatgcatgctatagtttagtttgtggtccgatcaagatcgatcatacatacatatacacacacgatgcataaagcgatagatcgagagggttggatacttggatcatggtgagggagacgcgcgtatacggggcccaggagatcgatctatcagttctctgaat

SEQ ID NO: 15194 - DNA, 1501 bp, Oryza sativa
acatgttgatcccaattgcgaaattgttttatttacaaataaaattgcatgcaatgatgaacatcctacttgtgattatgccatgccttgattattgtttacccttaaatctttgtaaccatgtttacgtatgagtccctagtcaactatgacaattgcttagaaatgctattctagaatcatgcatactcatatttatcaaatgctatatgcttgggcaattacctttgggaaggtaattgagatgcggcatgtggagacatgagcgccacattgccatgatgttgatgacatgatttgtgaaaggagaaataaaattaaacaactgttttcgactggggcggacagaggatttgggtggtatctggaaaaggctagtaccgtccccggtcaattaaggaccgtgtcggtgacatggggccgggggtatcgtgactagaggcctgggtagccgcggtcacccacgtggcctgaccccctcgggggagtcgggcccgaaggtgacgtggccacccctccctctgtctccccgaggggtcgggccgctcccgtttcggccccgagggctggggtgccccgaccccctgtggttttggcgccacgtgtgtgggttaggtgagcacagcgggctcacctaaccgcatttatagcaggttggacgagcgcgccacgccgcatttaatgcggcgcagcgcacgcttattcggtccgtgaccgatcgcggtgagtgaccggtcacagaccggtcagatcgcgggttaggtggcaacaggcggcctgccacacgcctcgccccgtcccgtcggaatgatgagatcttcctagctctcgtccctagccggagccggcgtgccaactccaggagtgggtatgtcagtcccggtcagattcattccaggcttcagcgcaagtatgacaaggaagtcgctggccattaaatgaaggttgaaatgggcgtccaccggaagaggggcgagcggagcaagagacgtgcgctcggcttgtcagaggtcacttccggctgtagactagccctcattgtaaaagcatgtttcctttcttaggtagctagaggcccatgtggtgacccctgaccagataaaaaggaggcccaggcctaaaaaaaagggaggacgaaaggggagttgggactctggcgaatgttggctagaacctgaactctctctctcgctctcgagtctctggattccttcacacacagatccaccagaacacaggagtagggtgttacgcttctcagcggcccgaacctgtctacgtcgcccgtgtcttgcgcatttcttctctcgctgacgttcctcagatcgagggcgaagaacctcacttagcgcccccggccgaaccggcaaaggggggcctgcgtagtctcccggtgaggagccccacgctccgtcatctggcgcgccaggtagggggcgcgcgtgtctttctaagccctcgtcctctttcgtgtgcgccaagcttctcccgctcagcccaa

SEQ ID NO: 15195 - DNA, 1501 bp, Oryza sativa
gccgtcgccacgccgccgctgtctccacggcgccaaccgccgccccgatgccgccacaccgccattaacgaacgagaacgagaacgatcgaacgaacgagaagcgagaacgaacacgtcaacgtacgttgccgtgagaacgtgaacgagaacgagaacgatcgaacgaacgagagcgagaacgaacacgtcaatgtatgttgccgcgagaacgtgaacgagaacgagaacgatcgaacgaacgttaacgtgaaatgcaatatatatatatatatatatgtatatatatatatatgtatatatatatatatatgtatatatatatatatgtatatatatatatatatgtatatgttacttcgcatttgactatatacatctttttgtatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagccctgtaattagacttatcatataagattgtgtagtgttctaatattatttgagttttaatataagattactttatttgtaattagacttagtatgtaattattgactacggaagtggtgcgacaagtagcaattgactattgtagtcttaattagacttagcatatacgcacgaaacacttagcatacatgactattttagtcttagcatgtaatattatttgaatatatatataagattactttatttgtaattagacttagtatataattattgactacggaagtggtgcgacaagtagcaattgactattgtagtcttaattacacttagcatatacgcacgaaacacttagcagacatgactattttagtcttagcatgtaatattatttgagttttaatataagattactttatttgagattagacttagtatataattatttactacggaagtggtgcgacaagtagcaattgactattgtagtcttaattacacttagcatatacgcacgaaacacttagcagacatgactattttagtcttagcatgtaatattatttgagttttaatataagattactttatttgagattagacttagtatataattatttactacggaaatggtgcgacaagtagcaattgactattgttgtcttaattagacttagcatatatgcacgaaacacttagcatacatgactattttagtcttagcatgtaatattatttgagttttaatataagattactttatttgtaattagacttagtatataattatttactagctagggttgtataatatacgtcacctagacttagcttatatcacgatttgtaattagacttagcacgtaagtttgtgtagggttctaatgtacgacatttacacttagcatacatgacttagattgttaaaacataaatgtgtcgtgacttagcagatgtttcttgtatcaacaga

SEQ ID NO: 15196 - DNA, 1501 bp, Oryza sativa
ccacttctcctctcccaatcctaacccatatgtcttctttgtctctagcctcaccttctcgcgcgcacggcaccgataagcaggcacgggtgtgtggacagccccctcttcctcccaagtcacaacccagccctagccttctcccttgtgtgccatgtgccttctcatgtgcatgcccgacgacctggtttggagctaggggcaacgcagccagcatctggcctcctccaattgaccatatgaaatcgaattcaaggtgagcatgaagctccaactgctgtatgcgcgggaggaggtgaagagaccgtcgatgcccaccacgctcctttgttttcttgcgtgccatttgtgataagtaacagtaacctagggtcctggagtctcccttcgacaacatattcaattctacggagaatctttctgctttaaatttatattccagatcatgaaatgaaataaataagttccggaacattgatccaacaataaacttagctatacaaagaaaataatttgtaacccaccaagtgaacaattatgaagctcttggattaaaacaaaacaatgttgcatactataaaaaaatagatattaatgtacattttgagcaaagttaccatttacagaagttgatgtgaatattactcaactaaaatggctatagtgacggcgcatggagcggccgctgggcgatgccacgtcggataggaacagtgcgcggagtgaaaatttttcgaaaaaaccctctgatttatgcgtaattagatctaggttccccacaaacagttctcctgaaatgttattttacataggggtccttctaaaaaccagatatgctgtgcgaaggacttaaaaaatcgtgaagccggatatatataaggaagaagattattaaaattaagcaataaataataaaaaatcattataaaaatgaccatcgtcttcaaaattttcacaaccacatgtaacgaagagtttgatcacgcgtctctcgtcatgttgtccacctaaaaaccatacacagccacttgtgctactagccttgtataaggctataagcatatcaccggtcactgacacgtggccccataaaccgccaccctgcccccgcgactactggcgcgcgccttctggactcttcctgacccttttttggcgggcgacgcacggtgcccttgacgtccacgtcgaccgcgaccaccaacctctgaccccgtcgccctccacgtcgccgcctccttctcccccgccgacgtggccgccgcctccgccaccaccaccgctccccacctccccgtgaccttctcgatctccccgcctatttatgctcgtctcgtcacccgcagcagcagtagcagcagaagaactgaagaagagtgatctagctagctcgctcgcctgagttctttgcttcaattcgatcctcgctaagcttcctccagctcgatcgatctctctctgcgttttagttggttaatttttgtgtttgagttatttgcaa

SEQ ID NO: 15197 - DNA, 1501 bp, Oryza sativa
ccgccgccgtcgagcatcccccggcgaatccgagccattggctcgtctcccctcgtcctgcgcaacatcccggtgtgctcgccttcgcctgtatcgccatggtttgctccgccgctcgccgctgtcgaccgccgtccgttccggccggcgtcgtcgtctacctcccgccggcccgcgtggcagccacgtaggcgccacgtcggcgccacctcggccgcgaccaggtcaagtagaccccggtccgccgcttccctccgcccctcgcgcgcgcggtccaccgcgagccgtgaggctgcgcgtgggcccgccgcaccgcgtcctccgcgaaccgcgcgcatgcgccgcgcctccctccccaaaccctagcacgccccgcgtgcacctcgctcacggtgagccgagtcgccgacaagcgggtcccacccgggaccacgagggatggacccggcccaccggctctctctctcccctccccgctcgcgcgcgcgccttgggccgccttcataggccagccagcccattaaggtcggccgagccgccccattctctcgggccgtgccctagccgcccgagggaagtctaatttccctccctccttcttttcttttcttttctttttcaaaaaggatttaaataaatccttttcctttagaccaaaaatccaataatcttagaaattcaatatctccccaaccgtaagtccgtttgactccgttcaacttccaaaattcctcaaatctcgagatctatctaatggcacgcttagaggtcaataataaggctttattttcgccgtttgctgagttgtcccgtttcgcgtgtagtttcggagcccgaagacccgtagtacgaggatttcgaggatcaagctcaagatctcgagcgaggcaagccacctttgaacatcttgagcctatatttgaacttaattatattgcttgaaaaatattatgcattgataggatcgcacttaatctgcttgtcccctctgcaaggcagattggcggacctacctattttgttgcatttgacccttccattgtaattgttacaccatgttcccttgtatccacctagttgcgcctcggtaatcgtgcactctgcacgggtatcgacggtcgccttcaaacttaaaatctgagaaacttcttgggtaaaacttgggttttacaaaagacttggaaaacccgacacctgggtcggtgcttgcgaactaaatgaatttccaaaatcgcggaccgaggaacgtaccgggtgtacggtttcccgctcttgcacttaaggaccgtttccttggaatttcattcgaacataagacaagtacgaccacatgggtggaatgggacacccctggctgagtaactagcttatcgggggagccatgatgccaagagacatgtggattcgccggggtggtgtcggggaggacccctgggcttcctggcacagtatggtctgggacataatctggtgttggtctgggatccctctcgttggcata

SEQ ID NO: 15198 - DNA, 1501 bp, Oryza sativa
aatagcccagcaccgactgcttcggctgctttcccctccttcccgttccaggcttcccctcctcccctctcaccacgccactcccctcctaccccactctcgtctcggagaaggcaacgtcgccctcgccgccgcggcggccggatccggcggatggcgaactcgaagcggctcccgtactccacggccggcggcggcgggggaggaggaggaggaggggggaggcgcggcggcgcctccggctccggcgtggtggcgccgctggtggtcctcgtgttcctcttcgtgctcgcgccgtcgatcttcttcgtcgcgcgcaatgggggccacgtccacgtcgcctcaggttccggtttgcaccccccctctcccccccccctgatgtagcatctagattttattattatttttttggtggggtggggactgggagtgatgtcttcaggtttggtaaatttcccagcgttggtctcatggatattgccggaatggaatccgagtagattttagtggtactgttgttaaatgcaattgatgagttgtatttacagggtatggtatgattttggatgagaactctgtatatagataattggatcatgatgctttgttttggaaacgcaaataatcaatctcactttggagaaatcatgagtttacagcagacaattgaagttgtgcttcaagtgattttggaaatcattttcccctctcttgtagtgtcacttgtgccattgcgaggttagaatgttagatgtgtgacattgtgcggaaagccccagctattaagaagctagggcgcacaagtgaattgtgggtgtaattctagtgccaaaagcccataaacaagaaaactgcatttataagaactgtaggaacattgtcaatgttttgtagtatttgaatactgctatactgatttgaaatatgtaagtgatgttgtattctgtttacctgcagatcccaaggatagggaaggtaatcaggtatttatcttttctgggagctagtcaattggtttactagcctaaattttgaggatccatctcactttaaagcttgcttgcaggaaacagattggcaaaaacaactggcaacaaacaacctgaaatctattttgtccaaggaggtcagaattgtcttgcgacttagtaatataatttcttatctttattttttggtttcatggaaatgtacaagggtacataacaacatgctcatctttgctatgctactaatttcgaaatgtcatgatctctgatttgtccttgcaactgattgccctttctctaaataccatgctactctctattgttccaagtagatttgcatgctgtgtcctctatctgctctgtaattctgttgcgaacattttgatttttcaattaccatctactgttatttgcataggaaactgtcatcttgttcagaagtatcctcgatttttctgtgcttttagtcttatgcataccttttggtctccagatgatcgatgctttag

SEQ ID NO: 15199 - DNA, 1501 bp, Oryza sativa
tctccttttcttctcccttttcttttcctctttctccttttttttctttctcctctcttggtaggcatggtcctccttttatatctcaaggggataccacatacaccatttctacctatccttcttttgggtggggacccattctactttgaccaaaacatggctcatgccttcgcctcacaccgggataaccctgtccttccttcatttatgggcggagatttgcaatggctgctgtccgaatgaccctccgatgggatgggtcataccaacctccagatgacggaggcaggtgcaacgtgggagcacggttgtttgctgatgacgtgaccggcgtcagaccagtcacaaaccggtcattcttgtctaccacgcgtcagtttagcatgccacgcgttagcccttcttcataaaatgacttccttgtaatggttgcgatgaagcctggtatgaatctagccgggaccgacgtgctaactccaggagttcccacgccagctccgtctagggacgagtgcctagaggctctcatcattccgacgggacggggcgaggcgtgcgacaggccgcctgttgccacctaacccgcgatctgaccggtctgtgaccggtcacatgccgcgactggtcacaaaccggataagcatgcgctgcgccgcattgaatgcggcgtgacgcgctcgtctaacccgctataaatgtggttaggtgagggccgctatgctcacctaacccacacacgtggcgccaacaccacagggggttggggcgccccagccctcggggccgaaacgggagcggcccgacccctcggggagacagagggaggggtggccatgtcaccgtcgggcccgaccccctcggggggtcgggccacgtgagtgatcgcggctacccaagcctctagtcacgatacccccggccccatgtcaccgacagtagcccccggcgtcacgccagggcgaccgcccccctcgagggaggcgatcgggcgagatgccactccttaggcccggtgacaggtggggccggtccccacaggcgggcagaaacccaacggtcgcaaatcgcgcgcatcggcaagggagaaaccgatcgacaataatgagcggcctcttcaagaccgctacattacttgagtagcgcgcgaatcgggacgaaccggttcgtttcgcctagtgatgtgatgatggtgcatcggtcagcgagcgtagttaacgcgcgcacgatatgtcccatcttgactgccacggccgcacatccgcctcgtgcgccgcaaacgggcgaacgggattagtggaggagtgggcgcgagaaacgagggggcgagatagtgggagcgggaagcgaggagccgggcatagcgttggcaagggtataaagacgccgaggaagagatttgtttccttcctctcgccactcttccccttgccttcgccacttgtgctctgacactccgtttcctgcgccctacccttgccatactcactcgctctcaagc

SEQ ID NO: 15200 - DNA, 1501 bp, Oryza sativa
acttgaagaaatgtaacttatcacgaacccaaaacaactttctacaacgacgagagtatattttcctcagaacataaaaggaagtatggacaaacatgtctactgcacaacacaaaacacagtgatgtataataccacagcgctagtagagtactttgcaggcattgatgctatagggcggtccagtgtagtacggctgtgtttagttcaccgcaaaatttgaattttggttaaaattagagatgatgtgactgaaaagttgtgtatatgacaggttgatgtgatggtaatggactgaagtttagatccaaactctggatttaaacacatgcgtacgtagagagtatcacatggtggtacgtacatggtgcaggcaagtacgtacagggtacgtgacagggggaaagtcaggttgggggtgccctgtagcatgcatggcacggcatggatgggcccatttcgccagtatgccatggcaaagctttaatatcggtcgatattttactacaccgtgtcttttgttactgatatatgggtccagcgattatcggtctcacatgtcagtggctttagttagagcaagtataatagtgagctataagcttactataaacttatgtggaggagagaggtaatgaaaaatcaaagatgttggctcttatgcaagagctagcttatcacaagttccaagacaaatacaattaatttataagtgagagatatggataggagaagaaaattatagccagccttatagataatctattatataaaatatgttggtttaatatctccctacttgggttggcacttggcagcgtcgttttctgttgggatatgatccgaacagaaaagcacacagggaagagagagagagagagaggagagagagtgagcaaaaagctctgcccttttggaaaggagtatctcatccggtatatatgtttttgcgcaactagctgatggatatagtaacacggacatataccacaagtgatgacatgagagcatcgggtctaaagcgtgtggtttttttttaatggaggattcgacggattatggtttatggatagttaattgtagagatgaattaaatgttgtatagcatgtgtcggtgatatggggccgggggtatcgtgactagaggcttgggtagccgcggtcacccacgtggcctgaccccctgggggggtcgggcccgagggtgacgtggccacccctccctctgtctccccgaggggtcgggccgctcccgtttcggccccgagggctggggcgccctgaccccctgtggttttggcgccacgtatgtgggttaggtaagcacagcgggctcacctaaccgcatttatagcaggttggacgagcgcgccacgccgcatttaatgcggcgcagcgagcgcttatccggtccgtgaccggtcgcggtgacagaccggtcagatcgcgggttaggtggcaacaggcggcctgtcacacgcctcgccccgtcccatcggaa

SEQ ID NO: 15201 - DNA, 1501 bp, Oryza sativa
taactgtcaacttgattaagatacagatttttttcctcgacttttattagcacatttttcaaactgctaaataaatgtatttagtgcagaaacttcctatgtagaaattgttttaaaatataagataaacctatttagtttataataattacaacttaattaatctcacattaagggctttcttattttacgtattatcacttaatttttatcttcattacattcaaacgggacctctgtgccatggttctcgaattacaattctttaagaacttgaagcactttctatatcaccatttattagacagcttgttcgaaacttttttataacatgctgacggagcttggggctcctcaccgggagaccgcgcaggcccccctttgccggttcggccgggggcgctaagtgaggttcttcgccctcgatctgaggaacgtccgcgagagagggagtgcacaagacacgggcgacgtagacaggttcgggccgctgagaagcgtaacaccctactcctgtgttttggtggatctgtgtgtgaaggaatacagagagccggagagcgagagatagttcaggctctagaatcccctcgccagagtcccaacccccctcttcctaggcctgggcctcctttttatctggtcaggggtcaccacatggggctctagctgcctaagaagggaaacatgctttttacaaagagggctagtctacagccggaagtgacctttgacaagcagagcacacgcctcctgccccgctcgcccgcttttccggtggacgcccatttcaaccttcatttaatggccagcgacttccttgccatacttgcgctgaagcctggaatggatctgaccgggactgacataccaactccaggagttagcacgccggctccggctagggacgagagccaggtagctctcatcattccgacgggacggggcgaggcgtgtgacaggccgcctgttgccacctaacccgcgatctgaccggtctgtgaccggtcacacaccgcgaccggtcacggaccggataagcgctcgctgcgccgcattaaatgcggcgtggcgcgctcgtccaacctgctataaatgcggttaggtgagcccgctgtgcttacctaacccacacacgtggcgccaaaaccacagggggtcggggcgccccagccctcggggccgaaacgggagcggcccgacccctcggggagacagagggaggggtggccacgtcaccctcaggcccgacccccccgagggggtcaggccacgtgggtgaccgcggctacccaagcctctagtcacgatacccccggccccatgtcaccgacagtagcccccggcgttacgccagggcgatcgcccccctcgagggaagcgctcgggcgtgacgccactccttaggcccggtgacaggtggggccggtccctacaggcgggcagaaacccagcggtcgcaaatcgcgcgcatcggcaagggaaaaccgaccgacgataa

SEQ ID NO: 15202 - DNA, 1501 bp, Oryza sativa
gaggaaaaatagaattattccatgctcggttgaagcgcatggattcatgaaaaatagaattatttagagggcttctcttatgggcccaaaattgcaaatgcccaaaatagcttggagcccacgttgtcatttcaccaaaggcccacacagaaacgcagcccaacaacacggcgcggtgccgtgcctgtgccttgccttccccaatattttggcgggagaattcgcttccattttgcgcccactcgaaatccccaaaatccgcacgagaaaaaaggaaggggaaaatcgagctggagctggagccctagcggcggcgatggggcgcggcggcgggggacggtggaagaaggaggaggaggaggagctgaaggcggcgaagcgggggtaccgggaggcggtggcggaggggaaccgggaggaggaggcgcggtgggcgaacgtcatcggcgacatccacaagcggcggggggagtacgtggaggcgctccggtggctgcggatcgactacgaggtctctgtcaagtacctcccccagcgccacctcctcccctcctgccagtcgctcggcgaggtccacctccgcctcggcaactcctccgaggccctcacctaccaggttacgacgatccttccatttcgcatcacacgcatatgatcagatcacgttttctgatgcctgagtcgttataggcaggtgtaggttaagttgtagtagaatttccgcattgagttgtttggtctgccggcaaacaaatatttgctagtagtagtaccaatctgcattatggtttgtcccattttatagtgtatatgcaattatagtttgtttctgtgtgagttagtgctaaggtatgctgtagaagccactgtatcagagaattttgctcatctcaacgcccactatgctttgggccatttggtgttgcatctgtatataaatggtttagtcaagtatttgaatgtttagctgaatatcagattaagctgcatatactttgtgttagatttaattgggtaattgatccatttaaatcaattaaatcaaataaattctaaggctcattatgctaggaattcatgtgtattcattcttttatgggatatcaatgggatgaagagttttgagaattaatccatttgattagggaattggtaacttatatcaattagtcctaattgatggatggttgatggttgtgtagtggaggatggttcatggctagttgatgacaattagttgctctattcctcttcctattccattggtaacttacatcaattactcctaattgattgttggttgatggttgtgtagtggaggatggttcatggctagttgatgacaattagttgctctattcctcttcctattccatgactcttactcttcatcttccatttctcttataaaatgagaatggatttgatctcccgcaagaatagtgagacacactttcatccattttccaacgctgttgctgctacggtaatcccatcccga

SEQ ID NO: 15203 - DNA, 1501 bp, Oryza sativa
tgagtcgaatttaattcgcggacattaacagcactgcccaggtatacgatgggggatggctgatcgcccggcacgcccgtgcgaccagcgctagccctctagtctcagtatgtataggtatgtatatatgtcttaaatatgtacgtataaacttcgtatcatacaatatgaggtgtatatacatatatacatatatatatatatacatatatatatatatatatacatatatatatatacatatatatatatatatatatatacatatatatataatatatatatatatatacacatacatacatatacatacatacatacatacatacatacatacacatacatacatacacatacatacatatacatacatacatatatgtatgtatgtatgtatgtatatacatatatatatgtatatatgtatatatatatatatatatatatatatatatatatatatatgtatacaaactatacaaactttgtatattttatatatgtatgtttaaaaaacgaaaaaatatatgtgtatataaagtttgtacacgcatacatacagacttagtatatgtgtatacatagtttgtataacagccgaaaaaagaaaaagaaacgaaagaaaggaaaaaaacaaccgaaaaagcgaaaaagaaacggaaaagaggggaagaaacaatagaaacgggaaaaggaaaaaaaaaaggaaaagagcggctgtctgccaccctcctccccgtgcgcgctgtgtccagtcacgctggggagggcgcgcgcgactagccgcgaaatagcagtttccgtacatgatgtacctaatttattttacacccccaggactgtttttcacggtggatttttttggctgactgagaccccgcatggtcacatgaatacgaaagctaggaaaagcagctagagaataaaattagggatgtcaattttgctcacgggttcaggtatccgcggttacccgaccagatgggcacaggcatgggtgcaatattttacccttaggcatgcacgcccgagacccgataatgtagtgggcagcagccggatcttaccttttactcgcggataacccatacccgacccgatatatgtattattgattttggcccatatcttcattctcatctctctcttggcccattagccaacaacatcaaaccataacctaattttcatcccacctcacttcaacgcagtggcgacgacagcacatttagcaaaggaacatgtggaggcagcgccggcaagcgacgatggcggtggctcaaggtagcgcgggggcaagcaacgacgatggcggctgaaggcaatgcacgagcaagtgggaacaatggcggctctcagggcagtggtagcacgagcaagtggcgggagcaagcggcggtaccagcggagtcaatgacggcggggggcttagcaggcgacagagtcggcaacgcaaccacggcaggtagtcaactctcctatcgacagcatcagtagagtc

SEQ ID NO: 15204 - DNA, 1501 bp, Oryza sativa
caaagatgacgccacctgatggtccgcgagcggtccgatgatatcagtcaaaggaagggcctacgctcaatcaagtcataaagtgatttcgaaaggagaatgcgggatgttcaccaaatatacttacgttgatggcttcatcacgttccgctgcccccttttcacaaaggggcacagggatgtcactcgccgtagtcgggccgctgatcatcacttggccgacgcggcgctccacgttttcgccgctcagacctgttaatcgagaaccaaccttcgataagtcaagaggaatgcggacacaagtatgtcaagatgaatgcgagaaagataccccgaggagaaacccgggtcgcgtcctctggcccggaatagttataagctggatgggcccgagcctgaagcggctagatccgcctaccaacgaagtctgcaacgacttcatatcccgacaaaccctgtactcagagatcgtcgatgatgtcgagaaacgactgaagagagggggtcaaggggggcttggcggtccaagacggaatcttgtccggttgatcttcgggaaccacgaagacagggttcgagtccttgatctcaagataaaaccacctattcctccacttgctgcgagaagaagggcactggaagggaatgtaacgcaacttcaggccatcccgaagtcggaacccaacgcaaccagataccctgttggattccatccaacgcagttcgtagtaaaagcaaaaaagatcaaggaaaggctctaccccgatgtaggcctcgcaaagatgcacaaagatgctaaggaaggcgatggaattggggttcaaatggagaagagaaagaccatagaaattcaaaaccaggagaagaaattcagaaggaggagggagaaaaccgcagagaacataatcttcgatcgcaaccatgcgacccaagatgggctgaggattagtacctcctacttccctctccatggttccacagccaggaagagcgccatcctcctatagtttctttaacgttgcactggtggaagccgatttgccgaggtccattgctgatcgaaggtcgccggaaaacgagcctagattgatgaactagggtttcttgcggcggcggagaaggcaaagagtgcttgcagtggggtgtgtttaacaggtttggcggacttcaaaatggactcccaaaattcctttaaataggcgcactaccgacggtgcgaattccagggaatagagagagatgcccgccggaaatttctggtcccattacacgcggcggttttttggacttcagtttaaaattcgttcgtgaccgttgggcttcaaatggcgtgctcgactacggtctatctccgcggtcctcgcaccgggaatgacaacagtctcgacacccgaagtcgcaaatggttgcacgagttcattttaagcagaagttgggggctactgtcagggttacaggttaggcataccctttacccttcgatatacgtcacatatcggta

SEQ ID NO: 15205 - DNA, 1501 bp, Oryza sativa; identical to SEQ ID NO: 15204

SEQ ID NO: 15206 - DNA, 1501 bp, Oryza sativa
cttcttctagctttttgtgatatgttttgcatgcaatgtgcatgcatgaccttcactgcagctgcctgctgcttgatgcgatcttgtttgcatgatatattctcgatcacattggatttcggaagagctgtgcaaattaagtttaattgtaattaactgatacacgcctagcgactctaaaatccaacacgttgccggtagtacgctgactgatctgactgacatgacatgttcatgacactacccatgcatgcatttaattagcatttgttttttttttgagtcatgcatgactgaatcttcttattaattagcatcgacgacatatatgtgtgggattactttttgagtggcttggttaaattaccatcttttgcttcaaattaaaggcgctttttaagatgtatattcagaaattgaaatgataaacctcaaatgaaatatagccagctaaactaattaaggatcgattcgatcgtattaatgaatgatccctctatgactctatctccttaattaccgcaatgttggaagcaagtacagaactcaaatttaaaatgtttggaaggtaaaagtaaaaatcacaccctctctctagtctctactagttatcctagctacgccgttctagttctacgagagaccaggtgaaagcttccatcagtgtgtgacaagcgagacacgacagtacaatgcaagtacttaactctgcaaattttgcggttaattatcataactacatagataattaaaccctgtagccaactaatatagttaattaattaccagctcctcgcagatagctagacatccatagttttatactcatctagtcagagattttaaacagtgtagttggtcaccatctcctatccctgacatacactgcttccatggagctaaagaggaatctaattctaagtgagacaagcatgtgaccatcagacacatcagctgactaggcattgcatgttacagtacgtgttaggtatgtatgttcatgcaagttgatgtaatctgaatcctttattaattacgccaatgtttgtgtgaccacactgtactgaccagcactccagcagcatcgatccaaactaatcatttctaaatgacgcagagcttaacctgtattgttatgcatgtaatgtagttgtggacgcatgttggtttgaatttgagaatcgtccttgagcatttgcacttgttgcatacgtacaaaaaatcagcttgacgtacgtacgctggatctatactccagaaagtcatggaatggtaaactgctgttcgtcttggcatgcatatgtatgcatgttgttttttcttttttaaaagggtgactaattgttaattaatttacagatgggttgagaaaggatttgcatttgcaaaagacaaacatgagaagtccatccatgcatggcaatatatagtgcgtacgtaacgtacgtactatacatgttgtgttgcatgccggcatatacgttacgtcctgcagggtgca

SEQ ID NO: 15207 - DNA, 1501 bp, Oryza sativa
aacgtcgtcggctgcaccaccgtgtccttgctctccgccgccgccgccgccgccgccttgatgttcctcgcctccgccgcgccgaccaccgcgagcaccagcaccgccgccaccgccatcatcttgctcgacttctccatctctagctcgatctctcttgcaaaagctaagctaagctcgagtgtgcaagctgctgctgctgctgatcgatgtggagttggaggaggagggagagaggaggggagaggatttatagcggaggagaagctcatcgtcatcgatcggcagagaagacggtaggtgggaggcgtaactgcggatgttaaaggagggggtacctgctgctgttactgcaatcctgtgatccccattaatacttttgctcttacagatcatcaatataaatgtagtacacatgtaggagtaatatgatatggagtagtatggctctcaatgactttggatgaattggcacaacggaaaggaggaggaggagagaggagagaaatgaacaaaccctagctagatctgtggttgtggttgggagctagtagtggcattcaaaatgttgtgaaacccttttaattagacagcttgcattgcatgtaaggggggttagtgtactaagaccaagtataatagcaggctataagccaactatatgcttatgtggaggaaagagaatttaaaaaatgcagaggattggctctcatacaagagctagctattcacatacttcaagacaaatacattaaatatataggtaagagatagagagaggaggagaaaaaaagaaataaccttatagctcatttactatacatgtttactccaatataaattataagcttatagttagctctattattaaacttgctctaatgaactagttatggattggtgtgcctgatgatgatatcatatggcacttggtaggcaatggaaaacaagagagatggcatattaatggcattgcctttttttttgtgtgtccaactgtgattaaatgtgggatactactaatgaaggacttagcatctattactgatattaatttaacataaagaaaaactttattgatctcagataattaattgcatcaatgtgatattattaatcgatctaagagacaacctgtcaacctctgcatatagctaggatatggatgccctaggatatgcagagagcctgagattattaaaaaggaaaaagtacgaattacccccccaaatctatcgcgctcgtccgaattacccccctaaaccacaaaaccggacattcttcacccccaactatgcaaaccagacaaattaccccccctcgacccaatccgcggtggttttggcctatgtggcgtacacgtggcaatccagtcagcattttattttatttttaatggtgggacccacatgtcagacccctctttctctcttcctccctctctctttctctctcttcatcggttagcggcagcggcgcacacgtcggtggccggcacgca

SEQ ID NO: 15208 - DNA, 1501 bp, Oryza sativa
cggacagagagagaaacagtaatggcgagctcttgtggtgaatatggcgaggtgagtgcgtcaaacgtgttcctggacaagggggttatgtttttttcttgaaagcgtaggagggagggatcattgggagaagagggacgctgggaggacggggtgatggggaggaggggtgctagggaggagaggggccacgggaggagggggagcgcatgcagcgagggagagagggggtgccgagagggagggaggtggaagcggaggcgagtgggagggtgggagggagggatgaaagagatggggggatgtcgggagggagggcgacgtgcacgagggaggaagggatggataaaaaaaatgtgcggaatccttacgtatttttctaattatatataggtatatagatgtgttccgctttatctttcacctagtttgtgtcctagtttatccatgtttatcaatttgcactataaatcgtacaccttcacacaaagttatttgtatatgtttgtctcgaaaatccttttttttggctatttattcccaaattatctaacttggtctagactagaggcaaccagcttttatcttgttaccatcttggttagtaacttgccatatcaaagtgattggtgacactctacacaacacacagttgaattaattattaggttagttccccaaaagaaaatgagtacaacagctagctaggtaggtattactctactccgtattcttctagttaacttgttcgatcgtctcgtccgctgcagccgctcgctagctagtagctatagctagccctcaatggtggaggaaattgaatggtaagaaatagagtttagacgatgatcgacggagctcatttcccgggcgcgtggggtgagaaataaagatgcatgcgtggatgggagtaagcgatggatatgatcgatcggagttccgatgtccttgcagattaataatagcagatagccggccaaattaaggttgcaggctgggtagacaagctagaagatcgatgatgaatggaatgcataatctgtgcatactagctagctagctaataacacataatattcctagctagctaattggttgctgctgattgcatatatatatgtgtatgtaattaggaagctgagctgaggagaggagaggagaggagagtacatacatgatggccgcatctgcaggtccaggcgtcgtggtggtggcgctggtggtggtggtgtacctcatcttgttgatccggccggctgcgtcatttcgcgtcaacgtcggcgtgggtatcggcggcggcatcggcatcggcaaccagaatcagaaccaggaccagaaccagaaccagaatcagaagccgtactatgatgatagcaataacaacaacaattacgatgagggcgagggggagggcggcgatgatcaggaggagggtccggaggcggcggcgccggtggggccggggcagtcgttcaccggcgggcgcgggacgtacaagtac

SEQ ID NO: 15209 - DNA, 1501 bp, Oryza sativa
acggcgagctctagtggtgaacatgatcggatgagtgtgtcaaaatgcattctcagatgaggggattccattttctttgaacgcattgaaagaaagaaaaatgaagaaaaaatgactaacactattcatcgtcttccctagccaaacaagaaacaaaagagaagatgagcgacggtgcttcgtttaccaaacatcgacgagtaaggtggtcggacttgtcccacaatgtggcacgtccatggatgctggcagttggcaacgaagaaaaccagaacagcgggagcacacccaacgacgacgtggtccggacagagagagaaacagtaatggcgagctcttgtggtgaatatggcgaggtgagtgcgtcaaacgtgttcctggacaagggggttatgtttttttcttgaaagcgtaggagggagggatcattgggagaagagggacgctgggaggacggggtgatggggaggaggggtgctagggaggagaggggccacgggaggagggggagcgcatgcagcgagggagagagggggtgccgagagggagggaggtggaagcggaggcgagtgggagggtgggagggagggatgaaagagatggggggatgtcgggagggagggcgacgtgcacgagggaggaagggatggataaaaaaaatgtgcggaatccttacgtatttttctaattatatataggtatatagatgtgttccgctttatctttcacctagtttgtgtcctagtttatccatgtttatcaatttgcactataaatcgtacaccttcacacaaagttatttgtatatgtttgtctcgaaaatccttttttttggctatttattcccaaattatctaacttggtctagactagaggcaaccagcttttatcttgttaccatcttggttagtaacttgccatatcaaagtgattggtgacactctacacaacacacagttgaattaattattaggttagttccccaaaagaaaatgagtacaacagctagctaggtaggtattactctactccgtattcttctagttaacttgttcgatcgtctcgtccgctgcagccgctcgctagctagtagctatagctagccctcaatggtggaggaaattgaatggtaagaaatagagtttagacgatgatcgacggagctcatttcccgggcgcgtggggtgagaaataaagatgcatgcgtggatgggagtaagcgatggatatgatcgatcggagttccgatgtccttgcagattaataatagcagatagccggccaaattaaggttgcaggctgggtagacaagctagaagatcgatgatgaatggaatgcataatctgtgcatactagctagctagctaataacacataatattcctagctagctaattggttgctgctgattgcatatatatatgtgtatgtaattaggaagctgagctgaggagaggagaggagaggagagtacatacatgatggccgcatctgcaggtc

SEQ ID NO: 15210 - DNA, 1501 bp, Oryza sativa
aaagtgctcagaatgttaacagtatgcataacgctagttagatagcacaagtgctaactgtaattcaaggtttcatcttcacagtaaaaaggtactaaagataacttgtactaaaatttagcaacaacgaaatatagagatggttagaacaagaagtgaaagtttacttgaataatcatgatggtggaggctttgggctcacaatcgatgccctgtttctcaagcttctcgagtgttacagcgtcgacatgctcaatttccaccgtcaaaaccccgcacctaacagcaaccaaaggaattttttacaacagtttgtaaaccataagagcttgaaagtaaacaagtgttctccgaatgaagcttgataagagctttgcaactaggggccaccacctctttgcgaactcgctaaccgtggcgccatcattgaagctcccgacgacatgctcgtggcaaaccgagctcgccgggcagtcctcgaggggatcaagtatggccatcctgacccccatctggctggccgcctggcacagcatcttccccagctggcctccccccagcacgccgacgaccgtgttggtgacgccatgcacaggctggtcgctatgcctacaagcaccacacaccaaaaaaaaaaaatccaatcaggtgaaaatcctgcggcggcgccaacgaatgatacagaaatcgcaacgaactcgaagaccagcagggagaaacgggcccttacccctcgggaggaggagaaggatgcatggaggcggtggcgcgcagcagcgatagaggcggcagcggggaggtgggccgcggcgtccaggaggcgcggcaagggtgggcggcggcgaaggggaggggggaggaggaggcggcggaggcgtgggagggggcgctgaggagcctggagtgcatgctccccggtggggtgggggggtgggaggctagggtttagcgagggtttaggaggaggaggaggtgaggcgcgagaggtgggagacggccgcgcggagcggaggaggaggcggcggcggcggaggaaagcgacgcgtctgtctactctagcgctgtgctaaaggcatctctgcttttttctttggagattttctcctttttaaaaatatatttttttatttgctggatagtattgtacctgtacacacaggctgtcttctttactcaatcttttcaacttcactcattttccacattcacctttcttaaattattaaaccatgtattttctgaaaaatcatattaatttattttttaaaaaatagctaatacttaattaattatgtgctaattaatcactatgtttccaactcactcatagaaacacagggtgtgtttagttaacgccaaaattgaaagtttaattgaaattggaacgatgtaacggaaaagttgtaagtttgtgcgtagaaaagttttgatgtgatggaaaaattgaaagttcgaagaaaaaattaggaactaaactatgccacagccaataatgcctcgg

SEQ ID NO: 15211 - DNA, 1501 bp, Oryza sativa
ggcgcaccccgtcggtggccgaggatgagctcctcctcccctgtcccctcgtcgccgcccccactccactgccaccgcttgcagcgttgttcccctcttctgcttaatagggcgggtgagggatgccaggagggacacaacatcgggctccggcagtgagtccgcggtccgccgcccatccccgagctgcctcagcctcgccgtcctcgacgccccgagcggcctccaccatcgcccgtcgccatcctaccaccccaagctacatctgtcctcgccgccgtcctacctccctcgctcgccgtcgttccactgctgtccgccgctgtcctcgatgccctgagcggcctccgccaccgcccgccgcccccaagctccatccgcccctaccgctgtcctgccgccctcgtcctccaacaccctcctcgacgccgcccgccgctgccgcgtcctccccgcactccaccaccgcccgcacgccgactgcccgtctgacgcgcgccaccggcgcccacacgccgaccgctgtgcgagctttatgcctgagagagagaggggggaggaggtatgacaggtggtatgatcgcctctccgccatggccgccccgtgcgtgccgctactcgccttcgcttccgccttcgttgctggttgcacgagtgcgccatcggcgtccgagcaacctccgcctccgcgcgccaccgccagcgcccgagcatcgccctccactcctccgtcgccattctcaatgctgccatgctggtgagctggtgaggggagggagaagagagagaggggggggattggggatagagagatagaggggtggcgaactgacaggtgggcccactgattttatattaaaagaattgctgactgtactcccacgtttactaaaaccaccgcgaattgggtcgaggggggtaattcgtccggtttgcatagttgggattaaaaaatgtccggttttatggttcggggggtaattcggtcgatcatgatagttgggggggtaattcgtagtttttcaattctactgttatcagtccaaagtcaaaaggctgaaaaataattaaagaaggaagatgaagaaacccataaaccatttatctaggtctaaatttaattaaaatcgaccgcggctcaatcaaaagttcgttttccccatcttgagccgttttaagaagcgaagaaaacaatattttgaaaaaaaaaacaccaagacacagggagtattacgtttttctggtgggttttgtgctttttcagagtacgttttcgacgtcataggctccatcagttctccccacacttttcccctccgcttgaactcgccgccactgaaatgccctccaaatccaaatcctccaaattcgattcgcgtcctccgtttgcttcgcttcttcttctagaacccaccaaactctccggccacgtgcgccccgccctaaaccctagccgcaccccccgcctccctctcgtcgccggcgaccgccgccgccgcca

SEQ ID NO: 15212 - DNA, 1501 bp, Oryza sativa
cgctgttggctgtttttctttggaaaaatcattttacaactgttaatcatggcctaactccagtttccaaccctcaacttcgaatagttcaccttttgaccattgactattagaaccacctactgtttaacctttggcctcattctagagtggttctgcagttacatgtcactaatgtgacaatgtggctcaaggttgaaatagttttgagtatttacagccaaaacaaattccgccaaagcagaaattgtggtgtgaaataactgttatgatacttcaattctttgatgattcaatgtagtttacaacacaaccagctaacgaaacaaatagacctatacattcccctcctgaagcacgtccatctaaattccaattcctcctggagcacgttcatctaaattgcatacatagtactatagtaagtgcaggacaagggtagcagtagcacgcagcaaacgaaacctgggaatccgacatcgcggaactcgcgcactggcttgggcacgtcgcggccctccacggtgatctcccggcggcgccggtaggcctccacctcctcctccgtcatgccggccacggagggggactccacgtagaagttcttctcgaaccgcggcagcccatccaggtcagcggccgcggccgcggagtccgccttgctcgtcggggcgaacgccctcgtcccgcccccgaacgccccttcgctgcaaccaaaccccaacccaacccaacgagcaatcagaacccccaacacttagggcttagggtttagaaatcaaaaccacggtggtggagcggttacctgcggcggtcgcggtacgagccggggtccgcggcgcggccgtcgaagcggctcatggcggcggcggcggtcgccggcgacgagagggaggcggggggtgcggctagggtttagggcggggcgcacgtggccggagagtttggtgggttctagaagaagaagcgaagcaaacggaggacgcgaatcgaatttggaggatttggatttggagggcatttcagtggcggcgagttcaagcggaggggaaaagtgtggggagaactgatggagcctatgacgtcgaaaacgtactctgaaaaagcacaaaacccaccagaaaaacgtaatactccctgtgtcttggtgttttttttttcaaaatattgttttcttcgcttcttaaaacggctcaagatggggaaaacgaacttttgattgagccgcggtcgattttaattaaatttagacctagataaatggtttatgggtttcttcatcttccttctttaattatttttcagccttttgactttggactgataacagtagaattgaaaaactacgaattacccccccaactatcatgatcgaccgaattaccccccgaaccataaaaccggacattttttaatcccaactatgcaaaccggacgaattacccccctcgacccaattcgcggtggttttagtaaacgtgggagtacagtcagcaattct

SEQ ID NO: 15213 - DNA, 1501 bp, Oryza sativa
gaggatgacatataggatcatctgagtgaatgaaagtgggtcaagatgtcaaataatcgaaacacattttaagaagtgttaaattatcaaatctctcccaaaatttattggtgatttctgtgttttgttcccattttttaaaattggttggttatttcggtcatgaccaaagaacgaaccaaaatgaccaaaaccgaaaagcctgctctgaccgtatgccctactgccagtatttggatcttagtttaaccgtgtttttaaaatatatttttaaaaaaattcaatttaaaacaagtcttataaaagtacagtaggtacacgaattgaagttgtttgaaggtccggatcctaactgtcgtaggtacacgaaggtagtactaattccttgggtagctgtagctcgagtggtacacgtaggactaatcatcacacaattattatttgctatatatctatctattatattattagaacaactttgaaaggaggcaccacgttcgctgtggggactaaaaattcccacactaatcagagaaaaagaaaaaaaaaagaaaaggagagtccaagtagaaatacaatctaaaaatagctgaaatttagaattaaaaataagcaatattaaaaaaagtttccatataagaacccaatacgagattaatcaaaattcgaaataaaaataaaataaaatccaaaattaggaaaaaaaaagagagtccaagtagaaatacaatttaaaaatagatgaaattcggaattaaaaataatcaatattgaaagaagtttccatgtaagaacccaatacgagattaatcaaaattggaaataaaaataaaataaaatccaaaattagaaaaggaaataagagtccaagtaggaatacaatttaaaaataactgaaattcagtattaaaaataagaaacattaaaagaagagttcatataagaacccaatacgagattaattaaaatttggaataaaaataaattaagtaacaggcctataaaagagtagagtggtggcggttgatacgacatataaaaattgttaataaaacatcaaatagaatcctactgacgattaaaaaggagggacgtcaggcaggccgtgaagcaaacgagtaaggcggttgccggaacttcttagacagtaaaaaaacaaatcgtattgataatcgtattcgatttttaaaatctcaatgataataaaaaggagaagcagcgagcggggtgtataagagtatagttgcagagccaccgacggttgacgggacttctagaaaataaaaaatgaattccaacgatagttatgttcgatttttagaatcacaatgacaataaagaagtaggtggcgaacatgctgtagaggggcatagtggcatcgtttgataggacttctaaaaattataaaaaatgaaactataagttatgttcgattttaaaatctcaatgacaataaagaatgaattccaacgatagttatgttcgattttaaaatctcaa

SEQ ID NO: 15214 - DNA, 1501 bp, Oryza sativa
ctcctcggccagacgggcctccaaagcggcgtagcggcgggcaagggagcggtaagcctcaaggagtaggtcgtgctgagtggcctgagcctccgaaagctcgaccatgcgagtcagcactggctgagactcgctgtacggacaagggtacctggcgtctgagtggccagagggaaggcgtggaagctgccggaaggcggaacctccgagacggtggctgtagtcgtgggccaggcgacaaagcgcagtccaggagaggtcctggtacgcgatctggagagtgggcctggccacagtgaagtggtgggggcgaaggccagctccgtgtatacctccacgggggtaaaggtacaccgagagctcacagtgagggggaacacggtccacggagtaccccgtgtactcgggacacgagaagccaaggaaacgggagaggtctcgaagctgagcgacgtggtgaccctcaccaaaaccgtgggaactgaagctggcgttccctgccatctacaattttgaaagagggagaaagatcagtaaccgttttagaaacaaactattgaaaataaagaaaacaaaagaaaccttagcttttcgcaagtagttttgaacttagtatccttagggtcgtcctaagcgtcgggtttcgccctagggccaagcctgtgctctaataccatctcttgtcacgccccgaactagtcccgaccggaactagcccgtgacgctccaaattaacctcttaatcgataccagtcccaggaaacagtgctggtatcacagggagacagagtatcacagcaacagaggtctctttattatagagtagaagtacagtcatgttgggctgcgggcagatcccgagctcacaactgcattacaaaaggaaagcggaagccaggacttggaccaatcatcacaggcgcgacttgggaactaggccgaaaccctaaaactcatcgtagccgacttgctcctggaagaactcctcgtcagcaggatccacttcatcttcttcagcaactggggggggattatttatatggagcaagggtgagtacgggagtactcagcaagccaggggaaataagtgtttaatgcaggcttcaaggaaaggctgttattttcgtaattgattttgtttgaactcttttctaaaaagtctaagtgagtgcttctcaaacgacacggatgagacagtgcgtctcgtccagtcggagtatgtgcaatgtgtcagtctttaggattgcaacaaggttggcacccggccaacagcttttcaaacggccacccgggccaacaacttttcaaacggccacctgggcctagctgatcccatcagctgcagatttttcaaacatcgaaccccttttcacaacagcaatttcacaagcagtaatcaaacaaaactacgctaggaatcacctcacatccgcccatgaccgtgggcacggctgttcgagcagtttgttaacctctgcagagggggtacactttacccaca

SEQ ID NO: 15215 - DNA, 1501 bp, Oryza sativa
atggagaacttgatctctcggtctggtggcatactcgataactcttctggaaatatgtcgtgatattcacagactatgggcaccgattccaaaggagtggcttgcaaactggttaggatagaccgacttgcgataagggtgttaggggtaaagcagacttgctttcctccaggtccttgcaaggtgatagacctttcggcacaatctatctgtcctttgtgcttagccaaccaatccatccctaggatgatgtccaagctttgcgagtctaggactatcggtttggctaggaagtcaacttcctcaattctaaggttaacttctgggcatattttagttgcccttatatcccttctaggggtgacggagcgtggggctcctcaccaggagaccgcgcaggcccccctttgccggttcggccgggggcgctaagtgaggttcttcgccctcgatctgaggaacgtcagcgagagaggaagtgcacaagacacgggcgacgtagacaggttcgggccgctgagaagcgtaacaccctactcctgtgttctggtggatctgtgagtgaaggaatacagagagccggagagccagagagagttcaggctctagaacccattcgccagagtcccaacccctttctcttttttctcctctccttttctctctaggcctgggcctcctttttatctggtcaggggtcaccacaagggcctccagctacctaagaaaggaaacatgctttttacaatgagggctagtctacagccggaagtgacctctgacaagcagagcacacgcctcctgccccgctcgcccgcttttccggtggacgcccatttcaaccttcatttaatggccagcgacttccttgccatacttgcgctgaagcctggaatgaatctgaccgggactgacataccaactccaggagttagcacgccggctccggctagggacgagagccaggaagctctcatcattccgacgggacggggcgaggcgtgtgacaggccgcctgttgccacctaacccgcgatctgaccggtctgtgaccggtcacacaccgcgaccggtcacggaccggataagcgtgtgctgcgccgcattaaatgcggcgtggcgcgcttgtccaacctgctataaatgcggttaggtgagcccgctgtgctcacctaacccatacacatggcgccaaaaccacagggggtcggggcgccccagccctcggggccgaaacgggagcggcccgacccctcggggagacagagggaggggtggccacgtcaccctcgggcccgaccgccccgagggggtcaggccacgtgggtgaccgcggctacccaagcctctagtcacgatacccccggccccatgtcaccgacaaggggaatgtactatcattggtactcgcaaattttgggttttccggggcacacctggccgttgggtcatatcgacctcccgttcaccttcggtggttccgccaacttccgcacggagc

SEQ ID NO: 15216 - DNA, 1501 bp, Oryza sativa
tcactatgccagacagtgccctcagaatcctaccaacttgaactcagggcatgctaatggcagcactgccagaactcctactccagcagcagctcagtccagtcctagctcgcaggcaagtggacaaggttcccgtgcttccaacaactttggtcgaggccgggtgaaccacattcaagctgagaccgcttaggatgctccagacgttgtgatgggtatgttctctgtcaactccgtacccgcaatagttctgtttgattctggagcttcacattttttcatatcgcaagcttttgtgaaaagaaacggttgtgacggagcgtggggctcctcaccgggagaccgcgcaggcccccctttgccggttcggccgggggcgctaagtgaggttcttcgccctcgatctgaggaacgtcagcgagagaggaagtgcacaagacacgggcgacgtagacaggttcgggccgctgagaagcgtaacaccctactcctgtgttctggtggatctgtgagtgaaggaatacagagagccggagagccagagagagttcaggctctagaacccattcgctagagtcccaacccctttctcttttttctcctccccctttctctcctaggcctgggcctcctttttatctggtcaggggtcaccacaagggcctccaactacctaagaaaggaaacatgctttttacaatgagggctagtctacagccggaagtgacctctgacaagcagagcacacgcctcctgccccgctcgcccgcttttccggtggacgcccatttcaaccttcatttaatggccagcgacttccttgccatacttgcgctgaagcctggaatggatctgaccgggactgacataccaactccaggagttagcacgccggctccggctagggacgagagccaggaagctctcatcattccgacgggatggggcgaggcgtgtgacaggccgcctgttgccacctaacccgcgatctgaccgatctgtgaccggtcacacaccgcgaccggtcacggaccggataagcgtgcgctgcgccgcattaaatgcggcgtggcgcgctcgtccaacttgctataaatgcggttaggtgagcccgctgtgctcacctaacccacacacgtggcgccaaaaccacagggggtcggggcgccccagccctcggggccgaaacgggagcggcccgacccctcggggagacagagggaggggtggccacgtcaccctcgggctcgacccccccgagggggttaggccacgtgggtgaccgcggctacccaagcctctagtcacgatacccccggccccatgtcaccgacagtagcccccggcgtcacgccagggcaatcgcccccctcgagggaagcgctcgggcgtgacgccactccttaggcccggtgacaggtggggccggtccctacaggcgggcagaaacccagcggtcgcaaatcgcgcgcatcggcaaaggaaaaccgaccgacaataa

SEQ ID NO: 15217 - DNA, 1501 bp, Oryza sativa
ttggaaataattttaaccaattaaaaatgagcaagtgcaatatttaaccctcaggaaatcctttttccatttcctcctttttcttttctttctttttctttgttgggccgtcggcccaacctccctcccacgcgccgtccttgctgggccggcccgctcctcccctctcctccctgaagttctctctccctccctctctctctcaagcgccgacaggtgggccctacctgtcgggtcatccctaacctcccgccgccgccgcctgctccagccgcccacgtcgtccgcccactccgtgcccactccgtgccccgcgctcgcgcccacgtcgccgcccacctcctccacctctcccgtgcgcgcgcgcccgtttagaggccgggattcggtttgaatcccgtctctcctatctctcttttcctccccactcccccacgtcgctggcgcaataggggccatccccggccacgtccaccccttcctcacccataaaaacactcccccaaacctcctctcccatttccctcactcgccgcgccctcccgtgcttcctatcgtcgccgcgccgctctcccgagctccgccgctcaccgccgcatttcagccgcgcaccgccgccgctagagccgccgccgccgctagcttcgtcgttgcgcgggtcatctcggccaccgcctcgcgtcgccggaaccccaccggaaccctatctccctcgcgagccggtgagatatccatccccctccgtctccggtcaacaatggtggccgccgtggtcacttaccccacccctaacccatctctgctctctcctagggtgccaccgccgctcgtccgcgcctcggcattgccggtcgtcgccgccaccctcgttttccgcgtcggttgccgctgccccctctagtgaggactccctcccctcctctctcccttcccgcgtgcgccgccgccgttggccgcgccgccgctccggccgttcgccggtcgccgtcggtggccgcgcgccgccgctgccgcaccatggccggccggcttgagctgtgccgacccgccagccgcgcctcctttccgccttgtgccgctgcccgtggggcccgcgtgccggcgccccctccctctctcttgagccgctgacatgcggggcctgcttgccggtgccgccccccttgctgacgtcagccctggggatttattgcgcaataaattgattaaggacttttctttgttagtaaaaacatagattatcttctaaaattcataagtaattcatccgagctccgtttaagtccattcaagtctcagtaaattcataaaaatccctagaatccattaaaaatggttttgtttcctgtttcagtagtcttatagcatgttttgcttgtgtgctttgtttgtcgcatagatctcggccgtttcgtcgatccgcggtttctcgaagacgttgctaaggtctcataagtgcgagagcaaggcaagtcatgcattacaattgatcatattgtac

SEQ ID NO: 15218 - DNA, 1501 bp, Oryza sativa
agcaaactttaaactattttttctcctaaattatatatccaaatcatgatccgattgcaccattaaattcattgtaattaaaattttaaaacaagaccacacatggatatattccgacgaaattttttttagcttattatagaattatgtttaaatgttgcacgatgtttcactaagtatatcggaattgttttactaagtagatcgaaaatgtttcaatcgtttaaattgggtgttgtttcatcttttataaaaacaatatttcagcaaatagcgaaagaatatttcagttcactgcaacatttgatccatacatagtgaaacattgtgactacactaggtgaaacattttttttggaaaaaaaataaaacgaattcccttaatagagtgtcggtgacatggggccgggggtatcgtgactagaggcttgggtagccgcgatcacccacgtggcccgaccccctcgggggggttgggcccgagggtgacgtggccacccctccttctgtctccccgaggggtcgggccgctcccgtttcggccccgagggctggggcgccccgaccccctgtggtgttggcgccacgtgtgtgggttaggtgagcacagcggcgctcacctaaccgcatttatagcgggttagacaagcgcgccacgccgtattcaatgcggtgcagcgcatgcttatccggtccgtgaccagtcgcggtatgtgaccggtcatagactggtcagatcgcgggttaggtggcaacaggcggcctgtcgcacgcctcgccccgtcccgtcggaatgatgagagcttcctggctctcgtctctagccggagctggcgtgctgactcctggagttggtatgtcagtcccggtcagatccattctaggcttcagcgcaagcatggcaagaaagtcgctggccattgaatgaaggttgaaacgggcgtccaccgggagagctgacgagcggagcagaaggcgtgtgctgtgcttgtcaggggtcacttctggctgtagactagccctcattgtaaaaagaatgtttcttttcttaggcagcttgaggcccatgtggtgacccctgaccagataaaaaggaggcccaggcctaagagaaggagagagagaagagagaggaaaaaaagagaaaaaggagaagaggagggaggggttctagagcctgaacggtctctcgctctccggctctctgtattccttcacacacagatccatcagaacacaggagtagggtgttacgcttctcagcggcccgaacctgtctacgtcgcccgtgtcttgtgcgattcttctcgctgacattccttagatcgagggcgaagaacctcacatagcgcccccggccgaaccggcaaaggagggcctgcgcggtctcccggtgaggagccccaagctccgtcatctggcgcgccaggtagggggcgcgcgtgtctttctaagccctcgtcctctttcgtgtgcgccaagcttctcccgctcagcccaa

SEQ ID NO: 15219 - DNA, 1501 bp, Oryza sativa
tttacaattatttctctttccgtagcatattctataacatatgttttgctttagtcaaattattctggctgaaacaataccaataaatcaaaagtaatgctgtatgatgagaccctcattaaagtaattaactacagaatgaaactaaatgttctacattgtttgttatagaaacaggattctttttttctcatagcaaagttaacaactgccaaaaatgaagtgcatttcatccaaataagcactataaacagtacaagtggcaacatgtaagtatatcttaaattaataggctgtagctatgcctgtcaaagttaaaactacaagtatgcagaatacaagaagttcccacttggctgcaaacaggagtataaatttaaagcagagaccagttgaccactccattggttatacagacaggctcaaggcattagcagttcattgtaggatgaaatgatccaaacaatcattttctttccaaagaaatagcaaatagaaagcaacaaccttacacccatggaccccacctagtaagtacgaagaaaagctcatctagttcctccggagcgcaatatccatgaagaatatgaacaaggtaacctgccttctccaccagagcgcaatatccatgaagaatatgaacaaggtaacctgccctctccaccagagcgcaatatccatgaagaatatgaacaaggtaatctgccttctcctatcagcctctagtttctttcctttgtttttttagtgcagcctctagtttcttactatttgtcatgcaaaaattatggcatggcataaacattccatcggaaagctacagactcggtttacagatgaacttgaaacagcacatctgcaaatggacgaaccaaaatccacccgacacatcccaaaattgagggaaactaccaaactgcaggatcaggatccaaaccgcttcaaatggaaaaatatattatacttgcttttttacgccatcgaccaggaaaaaaaaaaagaaacaccgtgcatgatgtctaacagggagaaccgctcgccgaagcaatcaggcatgccacaccacatggccacatttgtgcacagaaagtggatatgcgattattaagagtctacgacatccttatttccctcagctcatctaaactgaaaaatgcaggccagtgaagtcgggagtcgaacacgagccgcggaagccggaagtggagaaacgcgtcaatggcggaagccgcggagccacaaaacatttcggtgccagtgcgcctccgccgacgcgtcgcccacctcaccgctgctccaccgccggctgattccgagcgctcctctccggtgaggaggagacgaaccgtgaaaccaaccacggaggaagccaagagatcatccgacgaagctgtgcctcctcacctcaatcgatcagaaccttcctcaaccacacccagaaaaatctcctccccgaaaaaccgcaagcattccgcccaaaaatccctcccaaaaaaccgga

SEQ ID NO: 15220 - DNA, 1501 bp, Oryza sativa
tttgttgcatggtgatgaaagaaaggaaataaaagtaagaaaagttattttgatacattaatgattagagaccatattgtctctaactgttgtaggatgctagtctctaaataacgtagagcttatatacgactctatctttgtacgtgccctaattagcaactgggcagcgtgaaaacgcatttcctatcaatccacgaggcgatttgttttggagaaaagaggaggaatgaagaaaatgaaaggaaattagtgactggtagaagaatgtgccgaatattgggtcatcgtcgacgagaaaaactccaaatattcgcaacaaaagagagttcgatctcctaattattaacgtctcgcttgatgtggaagttgtcatccgtgggaaaactggaaaggttgaaaacactgtttttgcacggaagaaaataatttgcaaaagctgatggatgtttgtttgcctgctgccacgcctggataacaatagtggttatcatataacgtcccgaatcctccaaggtatctgatccctgcagctgattgagaaaatatttatgcccactgaagtctgaactcttaagctgtgaagcaacgcaattcagcgtgtagcccaaatcgagtacacttggatcatctgttcgcacgctacctccgtcttaaaacaagtacagcagtgaaaatccgtgtccaacgtttgaccgtctgtcttatttgaaaaatttataaattttttttaaaaaatagtcacacaaaaagtactattcatattttatcatctaataacaaataaaataataatcataaaaaattttcacataagacgaacggtcaaacgttggagataaatagtgtaaaactatacttattttgggacggacggagtatatgtcaagagcgggggatacatgccatggcctgtgtacagccaagtagcagcaggatttgattgaggagagtgagatatatcctgccatgagaaccaacccccaggaagcaagagctaatggggatccaaatgaagtgacagtgatcggggccgatgtatagaggagctttgggacttggtgtttggtatgacagcagcctaattttgacatttaacagccgctgtcaattcaatcacaaaattaacggagaatgttttgagcttttggtgcaagaatgggtgtggccccagttttttgttctctttttaccaagagcctcttcttagcggttgacaacactaactgggccgtcttatctgactcacattgtggcccgtttgttggagtactagcacagtagcaccagttcggcgatgtcatgatgtcagcgattgatgcagtaaaatgattcatacgcgtgactcatattgcttgttttcctcttattcttttcattgcagccatcaggttcagtcttcatctaccaacaagaccagtagtagtctttaagccgttccagtgggaaaagattccaaaagaggatgtgtcaatttttctgttagagcaagtcccaatct

SEQ ID NO: 15221 - DNA, 1501 bp, Oryza sativa
gttccctgcaaaccatttgaaatatttatgcgacaaagtaaaagtctcaaatcatatttgtgaaatctcacatacttaggaaatacatatatttttcattcattacatcactttttttgtccatcatccatatttagttgcatccagatcgttcatccgtaaaacacaaacacaatgctacgattgttggtaataaaaaggtgacccaaatcgcaatgtacttaaattcaaaacataccatcaaggtttgcggatacatttagaaggcaaaactatatgttgtcatatcaaacacacatagagtttttgcctttttattttcacttttcttgagtggcatatatcgaaccagtaaagaaaacattgaaaacacaaaatcagtaagaaattctaaggtgtgtcattgataggaatctaatttatcaagttgcgattaatgaagttacaataaataccatcttataagacaatttgtataagaatgttattgacgtgacgttccatcgatttaactttgttagctcatgtggagtgaacattttaccactatataacaattaagctccttaacgtgaaaagaacaatgatatcgctgcaacaaatcacgctctagcaaacatctccaagcccttcactcttataaatccgttgtcgctggaaagataaaaaccacaaccatcaaaaggagatcaccggtgagagtgctagcaaactttttcatgggtggtgtggcggcggtagtagccaagataggggtcatgtcgggaatcctgtgctgtcgcttcacgccaccgccaccgcttgaaatgcacgttaatgttgttttagcctataactatcttcgtcctcacctagaagcgatgtgttactaggctttccttacttgcaaccgtcctaactatattacgtacatggtaccatctattttttaaaataaattgatataatgatttattatagacagaagaatgtgaaactaaatatacattaagagtacaacttaaaattatttctctcctcgtagaaacgattatccgtctataagaaagttaacggggaaattccggtgatcaatgtcgagataacgttccatctcaaagaaaaaaaactgagaaaaccataatactatggaaaagtctatacgtactaactttttcttactaaatttttactaacactgacatgccatgctataagtgtatctagatttttttataactttcatctacttgaatcaaacggttgagatgattgttagtataaatttagtaagaaaaatttagtacgtgtagcggtgctctaatccttttaccgagtagcaacaggctaacagattcagagtaggcagttggatctcaatcccatcccgtcctctaaaaataaaacaaaatcgggaacaggaaacccacgcacgaatcgattcccatctaggcatctcttcccagagagaagaaaaagaactctcccgcagccgatccccaaatccccacgcatctcatgg

SEQ ID NO: 15222 - DNA, 1501 bp, Oryza sativa
tggcgatgagcggtggacacgacaggcaatgaggcaccaaagccatggggatggtggagggcagtcggccggggttggtggcaaggacaaagtgagcttatggttaggaggagatggtcggttgtggacgaatacaacggtggggagatagggaagaggtggtgtaggggcatctcttagccgccgcctcgggaaggaggaggagagagatgaaagggaaatgataccgactggggccttgcgcggcgttgtagatgccctctgtccaacccgtgaggttgagtgacggcacagtcgggtggcagcggggagaatgcacatgcacaaggaagaggtgggggaggacgggggaagggaaacgaacttgtgggctactgtggttagagatgggaatgagcatagaaggaagagggattaaggttaggtgttgttgaacgaatctcaaaacaatccaatagtgcaaattttgcgagatttcggaggcggtttttctatcaaacgacatatagatagtctctatttattatcattgtacaattttatggtagaagctatagatgtttaattctttgaacgaaaattgcaaaaatctgaggttgtccgaactctcaactttgctagtagtttttagactctagctttgcgcttaccacttggcaaatatcatcgtcacggtgtctgatcttatctgttttgtgctgtggttctgatcaaggtacagttagctttgtctttgctgaaaaataaatatctccacgtgtgcacgaactcatccgccgcacaaattaggccacaaattaatctcaagtagctcagctcacggccggcatcttaaagacctaaacacatcggaaattatctgtagaagctctaagcatatatatatatctatcatctctagaacctcttttctgctatatcctatctgaaaaggattcagaagcaagtcagtaggtagaaagtcattaacaagtaatacaggtttttaattttaataacaaaccttaaaaagtgaatttcaaaaaaacaaactttagttttaatatatgtattcttcgcgctttaaaaaaccaatactaatcgataagaaaacatcaaaatgaattctaaaactatgtttttatatgtgcctaataagacgaagagtaaacgattgagctatttgaatagattttctttcgtagagtttgaacaactcttcactgaattcaaacaaattctactccatggcaagaccggaggaagcattatattgcatctgaactctgaagggaagacaccgcctccaaaaatatcagggaagcttagctaaaaatgccaccatgcgacgtggcgacaactcatcacgcccctcgtttccctggcacgagccttccacgtggcaacgattcgccatcattttaaatgtttttatcgtctatttttgaaatttttgcgtatttttccggtgaatttaaacttggccagatcacttctccatccattttaagtgtcgccctag

SEQ ID NO: 15223 - DNA, 1501 bp, Oryza sativa
ctaactttaaatttgacagtagtgttgaaatgggcggaacgatgacttggtcacttgcaaacagctgcggccccatcctctccggttgcccaccaccaccgccaccttcccgtggacggcgagcttgagctacacaccagtggcatcgccaacctctaaccgcaactgccacctcacgcaaacgggctcgctggtcgcctctcctctcgtcgccgacgagttgttggggaagagaggggataagtagggagaggtggagtccactttacatatgggcttcacatttttttttgattttctatttgtcgactaggatgccacatcaatcaaaacaatcacttgtactgtctcaggaccttatttaacctagttatgaaagattttttttcttagttatgaaagatgtggttatgatttctattattacggttcaaaggacgtgattcaaactcgcgtgggtgatcgaaagtggacttattccggggagaaaaaaggaaggtggtggtgctttggctggccggagagaggatgggaggatgggccggccttgctaaggggaaggatggaggcggcttgtagagatgggctgggctggggtgaggaaagaaagaggaggaaatgtcgggccaggagggaggaaggataattgggccggaaggaaatggtggcccagttgcatttagcaacctttgaaatcagcacaaatcgcggcgcagatcatacggtcgaaaaaacgacaaaatacgtagaaaaaaaatcacgcgacaaatatatagcaaattccacgggtcggtccctcggcagctttgcggattaaggcagccctgactttcctctttttttaccagtcggatgatccgtgacgcagccgccactccaaacaccagggcacaggacgtgacgacggtaaaaccgggaaagggacgacggagtcgctagactcggagacggttcaccggtcggaatcggacacggtttgtttcccatcagatcagataaaaggcagcaacaagctaatcccatgacccccaaacaaaccacgcacccagcgtcccagccggagggtgattcagtcgatcgatcgatcgatccatggacaagggaggcggcgccggcgattgccagccgccggagtcgtcatcacatgagaacgaagagaagaacgcgttggttattccttgttccctcgctccaatcaaaacggggaagaagtatgaccagcagcaggaggaggaggagaacaattgggagtatgatgaggaagaggaggaattcttgtacgacatcgacgaagacgacgacatgatggaagcctccgagctcatcggcgtcaagcacagcgacggatccatctacgaccccgactcccacccgttccacagcctctactgcctcgacgacacccgcgagactagcctgctgccgatgaggctgtcggctcggaccgaccattgccagccatgctggacggcttgcatcgtccaccatggctgccgcatga

SEQ ID NO: 15224 - DNA, 1501 bp, Oryza sativa
aatatacttatttttttaataatttacgtttatatacatgtatggtttatatacatgtacggaaaggttttgcaaaagtatatccgtcctacaggacagaaatgtgggaccatgacggtcccacagattcaaaacgcgggaccgacgatcccgcggtacagtcgtgcgggaccatcacagtcccctagctccaaaacgcggaacgacgacggtcccgcggttcccaaacacggaaccgcggtgcccagcgatttcaaccctatgtagcactgttccgacacttcaagtactgtccgacaatgttcatacatcagtaccgtgtcctcattgtgtggaaccgacccacgaacagtgtcaaaagtactagaacaatgtcgaacacagtgccatgcagtacaacaaaaaagatggcgccgcggttcggcacactggtgctgcgagagcgagccggttccaagttcacgacaagctcggtcccacagccccattccgcgcgagcgcctccgtcgtccgctccacgccgcgctttggtagcgctcccgcggaaccgatctgcagaataggtatattttcacaaatttttcgccctagtttatataaacgcaattttgttttaaaaaaaatggatattttcaaaaaaaaatcgttaaactaaagggaacaaaagttttatacttacatttaggatgtaatacacttcaagaatgtggcacctttttagggtttgtaaatactttgtaaacaaagggatgaattaatattcctctataaactaaacttaattaatttttgaataatttgacttagtataaaactaaaactttttacatttcgcaatggagcgggtacagtgtaactgctcaactcttaatttgtcgtcaacaagttcagatcctgtgtttaattttcattttttccccctcttagaaatcatcgttttgttcctttttcctaatcctaagaataataaaagtccactataatagtataatagctgtagtactcctcgagagtcgagtcctcgtctcggccaaacaaaacactcgaacaagagtctctcagccacggagtcgatggggtctcgtcctcgcgtcgccttcctccaccaccaccaccaccaccaccaccacctcctcgccgtcgccgtcgtcctcctcctcctcgcgcgcggcgccgagccgatcgccgccggcggtggcgccgccggccggcacctgacgacggaggagcggtggatggaccagcgcctcgaccacttctcccccaccgtgagtcgtcttcttcctcgtcttcctcctcggaggaattagttttgttttactctaaaaccccctggattaaaactgtttctcaaaacgatccctgagtggctctggcttgttcactcgtcgagggcatggattgtattagttttaatatcaggggctgatatgtaatgtcgcgagaaacaaaaaagttctttgggtttagcgccctcgcgctgatgtcgccggcggcgtgc

SEQ ID NO: 15225 - DNA, 1501 bp, Oryza sativa
accgtgcttaaaatctgatgtacaagttgtttttggcttgttgcatcacttgtgcattactcctctaaaagaacttgtctaatgtggcgtcaagaactaacaattaagttacagttgagtcaatcaggaatatgaggccgcgccatctgtaaggtctccttctatgtccacgtcagtgtaatttgtttctatcgttcgatatatcatatacggttcggatgcattttgccagattatgcatgcactagaatgcacaggtactagtgcttgacaatgacctatcatattacaagtgtacataatgcaaaatgtatgaggctataatcctgcactgatttttatctgagggtgcatgcatggataagaatggatgctattggccatccatgtaacaagtttgcagggtgcacgaatgcacgatggcctcactccctcgtgtgttattgtgttaggtctgctattttcttttttaaaaaaatatagtccaaaagagagacgaggtggggaagacttgattatattgttctcttttttttttcagaacacgcaatacgattacgcatcttttcaccgaaagacggggaaaagaaaagaaaaactcaaatcacccatacaaactgattgattgaaataggatcacatcaaggtggaagggaaaaaaattaaaacaacatatatctattatatgaactctagatgacaacaacattaacagtcagatttaggataagtgtgtacattaacatctactccctccgtcctaaaaaaaaagaagacaaaccctggtttccgtgtctaacgtttgaccatccgtcttatttgaaaaaaatatgaaaaaaattaaaaagacaagtcacgcataaaatattaatcatgttttatcatttaacaacaatgaaaatacgaattataaaaaaattttatataagacggacagtcaaagttggacacggaaacctggggtttgtctttttttttttggacggagggagtatctgtattgtaatgtgtttttttttaaaaaaagaaaaagcttgcatgcatgatttctatgctagtttaaaaagagcagtgatggtgatgaggggttaatctgtcatcaccaactacttactcttttgtaataaagaaataatatgtggggtcaaaaggttcacatgttaaccaccccatcgtctctaattttactgggaaagacaaatgatattataacgtcatatggatcatatattaattacaaatatatatagaatttaagagatgatatatacagaaaataatgataatagcaagttaatcattatttttcgtcaattaaaattctgttgccacaaaatgtttcatccgattctaatttcttatattttttactcagcagcagtagtaataccattatcatcaagcctatggtcacatcattcacgccaagtgtccaagcacctactccgaagcttcttgctgattaaattagacggaaatggagctgctaactgatgcctaa

SEQ ID NO: 15226 - DNA, 1501 bp, Oryza sativa
atgtaggctgcgggcactggcgtttgcgggtcagagtgagctcagccagtggtgaatcaaaaggcaacttggcatccgtgtggaaatgggttgcaccggaagcttccgctgcaccgctaacggctagaattgctccgatgcacagccgactagcaaataatattccacagtccacccggctccattgtgtgtcataccaccatttttctgcgggagaggattctaataactcgagtggatgtccacccgtttattgcatatgaactagatggttatgaaaaatttttaaaaaaattgacaagatatatcaatatgtaatatatcactccacaaacatgcaagttcaaattcaacttctacaggttgtaacaaaaataacaaatttaattgtaaatatacatatagtaatttgagttttgtttgttacaacttgtagaagttaaattttaacttctatgtttatgtattgatatattacatattgatctatcttattcatattttttttatttttttataactatttagataacatacaataaacgggtgaacgtccactcgagctgttaaacagtttcccatttttctgcgcctcgttcggcggcctatatatgaggttattttttcccaaagacaatgttgtacgtagtactacgtatatgcttacgtgcagacaccaccatacacatccatccatccatcctctcaagcatgcggttttgccggctgcagattggaccacgtggcaccgttaaaagttgagataaatacgagaaattacgaatggtaaaaaactccacagcggtaatttcgggtgtttggtctcgcgcggagagtcacgtccttgtcaatctctctcgtggatgggcttgatcagcccatgagcgtagccaggagccatgttggcccatcactatgcgtggacagtgcgggctgagccaacctcgtgcagtcgtgctgagctgcccagcctcccacgcacgtgggatgtggcttagccatgttggtgcacaaacattgctacgggctgaacgccaagccttgtggacagtataaacatgttgcagtatcaaatcctaaaataataataaagaagtgtggtattttgaaaattgaagattaaagatgtaggtgccaaaccaagctgttagggcatccacaatgtacttcaaaattaagtagtccataagcaatataatatttattcagctacctagcaacattgtggaattagtccataaaaaaaaataacaaaagctacccataagcatatgggttgcccatagagaataaaatatattatttgtctctatctcttctctcctactaatactatttgctatccatatagtttgtgaaggttacaatagttaaagttcatatatatgggtctcatctctatagactacttttgccatatacattgttgttgcccttagcatcctgtattatcaaagtaatattaacatacaaaccataaagtagcaaagcttttatcctt

SEQ ID NO: 15227 - DNA, 1501 bp, Oryza sativa
ataatagtaggctataagactaaatgctgaggtggaggagagaagagaggagagagaggagaagcgagctataaacttatagccggcttggatataagaacaaagaaactctgtgaaagagacaggtgggtcatatattaattgtaaagagctaactattatatggatgagctgagagaaagttaccaaaaaccttatagccaataaatcggttgtattattacccttactctaaccaagagaaaactttgatagctcggttgtgcatggcatatgcgcgtggtgtgagcgggaagttctgggttcctcttccccacacggctagctaattctttctcagctcagcacaaatcttcaagtgcattgaatggttaaaaaagtcgaaagttttcaaccacaaaaactgccgccagtttttttagcaaaacggtagtagtagataacgtgcacatcttaaggccgaggataagatataacgggtagagtttatttttttctttagcaaaaccgtaatagatatgcacctgttaaggccgaggataagatataacaggtggagttttttcagcaaaaccgtaatagatatgcacctattaaggtagaggataagatataataggtggagtttttttcaccaaaaccgtaaaagatatgaacttgttaaggccaaggataagatactccctccgtcccaaaatataaatgttttaggacttcaacacagtctttgagatgctactttgaccaacaatatctataaaaataaaaaaaaatcaaataaaaagagttacatattatgatagcttgattataaatctagtaagatcaattttacacgattgatcttttttattttcttgctattagtagtcaaagttagaaatgattgacttggcactatttcaaaaatgttcatattttgggacggagggagtataacagctggaggagtgcaggtgagttggttttggtgccattccgtttctcgtaaacttgacttatgtatatgctgctacatttttcgcttttggaccacataatctccttgtaatcttaatcgatcgctcctgtttctcatcagaagtagcgagagggcaagatccggagaagtaatcaaggactacggaagtgatggacgccgtggaaacgatcatctcaaccgggatcaacatctatgaagcgacccagctgagcgatgaactgtcccgcctgcaggccaccttgcccaaggctcgcttcctcatcaatcgcggcgagtggggcaggttcaagaacaaggacatggcgatccttctgtcgcagctcaaggacaccacctacgacgccgaggatcttctccgcgagttcgatgaccaggcgctgcggcaaaagatggaggacgctgaccggagctgggcaggtcaactcttatcttcctctctaaatcatgcaaaaactttgatccgtggtagcaaaacaaggataaagtaggcccaggagaagctcgacaaggctgtggctg

SEQ ID NO: 15228 - DNA, 1501 bp, Oryza sativa
tatatatgtagactcgagattgagattcccaatcgagggaaaggtgaggtgcacgcgccggacggcccctgccgtaggaggatgccggggcgaatgcgtgcatgtgtccgtccgtccgtcccgttgtgcggcgcacacgcgcgcaccgtcggcgttcggcagcgcggcgcaaaatggtgacaggcgggtggtgtgggaggtgggctccgtggatctgagttcccccatgctcccgtgtcgcgcccgtcgggattggatcgatccgccgctggcgaattcaccgcggcgcgcgcgggcttgagccgagcccatcacgcacgacacggccgttctgcccctgcagccgcgcgcgtggcgtgttgccaccccccgcactcaacggcccccgtatcgcacgcacaaacacacacgcgacgactttttccctcccacgccgccgcggtgatgtcacgggctcacggcccccgcttcctcctgggcgacctaacccctcacgtctcgccgtgtcgcggccggtcgcgggcgccgtccgtgacgcggccgtgtggatcactacgggtgggggggggggagggacgcagattgcggtggggttaggttttttccgctgatgcgtgatgggccacacgcgggcgctcggccggtccggtggtggatggatcggcgagcccgagcgcgaggaggatttggacgcggacgtggatcggggtagatcgcgcgtaagctttgggatatttccgagtttctattggctttccacaatgaaagcaacgcgggggccgggccaccgtacttgcttcgtttattctatggcaagtgttaggcggcacgggctgccttccacggaatctttgccaacagcggctgacaggtgggcccatcagtgacgctaggcacagtgacaaaatgtggccattcattcaaagttcagttgattataactgtcactgtgaaactgtggtggcttaatgggggttcagctaactgctaaccacgccattgagagggatccgattcaggtgcagtagctagtgtgactgcaagataagcagtcacattagcatcacatgattcaaaatggacgttccagatatatctgagcactgtagcaaaacactgtagcgatttactgtagaaaaggaactgttctgattttactgtgctgaatccttttaggccgttagattttgacatggagggcttggattgtgtgcagtagttaccatgcagtcctagtagctactgcatttgatctcaatcccattgagagcatatttctctccttgcctttttctgctatgcatttgtgagtggtcactggtcagtgggtggatggactgttggagttcatggcttcatggccaccattttgtcatcatatctccacacaaaggaattccccccaagcaaatgtgatagataatcgagagctgtagtggtgtggtgacagtcagtagtatcccactccttcgtgggagcacctcttttcgatcagataagt

SEQ ID NO: 15229 - DNA, 533 bp, Oryza sativa
  unsure (1)..(533): unsure at all n locations
ctgtgggttgacatgacgcttagatgtcatttgaattaaaaacgtatatgtgggatccgtttgtcattcacacacataaaaaaggtggggcccactgacatgtgggcccaacatatcatcctctctcttcttcttcctcccctcttcctcccttctctcagtaccggacagcaccatggggacggcgatacagcgcccttgcgagggacgccgcgttgcaccgctccgcctcgacggcggcgccccccccccccccccnnnnnnngnannnngntngnngccgnncaggcgctcggcgaggacgccgaccaccgttcgtcgacgatgggttccacgacgccatgagcagcgcggcgccgtgcttggcggcggtgggtgggtcactaggccactagggagtgcgaggagtaggacggcagcgaacgagctctagccacatcgccgtgaaggagagcgccgacctggggaatgagcccgtgagtcccttcgcctcccttgcgaactcctgtagctcttgccgcaccggcttggcg

SEQ ID NO: 15230 - DNA, 1501 bp, Oryza sativa
taaattaagagaaattggatgtgtattgttttgtaggaatacaggagattaaagcaggacattcagcatggtatatgcatctgtgtttgtgtgtgggctgtctaaaatcgcatgaattctgcgtgattttcatagaaatttgaaattaaacaattcaagtgcattaggagataggaaaaaaaatctaggtggtgttttttttctaaagatgaagattaagattaagattaagctttttacgcaaaacaatgtggtattaacgtatgattgattgagttttaattattacaaacttaaaaaagtatattaatatgatattttagagcaactttcatatagaaagtttttacacgaaacgtactgtttatttaaacagtttgaaaagcgtgctacaaaaatcttaatcttcgtctaactttttgttttggaaaaaagaacgggaactgtgtaaaagctggggcgtttttcatccactagcaacatgtttgaattcgacatgtacgtgtgttttgtacttttgtttagttgagcaaaactagtaccattgacttggaatcaatacagaaaatcctccttttcaaacaaaaaattctgtatcgaaaccttcagagaggagcaaagcgttgactttcattggagacaactgaacttctctcgagaacaaaagagagttgaacttgaaaatgtgatggtactgtccttgagatgatcaaagtacaggccggacgcatcgttaatcgatccggtcaacattctagatcaggcccatgtgcatgtactcctttcactacaaaatccttatatgggctgcagggccggccatttgagtctagcgataataggccgggagactccaacgtgtcattaagaggaagggaaaaaataaaagctgaacacatactccctccacaccttccgtttcagaaaaaaaaataaatttaaaaggaaatgtgatattttctagtacaacgaatctgaataaagagttatccagattcattgtactacgacatgttacatttttttttttgcggggagacatgttacatatttgcttaggttaaggttttttttagacggagggagtagatgcgttgcgtacctggccatgggaatgcgatgcccgtcaggtcacgagcacggacgacgtacggccggcatctaggcacatggcggctcgacggtgcgccacgcagccacgcgcccaccgaggcccaaaagctccgcgccacctcatgccgtgacgtgcagatcccctcctcccgcatcccccgcatgcgcgccacctagcacgaacacccaacgccgccgctcgatctcatccatgatccatcccatcatcgtcgatggcctatatatactctactccaatcaacccaatcgtccaaaacacgtcgcaagtcgaagcacaaaacgcaagcaacgaatctcaatccacaggctcacactgatacgcaacgcacgtagctactgtactgtaggagcaaaagaaaagaaaaga

SEQ ID NO: 15231 - DNA, 1501 bp, Oryza sativa
ccgtgtgttcctctcggtgtggtggtgtgtaggcacgtggccgggtgtgttttctcttgtccggttcccctgtcccctgctgcttttgcctttggttgtaaatggctgttttactcctctaaatgcaaaaatacgctagaagcgtattcccaaaaaaaaaaggattggcagaattctgagaagaagtatcagtatcatctttcctatgactttgttgattgtctccatgtttttcatttccttcctcttcactgtccacttcgatggggacatgttgtttggcaaattgattctcagtaacagcaacatcatcattacatatttgctcattactccaatcagcatcagatggagaattatacttccttttcctctcaatattagagttcatagcacggctgctgtcagagctatcacagagctttctccgacccaatatctgaagactggatgatcctggagcatttgtccctgctgatacactttctccagtcaaattctgcacagcgatggagtttggatcaggactccttggtaccaaagttccgggcatatcattgtcagcaggaggcacatgagatttagcttggctaatttctgaaaattgaactctgtcacttcttgtcaccaggcctttaccttccatgtcaccagcccagccatactgttttatggattcatcagtttcttcagtatctctggatttgccaaaatcaaagtctggataagggtaggcaatcactgaattgagatacttctgagcagcagtatcattaacatttttctgacaagtttgttggttgcctccatgtcttgcatttccttcctcttcactgtccacttcgatgggaacattctgtccagtagattgattatcaggaacagcaacatcatcattacatatctgctcattactcgaatcagaatcggatggacaaatatacttcctttgcctcttaatattggagttcataccatggctgctgtcagaggtaacatagagctttctcttacccaatatctgaaaactggatgattctgcagcattttcctctgcaggtgcactttctctagtcaaattcttaacagagatggagtttagatcagaactctttggtaccaaagttccaggcttatcattgtcagaagagcagatgtgagatttagtttgcttcattgctgaaaattgaatggcctcgcttcttgtcaccaagcatttaccttgttgatgctgattaccatgctgattggggacactacttcgttgaaatgagaacatttctgacggtgaaagctgagacctttttgcagcagttgataggattcttgagggcacagactgctcacgcagtttgattgcaaagaacttaccacaatcattgcagcgggccaaaaagttccgttggtagtacagagattgcttctgacaatgcggacatatctatctatctatctatctatctatctatctatctatctatctatatatctatctattatt

SEQ ID NO: 15232 - DNA, 1501 bp, Oryza sativa
catcgcccgatttggccgccgccaggccaggtgccgcgccgagccaccagcctgcgtcgaacccgctccagtggcgcgtcggagtggacggatgggaagaagatggaagagagaaggaacaaaacgaaggagatggatggaagaagacgggagaaaacggaaaacaagaaagagatggatggaaacgtgacagtggtggcatgtttctattattgtaaaatttcaatgacacggtatgaatatgcgaattgtaatgttatttatctgaatatgcatatttgcaatagcatgatccaattaaacttttttttctactcctctgaagtttatatactaggagtttatatatatttttttcgttggccacttgtgagtatattgactgactgcctgcctgcctgacgctttctatgattacttgtggatttaatagttggatttaatagttgggtttcttttgcagtaatttgtatcgtgatgtacaattaaggaaaaatgaatgtataactgacagaaaaataaatgaatgtaattgagagagagagagaagtaatgtttcatgaaattattagacaggaaacttctcttctttatacttaaaatgtacgttgtaacgggtcataaccacagaagtaggaatggactatagggtgatttgagataaaacattgatctggtggttgccttcggtgtaatggaccatgcccatataaatagatataggttataaggtaatttaacataaaacattgatcgggtggttatgggaggtggtgcgctcggttggaggataaaggaggatgatttagcttttaagattgtagagatattggatgaatcttctattcaagccatctcaagaaagggaattgtccatgctaaatgctactatctctatttttagcaaagtaacgtgtaccaaaataaagttatttcttcacctacctttttctcttaaccaatcacaaccattctcttctcctttaatcataaccctcgtccaatcatttctatctactttcgttatatccgtgtctatctcaaaatggtttcattatgggacagatggagtattatctacccatttattgccaattaaatgaaagccacgtatggacgggtgtgcctaatggatgaatgttcaagcacgaacacttttggcccggctcacatgcatctagcctaacaaaaaaagctatttcagaaattttttatgtgtatgtacaaacttttaatataaaaaaatatttgaatccaaatcaaacatataaacttctgttataaatctctactattttaaaaattgaagatgtttttgccggcactttggtacgttatccgtgtatgagttggttttcgaaatacagatccgtatttgagtcgggttttaagttcgttcgtttttggaaatgcagaaggagtcgtataagaaatttaaataaaaaattcgcatattaacttgagatgatcggactcctacttacagctcatggttttttta

SEQ ID NO: 15233 - DNA, 1501 bp, Oryza sativa
tggcaggaatgctcccttgtagcatgttgagccctactccgatcaccctcagtgccgacagattccatagagagtgggggaattcgccggtgagcatgtttgcttccaagctaagctcatgcagaactgggaagttgccgaggcatggtgggatcaggccctccaggtggttgtagtccaagtataggtcctggagcaatgataggttggctagcgagggcgggatcggtccgatgatgctattgttggtcagtagaagcatctgaagctgtgtcaacgtgtttcctagctccaccgggataatcccgcccagctggttatagtcgaggtccaggattttcagactgatgcaggaggtgaggttgacagggaacgcaccagagaaggagttgtagctcaggttgagccattgcaggcgtcggaggcgaccaatgctggtggggatctcgccgtagaggccgttggagctcaggtttagccttcgcgggaaggtgaggttcccgatggctggggagagcgtgccggcgagattgctggatggcaggctcagcgacgccacccgcgtcggcctccggcgactgcaggtgacgccctcccagttgcagaagctggcgccgctgctgttccatgaggcgagcgcgcttgaattactcccggtgagccccgccttgaaagcaagcagcgatgcctcatcgctgcttgacgcagcagcgatcgtcaggaggacggggaggaggggcagtccaagccgcctcatgagacgtatcgccatgtggatttttatttggtaagcgtctttggagcaaagtttagtttcaggctggagatatatcgctgctttctgattccatttttccccccggcccccttgttgtaagagttcacttgacctcattgacttcaagtcaccgggcaggaccagtgtaattgtagtactaggagcagtgtgttccacttccacctacttccttcttgtgataaaaaaaccaatctaatatgggatgttccgattcgttgcaatagaatgtgttatatccagttttatatatatatatatatatatatatatatagtaaatttgttaggggcaccatggtgcccgggctccatagccatccaccgtccaaatgctttaagatccgtgcaacacactagaggatgctatcacacattaacgggtctaacccgataagagttgcatgcatatactttccttagaacatgcatgcaggtatttccatttttactgtgcatgtatttacaaatttgcgccctctaatcatgcatacacattatgattagcactttccattttctatatcacatttccatatatacaacgtttgcatgcagatacttaccttttgaatcacgattcgtttttgaaaaatgacgccattccactaattgcgattattgccatctattttcaagattacattccattttcaagatgcacatataaccggctactgtattcctttttttgatttttcttttc

SEQ ID NO: 15234 - DNA, 1501 bp, Oryza sativa
agtttggatccaaaatttggatctaaacacagcctgagtcactggatctggacttggatatcatatcaccgatatgatctcgctgctgcgtgccagcgcggtcgatcgcgtgaggaaaacggcaggaaaagctgcgttccccttgaccggctagacagataaacgttcttcgcctgagcagaagatcgcgtcaactcgttcaccggcgatggagatggaggacgacggagaggagaagtgttcggtgaagcggcggcgacggggagcaagtgagcaactttgttgctcagcctgtcagataatgggccatatctcgtgcttgcctcgaatagtttgggcctttacacgggcccaaatgtatctctcttggttgtagcccgttgcaaatcatgggctgcgcgctaaccttcttgtgggcctccttctggtattgtgggcccaccaaaatgctaatccaccgcaaggtccattcactgttggacagatcgctcacgcgcgcgcttccgccggggtctcgtgctcacctccgggcaccgcctcgccgccgccgccggaatgcgccgtcactggaagccgtgctcagctccgacgcgtacgatgcccaatcctgtatactttttcttcttcgagactcccgtcgctgtagccacaacaattctccagagactcggagttctcagtctgcgcccgttacctgttcgacagaactcctccgaggagcttactgtccctggccctttgactaaggtgagcatccaattggttaatctccataaattttccacgccacggaccttttcaagtttgtacatatgtggaaagacatggccgtgcctgctgtaattctcgatttctcgttgttcccaggaggctcggtgttgttcgtttttgtgctcgtcaactgtagttgtccatgctttcacggaagctctacacaagctgaatctaatcctggatcaccacaagacttttacctttcctcgtgtgtctggaactccgcatacaagcgtggaaaagggtggccgtacaactgtacaaggtaacactctggactgccaacctaatggattctctgttggaatcagtcaggaagaaattatcaggaatttggtcgaacagagaaggggtgaggacataattggagcgagctaagtcatgtgtgagggccgagggcgacagcgacgagagcttggatgcgtccaagctttccatatccttccagtactatgttacagtaagtatctagttgggaaatgatgtggaaaggaatggcgggaacagtcaaaaaggtaacatgcactgctccaagtcgacatggtatcttaccactcctgtctctctccctgtgagcgcggagaccgctaaacaagtcaagattttgactcggtgtcctcgccgtctcgccaatggcactctgggatcatggcgtcgtggggttaaaatacggtgctctggggcactgcttgtcactccacttgtgtaccttgcaagtttgcaacca

SEQ ID NO: 15235 - DNA, 1501 bp, Oryza sativa
tcttgccactcactgaccttggccatgaaagactgtcaattttgctgtcagtgtaaaccttcactgaacatttgtccaactggagaacattatacaaatagatagttctataagataccacagcttttagtgttctatgattcacctccgaataatgagtaggtagttcgatcctttcgattcatatcttcctagtaaacggggatccagagcaataggtcgaatttctatataaagaagacttgtaaacaaaaggacttattgctctttttcggttttccgcttcacctattgttcttatcaattcattttcctccttccttctttcaataagaactatttgaaatgaaacaaattcctcttcattctgttacagaaacagggaattataaccagcttcaactgtctacatacttcaataaagttcagcctaattcaattgctttgtcactcttagttgacgatgatattgatcagagccattaatatttaagatcaagaactccaagattctaatatgcatagcaagcatggcgtctaagtgtcacaaaattacagcatcactcagtcacaccattgtagcttcgtcgctgtcgtcttcgtcgtcgtcgtcctcccacacgccgacggccttggtgaaccagagagcggtggacaccaccgcggcggcgaacacgggcggcacgagcacgtcgagggtgaccctgccgaacagcgcggcgggcacgcaggcggcgtcccacggcggcccgtcgagcggcaggacgatgccgcccgggcagccggccgtcgacgacgccagcggcgcggcgcccggcgtgacagcccagacgaaggcgagctccggcgcgaacgcggccacggacaccgcggcggtggcgacggccgtccaggtggccgcgtagaagagcaccgggtggcgcgcgagaatgccggagacggagagggaggggaacgccatggcagagatcgaggtggatccatggatatatacaaggaggcagctcagctcaatggcttttgggttgagaggatttggcgggagagcaggtgagcggtgacacttcagctcagttcgtcaagtgaagtggagtgctcagtatatttcaaactattcgaggcttcgagctgctccactcagctcacctgctcttaaaactgaattatatagatgtaattttaaaaagtgtaatttatttcaatgcaagattagctgctactacctgctacgctctttgaaatgcgaaattaattgtttttttctataacaaataaattgttgagttaatcaatctttccatcacgactaagggggtgtttagaagagaggggctaagttcctcaaagtgggggtactcttactaatttaagtttgtattttggttggttcagatttgcagcatgctgaaacgttaaaagctgtttggttagttctgtacttctgttgcaggttatatcaggcctctatatctgttgctatctgggccggactgtatgattg

SEQ ID NO: 15236 - DNA, 1501 bp, Oryza sativa
cttttttttaatctgcatgcattatgcatagccttttttttaattacctcggtaatttacacacgagctgactcgagctattatcttggaggggtttgtgtgtcagtccatttaaaaaagatgtgtcagtattatattgcacaatggagtgatttgtgtcagtgctcactactcagtataatatatttttttgtatagtcaaaattaactatatgttggttaatgttaaccccatatctctttcactgtttcacacagatcaaaagatattaactactcctatcaattaagcttaattcttttgggttaatacattaactaaagagattagcgaaattggcagaggatgatgaattgagatctcaagttcgttcatgccggccggccggtcggtcatcatcgacctaatcttcaacaaatgcagcatcatcagatgatcagacaacaatggaccaatggttatacaaagtaggccggccccatttgctaccgcagacgagtgaccaaaataatttccagtaacacatcggaccaactatgggctgtaaaataattaaagcctaatttgtaaaatactagtaaaaagaaagaaaatcaaacctctcatataaacacaggcaagcaaggtgttgattctagatacttgctaaatttagagtttgtaagataaactatagtgagatttaaaattttatatttctcataaaatacaaacaacaattcatctaaatattatcaatataatcataattttagatgtatagatttctagagttatgaatacttagttaaagaaaaatcttaaatctagaactgtcccaaacagagtcgagtatgccacggttgctagcactggcagtaacatactccctccgtcccattttaagtgcaactataagtttctgtgctcaactttgatcgtccgtcttatttatttttttttgtaattagtatttttattgttatgagatgataaaacataaatagtactttatgtataacttatgtttttgtttttaaaaaaaaattaaatgggataaacgattaaagttggacacgaaaaatcatagctgagacagagggagtacgagattatacgagtgacagatggcaaatcaggaagtgattaggagcactgcatcaatgcatcatgtatacaacgggacccaacgggacagtgacacgctacgtagttcataatctacagcaaattacttcccctgaattttaatcgaatacgaagcgctgctacacaccaaccagacctctttgtgaaccaatttggtgtagcatttggacatttttgagatattcatattcatataccggactagcagtaaattacaaaacccaaacgtataaaattctcttaaaatttggatgaatccaggtcgattcgattctttctgtgacgattccaaattcctttctgtctcgtcttcttcctaatccttcctgcatcgattctaactccgcgaccaactctgcaccggcgccccca

SEQ ID NO: 15237 - DNA, 1501 bp, Oryza sativa
tagcttcccaatactttctggaattactccagatatgggattgaaccccaggtcgagtaatctcaagccaatcaaattgctaatgtcgtgagggatggtcccagagaagctgttattctctaaatcgagcatctgtaacgtcattgacagattcacaatcgatcttggcagctgcccaccaaagaagttgtgagagagcatcaattcttgcagctggctgcagtttgctagagaagttacaaattccgaaccctttccgttatctgcctcaagctggtttgttccgatgtatagatacttaagagaatgcaacatccccaaggtgggaggcacaaatccagtgaagttgttatctgcgaggtacaaatctgtgagccttgaaagattggacagagaagatggtatggccccatgaaaacgattctcatgcaatccaaagaagcgcatggcaggaaacttgtcaccaatgttggcaggaatgctcccttgtagcatgttgagccctactccgatcaccctcagtgccgacagattccatagagagtgggggaattcgccggtgagcatgtttgcttccaagctaagctcatgcagaactgggaagttgccgaggcatggtgggatcaggccctccaggtggttgtagtccaagtataggtcctggagcaatgataggttggctagcgagggcgggatcggtccgatgatgctattgttggtcagtagaagcatctgaagctgtgtcaacgtgtttcctagctccaccgggataatcccgcccagctggttatagtcgaggtccaggattttcagactgatgcaggaggtgaggttgacagggaacgcaccagagaaggagttgtagctcaggttgagccattgcaggcgtcggaggcgaccaatgctggtggggatctcgccgtagaggccgttggagctcaggtttagccttcgcgggaaggtgaggttcccgatggctggggagagcgtgccggcgagattgctggatggcaggctcagcgacgccacccgcgtcggcctccggcgactgcaggtgacgccctcccagttgcagaagctggcgccgctgctgttccatgaggcgagcgcgcttgaattactcccggtgagccccgccttgaaagcaagcagcgatgcctcatcgctgcttgacgcagcagcgatcgtcaggaggacggggaggaggggcagtccaagccgcctcatgagacgtatcgccatgtggatttttatttggtaagcgtctttggagcaaagtttagtttcaggctggagatatatcgctgctttctgattccatttttccccccggcccccttgttgtaagagttcacttgacctcattgacttcaagtcaccgggcaggaccagtgtaattgtagtactaggagcagtgtgttccacttccacctacttccttcttgtgataaaaaaaccaatctaatatgggatgttccgattcgttgcaatagaatgtgtt

SEQ ID NO: 15238 - DNA, 1501 bp, Oryza sativa
gacagattccatagagagtgggggaattcgccggtgagcatgtttgcttccaagctaagctcatgcagaactgggaagttgccgaggcatggtgggatcaggccctccaggtggttgtagtccaagtataggtcctggagcaatgataggttggctagcgagggcgggatcggtccgatgatgctattgttggtcagtagaagcatctgaagctgtgtcaacgtgtttcctagctccaccgggataatcccgcccagctggttatagtcgaggtccaggattttcagactgatgcaggaggtgaggttgacagggaacgcaccagagaaggagttgtagctcaggttgagccattgcaggcgtcggaggcgaccaatgctggtggggatctcgccgtagaggccgttggagctcaggtttagccttcgcgggaaggtgaggttcccgatggctggggagagcgtgccggcgagattgctggatggcaggctcagcgacgccacccgcgtcggcctccggcgactgcaggtgacgccctcccagttgcagaagctggcgccgctgctgttccatgaggcgagcgcgcttgaattactcccggtgagccccgccttgaaagcaagcagcgatgcctcatcgctgcttgacgcagcagcgatcgtcaggaggacggggaggaggggcagtccaagccgcctcatgagacgtatcgccatgtggatttttatttggtaagcgtctttggagcaaagtttagtttcaggctggagatatatcgctgctttctgattccatttttccccccggcccccttgttgtaagagttcacttgacctcattgacttcaagtcaccgggcaggaccagtgtaattgtagtactaggagcagtgtgttccacttccacctacttccttcttgtgataaaaaaaccaatctaatatgggatgttccgattcgttgcaatagaatgtgttatatccagttttatatatatatatatatatatatatatatatatatatatatatatatatatatatatatatatatatatatatatatatatatatagtaaatttgttaggggcaccatggtgcccgggctccatagccatccaccgtccaaatgctttaagatccgtgcaacacactagaggatgctatcacacattaacgggtctaacccgataagagttgcatgcatatactttccttagaacatgcatgcaggtatttccatttttactgtgcatgtatttacaaatttgcgccctctaatcatgcatacacattatgattagcactttccattttctatatcacatttccatatatacaacgtttgcatgcagatacttaccttttgaatcacgattcgtttttgaaaaatgacgccattccactaattgcgattattgccatctattttcaagattacattccattttcaagatgcacatataaccggctactgtattcctttttttgatttttcttttc

SEQ ID NO: 15239 - DNA, 1501 bp, Oryza sativa
cgtcgtccaccgcggcgcggcgcactggctgtgcaccgaccacgtcgcgagcgccacccgagacgactacctgtacaagagctcagcgtggaggtgggcggcacagccacggccacgccgcgcgtctccatgacgaagctccccgtcctcgacggcggcacgccgacgccgctgctctgcgtcggcggagacggcgagctcaccatcgtctgcgtgttcatcatgcacgtcagagtctggaagcagcagcgacgcggcgatggcgatggcgacggtgcggcggcgtggcgccgcgacgtgatttggatgccaacggaggtgtccaactaccccaaaagttacacgatggcgcatggattgggacgcaggggatcggtggccatgatgtacagtagcaccggcgctgtgttcgtcctcgacctcgacaagaaggtgatggagaaggccatggactgcttgctgcccctgcgaatggaccattcactggatcggccgcctgtgccgtacgagatggacttggtggagttctttctgctccagcttggtggtctatggctctatgcagcagaggtgatctacaggataatcaattaattaattgattgattgattacacatgtttatggccccgcgaaaattactcatgttatgcagtagaaaaacgagggttaattgtagaataggggtatgtgcgggaaaaaaaagtaagttttgatttaaggacaacagcatattattatcattgataaattcttcaagtgttattaaggtttggtaattggtgtcaccttttttttttccttttttttttgactgtctgatcctttgttcagcaatttttgttcattaacaatatggcattgtgcattatccaccctgatttatggtctggtcgtttgctcgttgcttacgcacaacctgatgaggtgagcgtgaccgtccgccggaaatgcgggattttataaggctcacgcagaatatgaaagttggccatgtcgaagggtataggaggaagaggtttcatttttctccctcacccatcttcctcgattctaaagatatggctagagtgaggtttagtgtcggttgttagaattgggttatgatcttttggacaaccttggctgtagtttcttcgttggcttagcgacggccgatctagtgatagttttctcttgggtttgtgtgttggtgggtgggtggtggttattttttcttcgtttttctagttacgatatcccagggttataattttataatttttttctactttattaagggcctatttggttctctaccctaccaattaattggtagtgctaaaatctagacaacttttagcactaccaattttttggtagggtaaagttagctagtctatgtttggtttaataccaatataaagctaaaatttagtatgagagtgaagaagattttagaatatagccaaattgagcgtaggcgctatcaattgtttggcttcaatctaaactagcacgtt

SEQ ID NO: 15240 - DNA, 1501 bp, Oryza sativa
tcggattcgttcggagttaatcccgcaagtttcgccggcgtcttcaagggcggccgagatctccgcggccgattcctccccctccggccgtcctctctctctcccggcgctatataagcgttccccgtgctctcctcctccgtttccgccactcgccgcctctcctccccgtcggaatcgagcccgcaccgtcgcaccttctctccgccgtcgccgccgagctccggttcgccgccgtcgtcgctccggacctcctccccactcggcgtcacctccttcggcttcgccgcgtcgtcgtcgaccccgtccgctcctccgatttgctcgccgaccgccggagcaccgtcgccctcgccgtcccgaaccgcgccgccgccttcctccgcttcggccgccgttcccgtcgtcgccgtcgacccggggtgagccgaagaccgccctttcgcttccctctcctctccgctctctcgggcgccgctccgccgcgccggtggtcgccggcggtgaccatcggggcgcggtcgtgccgcctcccgtcggccgtgccggcgaggccgccttcgggcgcgccctcgcggctgccaagtgggcccggccgtcagccgcccgcgcccgcgggtgcggctgacgcgtgggacccacggcgccgaccgccgccagccgcgtgctcccgatccaccgtggaccgagaggctgacgcgtgggccccactcccgtggacccggtccgcgcgccctctccctcggctgacgcaataaatgagatttttaattaaaatttaaatgaagaaattcgtaaatatccatttaaagagcatataaacttcaaatggccatatttggccatttgaactcggaattggaccgttcaagtctctaatttttccttaagaagtcaagaacccatttttgtgctttgtttctgctgttatttggagtttattagagtaaaagccttttcttttccgttggtcgtgtagacgctgcagcttcggaagatccgctcttcgtggaagttgaagccggcgtttgggaaagcgagcaaggcaagtcacatcatccttgatcatattgaatcccagtttgtaaaattatgttgatttaaattattgcattaccgctttatttaaattcccgcgttatcactgttttatctagccatacctatttacctttgttatgaccttattattattgttattgttattattactttgttcaccctaggttaaacaaaaccccaactagtgagtactctattcatggttccactagtataaatttaggtagatgcttcgctgattaattaggcaacattaggtggttttataactttagactttgggaattctcatatcatttggacactatggaatggttggcttatgttggaattggacacacacctccccctcttttcaaaacccccaaaatggtttaggctgggctcgaggtgcgtggttgggttttgttagtcgtacctcgggtactataaggattaa

SEQ ID NO: 15241 - DNA, 1501 bp, Oryza sativa
atttaggtgttaatgaatctagacatatatatgcgtttagattcattaacatctatatgtatgtgggcaatgctaaaaagtcttacattgtgaaacggagggagtaagtatttttagttatgaatctggataactgtgtgtccatcatagctaaaaattgctatattttaggacagaggtaggtggacagaagcaaagacttaaatttgatagcagcagcagccaggttagttgagtcaaaccaacaaactaatcagctactgttctaaaagactagaagaacaaaagagaattatctcaacatactcccaaaccaaaatcgttggacaatcctagtgtacggctctgcaaaaaaaaaaaatacaaagcaggtggctgcgagagaagaggccggtttcaaggaatttgacctggactcccctcgttctggactcggaatagccattagccaatagcagccgggtttggattagatattttaggtggataagggtttcatggcacctcactctgacgtgagaaaacactgccttttgcattgtcatgctatcaacatcctactaacaaatagtaagagaataaaaatttaagataggagagcgtgcatggcattgttattagtattatttaaagtagatgcagtgtttgagctctcgattttcagttttagatttctgttgtcttttgtaacttacgtcccttttggtcttttgggtcttatgcagtggcggaggcaagattttcatgaagccggggtaattctaattaaaactgttacccacatattacggttaaaaaaagtaaaactattttattgaaaacaatggactattagggcctgtttggtatagctctaactcctaaatttagctccaagagttgggtctggagtggagttgtggagctgcctaaacccagctccacaactctagttcattttgtgagagagctccacccagctccactcccagttttggtggagctgaaactgtttggctgagctccagctccaggaggggtagagctggagctggagctgtgccaaacagacccttagtaggcgcgatctcctgcatgcattgatgcttaggtgttttaattcacataactaattattgtggcctcaagtacatgcacaaacagactcaaccaaacgggcatgcatggaacaggaaaaatcaggcaccatcttgttatttgcgttctaaagtatgaaatccatatactctatgaagtgcctatattacactttatcagggttacagataagacataccctatatcctacgacttatgaaatataccgataaggtataccttcacgtatacggcttatttccgtatacgctgttggaaatttatctcaagttatgaaaaatatctctatgagttaatgaatagccggaatcctactcggaggggataaaatcttgggataaaatctttggttataccgtgccagtttacatatctctaagtctttcttggggtcaaggtattc

SEQ ID NO: 15242 - DNA, 1501 bp, Oryza sativa
aaatccaatgcccatagttagagaaaacaaactccaattatttcgtgaattttttaaatgtgctgaaataatgcgagcaagctaaatgatctttcgtgtatttgctctaaactatgttaccatcaaattaacattagatggttcttaatgcaaatttagtatatcatagatatatatacatatatatatatatatacatatatatacatatatatatatatacatatatacatatatatatatatacatatatacatatatatatatatacatatacatatacatatatacatatatatatacatatacatatatacatatatacatatatatatacatatacatatatacatatatacatatacacatatacatatacatatatacatatatacatatacatatatacatatatacatatatacatatacatatatacatatatacatatacacatatatacatatatatatatatacatatatatatatacacatatatacatatatatatatacatatatatacatatatatatatatatatatacatatatgtatacatatatgtatatatgtatatgtacatgtatgtatgcatatatgtatgtacatatgtacatgtatgtatgcatatatgtatgtacatatgtacatgtatgtatgcatatatgtatgtatatgtacatgtatgtatgcatatatgtatatatatgtatgtatgtatgtatgtatatgtatatgtatgtatgtatgtatgtatgtatgtatatgtatatgtatgtatgtatgtatgtatgtatgtatatgtatatgtatgtatgtatgtatgtatgtatatgtatgtatgtatgtatgtatatgtatatatatgtatgtatgtatgtatgtatgtatatgtatgtatatgtatgtatgtatgtatgtatatgtatatatatatatatatgtatatgtatatatatatatatatatatatgtatatgtatatatatatatatatatatattcaagcgtgtggttgtggctttctacaccttcccggtaactctatttattttctttgtgcatagaccagtcaaaaggtgaatcaactatatgagcattaatcgtctatgaatatacacttgaagcattaactttggagtccatttagattttaggctataccaaaaacatggaaagtggactaactaagcttgacaaaaatgagatcaccactacgatgaatcacgatgaatcacaaggaaaccttcataggtgcaacgaccacatctcagttgtaggacacaatgactaggagctgtgagaaaaccgtatggtaggggaaaaggaacaatgagtttagctaggtcttacattttcaccaaccccccaaaactaatgaaaataaaaaccaccttgattttaatatgcacttaatttgttaaacatgttctaaacaaactaagtctactattttttatataatgataaagattatagatatttggttatactgat

SEQ ID NO: 15243 - DNA, 1501 bp, Oryza sativa
cctaattgccgagcaaaacctagtgagcttcctcccttgattctaccaattctcatcgtcggtgtgaataattcgtgctcatctgcgtagttttaggacaaaagaaggccatggcactacgttttgtgtgtaccttcaattgggaaggattttctgagttatttgggagtagagtattactgcttcttgagcttggtagctactgtaaaaattaacaacccttcaaaaaaaaggcttcttttttttcacttgaagctgactccctttgcaaagttgatgtcgcagtcctaattcaactcttctatttttgtttcttgattttggagactctgatgtgccatgagaattgttgaggttgttgcggggccatgacaattgtgtgcgtgtttttcctgtagcagattttcgcgtatttttttttcttatttgtctcctgcatgccgaaagttttggatttttttttacataatacgattttaatggaaaattgcaaaaatataggtcggttaggcgaaatcgcaagtttagtaccctgttgaacaaccacgattcgacaggagaacctatcgaacatctgcatatcgacgggtatttgtcgaactgtggcaatttaacaaggtagttggtcaagaaaaaaaaatttaaaaagtacgcagagacatatcaagcaagcaaagaacgataggaggacatatcgaacaggcagtgttcgacagggatgatgctacagtgatgctacaatgtttttttctctttttttaaattattttattacctgtcgaactgataggtgtcctatcgaactacggttgttcgatagggtgctcgatttcacctaatcgacatatattttttacgatttttcattaaaatcgtattatttccaaaaaaaaattcaaaagttttgcagacctggaaacaaacacaaaagaaggtttgtttggttatacaataatgttattatgcatggtacaattgtcatgaagaattaataaatatggtgggaaaacattaataagtatggtacaattgtaatattatattttgtttttttaaaataattttggatttgtgggatccaaacaacatcattgttatttagcaataatgaaatttattttgttggatcatactagtattgcagaaatctctaggcactcaaccattcactctgttttatttctggagttactaccaatctaaccatgttttcaaatgttaacacaacgttattgttcagaaaatactcctcttcaccaagctggagctgtagacagaatccgaaatcttctgaattttattcagataatgatgaaatcttctgaatatttgtccctgtcatgaacagcagtagaagttgcagcaatggaggagacctcatcagaggcagcagatcgctctctgcgtcagaaggcagcagcgatggttgcctcctccatggagacgtaccggagcaagcccatgtccttctggctgctgctcgtcctcagcgccggcgcga

SEQ ID NO: 15244 - DNA, 1501 bp, Oryza sativa
gcggtggcggtggtggcgttccggcggtcggcgatgtaggcctggacgtcgacgagaatccagtctgggtgaccgccatcgccatcgccatcgccgccgccgtggcagggcgggcgcagtgtgagatgcttggttttccacaagcggcggcccttcgccatggatgccatcatccgtcttgctcgatctccgcgagagagccagatcgatcgatctaacccacggaaggaagacgatggaaaggagggaaaactgcggcccttcagcccacaggctagaaaattaccggcccaccttagcccacagccaacaatatctctttcgaaattcaaacgattttttttggacttactgtaattcgttgtcttacttttttttttaataaaaataataataaaatttattccgatctttgcttaaataaagtaacatctaattattgcatatgttataggacgaataaataatttaattaaaggcataaaaactacttaatataccacctcaaagacttatatttctatctattgttagctaagctatatgcataacccttctttctaacaacggattaaaaagttgaatctccaaaaacgattctcggaagatcagagcgattgtgatcgaagaaagcctaataatggaatttcatgataattgtctcctgtgaagtgtggcaatcggcagccatcaagaacagcccagctagagtaacccgagatcgagaaaaacaaaacgagatggaactgaaatgtgaaatcgtacgatatatgtcacgtcctgataaattcatcccaaaataaaaattattttctaaaaggaataatagaattaattaaaattcgaaaagaaattggcaaacactaaaatgcgtacaagaaaaattcgaatgtggcccggggaatttttgttaaattctccttggtctaaaaggagcccttaaattttacttgaattttcagagcaccggaaataattattaagcaacaaaaacaattattagagtttattaaaaagaaaaacctaaaaataatctctctccccccctttgggccaagtctggcccaaagtcctccttctctcccctcggcccgcggccgaagtctccctctcctccctctccttctctccctcctcctcttgggcccctcttcccctcccggcccactccctcctcctccctctttctcccaggccgcctccccctcctctcctcctgggccggccgcccggcccaagccgcgcccaagccaggccgagccgagccggccgtgcacacgcgcgccgcgcgtgcgctgaccgcgcgtccggccgcgtggggcccgcgcgtcaggcgggtcatcgtcctcctcccgcccggccgtcctctctccctctcccgtgaaccctagcgccattcctccctcaaatccgcgcgattcaagcatgggattcccaaattgattagggggaattaaacccctttccctcctctctctttcccccttaattcccccttgaa

SEQ ID NO: 15245 - DNA, 1501 bp, Oryza sativa
gcggccgacgcggaggaaagggaagggcgacggcgggaacgcagctccgggggtctccgcgggaaacggagggcaagccgggcaaggggaggcagctgctatgctggaggaggcgacggcacgaccggaagacgctccggcgaggagggagaggcggctggaggcggccggcggcacgggagagagaggaggacggcggggagagggctagggaccacgggagatcgcgggagggggctaaaacgatagaacggagcgagggggttgcattttatagcggagggaagcgagccgagcacgggagagggcggaacggcgacgggaatggcggccggcggcaaaggaaggcggccggacttggcgcgtccgttcccggcgattgggggcgccattcaagggggaattaagggggaaagagagaggagggaaaggggtttaattccccctaatcaatttgggaatcccatgcttgaatcgcgcggatttgagggaggaatggcgctagggttcacgggagagggagagaggacggccgggcgggaggaggacgatgacccgcctgacgcgcgggccccacgcggccggacgcgcggtcagcgcacgcgcggcgcgcgtgtgcacggccggctcggctcggcctggcttgggcgcggcttgggccgggcggccggcccaggaggagaggagggggaggcggcctgggagaaagagggaggaggagggagtgggccgggaggggaagaggggcccaagaggaggagggagagaaggagagggaggagagggagacttcggccgcgggccgaggggagagaaggaggactttgggccagacttggcccaaagggggggagagagattatttttaggtttttctttttaataaactctaataattgtttttgttgcttaataattatttccggtgctctgaaaattcaagtaaaatttaagggctccttttagaccaaggagaatttaacaaaaattccccgggccacattcgaatttttcttgtacgcattttagtgtttgccaatttcttttcgaattttaattaattctattattccttttagaaaataatttttattttgggatgaatttatcaggacgtgacatatatcgtacgatttcacatttcagttccatctcgttttgtttttctcgatctcgggttactctagctgggctgttcttgatggctgccgattgccacacttcacaggagacaattatcatgaaattccattattaggctttcttcgatcacaatcgctctgatcttccgagaatcgtttttggagattcaactttttaatccgttgttagaaagaagggttatgcatatagcttagctaacaatagatagaaatataagtctttgaggtggtatattaagtagtttttatgcctttaattaaattatttattcgtcctataacatatgcaataattagatgttactttatttaagcaaagatcggaataaattttatta

SEQ ID NO: 15246 - DNA, 1501 bp, Oryza sativa
ctgtttgactggattgttccggggttattggatgggtagagtctgttgcgggcttaaggcacagaggttgctcgccatggagttggggccagccatggaagtgctgctctgtgttgttttggggtgggtgtagcagagtttggagggagttccgacgggcatggggctccgcgaaaattgggttttcttcatttggtaaattttaactttgtttggttacggttcgaatgtcagttgctacgttgggtggggggagcaggcagagagtatgtgtgggctcctgcgttgtgttcgattaggatcaatttttggaaggaaaggcagagaggaaagggggatcaggttgatgtctcgtaaagttagtggaaatgcgaatatttcttttgtaggccattgcatttttatctttagctttcgggcacttgcgatactcctcgttgatgattcgagttgggacccagcgataacacgttgatttgggtggctgttgatgttgtgtgcagagtagttgcttttacctcaaatctgaactttttagtcaactggtatatatgctacaataatgcctttggggattcttgatcatatccatatcatcccaaccttctgaaggtgctgatctattaccattgcgattgaaatttgcttgctgttttttttttttaaaaaactttacaacaacaaaaggaaccttcagtttatctccttatcttcttgtgcccccctttagattggcatttgattcatttcatgattctcatatatgtaagaactaatacaacttgaacttttttcctggaagttagcaagtacagtagtcatatcaattgctgctttaagatggtccatgtaatgtgttttacagcagtcagtaaaaaccagtcatacatctctactattataaaaattgaagatgtttttgccggtactttggtacatcatccgtgtatgagtcggtttttaagttcgttcgcttttgtaaatacagaaggagccgtatagatatctctttaaaaaactcgcatgctaacttgatacgatcagactcctaattgcagctcatgattaaaatagttttcacccgttgcaacgcacagacattttttctagttaaggaataaaactcaaatccatctgacatagcttgaagccttgttataagcactacaaaagcaactgttatgctgccagtcatgacgtaccaactatcttcttatataacttcagttgatgtttctgaataaaaagtctgtcggtttgacttattacactcgttgtaagctaagcaacttcattttcaagcctctaaaatagtgtgcaggaccgtaggcattttttatttttcaaaacttttaacttttggcaaaatggcattttattattgttttgtttattcaaagttgggattgagattgctagttacatactgaaatcaacatgtattccttttttgtgtaggtgatacctttagtctggcaaacataaaatatggttaagataa

SEQ ID NO: 15247 - DNA, 1501 bp, Oryza sativa
catgacggcggcgcggggcttcgggtgggggcgctcggcatggggctcggggcgggacgcgacgggcggcggcgtgcggcgcgcggacgagcgacgacggcgacggacgagcgacgcgacggcgacggacgagcggcgacgggacgggcgacgcgacgggcgacggcgcgcggcgcgtggtgcggcagacggcagcggcgcggggcgcaaggcgcaacggcgacggacgagcggcgacgggacgggcgacgtgacgggcgacgcgacgggcgggcagcggcggcgcgcggcgcgaggtgcgggcgcgggcgcagcagtggtgcgcggcgcgaggcggcgtcagcgcggcagcggcggcgcggggctcgagatgacacgacggcagcagcggcgacacgacggctacgcggcgcggcgatggcgacggcaatggcgcgcggcgggacgaggcgcgaggcgcgacggcgacggccgagcggcgcgcggcgcggcaggcgacagcggcacggcggcaggcggcgacggcgacggctcggggcgcgaggcgcgcatggcaggggaggggaaggggctagggaacctcgtcgaacacctagaggctaatgaatagtgtctttttcctatttttcccaattttagtttatttcctatatgaatttgattctataatttctaaatcttgcataaatgaagtttactcaatatgtgtattatctcaactaatgaattcaccctagattagattaatattactcatattttatttttatataatttatttgagctttaattagggttaattcttattccatcgcaatgaaatttaattgatccaaatatggtcgcgataatattttatttattactatccacacctaatctttatttttaatttatatttattttaccaatttgtttttagggtttatttctaattaactattctttactcacgattaataatcctcgagatcaactccagataaaatagacgaatgagatcggcatgatgcaattagtttaaaaagtttttgaaaatccgtactcaaataagatatgagatattcttagcatagcctgactcccaaaatgtaaaaaatcatatcttttggaatgtccattgaattcatcatgccagacaagatggcaacaaagtatcaaaacatctcagatgctcttattatcaattttattaacaattttatacatacacacttccatatggttggatcactatttgagaacataatcctgatgggcttttcattagcaataaaattttttaaaactttcagtaaacgggttacaatcaaatcactaaaaaaatataactagccacatcaatcttaaaatatagtgaagcaaaaaaaaaggagtgtatgtaaaacaaaggaaggtgtacaatatgtataaaagagaatttcccttccattcaaattaatataacgtattaaatttacgtaaaacacagtactcactatttaccaaaattaacatgcac

SEQ ID NO: 15248 - DNA, 1501 bp, Oryza sativa
tgaattactctctctgtaaaaaaaagttgtatcctagtattatgacaaatgtttaatttattgagacgaagagagtagctgcgaaacggaaggagtaataatcaaacaactgtatcgctgaccgcctctcatctataacgtcacttatttgtgatcggaggaggtactatatgttatactatcatatatcaattcgatccacacatcgagagagaaaagggatggcctgtaaaagtagtgcatgtatatctcgcgcaaaccgagcgattgtgcacaagatatatgtcaatcattgtcgaccacaacagcatggaggtacaatggatataactgatagatgggcacatatacacacatataccgatcgacatagcttgttccttctcgagcacaaacaggatatgcaagtagcaaatgcagggcacaacaggatatgattctagggtaagatagatatatagatatagctctagatcgatcatacaatatatatgacatcgatatatccatccatgcaaaattgcaatgcaaatgcaaacaagatatacatacacactttgggattgggtcatatcgatcaatcaactttggcttggctaggctatagctgcatgctccttcatccatgcatgctagctgccggcctgtgtactgtatatagggtgactagatgaatcactgaaaggtcaccggtagctgcatgcacgtatatactcccaccataatgtatgacgccgttgacttttcgatcaacgtttgaccattcgtttcatttaaaatttttgtgcaaatatgaaaatatttatatcatgctcaaagaacatttgatgacgaatcaagtcataataaaataaataataattacataatttttttaaataagacgaatggtcaaacgttgatcaaaaagtcaacggcgttatacattaaaatatggaggtagtatatgacactattagctatagcacaccaacatatattgtgcaatgcaaaaacatgcttgaatcgtcatgcatatatatgcagcatgacaagcctagcctaagatagcttggcccaatttgaatcgcacatacatgtcctagtaagctctactcactaccagatttcggagctactccctccgtccgcaataagtttatttttggcttatttcatttgtcagaaaataagtatttttaaaataaccattacatatcatagtttataaaagtaatgaataattgtatcgggagtagataaaatgaggaataattgcattaggatttgataaagtaggggtattctattttttttatattggtatgtgtgagataggtaaaaaatattttttttgaatggaggtagtattaattttgacggttttcggccacacatgattggttcgaagcctagtacggagtagcaactttatataagtgatgcagggtacgtagtatagtcctgtttgatccggtactacatataacgaaaacagtttcatttcttttattttgactca

SEQ ID NO: 15249 - DNA, 1501 bp, Oryza sativa
gattgctatccgttcggggcaaagcgcggtttggcgtaataatgcaccgaattgtgttatgcaatgtctgcagcatgactgtaatcctgttacgtaatcaataaagctctctattcccgcaaaaaaaaaagtagtaacaaataattggggttaatgatgagcagagcgatccatggttggatcgatcgagctacctaagctatcatctgcattacggcagctagcccgatcgatcgatctatctagttgggggcagatgatgacaagagatgctagccagctgcagactgctgctgctaatctcgtctcttctgatatcgatcacccacagaaaaggggagaaaaaactcagatcgggacagacagcccaaggaaaacaaaagacgaacacgcagagtactctggtgataatcagccacttgatcattaatttcttcgtgaccgttggcgtagccctgcctcaaatcaaatcgatatatatatattcttcgatctatctactctctctaggcttctcgaatctcgaaggacgatgatttgtactccctccatcccaatataaatgtaaagcagatataaccagcttatacaaaccaaaactacctgttcggattcgcactattagagtgcgttaagttgttgaatgtcagtgttacaatgagcaaagcaatagtccagtattacactttgttgtaatatgacgaattgagagccaatttggattgctaccctaccaaaatttactctaccaaaacactggtagggtagcaaactaaacacctatattaaaacattacctttgtcataaatttggctttgcccataaacttataccttatgggtatattttggcttcaatcaaaatcaacattttcaactctaccctaccaaagttttggcggcatgtctaagatttagcactatcaaaattttgatagggtatcaatccaaacatgcccttgtactatataattagctttggccggtcggccgacagaataattaaccttggcggtttttagattatacttggtggttttcgaccgccaaggacatgccgttttcttgtagcgtattgactctcagaatatatctaacaaaactgccgttcgtgcacatgtatttaattacgttgtaaattgacaatccattctctcttctctctaatcgtaaactaaaaacatgtgtgttaattagactatgattttaaaaaacaactcaatacttagaaaattattttcacagctccctttatttttacaaatgggctaaaagaagattcacttgtgaaaatatataggactctcacagtcaacaccgggccggcgctgtattttagacgaccaagacgcaccaacacatacgttatattaaaataaaggagcacgaacaccaacaacaccttgcttctcacattttccttaaactctccacacttccctctcctcttcgttttttctttccacagcacagaggacactgccttggctcctccttcccc

SEQ ID NO: 15250 - DNA, 1501 bp, Oryza sativa
gaatattttgagcctaattacgtcataatttgactatgtggtgctacagtaaatatttgctaatgatagattaattaggcttaatagattcgtctcacagtttacagacggaatctgtaatttattttattattagtctacatttaatacttcaaatgtgtgtccgtatacttaaatttttttttgacacacggactaaacacagccctggatctgatttccgagagttcatcatctgcatttgccaacctgttttggcttcttcacgtgaatcgtgccggcgtgccaacctgtttctactgctctcattgatccagctctagaaaaataatttcccaaacatataatcaacggcaagaaaataatcactcgtgttttgaagcagttgtggatcaggaaaaaataatagagagggtaaactggacaaagctaagacccttgcgcgccatcccatggtaggttcgcccctattttgaagcacgggactctatccaatttcactgtaaatcaaaacatcttctaccaaggcatcctaaaaacacaaataatttatacgcattcatatgaaatctaaactaccaaccatacagaaatcgtggagccttgcgttcaaaaatggctaaaaagaaaatcaccgtgttatggcatggtgaaacgaagaataaactttttttaaagtaaatttcacaaaactacaaatactttaattaaattatcacagaactacagatttaccaataaatttaatataaaactataggtttaaggctaagtatcataaaactacaaatttaataaaaaaaattatcataaaattatagattttgcggtttaaatccttagcactaatgttatgttggacttataagtgttcaagttttgtgattaaattatcattaaatatgtagtttgtgatacttttgttactaaatctatatttttatgatattccaccttaattaatctgtagttttatggtaaatttagtattaaatatatagttttatgatacatcacattaagagtaacgatagttttgcgaaatttactaaactttttttctgtgagatagaaggaagcacaacgattgggccacgtggaggcaggagaggaggggcccatgtcgaggtagcagcaaaggtggcccagaagagccaaaccgaacggtctaaactcaaaaggcgtcgtctccctccatcctccacctacgcttaattctaaatttctaattccccacagaattagggcacaaaaatcaaatcaaatcaaaccaagagcagaggcgacgcgaggagagagaaggcgagctcgtctcgtctcgtctcgcgccattaatgcgagggggagtcggtggatggatggatccagccagcctcaattgccactgcggccatggccagcttcacagtacaacctccataaatcccccaccacctccgctcctccgctgcaaccaccaccaccaccacctgctgctgcggggaggaggaggaggcggaga

SEQ ID NO: 15251 - DNA, 1501 bp, Oryza sativa
gttgctattttttttcttgacagaaaagttcactccaaattggagtatatgtatgtaagataagaaaaaacaatgtcatcaggtattcaggtttaacccttttaatcctcctcacactgaattggaaagaacaagaaatgatgtagtataccacattatcacgtcaaaaatcactttggaccacacctcacacgtaggcactaagttaacatacacaatcttttaccatatgctttgtgagacaaaacacaacatgatcagcaggcttaacccttttaatccattcatccatgttgagttgaaaagaaataacaaatgatgtgtgttgtatgaagtatataaaccacattttcacataaaaaattaatcacttttgagtcacacctcacatgttgctacgtatacgcaaatcatcctccaaattaagcttggagtttgaatcaaactgtttgatgaggaggagggtaatacatcgatcgtgtaggcaagctgacgctctgcgttggagtatatacgtacgtagaattcgaaaggattcttcagcctttcttggcgaagagggcgccgaggttgaagccgccgccgccgccttcctcgtcggcggcgctcgccgcgggcttcttggcgggggccttccgggagacagtggagccggagggcggcgcgccgtcgaccttgttgagcagcgggtcggtctcgacgagctggtccttcttgaagatgaagccgaagatgaagtcggcgaggctcttctcctcctccgccggcgccggcttccccctcgtggcgccgaccgccatcgccacccgcgacggccgcctccgcccagccgacgacgacgacgccgacggcgccacgcccgccgccgccactctgctcccgaatcccaccgaagccatgattcttagctcagctctagctctctctcacgcgacgatgatgagaatgagatgggtgatgcgtcgtctcgatcgatcggcggtgagagggatcgcgaggtatatgaggtggtgattgggcggcgtgtggtggaggagagcgggtgtgtgaggcggccacaagcggcttatccacaccacgcgtacgcctccattgccaccaactccacgcgccccgttgctcgcctcgccaagttggcatcggcgcgcgcctcgcgtcgcgcgagaggccagccgttgcgcgccgcgcgcgtcctgtgaaatgggtgggagtgggcgtggcacggcaagagcggctgaaatgcacggcgagacgtggccacgagttgggttgggccacatctagtcggaggggccgggtgttttgggtcccctgacgggatggtaggaaatataaagtatactttgactctctcaactatgatcccagtatgattgtttcccatctaagcgcaaaaatgggtgagacgtgagtccacgtgctaactcagctgagtggatcaagtcaacgagccatatcggatgaaaccgcccccaaaactccttttgcactgagaaccgag

SEQ ID NO: 15252 - DNA, 1501 bp, Oryza sativa
ttctctgatggctggctggaactcaccagttcttggtgatgagaagaaaggtacatgcaacaaattaacaatatgatcgatcgacgataacgaactgaatgggaagattatttccttagttatatatacccacacaaataattcaatatgtattgatcggtcaatcgatctgtaattaattaatttgatctgtttttgttgagtatagttcggctgatgaggaaccgctcgctgaccagggaggaggtggacgcgttctggaggcgccagcaacggaagcagccaccgtcgtcgtcgacgtcgtcggagcccaacgccaccacctcgccgctcgcctctccccgcgccgccgccaacgtcgtctcgccgctcgcatcaccccgcgccgccggcgacatctcgccgctcgccgcctctcccggccgcgcggtatgtaattaaactaattaaacatgcatcgatatattcttggactgaattaatcaattaatataattaattctctcatgcagcagcaggagatgagtagtagtcgttgcacgttggcgttgaggaggctggagaggatgaactccatgccgtcaccgctggcgcgcaccgtcatgacgagggccgacgatcacccgtaccagtcgtactcccacagcgagccgccgtcgccggcggctcctcacgccggcgaccatcgtcatcagcggtcgtcgttcgctgccgatcatgacgacgacgacgacgacgtcgccagcaccagcagcgagtgctggtacgtatacttaaatttatttaattaacagctgatgtttcaccggccaataattaattgattatacgatgttaatttggtataggtggacacggagcagctgggcattcctgaacgagacgccgtcgccggagcagcagatgttcggcaagtcgcagacgtacgcctgcgttcagttccacgtctcccgggtcgtcaccggcaacgcctaggcctcagctagttatagctagccacatgtcagggaatgcatatgcatgtacgtatgtacgtacgtatatacgttagtacttaggctggttagctagctagcttagctttgcagctctgcatcgtcctgatcctctaagagagtagtgtgttctgtagtagtggttaagtacgcatgcaatttgtatgtgtagaatattactatacaaagagcagtagagaagtgtataggatcgggccggcgttcgagagcttttaatccttcagctctccgtgtaaatacagatactgctcatgtatatactctctctagtctctcctatatagatagttaattgtgttaagactgtactttgtgtgtgtgtgtgtgagtagttctgtgacttcttaatgtatgatatatatatatatatatgtaaaaaactaaaaatcatttgcactgtttcaactgtgttacactgttcattctttttttttcctcttctcccaactagggatgaaaacggtcggaaaaaccatataccattt

SEQ ID NO: 15253 - DNA, 1138 bp, Oryza sativa
cccccccccagcccccacgttgtctctgccgctgcttgttgacttgatccactcggctgagtcagcatgtgggcttacgtctcacccgttttgtgtttagagggcaagaatcatactcagatcatagtcgagagagcaaattaatgtctctcaatcacaaaaccgaatatttcacgatcccaactaatgaaaccggtgcaaaaggagtttttttttgagagctctccactttgagaacaagctgtagtaactgaacatacgtgcaaacgcactccaccacgcacacacactccacacacgcacccctacacgcatgctagacctatcaactatacacacatgtgctaatgagatacacaaagctacctaaggaccttgtgcgtgacgaggacgtcactctattattgtggcgttggcacgggagagctggaaatttatttgggaataaatcccggtgagacgcgcgggtatgatcccagggatcgaacccgcacgggctgctcgctcaccagcaatgctagccaaccgagcaacgctcggttctcagtgcaaaaggagttttgggggcggtttcatccgatatggctcgttgacttgatccactcagctgagttagcacgtggactcacgtctcacccatttttgcgcttagatgggaaacaatcatactgggatcatagttgagagagtcaaagtatactttatatttcctaccatcccgtcaggggacccaaaacacccggcccctccgactagatgtggcccaacccaactcgtggccacgtctcgccgtgcatttcagccgctcttgccgtgccacgcccactcccacccatttcacaggacgcgcgcggcgcgcaacggctggcctctcgcgcgacgcgaggcgcgcgccgatgccaacttggcgaggcgagcaacggggcgcgtggagttggtggcaatggaggcgtacgcgtggtgtggataagccgcttgtggccgcctcacacacccgctctcctccaccacacgccgcccaatcaccacctcatatacctcgcgatccctctcaccgccgatcgatcgagacgacgcatcacccatctcattctcatcatcgtcgcgtgagagagagctagagctgagctaagaatca

SEQ ID NO: 15254 - DNA, 1501 bp, Oryza sativa
gtgcgcagcagcatctcggactggtcggagagagcgcgtacagcggcagcggcgaggagggtgttgtaggtggtgaggtcgggacgaacggagggggaagggtcatggcgcatttcagcgaagaggccgagcagcatgtcgaacgggaccggcggatcggtggcgcgagcgcaggcggcgagcacggtgttgtacgtggcggcggtgggcgcgacgccggaggccttcatctggtcgagcagctcgcgggcctcctcgtgcagcgcgttgcgcgcgtaggcggcgatgagggaggtgtaggagagcgcggtgcgcgactcggaggggaggtcatggaatacctcgaggcacttgtcgagcagggcggggccctggcgcccgagcacgccgatgacgatggcgtggatgtgctcgtcggggcggcaccacgactggcgctgcatgtacttgaacagccggagcgaccgctgccagtcgccgcggcgggagaactcgcggtacaccgcggcgaagtcctgcagcgtgagccggtggcgcgccgtctcgaggcaccgcgcgatggacccccgcggcggcaggttgctcagccggtcgatcagcgactccacctcgtaagagtgccccccattctccaccaccaccgccgccgccgccgcctccctcggcgccctcgcggccaccaccgcgacccgccccccgcccccgccgcgtctcctcgccctgcaacaccacctcctcgcgggcgggaacagcaggtcgcagtagtggtaggacggcgacgcgactgtggcggtggtggagacgagcgccatgggagcatccaccatccgccgccgccgacgacgacgaggaggaggaagaggaggggtttaggattccactcccttcgcgtagtagattttggggagagatttttcgtcgcgggagtggatagagtcggactccgagaggcgcgggtgcgacgcgagcgagtcggactcgagttggctaagcctgaccagcttggcccttccacttctctctctatctctctctcttctctttttccccaataggcaactgcacgcgccgccgcagcctctctctctctctccgccgctccggctttctcctcctcttgctgctccgattgctccatggcgggcggcgacagcgcggcggtgtcggcggtggaggggaggctgtcggagctctccaccaacagcgacgagaaggggctccccaggaggggcaaggtgagctctccttttcagtccctcccctcccccgtgtcagttctcctctttgggatcgggcgatgagtgtaagcgacattgaatctccatatgagcaatctcccttggcgaagcttagcttggatttggttttggaatctgaatccttggccaatcttctgtaggcagttaatcataatttgtaacgatcgaatttggattcttgtgaaagatgggatgggaaaaagaacaagatcgctgaaatacggcactgccgcctttagatt

SEQ ID NO: 15255 - DNA, 1501 bp, Oryza sativa
ttgaaaggaatagttgtatgtttttatcaaaaagaaatgctaactgagtagtaagtaggctcaaagcataggcacactgaattagctgaatggttttaccaaaggccaacaaattaagatttcagtgaatattgctagttgtctgtcagctggttagcgcttgccagttgccaatgaagtgtttcgacacgcgacgaacatgaggaaaaaaaaaagagagagtaacacacagtgttaaaaagaaaagaatatccagattccagaggggttcggagttttaatctccgaaccccctcgatcatgcatctgtaaacgttatcctccggtattttcttttaagttgtccagtttaattgctgtacgtttgacatttctgcatcatccatctatccatcacaaatgatgtccatcggtccagctcatccatcaagacaagtcagataacacaatactaatctcagaagctatgactctcaatttgactgccaacagtaatggttgatatatacggtcataatcgaaactagtgtaatagttcatttattcaaggtgatctaattaaacaaaaaggaacaaacactagaaagaaaacgatagtagcagtagaataagaatgcaccattaaaaaggagaaacagaggggtcggtgtagtagttttagcctacgtaatcctacttcgttggttcaagctgatcgaagcaaataaattaacttaacttattaaggtccatccatgcagtagcatacagcgtcgcatgattattattattacgtgtggctgcaaaacggatataaataaacaagcaatcaaactaatttaatcaatcgatggattgcattgctatcatggatatgatgcatcaggctggcaggcgatccatccatcagagaattctggtggtggtggcaacgccgacggcggcggaggcggcggagtcccggcggcagtcgttgagcatgtcgaggtagggctggcatctgctgacgtggatcccttgctgggcgacgcattcctggaacgccttcttgtgggcgccgcacgcatccaacattggatgagccgcagcggcggccgccggcgccggagaagacgaagtggacgtggcgtcgacgacgttgacggtgcgagggccgaagacggcgtccatccccctctgcaccatcccgtaacccgtgccccatccccaccctgcattttcacttcatgattatgccgtccagtttgagagcggctcgattatttacttattaacatgaaaaattaatattatggaaaataaatttcgcaattaagtggtaggtgtacgaccaatacaataggtacaaaagtattttgataaatcatgcatatttctcagaagcacgaagcaaataatccagtgacaaaaatctgattaaaaaaactaaggtcaaatatctatactccatttagtatagtattttttttatttatcacctactcaatcatattttccattaactacctaataatgtacttta

SEQ ID NO: 15256 - DNA, 1501 bp, Oryza sativa
gaaagaaaatcttatttgatagtgtagatgagtaagatgaccgcaggaggtcaccactgctgcactgcatgcaacggcccaagctaggacggtaacgaggagtagtagctaatggtaatacgtactgtataccccttgtgatgattaatccaacaaaacattggattctactagcagtaacgaagaatttaatactcctgacgatgcgtggtgcatctagtacggctctcactgcacctgcgtttgtcttgttgttgcaaaatttaacgttgggctcagatgagtttcaggacagatcgatcttgtttgaacttattttattttaaaaagggtgtatgtggatcgaatcgaattggagttggtatgggcgtgtctgtggttttgaaacattcatcaaatgatcaacaagttattgtttgttcttcagctactgtttcaagtttacacgtactagtagtattgaagtagcaactcaacgggattgtgttggtggtggtgggccatcgtcattccattatcaacggctactccagttgctaacattatttttgtcattttgtattttgttgtctctgtcttgctgttccctcgatcttgcacacaccaaagttaagttaatgcatgcaaggagtactatacttacatggtgctcatcttgttagtacaggcaggttactatgctagtgatgctcatgtagtaattatcttcaatggcaatgcagcagtatttgcagtcagctagctgtctgtattttttgacaatccggcctttcctcctgatcctcatcgtataccatcgcacaaccaacaagcttacgtaccgtagctcacatatttacatctccaacgttacgtacctacctggcttgtagtatctgtatctacgtatttaagtctgtctttacatacctacatacgtgtatttgtatgtatatacaggcggtacaatttgtctgtactgtacatacaggaggagtgctgaagaaagaaaaagaaaggaaagcaaaattcagtgtagcttgcgcgtgcgaccagtgtcgtgtttggcggcttttggagtagaaaattgctacggctaccaccacacatccttactcgccgacatgtgggcccgggagtcaggctggagtcccacatgtcagatgacagcagctcagactagtcctcggctcgctcgctacctttcaaaatccaaccagcaaaagcctccctcaccctcactctcactcccactacactctagagagagagagagagagagagagagagagaccaagccaaggccaccatggacagcacaagcaacaagatgaagaagatggagccgacgagcggcggccgccacgggactccggggcaggtggtgggcctgtgcgctgccctcgtcaccgccatggctgcctcactgctctgctccacctccatggccctcaccccggacggtaccctctctctctctgcgctgcactacgcatccatggatggatggatggatggatga

SEQ ID NO: 15257 - DNA, 1501 bp, Oryza sativa
ctcagcgcctcctctaccggtgagtcgcgccgccttggatcccccctgtccccgcctgcttggagccgtgtgcccgcgctgccggctcgccgcctcgtcgtcgttgcaccggctgccgcggtgccacccgccgcgcccacgcgtcggtgcctgcgatacaagcgctgagaccggagagcgagattgggagctaactagaggaggcggaaaccctagaggaggaggagaacggaaacccaggaggaggagaggatgggaataaggagaagggcttacccttctcgccggaggaggagtcccggcggtggcgcgtctcgccggagaaggaggcgcggcggcgcccgctgttgttcgcgcgagagagaagcgactccggttgcgcgagcgagaagcagtggcggatcgagagagcaaaaattcccaacctccgaaggtcggggacctttccctagggtttccccgtggattgggccgggaaatccctgcctcgtgggcttccaaatggacatggaataaaacccgtgacaatttcccctgcaggcctttctcccagggaatgggctgggatcccggtgggatcccgggctgccaaaggagcccttatatgattcccacgccccatttaaacggtcattgcttaattttcttgtaagttttcaatctaatggatttgaagcgatatgacactttaatcctgtaccttttcagaaatcagaacctgtagtgttccaaagagccctagatcggtggaggctggagggagagaaacatcaatgaagtgttcattatagtattgcacaacatgatattttttttaatgaaagaatcgagtggcatatgtttttacacgtttgtttgtagctttactagtactataaaatgtaccactagtatataggagtaccaagtcactgaaatggacagacgacagttgcgtcttgtccgtatacattgttacacacacccgttttgttcttcagctggtagttgttgcaaaatgtgcagtgcaaagtaaggtgtaagttaatctcaagaccctagcttggatgggtacagcgtgtgaaaacagacaaaataatggatgatccgaaacgaaacggacagacatgtcactagctctgtcgtcagtgaattaattatcacaaacacgaataatgtggtacaaaattaatcgtgacctcgatcgtgtgtgtagtactgtagccgaccgtcgatcgatcgacgatgaagatgatgacgaggatatcgtatatatggatctcctgcagcccaatctcaataatatgcagaagatgagagtacgatggatgcaatgtcaatctcatctcatcaatggtgtcgctattacagcacgtggttttaataataatccacggtacgtacggtgtctagctgctacttgcactgtgcccctcctctacttaaacgcgccatcgtctggatagctagctacgtactgagctcgagcttaattagctctagctagctgcagcaatggcca

SEQ ID NO: 15258 - DNA, 1501 bp, Oryza sativa
cgaatcatcgcatcacatctgtccacgatcgatcgtatatgtgtgtgtatgcgatctctcccacgtcagataattagctacctgttcctctcaaaaactgccaaaatttgagcctcaaaattcagagatccattacatttttggtggcctgctacagatagtgctccctgaatcatcagaattcagtcatcagttcctcgtctccgctccccacaagccaagttgtcgttggactcatttttttctcccattcttggataaatatatgatcgatagatgattttttttaagataatgatgatcgatagatgatgtagtagtatactcctatatctatccagctgagatcattcttgatcatatatctatctcaccatttaatatattttcatcgttcttccattattattaatcagatatatgtagacgacttataagacaatagtaattaatatctgccgcttaatcatatatagctagatgctggtgtgtgcgttgaagggctcaatccatgattgttgcttaaggatatatattattgaccctgcatatccgttccatctaactatagttaaattactccagcacacgctcgtccaacctatagctgttttgcaccaatggatgctagtaatataagaatattaatattactacctttgtgacattcttcaaaaaaaaaatgctgcacaggctagcactactggaattaagtctcaatacattatatattactccctccgtcccaaaataagtgtaattttgcactattcatgtctaacctttgaccgttcgtcttatttgaaatttttttataattagtatttttattattattagataataaaacatgaatagtactttatatgggactaattgttttcaattttttcataaatttttcaaataagacggacggtcaaacgttggacacggatacctacggctgtacttattttgggacagagatagtacatcttaattgaagtgggtttacagttatacaaacgttcattaattagtccaagcctggtacggagtagttagcatttctgcatttgcttgaccgtcattagacaagaaacagggttccacaaactagtgctatctggactgaaccttttgcccattggtcatgcaatgttgccgtgcatggaagcaaagcaatggtcaattacactggctaattagcacgctagcttaacacagttgttagtccctccattaattaacaatctagctacttatctcaaataaacaaccatgtactgatcagctcctatattgtaccgtaacaatccatgtcaaccagttgtcttatggaaaaaataaatagtaaataaaaataaaatataaaatcatgtttaaaattatttaatgataaaataaaatgcaacaaaaataaatgacatttacatagatttttttaataaaatgaatggccagatatcggataaaaaagtttattaaatatgtgatgcgaatatcgacatacaatata

SEQ ID NO: 15259 - DNA, 424 bp, Oryza sativa
gagctaagccaaccaaggttgagccaagcccgagctgagctcatgagcctaagctttttttttttccaccactagctaggagtggagcgaccggagcgagcgaggagacggagtttgtgatgggaaaggggttggagtttcaaactccgacagaccgacatcctttggtctccttcttttcagttaacgttctgaattttttttcttcgttcattattttgatcagacgcaaattaaacctgttcaaagccgtacgatctgttaaaacagaaaacctattttgcggtcattccagtcttccagatgaggctaagcaacgaactgccgaactgctaggagttcttattcggaaaaaaaaaaacgaactgcgaggagtgaggaatacaggaatgaactcaaatatcgattctgatttcaggaacca

SEQ ID NO: 15260 - DNA, 1501 bp, Oryza sativa
ggccgtacggcttggtcacatcaacctcacccccgcagaaatgccgaccgcagtccaagcacacccacatgtcactcttctccaccttcgccttggccgcggaacctttcgttccacctcctttcttcttctgctgctgcttaccccctttctccttgccaccccctttcttcctaggggcatcatcccggcaatgctcgcacgacgcgaaatgcttggacgtcatgatctccaagaggaccttgtccaagcgggcgctgtcgccgccgtagtgtccgcactgctccctgccgctggccgacgcggcagcagcagcagcagcagcagcttcctccgtcgaattccccgagtcctgcgccgccgccgccgccgcatccccagatccagcatcagagggcgccgctgccgtcggctcctgttgttgctgtgctttcctcggattcttggccttcgccttcaccctcttccccatcgcttccgatgccgagacgcaagaatctgaaatgtaatccatatcgtgagtatctcaagaaaccctagagaaacaaaacccaatcacgaactacacgagcaaatcttgtcaagcttaagggggaaaaaaaacccacgaccgcgcagaaactccgggcacgaaccgtgtacaaaccctacaccaacagaaatccccttccgaatcggagagatcaagactaagcaagaaaccaagccggacaaccagtgtcaagaacccaaacagaaaagaaagaaagaaagaaagaaaaaaaagaatggcgagctttaccggaagggtggaggccgaggctgggagttgggcgcccggtcggcaagagagcaggctcagctttggcggcggcggcgccgccgtgcaggaggacggcgcggcggtgaggcggccggggtggcagagggtggaggtcggggagagtgggggaggaaaaaaaataagtttttatttttattttattttatccggcagccgctgccaatgagatggggagatgaaggggagcacgagacgtaacagggcctggtcaatttgggctgggctgggttgggttgggccgtttgggctgttcgattcagtaacagggcctgattaatttgggttgggtaaatgggttggttggacagtttgggccgttcaatttcgtactacctccatcccaaaatataaatatttttagattagtacgatactaataaagtagatggaaatgtttgataaatgttgtgattgattgataaaagatagtatgtgaaaaaatgagatggagaatatttgttatcagtcgagaggaggggtaggtggagaaattgtttcgattcgaaacaaagtatgtgctagaaacaatttcgttttggaacgaggaagtaccatggtagcacgacattattacatgtgtatctcttacaccgtcttctttattcatggcttttgaactaaatatttttgggctaaaatcataaattgtttgatggcatttaaacatgagcttatttg

SEQ ID NO: 15261 - DNA, 1501 bp, Oryza sativa
aagcaagtagcaatggctaaactttaatctatcaaaacccgagaaacccttaaggggtacctagctatttaaggaggtgggaggacgaccaagagggtcctagggtcgtgctccaccagcttgggccgcaccccacatgggccccacctgggccggggtcccaaatgaagttacaagcccacaggcccattataggtgacgcagcaccttgttcctgtgattccggccacacgagatggaattcggagaagaagctggatccgttggaaagagggctccgagagctttccatcaagtactcacgggctgaaaacggaggtcgtatgcagattcggcggccgtttgaagtcagcagtgtagtaggtggccgaatcggattccagcactgggaggacttgatctcgatatcttcttgttcatccatgatgtgagtaatggttacatccgtggtagccatggtcacatcaacttcaaataagctcatgtttaaatgccatcaaacaatttatgattttagcccaaaaatatttagttcaaaagccatgaataaagaagacggtgtaagagatacacatgtaataatgtcgtgctaccatggtacttcctcgttccaaaacgaaattgtttctagcacatactttgtttcgaatcgaaacaatttctccacctacccctcctctcgactgataacaaatattctccatctcattttttcacatactatcttttatcaatcaatcacaacatttatcaaacatttccatctactttattagtatcgtactaatctaaaaatatttatattttgggatggaggtagtacgaaattgaacggcccaaactgtccaaccaacccatttacccaacccaaattaatcaggccctgttactgaatcgaacagcccaaacggcccaacccaacccagcccagcccaaattgaccaggccctgttacgtctcgtgctccccttcatctccccatctcattggcagcggctgccggataaaataaaataaaaataaaaacttattttttttcctcccccactctccccgacctccaccctctgccaccccggccgcctcaccgccgcgccgtcctcctgcacggcggcgccgccgccgccaaagctgagcctgctctcttgccgaccgggcgcccaactcccagcctcggcctccacccttccggtaaagctcgccattcttttttttctttctttctttctttcttttctgtttgggttcttgacactggttgtccggcttggtttcttgcttagtcttgatctctccgattcggaaggggatttctgttggtgtagggtttgtacacggttcgtgcccggagtttctgcgcggtcgtgggttttttttcccccttaagcttgacaagatttgctcgtgtagttcgtgattgggttttgtttctctagggtttcttgagatactcacgatatggattacatttcagattcttgcgtctcggcatcggaagcga

SEQ ID NO: 15262 - DNA, 1501 bp, Oryza sativa
ttcgtcgcccccatgagcgtcatcgtaagaagctctcacctcatcgatcagctcttttcttttaaagatatataatgaaagtttttattgaactcagccaattacatcatatgatattataactgtagtaagaacattccccaacttgaactcaactcatcagttttttttaatataatgaaagcttttattgaactcagccaatattacgtcagatgatacaaccgtgctaagaacactttcaacatgaactcatttcatcagtttttttttaagatgatggaagctttattgaactcagccgattacatcagatgatacgatcattagcttgaactcagctcattagctttatcttttttaagataatggaagttttattggactgagccgattacatcagatgatacgatcgtactactgagaacactttcaacatgaactcagatcatcagctagtgatgatcttgcatcgtacttgttgagacatgtttgctgatcaatcgatcgatggatggatggttttgcagatggtggtgatcaagacgaaaagcgcggagttcatgccgttctcgctctccttcttcctcacgctcagcgccgtcgcctggttcttctacggcctcttcaccaacgacctctacgtcacggtaattaaacatctcgatcgatatcacatcaaatcttgatcaattctctcgaccaattcatgaatttcaatcaaagtttgaattgtttaatttgcgtgtagcttccgaacgtgggaggcttcttcttcggctgcgtccagatggcgctctacttcaaataccggaagcccaatacggctgccggcggcgtgatgatcctgccgacgacggcggctgcggcggcggtcgacggcgccgtggctgagcctgcggcggcggcgcagcagctggcggaggagctggaaatggagctcgcggccgcaggcgcgcacgcggtggccgtgctgccggcgagcgcgctgcccgtgctggccgagctgcacaagatggagcaggagatcgggacgccgcgcaagggcgccaccaagaccgtctgacacgtggctcgcctccattggttgtcgagtgccatgtcatcatcgtgattattatatatatgggcaaaatgcatcatacccagtagtaaatttcttaatttcagctgtttgtttgcgttccatttgtgtgtttgaattgagtttgtattgtgcaattatcccaagaaaaaagaaatgtgcatgtattggttatgattaattaaattaattcgtatcctatcaagcatagttgcaagtcgagactatcttttttcttcctagccattgggtctccaatccaaaggtgagacagcccatctgaacttcgcggtccagtcagcccaagctcattaggcccagtatctctctgcaacatttttgcatttttttttctttctttgataaactcctctagtgaatatgtgcataactgaaatggacgctggcctgacaaga

SEQ ID NO: 15263 - DNA, 1501 bp, Oryza sativa
atctaaaggactaaattgaaaccataccttcagaactagaattctgcaagttgtggaagaatatttaagaacaactcgcagaaaagttggactcaaaattataagcccaactatgtttttaaaaaggatttacatcatttattgccacctcacagtcctatgtacctaaatttacaaagttactggaatctatgtacctcactttttcaccacattccttacatagaaaaagaaaatctgaactccttttagtcatcaatttgctcctacttctttgaaatcataaaattttaaactattgttatgttgggactgcaacttcattaaacaaacactctccaaaatgtataatgctaagcaatatgaaaaattaaccattaaatcgtagcatttagctaagcagcatggataactaactagaagtctagaatgaatcatagcctttaaaagggatatgtatgagagaacctcatctgatcaggagtgacttctgctgcatttgatttaaatgtagcactgtttttcttgctccctgtgcggctcaagttcattgcaacttcatcaccgctcgtgttggggtagctaaatgagactgcaggggagtttgacacagaataagaaaatgtttgacatatgacccacaatcactgatgtaaaaccaactttgtatgctagaagttagccatatttcacatggtaatactcacatgcatactcctcaatcattgggccttcctccttctcacagatgcagaagagaagggtcttgagatatttcttctgtagtgcatcatagacacctaaaatttatcacaaaaatggattaaatgaacaaattggaaaattaaaaagatttaacacgtaaaacaggacatattttcacctttttccatccaatcaatcaacctcctcgactcagtatccatgggcattagcttcttaatcttcatctctgcaataaataaaagggtgttccagctaataatatcatatcatctgaggaatttggtgtataaaagggttagggactataggtaatgtgacctagtgccggaaccgacttatcattgaagtacttctcagggaatagacctctgatgtagctgatgttgtatatagcaatgcggagcaaattccttgtctgtttggtcaaaatatcaccacgttatcacaatagcgttctaccatacataattcaaagagagttcagtattcaatgtaatagaaatagaagggcaataaaatcatcacaaattggattactgattaacaagtttaggccttattggatcctggtccacccccagggatggactgaaattgtagttcagtttcctagcccatcctggagcatggcccagggttttgggcttgccaaacaaggtgaggcacaaaagttcaccaaacaacaaatgtgtcatgcttttcaatactttagcacatgttgaatcaaatagggtaccagtcccattcaaacacacacctgcaataaatttcttaa

SEQ ID NO: 15264 - DNA, 1501 bp, Oryza sativa
ttgccggaggtggtggcgacggcgagcccgtggtggacgtggacgtcgttgtgactgtgctgtcactcggagtcggctggtcgctggacgacactgctgttgctgctgccaccgtcgcagccgacgacacggccgtgtccttgttgagctcgacggtcatgacccagctggagtcagcgcgtgcgccggcgcgcttctgccagacgccaatgtgggacttctccgggtcaaggcggaggcaggtgagcgacggcgacggcgtcttgcagcacttgcggagcttggcgctgaggatctgagacaggctgttcccgccgccgttggccgtcattgaggacgagctgccgctgccgccgccgacacggccatcccgccctgccaccgcagccgccggtgtgagctcccccgtggcgttcctcgcgactgggaagttggtcttggcgttgcggccgctcatcaggatggcggcctcgtcgtacgcccgcgccgcctcctccgccgtctcaaaggtacccagccacaccctcctcttactgccacaacgcacgtagcaaaaaaaacatcatccatcattcatgcatgcacgcacccaagcaccttgagttagctactaacataccatgaaagagaaagaaaaaaagaaagaaagcaacaacaaaccagaaccactagctatccatcaaaatgtatctatcacgacagtggcataacacatcagagcaacatagctagctagtgatcatcactagtgagatagagacttacaggagagggtgcctgatctcggagacccaggagccccagtggcgctgcctgactccgcggaacttcttcttcgactgtcccatgatctcacctctgcagggatactgtccctgaagaattctcccaaggacacagcagaggaggcaggcagagtaggagaaggaatgagcagcagcagcagccagtcagtcagtcagacagtgagcatcctcctagtgtggagtgctgggaggagtgaagttctcggtttccagtgaatataaactacctgccacccctatacttgcctttcttgcagtgtagcgtgcgttcaatgtggctaagatatatagatgcacatatatatagacatacatggcatgagtgtggcgcgcgtgtgagagcgctgtggcgcacgagtgggggtggtggtagaagagggttagatttgggggttggacagtaactcaactgggacttgtctgtcacgtatctcctctgtcagtggccttagccttttggtacagtagcacaccagggttcagatctagttggtgtactctccttctactctgccaggaccaagtgagtacacaccttcagtcattgtaattaactttctggtcaatttccttgtggtcataactccacgagtccagtacatacactactttgaaccacagtggtactgataaacttgtgttgtaatccatgcagggtggttggggccagcaacagtaatatctagcaggaggga

SEQ ID NO: 15265 - DNA, 1501 bp, Oryza sativa; identical to SEQ ID NO: 15264

SEQ ID NO: 15266 - DNA, 1501 bp, Oryza sativa
ggtcccaacaattatcgtgtgtatacgatgcacatatctaggttccgggtattggtaaagcagctttactgaacgtaccatagccttgaccaggtcactaattaactttattaatttgatgaaagaaaactgaattaaagaaagaaagaaacatgggaaagaatagattcagctggttagtacgtgcatatatatagtatatatctatattatatatatgatctccaggtagagtctgtgtacgtttgtttcatgcatgatctgggactgacttaatttcataattagctagatgcaagtgggaagctatatactttatctcgaggctctagctatacagaccgtccattttaatcggccataagaaacatcagctctaattaatcggccataagaaacaccattttatttagtgttccttgatggatcgatcgatagatacgtacaacttactagaagagatagcagatctagatcgatctttatttgacagcgacgcacttacgtaccacaaaaacatgtagtaggccggagtgctgatcgagtgcaggcttatatatatgcatctttaataattttgtagctagtacgcactataacatttcatttctgtgcatacacgactaatcgacgcatatgaaaagctcatcttatagtatataattacggtgcaatataatggatagtgcattacagtatatatgtagctatctagcttaggcatctccagacagttagctaggctgatgccttatggatatatcgatcgatcgattgatctagctaggtatcatgctttgctacctttccctttttcccttttcccttttaactataactatgcaatgcacatatatatattagctagctagctgttctgtatgtatgcatgtggccaaccgttattgataagttggaacaaaagaaaggccagtttggtggaaattaggcaagcaccctcaacttctcacccactatagatatcatcagcaaaccaaacgggaaaaacagtacaattaactcagatatgaaaacaaaaaagtgtatgctctcttctcagttctcatcatccgatatttctgttgctagtgtagtagttgctctttatttctttcatttcatttttttagtgagaatgaagtcttcaatccgggacaaagtagaagcgagagagagaagaagaagcacatgggccagactgtgcggcccataaaagatccacttgaattaggcagatgggcctaaaccaaggcaacctaatttcttcttccacttctcgcggaggagaggagattccgatcgagaagcggcggcgggcggccggccggcggcgagggagagggagaatcgaatatactgtagcagaagatgcttccaattttcaatggcgggttaggaggaggagttggcgaacacgctacctaattagctaggtttcctttgcttctccaccatatccgttcccctcttctccgctacgatgcaggccgccgcggcgcca

SEQ ID NO: 15267 - DNA, 1501 bp, Oryza sativa
tgcattgcatagttatagttaaaagggaaaagggaaaaagggaaaggtagcaaagcatgatacctagctagatcaatcgatcgatcgatatatccataaggcatcagcctagctaactgtctggagatgcctaagctagatagctacatatatactgtaatgcactatccattatattgcaccgtaattatatactataagatgagcttttcatatgcgtcgattagtcgtgtatgcacagaaatgaaatgttatagtgcgtactagctacaaaattattaaagatgcatatatataagcctgcactcgatcagcactccggcctactacatgtttttgtggtacgtaagtgcgtcgctgtcaaataaagatcgatctagatctgctatctcttctagtaagttgtacgtatctatcgatcgatccatcaaggaacactaaataaaatggtgtttcttatggccgattaattagagctgatgtttcttatggccgattaaaatggacggtctgtatagctagagcctcgagataaagtatatagcttcccacttgcatctagctaattatgaaattaagtcagtcccagatcatgcatgaaacaaacgtacacagactctacctggagatcatatatataatatagatatatactatatatatgcacgtactaaccagctgaatctattctttcccatgtttctttctttctttaattcagttttctttcatcaaattaataaagttaattagtgacctggtcaaggctatggtacgttcagtaaagctgctttaccaatacccggaacctagatatgtgcatcgtatacacacgataattgttgggaccaaatgtcatgaagaaaatggggatagctagctaggccggaaaatactcttctccctgtttatccataagataaaagtgaacccgaggagtattcattggtactcatcgctactgtctcggtaaaaatataatctggtcttgctacagaatccagatggcttttatatagcctttcaaagatataatagtatatatctatattattatatagcccttcaaatctcagtaaaaatataattctgcacattaggacgactctctggacctctagctagtatcagcgtgtagaaatggttggagttgtccccctgcacctactaatggaatattaccgccgggccacgtagctatatatcaggcctcctcctcagcctggcaagttctatttgccctcctatagcaagctcaaatcccttctttctataaagttaaggtcaaaagcttaaacctcgtgcttccacgtcatcatcaaattatgaaccgttggatgaatacattagatcgcttctcagacgttcgatggaatgcagcatagagcccaacccatgccattagccaccggatgagtctcttcgcctcctcagtgccaaatgtggcccacatgaacacattggcccatctccacacacatctacatgtatccagcccatc

SEQ ID NO: 15268 - DNA, 1501 bp, Oryza sativa
aacggcgtcatctattaaaaaacggaggtagtacgtcactgggcagcacgtcgttgtcatcggagaacatatcgagggggagaaaaaaaagatactgacgtggtactaaccgggtatcagctactccctctgtaaaaaaaaaaacaaaccctagattttcgtgtccaactttgactgtccatcttatataaattttttttataattcgtattttcattattgttagatgataaaacatgattaatattttatgcgtaacttgtatttttaatttttttttataattttttcaaataagacggaaggtcaaacgttgggcaatgaaatcagggtttgtctttttttagacggatggagtactagcctagcattgatacaatatcaataagtatcatatatgataccaataagtatcggctgataggatgaggtatcaaaatccgatctctgtactgttcgaacgggatcttatgatatagcagctcccattacatctggtccgttggatctaatctgatggacgcgggtccatccaaagatgtactatattttttttaaaaaaagtaaaagtaaggcgtgcatggtgaattggtgaaagtggagagaaataaacaaaagctgcggttcctgcctgtcgatagttgtcgcctcgggaaatttctaagaaggatgactactgtacgagttggtttgtgtacgtccatggagactggctaggatagatgcgttgctggggtgtgcggtagatgtgcattgaaggtgcaatatcatttcgtctttatggctgtgtcagttgtactgtgtggtggcgatactcattgcagcagtcgtggcggaggacggatgaattaatcctttctaatttcacgggtgacgttaattagatgcgcggtagaagaacatgcatatagcagaagcatcgcatatgaattcgtcagcagcatcacatggcggtgttgatgataagaacccgcagtggcagggcacgtactacgcttctagtgtctggaagggaggaataggtgcgctactatccaatcatccgagggcgtgccacatgcattggtggcactaattactatccatcatgtttctgtggacgcgcggctcaagtgtacgtgaaagcgtggcatggccgataccgaccatctcgcgcgcgcgcgcgtacgtgggaacagagagcggcgccgatcgtgaatccgccgacgcggctaggactccatccgcggagaccgttcaccatccatgtctccgcgcccgtgatcgagcatcccaaatcaaatccatgaaccgatcgagcgtgcggcccccaccaatgcaacccaacgcaagcgaagcacatatgccaaaccgagccctccgcaatcaagctcaactctgaaaactctcacttcccggtttaagagagacacaagcaaagcacagagagctcgtaggcagcagctagcttgccctgcattgccgatcgatcaacacgcgcacaccaccatggcgaatccac

SEQ ID NO: 15269 - DNA, 1501 bp, Oryza sativa
gttattgatggttaaagttataaaagtttaacctcaatcttatccaaaacgataattagtatagaaccagagggagggagtaaagaaaaagtttggggcggtgacaagagagaatcaagttgtaagattaatcaactgaggcgtcaccttcatggaaggctagcaacaaccaaagagctagctagctaccttgaccgaccgaattctttaatattcgggcagctcatgctcgtgctctcgctcatgcgtgtggactttgaatccatccacctcatcctcctcccgcgtactccataaaactactcggattcgatctcttcctccagtactccccatctcccatccaccattgctgccatctccaccacatacaatacaacaactactactcagctcaccatcaccggagcaagagccaagaagacgacgacgacgacgagctagcagcagcattgcaaccgacggcaatggaggagcagcagcaggtggaggtggaggtggaggtgccgtcctacttcgtgtgccccatctcgctgcagatcatgcgcgacccggtgacgctccccaccggcatcacctacgaccgcgacggcatcgagcgatggctcctcaccgccggcacctgcccgctcaccaagcagcccgtgccgcccgactgcgaccccacgcccaaccacaccctgcgccgcctcatccagtcgtggtgcgccctccacgccgaccatggcgtcgacctcgtccccacccccaagccccccgccgaccgcgcccgcgtcgccgacctcgtctcccgcctccgcgccgccacgagctccgctgccctcctcgacgcgctgcgcgagctcagggacgttgccgccgagagcgagcgtaacaggaagctcctcgccgccgtccccggcgcggtggatgttctggccgccgtcgtcgtcgcgtcgtgtcgagacgccaaggccgcgtgcgacgaggccctcgagatcgtctgctcgctggagctctcggagcggtgcctggcgcggctcgtcgagaggaacgaggagctcgtcgacgcgctcgtcgccacgctgcagcggacgaacaccacgtcccgggcgcacgcggcgctgctcctggaggccgtgacggcggtcatgccgtcgaacaggctggtgtccctcccggaggaggtgttcggtgaggcggtgcagctgctccgcgacagggtatcgagcccggcgacgagggcggcgctgcacgtgctggtcggcacgacgtcgtggggccgcaaccgcgtgaaggcggtggacgccggcgcggtggcggtgctggtcgacatgctcctggacgggccagtcgagcggcgcgggtgcgagctggccctggcggcgctggaccggatgtgcgggtgcgcggaggggcgggcggcgctggtgtcgcacggcgcgggcgtggcggtggtggggaggaaggtgctgagggtgtcggaggtggcgagcgagaaggcggtgcgggtgctgcggtc

SEQ ID NO: 15270 - DNA, 1501 bp, Oryza sativa
tttgaggacaataaacaatgcatcggatatcccacaatttgatctatagattcagataaccaccacgtggaataaaacctgttgctaagcaatttggcatgacatgtaatcttcacaagtcactactaccatcagtaagggcaatttctcaccaaacaacaataaggtctctactctgacaagtatggcaaaaaaaatagggataaatttcagtcagaatctttaaggttggcaacttccagctttcaagcagcattacccactcaatctttctttatgacaaatataattgcataacagagtggtagaacaaattagcagaggaaacaacactctcacacataccttcatgatctccctttctgtcttgtataggggatcacgcaaatgctcaacaggcggctcactaacgtggtaacgaccaaaatttttcttcatgcacctcacatactgctttcaaccaggaaaacaatgattacacctcaatgcccatttacatttgcctgaaacagatcaaaaaaaagagacatgggcaccttttgcggcatcggagcaagaacccttgggatggagtagatgtcagtgtcaggcggcgtgacatacatctgttgcacattatgaaggaacacatgatttagttcaatcaacctaaaagattgagttctgtcaatttggatagcactgcaatgaatgtgtcatgagatgttgcattaacagatagcattgtcaaatacatgcttgataacacaggcaattagcaaagaatgtactagtgttagacagataaatgaggatgtatacctcccggaagtcgaagacgtcgtcgtcggggtcaggcaccttgcggataaaaaagtcgcagtgcagtaggcgaatcttgtggaattcgtcctcgttgacggagtagtcgaccacggtgtcggaggcggagtcctgcgtggagacgaagctctgggcggcgaccatggcgatgtccccctcctcctcgtcgccctccccggacagtgggcgcggcggcgccttgacgggggcgagcaggcggtcgtagtcgacgtcgtagtcctgctcgttgtcgaggtcttcgtcgtcccccacgccgtccccgtcgtcgaggtcgaagtccccgaagtcgtcgtccatgtcgtcgtcgccgtacgccgcggagacatcgcgccgcaggaggggcagtggggtggcgccgcgggagagggaggcggcgaggagaagggacgtggaggaggaggggttagctagggttttggagagcggcgaggggaatggataggggaagccggaggcggagacgacgagagagagcgacacggtggccgccatgtctgagtttttttttttttggcgcgcggtcgagagcgagtatatccatccacgtaggtgtgtcgagatgtattagcacgaatcttaaagcacccaactttgttctcgattgttctgacggcgagagaaccaaccaaccctaccttggctttgccggcgggcggcg

SEQ ID NO: 15271 - DNA, 781 bp, Oryza sativa
cagagatttttgttaaattaaaaaaagaagaagaagaagaaatgcgcacatgaaaggggaatagaaattcaaaaatggaaggcagagtgaggaggaggaaaacagacttgatctgctcgttgatggcggcctcgcactcgtcgacgaacttttgcctagcgagagactggtccttggcctgggggacgagggagagctcccccttgagctcctcgaatggctggaagaccacgccgctgagcacctccttccctttcccggcggccctgcacactgccccgggtccggcaccacgcggcacaggcagccagacggaagcaggggtcgaggccgcggcggcgagataggtaggcgcggcggcggcggcggccggggcaaccctaggaggaagcatggcggagaggcgcgtgtggcgtttgcttccggaggtcgcggcgggtgaagagtgatgagattaattgtgcggtggtaggggtggaggtgatagaaagggatatatataggcgcgtggagctcacggatgggccacacgtggacggtcgagatgggacgaaggcgagggagcgcgtggcgggctcgtggctgggaggatattttgggctggtggtttgttgatgtggagcccggcccggccgcaccggagtcggtcaagcttaaccactattcctttccggattgcttctgcgttctacttgatggatcggttagtctcgttaatttcgtcatcagcattatactgtgagacttttttagtattattcatatttatatagatgttaat

SEQ ID NO: 15272 - DNA, 1501 bp, Oryza sativa
gacccgccaggcggtcaagaacggtgtcatagccgtctcccagatctaccgtcgcccgccagctggaggcctgcgtcgggggctggctcggaagtcggaggcgcgcttcgtcggcgaggggggtgtagaaccagtcgctcttccagtcgtcccacttcttgcggagaacgcagggaatgtagcggttcagcacctgcccccgcggctggaagtagcagccaccaactaccgtcggcggcgacaccggctgtacggtgaagaaccaccggaacagccggagagatgggcgcaccccgataaacatctcgcacaggtgtgcgaagatggctaacgtcattatcgcgttgggggttaggtgcgccatctggagatcgtaaaactccagaatatccatgaaaaaagcagagaatggcgggaccagccccgccattgcgaaagagaggaagaagacggaccgccccgggtagtgtggcgccgggcgtccctcgcccagcgcgaccacctcccggccggcggcagattccggcatgaatcggcgcggcagcccggcctgcctctcgctcacgatacgggaaggcggcagcacgctaccatcgagcggtgcggagccccgtgccatgacgccggcggaggaggagcttgagagcgagcgagtgcggcaagggtagggcacaggaaacgaagagttagagcgcaagtggcgaaggcaaggggaagagtggcgaggggaaggaaacgaatcccttcctcggcgtctttattcccttgccaacgctatgcccgtctcctcgcttcccgcgcccactacctcgccccctcgtttctcgcgcccacgcctccactaaccccactcgcccgtttgcggcgcgcgcggcagatgtgtggccgtggcggttgagatggggcagatcgtgcgcgcattaactgcgctcgccaaccgagaaaaacgccatcatcatgtctccaggcgaaacgaaccggctcgtcccgattcgcgcgctgctcgagtaatgtagcggtcttgaagaggccgctcattattatcggtcggttttcccttaccgatgcacgcgatttacgaccgctgggtttctgcccgcctgtagagaccggccccacctgtcaccgggcctaaggagtgacgtcacgcccgagcgcttccctcgaggggggcgatcgccctgacgtaacgccgggggctactgtcggtgacatggggccgggggtatcattactagaggcttggggagccacggtcacccacgtggcctgaccccctcgggggggtcgggcccgagggtgacgtggccacccctccctctgtctcccggaggggtcgggccgctcccgtttcggccccgagggctggggcgccccgaccccctgtggtgttggcgccacgtgtgtgggttaggtgagcacagcggcgctcacctaaccgcatttatagcgggtcagacgcgcgcgccacgccgcattcaatgcggcgcagcgcatgctt

SEQ ID NO: 15273 - DNA, 1501 bp, Oryza sativa
tgcgttgtgtgtatctgtgatacttgttctggaaaattaattttaggagaagtgttctgaattgctgaatgttattcgcgtttcacaaagttaaattctcgtcatcagaaaaggaatactttcaggtttcaatttcccggttgagttttcagcggtggaggaagaattgataaaggtgcttataaaaattctaaccatgaattttctacatgaacgcggcgactgctctagctgtattcctttatgtaacaccgtgactgactaaaccttgtttgacatttacttctaatataatagtgaacggcagagtctgcatgttctctcgaaaaactttcacacaagagtgattttacgtgcttaaaaatgtattggaaggtattacattttctaatgtaaaatttgatacttctcagaacctccagtacagaatttgcactaaaaatattattacttatttgtatctctcaaggactgtaaaatttctcttcacatatgcggaagattctaaccataaactttatacgaaaataaaaatatatattagaaacttccaacaattgttaaaagttctaccagaatatacaactttctaccaaaaaaaattctaaattggataatttatagtgacacttttatcagggaaaaacaaactcgaagtctcgaacatgtactttgtacaagaatgaaaagaaatcttaaaatggttaaattttgttttaaatacgactaatatgttttttttaattcaatacgactaatatgttttgatggtcctagaaggctagaacaagctaaacagtcagtagaattcaataataataataaaaaaaacaattgagccaaataagtcatttggcccaagcggcattgctagcccacgaggcccaggccacgttcgagaaagaaacgcgagaatagatcgacgctgccgccgcctgagcctgctctgcagtacttctccggcagcgccggccgccggcccgggtatcaatctagggtttccgcccgccgcagccacctagctagctagttcaacgtacgatgaccatggaagatggaagctgtcctccagcagtcgcccccagtggcagccaagccgaagattacggatcatggacactgaagcagaagcttgaggatctcatcaactgtgatcctatccatggtatcatgccaaaaaatcctaaatataaagcatatttcgaggaaaagttcgaggtacgtattttcttcgatccatcatccatggatgcaaactaattaattaattaattttgacctcaccagcatatatatatttattttattgtatgcaatcgatcgatggatcaatctatcataaatattattgccattgtaggagaagttaagtacgtacgttcgtgttgtattgccgaaacttcgtccagcaattcagaaggatagcgtgaagcaattctatcaagtctataattgttggtcaggtttcatgggactgggagagtttctttaccctgatatc

SEQ ID NO: 15274 - DNA, 1501 bp, Oryza sativa
aaagtcgtttgtacgatcgtatttcttggaactcacacttgtcgatggcatttctaggatttggatgcttgtcaatagcatttcttggattttctcttctttctttcttttttcttttttggcaaggatacctgtggtgggttttatgggcatggaacgtaaggacaccacgttgtcctcatgacaaatgggctaacttgtttgatcttagatactactccctccttttctaaatgtttaacgccgttgatttttttaaacatgtttgaccgttcgtcttattcaaaaacttttgtgagctgtgtaaaactatatctatccataaaagtatatttaacaataaatcaaacgataggaaaagaattaataattacttaaattttttgaataagacaaacggtcaaacatttttaaaaaaatcaacggcgtcaaacattttgggatggagggagtatatctctctcctttaatatttgacgttggttagtatcatatttagctagccaacgtcatatataatagtggaagggagtaaattttaaattcctacttgttcttaatacttattgttctattgttctagtagtccaccgtttttcttggattttcttcaaaaagtgaagaaatttacgtgattatgagtgaggtaaggaaaaaaatgaagaaatacgatttgtccatcagtccattggaaacgttttcggcaaattcaaatattccacgttgtaggtgagctctgcttttgggaaagtcagttgttgacgccgccaaaaattccagtcctctccatggtagtcaacgtcaatttctcacttgtactatatcctaacgagtttttggttcacacctgtttaatctctgttcgaaatcaagaaaagctggatggagtagaggatctatgtcgagtttagctccaaactttttctttaaacttttaacttttccatcacatcaaaactttcctacacacaaacttttaatttttctatcacatcgtttcaattttaaccaaacttttaattttagtgtgaacgaaacacaccctagcatgtatggcattgtgccaagcgtcgtgtcctgaactccagaactccagaattccatatccatatcgtacctacagcgaagggaaggttcagatttcagactcgctgtggtaggtcagctcggacagtttgaccacgccttggccacttccgctactccactccactcgcacggtcgcctacccagttttctggccttagcggcacatagatttccgcccaaaaccatccaccttttgccgcctccgctcgtgcgcagcagcgcagctgccttgccgtttcccaattcccacacgccatgacgccaaccaacccaagcacagcagtacaccacacgatgtcacgactcacggacacacgggctatatatatcgacgtgccacaccacaccgtacccaagcaaacagatttccaactaaacttgtaccaaaacacaaacgacatcggtcccagtc

SEQ ID NO: 15275 - DNA, 1501 bp, Oryza sativa
acctcacagccagcgatcttgaggtctctatagcacgagacgaacatatggtagcagtagtcggacttgaagcgctcgccgtcagtggcccaatcagaggcatctcacatctagcggtcggggaagatctggccaccttgggtgacgagtgggtagtgatggacggcaatacaaattgacttatgaaatgaatacgaagacgacgagtacttacgtagaaggtggtgttgacgccggtggtgtagctggaggggaccttgattggagaagctcccttcttgttcgccttgccgatgccgttgttgggttcgtgggggcaaggaggggccctcgctgctcctcctcaagatgggtgccactctgcactggagctcgacagagcttctccgaagacgggcttcgccgcctccgtggctccgcctgcccctggccttctcctctcgatggcgccttgtatctcatgacaccaatggggctggcgccaagcacacccgtcctctcgcttcaccttgccaccctgagcctcgcctaccatcttgtctgccttgttgacgttgtcgttagggtccgtgggggtagggagggcactcgtcgacggttgtggcccgctcgtccaagtctagtgccccaacaacaagcacgattgcgactgctatgtcacctactgtgacatcactacccaacagagcgccctatttgtgcctggagcctggtacagcttcctcaccgcgccgccagcgctcctcggccacctcattggcaaccactcccggccctctcaggagattacctactgcgccatccactcgctcatcatgtttgcgtcggagccgacgtggcgacacctgttgctggttgtgcgtggggacggcgatggctacgacaagcgccatgtgttcctcctcgccatggcacctaatctcccgcaacatcgactgggccggcgccaaggacacccgttgagtgagggagagagtgaggagaaaaggcaatgattttttgtgagtatgataggtgggtttcacattgactcagccaccacgtcacctaaaatcgggaacagtactaatttaggacccaaagtgatccggttttataagataagggatatgttatagagtattttttgggttcaaggatgattttgtagctcgtccacagaatgaggggccttaagtgcaccttttccaagggaaaaccccttccagcgcgaagaaaccaaccaattcaatccaggcccatcaaagcccaaatccatcaaccctaactccttcaagcacaacctccaccgtcacagaccgccggcgccgttcgactcttcgacctccacgccgacgtcgcgctgcgcctgccacctttatcttgaaccgcgacgtcgttgtccgcccctcccgcgccggcgaggcgaccgagccccctcccctccttccctgcctcgtgccactagcgccgcccttcgccgccgccgccgccgccgcccgcgagggagacgcgagaagga

SEQ ID NO: 15276 - DNA, 1501 bp, Oryza sativa
ccagtttatctccaagatgtgcaaaatgatcagataaattgctatctgggccgcgcattgatgatccaaccgtgaaatgttcgagcggcccatgaaggcccaagtttgcgatccaaacttgcatcagctctgctcagtggatgttatgtatgtaggagtaactctgtaacagttaaacagtggctaagaaaatctcaaatctgagatctcatctgagtgatatttagctcatgagttattacaagcatgtctagtacttattcatgcacggattagatcagatcagattacaccatgcgcaaaagccaaatcactcttctcccgcgtcaacaccatgcatgttcgatcatgcaccgatcgcgacgaactcacgccatgtagcggcgtcgtcgtcgccgccgctgccacttaggatatcctgcaatggatcgaaccgagatgaacaaacaattcagtaaatgcaaactaatgcgccatgagaccaatctaatcaacttttttttaattattacttgctgcagtcggtggcggcgccgacggggatggcgagtccgagcttgcagagcgccgggaggcgccgcgcgcggtcggggagcacgccgaacgacggcccggactgctccaggcacctgcacagcgcgcgccgcgcctccgccgtgcccgccatcccgcgcagcgccctcgcgccgccgcagcaccgatcgcccggccgcgccgcgccgcccagcaggaacggcccgcacggcgccagcgcgctcaccgcgtcgccgcacgacaccgccgccgcgcccccggcgcccgccgccaccaccacgacagccacaaacaccgcgatccccaccgccgccacgccgcggctgcgacgagcgctcgccatcgtgcgctcgcggtgacggccgatcgattgaacaaacgcgttgcgtgtgagtgtgtgtgtgagtgctgagctcgaggttggcaatggcggccatttttgtaggtgggggaggtcaaggaggttggtgatgcgcctgaatgctttcccgcgactttaccatgctcgtcgccatttccggcaagctgaacaactctgcaggcgcgtattgaatcgaccggatggcgagcggctaaacgccatgcgtcgcctgcgaggtccatgtgattgtgcattcagttcacttgatctttatgttgcattcaatccgtatatccaaaagggaatatcaaaccataatgccccttgccacaattttttgtcatctgcattttttttccaacaactatactagtccgcatgccctttttgaatgatctccaactattttaaacattataaattcctgcccatagtttgtgaatctatagttgtacaacctagagaataatttgagagtcaaaagctcaaaaacacaactttatcatatgagaaaatccagaaaataccaccgataaacatccaaattcaagaaatgccatcgatgaacatatattcctaaaaatgtcattgtacaatcgtctttgt

SEQ ID NO: 15277 - DNA, 1501 bp, Oryza sativa
tcaaaccacagtatatcctacagtaaccgtgctattatcgtggtaaccgttaaactatgagttacagagttagtcctatttcaaacggtttgataaatcatgattgaccttgaactgatgaaaattatatcctatatcgtcctaggttggtcattggtgcaaagtgaaagtaccatttaaacctggtgcaaactaaaacatgaatcgcaacacaacacgcaaagtgcagtttagtctcctcatgatcaaacacaaatattatttttagcggaaattcgctctcaatctagcctagcaatcaatgagggtctcacaaattagctcatcctagcagaaaaggcggccgaaagagaggcgatgccacgggggatccggctggatgtggcacgtgggggcccacaccgacagccggccaagtcgatattttcattttcctcgagtgatttggcaccaaacaggccatcctactgggcaatgttggacgatcggtgtggactctacccccgaaagctgctcatcattgtacacttcattcatcaactcgatcaacatctcaaatggacggtttaaagcaacgaaaacgacacagagacagcagggtttttcttcttcttttttttttcagggagaagaaagctgcccccagcttcagtattctctgcaaccactagctaggacttctgaacgaatcaatttgaaaaattttactagtacagtggaagaggagttcctgttgaacatttgaaatcaccgtgtacaaagatttatctctttcttcttttttttcttttttcagagattacgcaagagaaccgcgcatcatcttagataagttaagcgaaatcgtgatctggattttggtatgtatgaaatcaaagggtatttagcctccccttttttttttgtgaaacatcatttttccttcttgaacacttatggcaggagctgtgccgatcgattgagagaaagaaaaaaggcatagtagatgaaacaccttgagcagctaacattatgcatcaccattatgcattactagatatgcttgtttgccggtgacaatgctgtggcattgtgcccccacggcaatgtagtgctactgcagacggctctgatctcgctgtcttgctgatgatatccctcttgcctttctctttatttttgcaagacaaagttgatctacggacaactactcctgaggtgttgtacaatcgtctttgcatatttctatgctagcttttcaataaaggcgtctaaagcaaagaggacgaactccaaagtttatagaggtctccatttgctgtaattattgtggctgatgaactctcaagcatcacacatgcaaccacttaaccaggcacaggatgctagttgtaatagtgttgatcaaatggggaatttcaaaatgtacttagaagactgtagagtttactccttctctattcaatgaaattggtggctcgctgattcgtttaaaaaaatgtactcaaaagaaataatgaac

SEQ ID NO: 15278 - DNA, 586 bp, Oryza sativa
gagaatggttgctggatctcgacaaggaatacggaatgaagagatggtgtacccgccgagataaaatttcttgacttcaatccaaattctcgattacagcaagacatgagacttagtcgtacgctctatactttctcagtcgacatcagagattaacttagacaaaccctttcggtgcccgcacgaggctgacaaaggaagttcaacgttatctctaaactcaccgagaacggtcacatgagctcgataacagttactccaatgtctgcgcgcggttgagaatatgaattcgttcatttgcatcgaagtcgggggctactgttagggttatggataccacatacataatagtagttgactaaatctcggcaggatccaccacataccatgtcttatacggaaactgacctcgagggagttccagataaggaaagacaaccagagttctacatggaaacgacaaggactactcgaattgtatccatattggtttccctagttctacttggacaaggggacacctatgggtataaatacaagccctcctaggaggacagagggagagacaaccaccatgaaaggacca

SEQ ID NO: 15279 - DNA, 1501 bp, Oryza sativa
gcctgcttatccatccttgaaagtgacgagaaaccagctgcagaagatcacacaagagcatgtgagctgtagctttggcacatggtagatgccgcccttatggtaatccaatatggtaaattctgtacatacccaagttagtgtcgatttacctgcctcaattgaagctagaaattaaaagcaataggctatcttttgtttgttttgtacatatttaaagtgttctgggccatttaatctagttaggcataatcagaagagagcaggttcctttcattctccctcttttgaaccaggcttccatttttcatatactttctggagaagtgtggtgggagcatttgcatcgtgctatgctcacaagctctggaagccagttaaggcttaaaccatgtcataaaggtaattgcaacgtgtagtagccatgtggcttggtgttcctggtggagctgaaattctgcatagagtcgagtagagttaaagtgatcatctgtttgtgaatctggacaaaatcggtcactgaaactttgaaggtatgcgactctgctaatgtgaagttaaaactcggatatgctttgctgtttagtaccagcaggcagcagaaattttctgggaatcagccagaaaccggtgtctcagcagctgacaagtgatatggaccatactctgcctgaacatatggattccaacgatgtctttggtatatgaatcacaattatatgttgacaactacacccggtggaatcggatgcctagttgatgtgtattcacacctttcaaatgttttgcatctgtgagagaaattccataccaaatcccgctgaaactctggcaaatttccacgggatgcttgtgcacggttgcacctacagtttctccacctttgcgagccgccgatggagagatcattgctgcactctaatcatctatcctctgattcattttgatttcactcatcttcctcccctcttcaacattttgtacaaccaatgaaatgcagttacttggcagcgctgaaacacaaatgccgaatagttttgatatgacgcaattgcctcataattctgacatgacacttgcattgatccccctgtgatttcttctgtggaacctttgagaggtgaatctgaatcatttctatcctcaatgaaattggcagagctcctgcatttccccctaaaaaaaaaacacttgcattgatcaccttagcttatcacagagcaagagctgattgcatgggattaatgtacaaacatcatgatgccatccttaaataggtactccaccgtactaaagtaaatcaactcctaactataggtatgcccaaagctagaatttaattccttttggacggaaggagtagggttcacgatcaagggcccctttgattcatgaacccggaaatgagctattcttgtgaaaacccaataaaattcccatatttcaaataaggcccatttttatatgtggagaaaatcataggattttttggatttcaatc

SEQ ID NO: 15280 - DNA, 532 bp, Oryza sativa
gccaccgttgcgtccgcagtcgctgaccgcccgtccccgcgccgtactcgccgtgcacgcagcgcgagccgcgagagagaaaaagcgagagagagagagagagaatagagagagaggaagaagagaagagtatggtaggcgggtcccacaattttttaattaaaaaacgctgactggattgccacgtgtgcgccacgttagacaaaaccgctcttaattggttcgaggggggtaattcgtccggtttgcatagttgggggtgaagaatgtccgattttgtggttcagggggtaattcggatgatagttcgggggggggggtaattcataatttttcctaactaggtaactgagttatcctcgtagggaatttatctctaagtacaagcagtttttgccaaaaaaacttgaagatgatcaaattaagataagctcctaaaaatttgctaggaaggatttataagaaactagaaaaggcaatcaagtccttcttttctctactagatagcaagctagatccatagctgcaacga

SEQ ID NO: 15281 - DNA, 1501 bp, Oryza sativa
ctcctttaaaaatatattgatgtattttcaagtttttagttaatacttaattaattatgtgctaatgactcaaccttctcccgcgaacacaaccttagaataatcaatagatgtcttgcccctgctcctttctatacttaatgtcatatacacacacgagcaaatccaatgctaccatttcgtttaggcttatgtttatacgttaatatcaattttagagtttttttattgtatattattttaccgtatttatttttaatcgttaaagacatgtatatacaaattttacttctactactactattattacttaaaaaaaagtacagataagtattagcataagcaacacaacgagcccaaatagagtaggcctctacctctgtttatgttacaaaagggtcaggatatcattgttgattgcttctcgcgggcagtgatgatggatagttgcgggcgtacgtggcacatgacgtggatctgactgtaaaatcgatccaagcttgcacgctcggcttgcaattgacgcgtgtgccgcacacacggtgtcgtgactcgtgaccggcgtcgaggtgcacactaaaaagaaaaaaaaacaaaaccaaacttgccggccacccaaaccagcaccaacacgtaaagcctttctccgagcaaaacatccaaacggcaaaatataccccacaaaaactaaaaagtgaaaaagagcagagaaaattaggcaagctccacgtgtcgggcttcctccgcgccgccggtcacatccaacccaacccaaactgccagccacacctcggttgggaactggaatagtatgcacggaaaacagagcgatccattagcacataactaattaagtattagctaatattttttaaaaaattaattaatttgattttttaaataacttttatataaaaactttttttaaaaaaatatatttaatagtttaaaaagcgtgcgcgtggaaaacgatggagagttgtcggaaaactgggtgccgaacacaccccaacccggcaacggcaacccgacccaacctgcgcgcgcctccccgtagccgcagaacgaacctgatgccgcggagtcgaagcgacgcgagagcgcgcacacgtgttcttcagccaagccgacgtcccgcctcgctgcagatcggccgagatgccacgcgaaaactcgcgaagaaaacgcaagggcgaaaaagaagaacagagcagatcaggccgcgcaccgaccggtccacgtggaacggacggcgaggatgaagcgacgattatagtttgttattatagtgttaaagtatgaacaaacaaacccacgggatggagcagatgtgaaaagaaaaggaaggaggcggaaaaaaataaacaaaacaaaaattaaacagaaaaaaaaaaggaaggaaaggtggtgtagattgagccattagaagccttcggctttacggcttcggcgagaggaaggggaggggaagaggagaggaggaagggactggaaggttcga

SEQ ID NO: 15282 - DNA, 1501 bp, Oryza sativa
ccaatccaaacagtgcatcccggcgcatgcaaaagtgcactgcaagcaggaattaaaaaaaattaaagcaccggttcatgtcggtagtcgatgccccattgatacatatatgtgggagagattaattattttgttgctcgagaaagcatctctcgtttcatacatgaaatttaaatagttattaaatttttttgataaaataataagatagattaatatgaaatatatcaccttcgcaagaatataaggtcaaattttacttattcaagttgcaaaaatcatttgccgactggtcatttctttccttctgtaattaacttagattcttaacttcacactgtctcgatcaaacttgcatccatgctcaccgatcaaattcgggatagaatggcaggctactactccgggaactatgtatccctagtttgatctgtctgtcgctggctcgtcattctcacacctgatcgaacattgtctcgtgagactggacgagatcgatgtgcattgccgactcaccggagccattagtttttcttcctcttttttgtttggtttttgttgggggatcttattgttttccagccataagatgatcccatgagcagttgtccggtgattgagagacgacccagctggctggacacaattgatggatggatcgatggatggggatttgcattatgcgttggctggccatgcaccggcatcacgagatgatgagaattaactgctaataacttctcatcatcgtatgtatcatggatggatcgacgatggatccactcaataatgaaatggcatcaatgatatatatgctgcatggaaccatgatcgaattgtggaatatgcatgcatcggcaccgcgcccatgagatcatgcttatatatattggtgatgggttcattaacatatatacggatatatgccgatatgggatttagatttacaaatagacttaagataaataatagaaaaaatttgaaagtgttggagttattagtctttgcatcctcgattcctggatttatatttctatttgttaaccaatagaaatagatgtagatttctacctcgattttcattaacacgttcttgaaactgctaaataatacatattgtgtagaaactttgtatatagaagtcgctctaaaatattaaataaatatattttttaaatttgtaataattaaaacttaattaatcatacgctaatatctttcttattttttcgtacacttacttaatcttttatcttaattagtttcaaacatcggtcatgtaagttcttgaaagaaaaaggcggattttattacgacatcagttaagaattcagtaagaaaaagttagtgcgcatagtctttttcttgttttattatctagaaaaatcttcatgcggatggatcaagagatttatttaggctgtgtttagttcagcgcaaagtttggattttgattgtaattggagatgatatgactgaaaagttgtgtgtgtataacagg

SEQ ID NO: 15283 - DNA, 1501 bp, Oryza sativa
ctatagcccgtcacagataagtgtcatccgtgacgggctttagttttgtgccgatataccatggctgtgcgaccatatctcaatcgggcgaaactttggcccgattgagattacttccttgtgacggcccgcaaattccagtcttgttatgggccgtcacagatggaaggatctgtattagtgactcctatatactactgctactatactaaacagtatatacctattgactaaataaaaaacggtatatactccctagccgatcaatttattatatattggatacttggaaaaacagttcataatccttaaccgatcgatttaatacaataatagatacttgaaaaatatagtatatactggataaaaaaatcagtatatacagataaaaacagtacatactgctagtaaattaaaaaacagttcatacctagtaaataaaaagaggtatatactactgttactatactaaacagtatatacctactgactaaataaaaaacggtacatacttcctaacctatcaatatattatatattagatacttgaaaaaacagtacataatccttaactaattgatttaatataatattggatacttgaaaattttagtatatactggattaaaaaatcagtatatactggaaaaacaatcagtacatgcatactccttataccagtatatataccattcttaagaaaaagtagtacatacttctacaagaaagtatatacttctaaaaaaagaaaaataataaaagtagtataaacttctacaagaaaaagtatatcattccctagctaaagatattatacatatagtggttacaaagcagtatttatacgtactactactatgtaaacacaactactggagtacgtagtatacaatgctactgctattaaaaaattagtacgtatacactagtactaatccacgtgtttggatcagttctgtgcatttaaaatttgtaatgcatgcactcgatcagttagttgtgcattaaaactaaagaaaagaaaatgcattgttttaaaacagatcagattcaccatggccctattagatgctattggatcatccattaacaaaggggagtatatacacttgggtgtacagaagagtcgtcctatatatatatatatatatatatatatatatatatatatatatatatatatataaaacacaactcttctctttccatctgtgtttccaactcttatcttcacaaacctccaccacttattatcaattatgccagaagtaccccccccaaaaaatgccagaagtacactattaccacttatcacccatacgttttgaaacaaccacaacgttaatcaaatagggatatgttaatgagacatctctgggggaacagggaatttaagatcaacatgggagcgtggagtaggttgggtccaaaagggggaactccaacatattcagcatggctttcaagggggacatgattagaaatccaaatacccaatagt

SEQ ID NO: 15284 - DNA, 1501 bp, Oryza sativa
gtccgacccacctcacctcacctcaccggctgaatcactttccacacgctcgttgtaaggctggaccccatcatgttggaccatgccgactagtttctctttttttttttggtctcttttatgtggttttttgaaaaaaagggggaaaatgtggttgacatttgagggaaatgcggggaattttcgtagcggggaagaagaagaaggggggattgttttgcgttcggggttgtgttctcaccttgggttggtcatggcgccgtcgcggtcgtactccgcccggagcaacccgctcttcccttccgtcggtggccggcagacctgaaaaacataatattgtcatgattaattcttttttactttgcaaaaaaatgtacaagtcatttgttaagctaaaatattagtgatagtaaccgtgacagcgatgataataataatgatgatgaggaggagatttgtaggggcttaaggttggataagattgtgagatttgtgacaaatagatggtgagatgggactagcggagtacccttgagaagacgttcttaagctcccgtgtccagtcaccgagcgtcctgatgtggacgctgacgtagtcgtcctgtggggccgacgtgatggagaatgggtgcctgcaggtggggtcacatggtcagcatcacatccttatcacagattatatatatatacacatatatccagcttatctcctctgctttggcttagccgtcctaataattatataaaagatgatgctcaaagcattcccacttaaggaactttaattgcttaatcaaatcaactagacccacaggtgatttaattaattattagtccaaaaggcatccttatgcactatcctacttccattatatatatatatatatattctgataatccgatcggacggctcaaatcgatcggtgtgcttaccattggaacggcgagacggcggcacagttgacgaagatgtactgcccactcttgtacttgaaaccctgtggcttggagaagtgcagcgacagcacatttccggggtacaccgcaaccttgagtatcttcactggcctcacgctcgaccggagcgccctcgtcagcctctcgcacgcgtacaggaacatcggcaccgccaggtacatccacgtctgcgtccacgtcacccaccatcagcaccgccacgtaggatagagagacgagggcatgtacaatggactaatagataaaggtttagtggtacgtaccgttttcttgtaccaatccttggtaaggaagaggtagtagccgtggacgatgaggagggcgtagacgatgacgaagcagtggtgggagtaccagaaggcgttgaaccccgtgaggcggttgagcgggcgggggaggcggaggcggccgcggcggaaccacggcgtggcgagggtgaacgccaccgccatgagcaccagcatcaccagccccgtccacccctccgtccccttcacgaaccaccagtagttgggcggccgcg

SEQ ID NO: 15285 - DNA, 1501 bp, Oryza sativa
caagttggagatagtcttgttgggtcttttatttcttctcttattggagttggagccccttcctctctcctttcttcttcccaagagatcattgaaccttctagcaagaagggcaatctcttcctccaagatcatcaaaatagtcctcgatattggtatttttaaactcggaatcattgtcacttctaatttttacaagagtgcaactaaattcattttgggccctttttgtaaactttttgaaaagctcggcaacaatagacttatcatgcaaaaagaacacccaagtatagcgagaataatcatcaacaatcacaagacaatgactattaccaccaatgttcttataggttgttgggccaaacaaatccatatgcaagagctccaatggtctagatgtggacatgatatacttagtaggatgagagcatgcaacttgcttgacggcttgacgagcactacaaagtttatccttctcaaactccacatctttcaagcccacaactagatcacgttttgaatgtttgctcaattgattcatgccaacatgggctagcctcctatgccaaaaccaacccaatgaagtttttgtaactaaacaagttttcaaatttgctttactagaactgaaatcaaccaaataaagatttccatatctaaaacctttgaacacacaagacttgtcatggagactagaaagaataacctcttgcggaaagaaagcacatgacaaggcaatatcacaaatttgagcaaccaaaagcgaattgaaatttagagattcaacaagagagacattttcaattgacaaatcattggagatagcaatttaacctaacccaatcacctttcctttactattgtctctaaatgtcactttctcttgttcttttcctcctacttcaaatatggtgaacatagccctatcaccggtcatgtgttgaatgcatccactattaagcacccaatggctcccaccgatgcggtagttcacctacaagagaaaatcaagctcttttaggtacccaaacttgtttgggtccttggaggttagagaccaaagctttgggcacccaaatggcattctttttaccaccaagtataggggaacccacatatctagcaacaatactaccatcatgagccttcttaagcatataatgagaatcaaacatgcatgtcttggaaggcttactaccggggcaatcattcaccaaatgcccaacctcatgacacttggagcaatacttaccgttgctcttgacaaaacgagtgacacggtgagaaggtttcttacccttctttggaatgtatccaagtcccttattgttaaggatgcaccgttgctcactgaaaatcttgtcaagagtgttcttacccttgaagcacctctccaaactcttgttgagcttggccacttgctccttaagctcattgttctcaacaacaagtgaggcatcacaaatagaaacacaagagctatagctagagctaggcatat

SEQ ID NO: 15286 - DNA, 1501 bp, Oryza sativa; identical to SEQ ID NO: 14683

SEQ ID NO: 15287 - DNA, 1501 bp, Oryza sativa
gcccgcgccaccaccgcctccgtctcgccatgctccaggcgctgccacacccaccggggataccactgctcctggctctccataccatgcatgtagcccaggatctcgaacagcaacatgccgtagctgtacacgtcgcacttgtgcgtcaccggcaccggcttccacagctccggcgccgcgtagcccggggtgcccctcccgccgcccgtcatcgtcaggtgcgtcttctccctgtcgcacagcctcgccagcccgaagtcccccaccttgggctccaactcctcgtccaggagtacattgccgggcttgatgtcgtagtggatgatccgccgcgcgcactcgtcgtggaggtaccggatcgccttggcagtcccaacggcgatgcggaacagcttgtggaagccgaggccctgctcctgttcgtcgaggaagaacaggtagcgctccagcgagcccttgggcatgcactcgtacacaagcgccttgaggtcggcgtcgaagcagaagccgtagagcatgacgaggttgacatgcgacgtcctaccgatggtgccgatctccgccatgaactgctcctctgcgcgcctccccatgtcgctaccaaggaccttcacggccactgccagaccgccggggatctgccctttgtacaccaccccgaaacccccggcgccaagcctctccgcgtagtcgccagtcatttcccgcaactgcggcgagctgaacctcacaggccgctccttgatgacgtcaaccgtcgtcgtggtcagcgcggccacagcacggtcgtcgtcgctcctgggcctgggcggctgcgatgccggtaattccggcggcgagaggccgtacttgcgccacatgcgcagcttgcagcacttgtagatgagaatggcaacaacgatgactactatgccgcctgtgatcacggacactgcaaaacgcaaataataatcaaactatctagctagctagctatatgaatcgatcagatcgatcaaaaaggagctagagctagggaatcgatcaaatgatccatggcgcgtaccgatggctacggcgatgttaccaccagatatgacatctgacgacgacgacgacatgtcgatccaactggtcgagttgatggaagcgcccaggtccagccgtggtaaaataaataaatttctggctatgcaattaccacctagtagaaggtagatggtcgcttattgttcatcatatcatctgacttgtagtaattaccaacgagtgattgattagaacaagtcaaaattggctggctggctagctcgacccaccaccgccagaggatatatatatatgatcggtcgtgttcgtctttgaccagccggcctgtaagcaattaattctgattattactagctagtaccaccaattagcaatcaccatctcgtaattaagttaggagtatttggagaagtagtacatcaacaaagactacatgaaattagtattattaattttcagctatagatca

SEQ ID NO: 15288 - DNA, 1501 bp, Oryza sativa
tggagctggacccgtcttggtcggacccggccctgtccggcccgttgcaagtgggcctgaccgcgtggtacatgggggttggccggtatatgggccacgggtgcgactccggcgacgcctccgtgctgcttccgccgccgccgccggcgggatgcggatccgccgcctccggcttcacgtccgcgccgccgtgctcggcctgatcctcgccgccgccgtcttcgtcggcggcggcggcggcgtcgtctcgcgtccgcttcaggccgatggagacgccgaacagccgcgcgctcgggtcgggctcgccgtctatggcgagccccgcagcggcggcggcggtggccagggcggggcacgagggcattagatcgagtatcgccggggggagaggcggcggcgggggaacggcctccgacgactcgccggagcagttcgctatggaggatatccccgcggagccctccacgtgctgggtggcggcgtacttggacatgaggaggaggatgttgttacagagcttcttcatgtggccgagctcccgcgtcagccgcgcgttctcccgccggagccgctcgttctcctcgcccatgtcgccgccggacgcggagccgccgccgccgccgccgggcgcagagccggacccagacgcttgccggtgctcctcccccgacccagagtttgacgacagcacctgctcctccgaggagtgcgccggcgagcccgcccgcgtcaccggcagcgccataggtatcggcgccgcggccaccgtcacagctcccgaagccaccgcggcagctgccgtcgccatccccggcgacggcggcggcggcgccgcggcagccgccgccaccaccttccggcggtgtatatcacacaacaaacgcttctcccctcgccggaagcagtcgttggcgaactcccaccggtccggcacgatcttcctaaatccctacgtcatacagcaagcaagcaaaatccagacacatcaccgacatggccaaaccaaaccaagctaaatcccaagcaaacgacgacgacgaggaggaggaataatcccgggggcgcgtacataggtgttgagctgtcctcgttccacgagatcacgtcgtccaccgccgggtcctccaccagctggtacgtcttcgtcaggaacggcgtcggcagcgacctctgccccgccaacgcctccgccgccgccgtcatcaccgccgccggcggcgggctccccgccgcccgcatccgcctcgcccgccccctgctccgccatccgccggggaggcggccggatctgatccggcgaggaccgaccgtagtagtagtagcttccagatgccggaagaaaggcagttttcgcgtgtgaaaacgaaggtacggaccggaagtcttctggaaacttcgtttgcggattaggaaaatttatactccaacgggaggaggagaagcaaagcaagagagaaacaaataaaaaagagggaaaaaaagcaccaaaagaaaaaacgat

SEQ ID NO: 15289 - DNA, 1501 bp, Oryza sativa
ttcgatcgaatcgaatagcataaaatgtgatgtgaagtggcacggctaagggaactacttcctccgtttcctccgttttaggttataagactttctaacattgtccacatttatatagatgtttactccctctgtcctaaaaaaaaaagcaaaccctagttttccgtgtccaactttgactgtccgtcttatatgaaatttttttataattcgtatttttattgttgttagatgataaaacatgattaatattttatgcgttacttgtctttttaattttttttataattttttcaaataagacggacggtcaaacgttgggcacggaaaccagggtttgtcttttttttaggacggagggagtatgtgtctagatccattaacatccatatgaatataggcaatgctagaaagtcttactccctccgttttaaaatatttgacaccattgactttttagtacgtgtttgaccattcattttattcaaaaaatttaagtaattatttattcttttcatatcatttgattcattgttaaatatactttcatgtacacatatagttttacataatttgttttaataagatgaacagtcaaacatgtgctaaatagtcaatggtgttaaatattttgaaacggatggaatatatagtatgaaacggaggtagtagtaataagccaagttggtcaaccactgctatataattcagctatagtctcgaacacttgtttaatcataataacaaaaggtcttcatgttgccctgttccttcactactttttctttccttttctttttctaaaaagcaaacagtctcctggcactgtttcagtttaataacatacgtactccgggtaatctaaacagaaagaaaagatagtctagtactactctactaatggtaaattaatggagattaaccacagtgcatggtaaagaatttctggctttttattattaacacatgtatgagatctaaagaaaaaaagtatgatatctatctattgtacccttcttaaaccggaagcaacatataaacatttttgtaatatgtccagttgtctgcacaaaagttaaaagcaaaaggcaacaaaacaaggactcatcttgatttttttttgtttcttttaaacaaaaaagaaggcctgggtattagccaagctaggtggccttggaatggacagcaaaaggcagcgatgatagctgcagcctccctttgtgcagcacacactgcactgcagcattgcagcaatcctcctctccaaaagcaggacacaccatcactagggtagtagaccaccagcacaccgagcctccctcaaaagcaagcactgcatgctttcaacataagcctagcctctagccatccatctagctcgatcaccacagttcttagccgaagagaaagaaagttaattagagagttcatatatagctgaagtaatcaagaaccaagaagaggagaggaaggtgatcgaggaggaaggaaaggatggtag

SEQ ID NO: 15290 - DNA, 1501 bp, Oryza sativa
cggaggaagtagagtggcagaaggatgagcggcgactagtggcgcaggcggaatgaggaggggcgaccggcggcgcgggcggaaggaggagcggctaccatcggcgcgggcggaaggaggagcgagtcagaggcaacgacgatgcggaagtggtggccggagcactcacccttgcccgccatcactgtcgccgccatcggagccctccacaccgccgcagccctcctcgctaccagattcgctaccaccgccctccccgcctccggattcgccaccgccgccatccccgcctccggattcgccaccgatgacgagccctccccgccctccctgccttcagattcactgccgccaccctccccaccaccggatctgccgccatcgtcatcactcacgatgggtggaggagcaagatgcgagtgagaggggcgagcgagtggcgtgcgacggtgcgagcgaacgagcgtggcgaagcggcgcgcctcacgccgtgcgctcgtcccaggtgggacgagctcgtccacgagatttttccggatggcttggttccggatctgagaggaatattcctgtccaggaaccaacccatcccactcacccctaaaccaaacacctttaaaagtgggttcgtcccatcccatcacatcctatcccaccaaccaaacactaccttaaagaaacatcagtgacatctccatcactccatcagcgagtccatgccagattgccaggtgcccggtactccggtagggtcagggcggatagctagggcttgagctctaggcctacctttaaattattgtttaaattttattaaaataccgtgtaatttttataaaggaaaatcaatgctccattagttaagttatatcttagctatagccttcaaaaaatttttgacttcgtcacttataaggtggatgttgtgagctcgtcatcagatcgtccacggcggatggcgtgactggagttggcatcctaccaacctgcacagctgaactgcacgagaacctcgcctgattgttcttcaccttctcatcaccgtgcagtttcacctgtagtaacatcagtaaataaattattcaccataggctgttcatctcaacaagttgtccgtgcaatgcagccgagagtaggcaaaataaaaaaaaaagaaaaaaaagagagagagggtaatttggcctttgggtcatcgcacacgatccgaggcttccccccatccacggctgccggtttttaacctcacctactccgcgcgcgccgtcacgcatgtgattttcgcaacatttcctcgccgttacccgcataatttcctcgagccgccgagcccggtggaaccgggtgtgaagtggaagcccagcgaccgaagccgaggaggcgacgcactcgtctcgacgcaacggcgggtgcggtgccttgtgcgccgtgacagcgacattctttacctgcccaaccccaaccccaaccctctcctctccgcccacgcctcgccctcgcgctc

SEQ ID NO: 15291 - DNA, 1501 bp, Oryza sativa
ttattaatgcttaaataaagggttacacttctaatttaataaatctagaattcttgcgaaagcacacaacctccactccgcgcaggacctagaacacattgccatttatgctaaaacatgtgctaccctatttgcttatctctttatcgatttaataaatctagaattcttgcgggagcacacaacctccactccgcgcaggacctagaacacattaccatttgtgctaaaacatgtgctaccctatttgcttctctctttatcgatttaataaatctagaattcttgcgggagcacacaacctccactccgcgcaggacttggaacacattaccatttgtgctaaaacatgtgctaccctatttgcttctctctttatcttgtgcacttgcacttgctgaaggcattgcatcactcctttaatctcttcaatcgtcgtcgcccaggccgatttcaactgatcatgcctcattaaatctttaacaatttctgcattgtccatctccagcacgttaattatattggcattgatttgtacgtgtacgtactacgtactatctacctgctcgtgtgacagcaacatgcataatgcattggtagctaactaggctccaaaatgcagcagataatttatgaatgtactaggctaaccgaatacgtgcacgtatgccaaaattgacagcctgaatattcgggtgtgtgtgtctccagcagtagttcttctcgatcgacgaatctatacacaactacgtgcgtatagagacactcgtcctacttagtactcctgccgtacgtatttattgtacgtactcccttcagttggattaatttcatgagaaaagcgagagtccgatccgaatatattcatgtgggttgatatataagtttttcatttagcaactgaagacatgcttggaagtttgaaagcgcgcagggagtttcgcagcaaagttcactgcaaatgattagatcctaattcccagacaggaactaatttcaatttgtctgctacaacggatatgtcatgagtatacacggttgaaaaaatatttcaagattattattcgtgtagtacatgcagctagcatatacttatacttttgtgcatgcatggcaggcaaaactttttcttgcccgcaggctaatacagcgaacagtccacttgtaaagctgttgaaaaatccggaccaaacctgcaggggagcactagtgctagtctccgatcagaaattcgccaatagcatgtgatgtatgggcccaagctagctagcgtccatgcaaatagggtttgacacagataactatactacttattcacatctgagtatgcatcaatattaaaacgaccgaactaactaatcccattgaaaaaaaaatgattccacctattgcgtggcgtccctttctaatctttacacagacaggtgcctatgagctgtctaattcgtaaacctctctaaataaaactctagcttcagacacgcagaaatgttatttttat

SEQ ID NO: 15292 - DNA, 1501 bp, Oryza sativa
acatatccaaaatagctatttttgctattctggcttcacactagccatcaataatattttcatgactttgagcagtgcaaacaagtgtatatataagatcatgaagaaactaattaatttgacagtgtaaactaacttaggatcaagatattcatcggactgaaaaaatgtcattgtttcttgatactacatgaaatgaacactgaatttgtatatgaggcaccaattgtggaagttgtaaatacaaaaacaatcagtcaactgagtacaccttcattttgtgcacaccaagagaagcgagctgtgatggcatgctctcttccttggtgcgcaaaaaataagttcactttagcctgttggatactaggatatgtacaatttttctgtggaatttatcatcgagtcatttcaagcacgaaaaaaattaagtgacggttaatttaacaactagtgtctagtagagaaaaataaatgaattcagatcaaatggtatgggtagcttgcttcatccaacaccagttaagtattctaacaaacaagtatatacactaagagcagcaagtgaactgcaggcttcaacagcaattcaattcctgcattgccattcttagcccctcccaacacctcagtaattctgtactcactcattacaacaccctacaggcgcattacatcacaagctggtcctaccacagtcaagctacaagccttacagaatttcatccgtgacttctcacgcatactagccttgaaccagagcaaacgcttacttatacatcataggctacgccatcgcataacaacaaaataccacagaaacctgccgcaatcctcttcctaccagacgcattacgccgaacactaggcggccaggggcttacttcctagccggaggagcaggcgcctcgtcgccggaggcagtcgcttcagccacgctgcagttgagtcggagagtgcggaggcgggacgggagcgctcctcctcgcccaccacccctcgacctgcgaagccaaacaacagggaggaaagttagggactcggaagcaaagcagaagcagccgctaggtctcggagcacggcggagcgcgcggcgtacgcgaggagcggcggcgggcggtggaggatgtgggagaggagcgtgcggctcatggcgtcccccaccccggccggcgtcgcaccgccgcacgcgtcggatttggctgcgcgtctttgggtgggagggggaagtggaggacgaaggagacgacgagccgcgagccgaactgaggttggtcgggttttgaggccggagatcgctcgggccggctcggtggaggaaaaaaggcccacgattttgccaatccagccacaggtgcggcccggactggccggcccggccccgtgtaactctccagaaaccggcctaaccgcgggggttacgtggcgccacctctcctgcgacgtgtccccggacaagcgggcggcggcgtcatcgtggcctcggcgcccgccgcgcggcgcg

SEQ ID NO: 15293 - DNA, 1501 bp, Oryza sativa
cgaggtccctctccacatgaggtggccgctagccaccgggtccctctccgcacgagatcgtcgccagccgctaggtccctgtccatgccgaggtcgccgcacccatacatccctccccacgctgaggtcgccgccggtggggaggccgcccatcgcaggcgacactgctcgccagttaggagggggcgggaggggagtatggcggatcggaggaggaggagaggggggaggggggccataggggagggggaggggagggcgtggcggaggaaggggcgagggggagagcgcacagaagagcccgggggggggggaggggataaggataaggatcgagcaacgcgcgtagataggccaggtcgatcggctcgtctcgcctagatcggcttgatttagaataggtgctggtttttttacagaactgatacctataatatattataggttattatattataggtgttagttttttaactaaccgtatcagttttaactaataaaccggcacctatatttcttaattaaagatatcggaggtgggaaaagacttataagtatcagttttaaatgaatcggcatctataagccggttggttttttagtagtgattcaaacgaacacacacttagttcacttggaagccaatcatgattaatttgtatattgcagtccggatcatcaatctgctatcatcgatgggctttagaaatcaggcatgcttttatatgtttcagtcaagtaacgtacggcatggcacgcatgctacatgttttgtgagatttgcgaaaggaaaaatgctatgcgtacttatcaatgatctaacgtgaataagacggacgtacggcacaccattaataaacgcataagcgtttcatagtacgaatatcgtaaacacccagatcgtacgtatagcagcgttgatttgtgaaacaacacactgcagtctgcaaaaccgttcagttattttgttcagggtgttcagagtggtacagtgtgcgctgaaagcactagttacacggattagacaaagccagtgtacgaatgagcatatgtacaatttggttgtaattaagcagcacaatgtcaatgcctcatagatttttatatataggtaataagaacaaatgtcatctgcgttactgctagtggcaaatgttttttgtcatcagtctggctgtatctgctgcttttttgcgatggatgcatggtcaaatgcctgagctcgagtacgtggtattgatacttgacctggccttatgcagcatcattatcaaatattaaactcacatatataatccaaacgtaacagtcaggccaagtcagaaaatttaaaggttcactagcagggatttatccagcaaaagtcataatgtgtttaaaaccactccattttgtattactcgttcgcgaagggcaatactgctgcatctcgtcacactagtacatatatttacatatacaagtgtcattttgcaatatataattgcatggtctccctgcc

SEQ ID NO: 15294 - DNA, 1501 bp, Oryza sativa
ccgctccccgccggcgagcgccgcctcgcccggccgtgcttttgcctccaacagcttcgccgcgtcgtgccacaccccggcatccactccgtcctccccttccacccccgcagcaccattcccaccgtgcaccgagccacagccgcctttcgtcacctccagtcgcgcgccaccaccgctcccgtcgctgccgcgctgcgctaccaccgccatcggcatcgccgttcctcgccgcaccccggcccctactccgtttcccctccctgcccctggaacgccgccgccgcgttcaccatccctttccgccgccagccgcctccctgtggtcgtctcgccgtcgccgtcctcggtaagaatccccaccgtcccttctccctttttcctcctccgccgctccccgtgcccgctgccgcgacgcgccgctgtcgccggcggtcgtctggccgcacgccgccgcgcgctatcgctcggccgagccggtttcatgccgtgcctgtgccctagccgcgccgcctcgtggccgtccgatcggcttcgggccgatctgggccatccacgtggtggacacgccccgaggccacgtgtggacttggtccaccgtgcgccgcccctttgactcgctgacgtgtggggcccgcgtgtcggcgccggccgccccttgctgacgtcagcgagatccatttcctttgtaaaaataaataataattgcgcaataattcgtaaataattatagaaattcatttaaatggctcaaaacttctaaaattcatatctaattcattcgaactccgaattgagccattcaacttgcaaaattcatctaaaattgagctctacatgtttgtttactttttatgtactgtttccttggtttttattagagtttttcctcgttttgcgtgccagcgtgtagtttccgtcgtttcggaagtccgcggtcgcgaggaaaagagttcggaagattgtttgaagaagcaaggcaagtcacacattccccttgagcattttgatcctaatttacaaatgttttactgtttgcaaataaatatgcatgttttgctaattacacgggatcagggtttacctatctgctcgcttgtgccatgtttacttgatatctgttctttgtcaaccttgggtaataaatcgaccagcttgtgttacttatgtgacctagctagaactatatgcttagccatgcttaattaccactagctcagttgatgggataattacaatattagacctttttagtatcagagtgagctgcgtgctcgagacacctggccatgcttcatggtcgtaattatccaactaaaatgcgactgaatggtgggctgtgggtgcatggttttgctggtcgcacccatggcagttaaggaccggttcgcgggatgccctggaagaacttatcgtacttaccacaagccagcgtgggcaacggctgggcttgtagtgtagctttcctctagtcgacgcatccaggcaagggtgggcgtga

SEQ ID NO: 15295 - DNA, 1501 bp, Oryza sativa
acaaatctattgagcctaattaatccatgattaacatatgtaacgctacagttaacatgtgctaattatggatgtaatgctaattaattaggcttaaaaatttgtctcgcgaattagctctcattaatgcaattagttttgtaattagtctatgtttaatactccaaattagcgtccaaacatccgatgtgacagggactaaactttagtccatggatccaaacacaacctaagtagcattaacatataattctgcaacaacttagtacaatatatctatcaacggttttctcagccatgcattgattcataattaatctaagccctagaaatatatggaatcctgagctagccatgagcactgtgcacgcacaacactagcaagaactagctagctagccagcagctacacgatgcgccaccaccgccttgctgtcccggccgccgccgtcctcctcctcttcctcatccacgtcgtcctcgtcgccggcgacgacggatacgcgggtgcaggaggcggcgtcgtccacgccgccgtgctgccgctgccgccgcggcagctgctgcaggaggtggcggcgccggacgatcagctcctcctccggccggcggtggtgggcggcagcctcgccaccaagccgccgccgccgcgcggcgccacggggtcgctcatccccgaccggccggcgtgcccgcgcggctgcgccgcccgtgggcgtggggcggacgcctacacccggccgtgcacgtatgccaacgggtgcatgaaggggcggcggccgtgatatggtatcgcgatgcggcggcgccgcccgccgccgccggccggccgggcgccgcacgcacgcacgcatgagatgacgagatcgaccaaacaaattaatcgaataatcgtgcaaattaagctgtagctgtacaactacgtactccatgttaaagcgtgatttgatcatcagtcgactgttatatatatatatatatatatacacacacacgcgtgtgtgtgtgtttcactgtgcttcgatcgggttaattctcacttctcactgcactttgatctctcgatgcctctcgatctaccatatatatgcatgcttttttttcccctaagaaatactcactccttccctaaatgtttgacgccgttgacttttctaaacatgtttgaccgttcatcttattcaaaaacttttgtgaaatatgtaaaattatatgtatacataaaagtatatttaacaatgaatcaaatgataggtaaataattaataattacttaaaatttttgaataagacgaacggtaaaacatgtttaaaaaaatcaacggcgtcagacatttaggaatggagggagtagtacagtgcaaaagttgacgctcacaacacttcgtatacttacccttataaacacacgtgcgtacaccttattcttatgagcacttatatccgagagattttgaaattgattaaattaccacgaccgcttatgctttgcttggcgttg

SEQ ID NO: 15296 - DNA, 1501 bp, Oryza sativa
cggtctcggaggaggtgccgcgggggaaggacgggaagatgctgccgctgcttctgctgccggagccgaaggggaagccgtcgaaggggtcccagaggtcgagggagaaggggtcgaacacgttgctgcggcggatcagcgacattgtgtattgtgtcttgctgttttttggttgtctggtttgtgttctagatggaaagagggtgatctcaattctccagaaaggctggtgatttttcgatcgaagaactgaattccttggcaccctggcggtgggtggtggcaacaatttatatagcagttcgtgatggtccatgggttctactggaagttttgcttccggatagttctcgtttgttcgttaatttgggccgaaattggaagtggtcttctggattgttctaggcctgcttatggcctagattattctggagagtcctggacgctatgggctacagcccaccccgctaccggtggtgtaaacttctagcccaagctatctcgtactaggttctagcccatgcgggggcaaactggaagtttctagaagcttattccaagctccacgatgccctctcgctgccctctataaaaccgcgctccccttcaccggcagaaccacgaagaaaacgcaaagcaaaccaagcaaacatcagagtaagaactcagagaagtccgatcgttccacctccaaattcgcagctattccgacgatgtcgatgatccgccgcagcaacgtgttcgaccccttctccctcgacctctgggaccccttcgacggcttccccttcggctccggcagcggcagcctcttccctcgcgccaactccgacgcggcggccttcgccggcgcgcggatcgactggaaggagacgcccgaggcgcacgtgttcaaggcggacgtgccggggctgaagaaggaggaggtcaaggtggaggttgaggacggcaacgtcctccagatcagcggcgagcgcatcaaggagcaggaggagaagacggacaagtggcaccgcgtggagcgcagcaacggcaagttcctccgcaggttccgcgtgcgggagacaacaaagccggagcagaacagggcgtcatgggagaacggcgtgctcaacgtccccgtgcccaaggaggagcccaagaagcccgacgtcaagtccatccaggttaccggctagtaagaaacttcgggtgtgacatgcacggtggagagcttcgattcgagccttcggtttgtgatcaattgcagtaaataaaagcgtcaaatctggtcctcagtgtttatgctgtgaaaaagttcaaagctatgttggaagtgagcaataaagacttttcttgttttgtgaacgaacctgagattatactagtcctacacttgtttgtttaatctaatctccggtatattctgccatttttatctcgatgtttcagtacttttagcctttggttcttgaatccttctgtcgagactggagagttcatttcggaaattgagagctca

SEQ ID NO: 15297 - DNA, 1501 bp, Oryza sativa
tggaacaacacactgacccagtgacacgacgcgacacacgactgttcaagacagacacggacacacactggactcaaccggacccgattttatttgctccttcacgacagacaaaccaggccaaagcgaaaaccccgccgtgctcctctccgtcgcgcacgcggcacgccggcgatgcctagccggagatctggatggacttgacgtcgggcttcttggcctcctccttgggaaccgtgacggtgagcacgccgttctccatggacgccttgatctgctccggcttggcgttgtcggggaggcggaacctgcggaggaacttgccgctgctgcgctccacgcggtgccactggtccgtcttctcctcctgctccttgttgcgctcgccgctgatctgcaggatgttgccgtcgtccacctccaccttgacctcctccttcttcagccccggcacgtccgccttgaacacgtgcgcctcgggcgtctccttccagtcgatccgcgcgccggcgaaggccgcggtctcggaggaggcgccgcgcgggaaggacgggaagatgctgccgctgctgctgccgccggagccgaaggggaagccgtcgaaggggtcccagaggtcgagggagaaggggtcgaacacgttgctgcggcggatcagcgacatcgtcggttggatttggcgcttacgactagtgtagtttcgcgaattggaagcggatttttggaagcttgggctttcgattgctggcttcttttctcgctttgcttggatatctgtcgaggaggggatggcgttcttatatgcggcgggggaatgataaggatggagaggaaagcagcttctcgatagttctcttctattcctggatagactcgaaaatgctggacttggttctgggctcggtagattacgaacggaacagttcaggttaccagcacgacccgaatcgtccagaacaaactcgagggaaaggatgctctgacttaactgctgtgtagttgagtcactgatatgtgggccatagtaaaatggggcccacatatcagtgactgactcaagtgcagttaattctctgcttccaaactcgagatatccagcaacttccagtccaaaattggagtgcttgatccgatttttttccttgaagacaatgggaaggaaatgaccaccgggctgggcttctcctagtcagtggcccatagacacagtgtgtactcagcccatggtacaagcttacacaaatgggctccggcccatcgtgaaactggcccacgcctacccaaacgcacgcactggtccgaggactctcgacttctcgtctcgagcctccccttcctcgagttcggccaatgtccacggcctagcgatcccggcagctggaggcgacgagccgacgagcagaggcagagggcgcgggaggagagagccagagagaggggggaagcgtggcgagaggaggagcagcgcgggacgccgccgccaccgccgcagcctcagcca

SEQ ID NO: 15298 - DNA, 1501 bp, Oryza sativa
attatagaaaacaacacatcaattattttcatcattaaatctacatggaacaaaccaatgttaagaactgtcatgtggctgattatacagatcgatcgactgtttgtggtaaagcacaacccttgaataatctctcattataactctcatcaaatagagctcagcaatgtaggatcaggttaattccatagagtgagaagagatatcgattggggttttagggatttaccttgtgatgcgccttgtccaagtccatgatggcctggtcgatctgcgactgctgctgcggatccattcccacaagcgcctccgacaccttgtcgttgatcacccgcaccgcatcggcgaccgccctggcgagcagcttccgcttctcggcgtccctgacggcgtcggcggcggcgccctcgggggcgtccgcggcggccgcggaggcgcggtgcacggccttgttggtgtggaggctgacctccacggcgggctccccgcggccgtcgaggatctggcgcgcccgcacgctcgtgatcacggccggcgccgcccggcgcatgtggttggagatgaagagcaccgggtcgggggccttggcgcggaccgccgcgttcacggcctcctcgatcttgcgcgacagcaggtgcttctccaggtactcctgcaccgacatggctgaggctgcggcggtggcggcggcgtcccgcgctgctcctcctctcgccacgcttcccccctctctctggctctctcctcccgcgccctctgcctctgctcgtcggctcgtcgcctccagctgccgggatcgctaggccgtggacattggccgaactcgaggaaggggaggctcgagacgagaagtcgagagtcctcggaccagtgcgtgcgtttgggtaggcgtgggccagtttcacgatgggccggagcccatttgtgtaagcttgtaccatgggctgagtacacactgtgtctatgggccactgactaggagaagcccagcccggtggtcatttccttcccattgtcttcaaggaaaaaaatcggatcaagcactccaattttggactggaagttgctggatatctcgagtttggaagcagagaattaactgcacttgagtcagtcactgatatgtgggccccattttactatggcccacatatcagtgactcaactacacagcagttaagtcagagcatcctttccctcgagtttgttctggacgattcgggtcgtgctggtaacctgaactgttccgttcgtaatctaccgagcccagaaccaagtccagcattttcgagtctatccaggaatagaagagaactatcgagaagctgctttcctctccatccttatcattcccccgccgcatataagaacgccatcccctcctcgacagatatccaagcaaagcgagaaaagaagccagcaatcgaaagcccaagcttccaaaaatccgcttccaattcgcgaaactacactagtcgtaagcgccaaatccaaccgacga

SEQ ID NO: 15299 - DNA, 1501 bp, Oryza sativa
gccgcggatgtggatgggaggaggcggagaggagggagaagggggagcctggtgccgtggagtggatggcgtttcaggtttggccgttgggtgtggaggttgccgtcaccgctcgcacctcgcagtcatccccaacggaacggcaccggggcccgcaggaatctgccatgagggcccagattccccgtgcggttgggcttgggcctagaatgagacgtgaatctttcgtctctccatctattcggtgtctgtctcttgggccctccgacacatatcttttttttttatcttttccaacacataacttctatcgtttcgtttgtgcttgtatttgttcgtactacttaggttgagtttgaggaggaggagattgggaagatacataaaacgaggtgagctattagcgcatgattaattgagtattaactattttaaatttgaaaaatagatttatatgaatttttaaagcaacttttctatagaaattttttgtaaaaaaatgcaccgtttagtagtttgggaagcatacgcacggaaatcgaaacaaactcactcattttcttcagctgccgaacgcaacaaattaagaaattatctataagtaaaaaatttatgtgtatgtacttagtgattctaaagcaaatagtataaaataaactacgtaaaaaacacaaaatctacttcggaaggtataagcgaaacaataaagctacaagagttccttcaaatttgagcaaacttcaaagcagtgagttgttgctctatggcaaaatcatacgtttatattatggaataaggagtagaattttcttgcctctatgttcggtggatctcgcattctgaaatccagcaaccagtagcagtctagcagtagttttggataactcaaaaagtaaagtacttcttgttagaattaaattagctaggtctaatttaatcataataaattttatgggtctataattaatattaaaatattaatatcaccttaacaaccaacgagaccagtataccacctcgaattaaatacacactccgttccaaaatataaatatttttagaatagtgtaaagtcaaatattttttactttgactattaatagaaaaaataaaaaaagaatcaatcatgtaaaattgatgttactagatttatcattaaacaaactatcataatatgtaactcttttatttaaaaaatcttacttttatagatattattggtcaaaatagtatctcacaaattatgtcaagatccaaaaatacttatattctaggtcaaaggtagataagatcttcctccttgtctctttggttccatttctagttctccttgggtagactctgttgttttgtttatgtgtagctcaggctttccacggttttgttggtagactcttgttgttctgtttttgtgcaactcaggctttcctcggtttctgggtatttgcgcacatgggtactcgggacgagcaagcctccggaactttgtcagttggagtac

SEQ ID NO: 15300 - DNA, 1354 bp, Oryza sativa
aaaaaatgttcgttaaaaagaaaatgtgtagcacaagggaaaacaaaacttgcataatcttagtgagaaggtacggtataattttgtcgcaaaaggataatcaatccgcacaattcaaaattagcttttaaattatgtgatggataggacctgataatttaaagctataattttgaattcaaccctccagaacagataattgctagcctcacgtcttctttatatgtattgatccgagatgcattgagtacacaatatgaggtggaaaaaccacctagcctcggcaatgaagttggtggctagcttcgagagcagataacgactcgatgtggcttgtattgggttgagattttgatatccttttttctcatgagtggtttatatttgtcatctgaaacggtctctttgtccaaactcaaaactagcttagaagctggagagtatattgggatatgacccgagcaatactaattgtcccgagtcggactagataggcattaccttctcatggttagttttctttttccagagacatactagatagctattagcttctcgtggttagtcttttctttgttacgagtacctgtgaggctgtgacagactggatcgggcattcatctatcatagtcataaagcatcaaggtttttgctgtcgatgatatgctacctaccattataaaaatatttaaccgtaaacagcacccgtgtcaagtctataaacataaaccagggtgagtaggttctaccaccggtcgatcacttggcaactttcttatccctatagaaaataaatcaattgtagtggagtggctcccacgcaaagactacacaccagctacccatataactagctaatgctgtacactcctcatgcttaacacatggccaacgtacacgaactcggaacatcgaccattcatgattcatgaatgctagcaccgcgagcatccatcacgcgcgtattaggaaggatacataggatagggagatagagatcgaatcccgaccactcgatcgtaggcatcccatccatccatcccaccatcgatctgtgaaacgtcctcgtctcgagccgcatttgtgctgtggtctcaacctaaatctaccagctacgtactcctagcttagagcatctgcagcgttgggttaaatcgtcacgtgcgaaagggcctgtagcctagtggttacaagagcctcagtagcacctgaggtcctgggcagtggcggatctagaaataaatagtagtggggtctgagcaaactagataaagttacagtcctccctcccatctacttatggtaaaaaattttagtggggtcttcgtggggtctctcatagtcttcacgccag

SEQ ID NO: 15301 - DNA, 1501 bp, Oryza sativa
tttgcatttcagcagcgttgttggacggctgatcacctccagaagcgtggcatcgattcagcagcgctgtcggacggctgatctcctccataagcgtggcatcgatagccactcggcttgccccttttgcgctcaggagcttgagacggcgaaccacatcctcttcgattgtgtgttcgcttgttaggtctggttatgggtgttgtcccctcctggctgggctgccctctccccgccccccctggtggcactggctccaggactggtggccatcttctagggcctgtttacctgaacgcctccgtaccggcttcgactccctgatccacctggtctcttggcaactgtggaaggaacggaactctagggtttttgactctgcactctcttcggtctcagtggttttagagtccatcctttcggaaggccggctatggtcgttagcgggcgttgcttcctttggggatttgttgggagtgtagcgtgactctgtcccctcccactgattgaagtagcattacccgtcgtacgtgtttttctttttcttccttgctttttgtctttgttttcttccacctctaggcataagctagtctggctgattgcgttgtgtaacaaaactcttttcttctaatatattgacgtgaattctttttgtgcgttcgtgaaaaagtgtttggctagttttttctgtatttttgtggagtagctgtacgtagtcttactcttttgctagtcttgcattactctataggacacagttctttaattctctattgatttgcttcttgctatcttgacttaaaaaactcacaaactttttagggttttattgtaatttaaaatgagataggcaaaacactttattgacgattacatattttataatcacatcaaaaggcatcttgttatcacgattggagtcatcagtctgtactgaaaactaatatgatattttacttttttttaagtcgaataagccaatattttttcaagagtaaagtccatcatcggtccctaaacttgtaccgctgtgtcatcccggtccctaaactcgcaaatcgaccgttcaggtcctcaaacttgttcgattgtgtcatcccggtccctaaacttacagatcactcgtttaggtcctccaacttgttcagttgtgtcaccccggtccctaaataagacggtctaaaaactttatatcaaaaaataattcataactttttcatgtaaactctaatgaagacaaactttatatcaaaattgtagccctagacgcgacctacaactttgtagttgaaaagtttttgaattaaaactgtttagggccccaaaatattattgtatgtttatagattttgaaattttaattttaaaattacattttgggacaaaaaatgacttaaaataaaaaaattaactacaaagttgtagatcgcgtcgagggctacaagtttgatataaagtttatcttcattagagttcacatgaaaaagttatgaattat

SEQ ID NO: 15302 - DNA, 1501 bp, Oryza sativa
gcggcggaacaaaagggcctaacacacggacggctgctgaagactgcctcctctactcctcgtcggcctggctgccccctgtagtcggctcctcagtcgaagaaacgtcgatcggctggcgcgaagggaccggcggaacctgtcgagggccggcagcagcacgggccgctggcggtgggggagctgggtggcggaaacggaacacggtggaagaaccaacaacacgcttccgtgcagtgcggataaagcgtgggccacggcgggaggaagcaactggagtgtgtccgggggtgtaggaagggctaactgggtgtgggtagggggagtacactggtgagtacggcgcacgcgagctgggggagcgcgggccactgggagtgcgagcagagccgcgggagctatgggaggacaggtggctggcgtggcagaggcggcctgagtcccaagagatagtgtcaactgaggtgacaccctcctcggccagacgggcctccaaagtggcgtagcggcgggcaagggagcggtaagcctcaaggagtaggtcgtgctgagtggcctgagcctccgaaagctcgaccatgcgagtcagcactggctgagactcgctgtacggacaagggtacctggcgtctgagtggccagaaggaaggcgtggaagctgccggaaggcggaacctccgagacggtggctgtagtcgtgggccaggcgacgaagcgcattccaggagaggtcctggtacgcgatctggagagtgggcctggccacagtgaagtggtgggggcgaaggccagctccgtgtatacctccacgagggtaaaggtacacagagagctcacagtgagggggaacacggtccacggagtaccccgtgtactcgggacacgagaagccaaggaaacgggcgaggtcacgaagctgggcgacgtggtgaccctcaccaaaaccgtgggaactgaagctggcgttcacttccatctacaattttgaaagagggagaaagatcagtaaccattttagaaacaaactattgaaaataaagaaaacaaaagaaaccttagcttttcgcaagtagttttgaacttagtatccttagggtcgtcctaagcgtcgggtttcgccctagggccaagcctgtgctctgataccatctcttgtcacgccccgaaatagtcccgaccggaactagcccgtgacgtttcaaattaacctgttaatcgataccagtcctaggaaacagtgctggtatcacagggagacagaatatcacagcaacagaggtctctttattatagagtaggagtacagtcatgttgggctacggacagatcccgagctcacaactgcattacaaaaggaaagcggaagccaggacttggaccaatcatcacaggcgcgacttgggaactaggccgaaaccctaaaactcatcgtagccggcttgctcctggaagaactcctcatcagcaggatccgcttcatcttcttcagcaactggggggg

SEQ ID NO: 15303 - DNA, 1501 bp, Oryza sativa
cgattaatagactccgacatcaaaatccaatgaaacaggcgaataaagtcggcatgatgcaattggtttaaaaagtttttgaaagtccgcatttttagagttttgatttcgttggtcgaattttcagggtgttacagcgggtatggtcttcgaagccaaaatcccaccggcgaagacgatacccagggtggagggggcggtccgcctgcgaagatcaatctttgcaggcggaccatataagcgacgcttgcgaagatctatcttcgcaggcggcaggcgacgtgcgcctgcgaagatcgattttcgcagccgccgcttatatggcccgcttgcaaagatgcccctatatagtcttcttcctcctcgaggagccctgttcattctccccaaagtttctctctcctaaagtgacttaaatatgggggggaggttttgaacttttagacctcaatttgtgatggatttatgcatgcaaaattgtgaaggaaaaggtccatgttttttaatttactttcttttgatatgttgatgttagatgtatgtgtaatacttgatgtctcttgttgtagtggtttaatgtggtaacataaattctcattttttttattttgctatcacatccacctcctagttctagatatagatctagatcttgtctagggctgggcaaaaaaacaccgaaaaccaaaaaccgatccgaaccgcattgaaccgaactgaatttttcggtttttcggtaattcggttcggtttcggttcaaagattagcataaaccgcataattcggatcggcttcggttttagttgtatgaaaaccgttcgcccaaaaaaaccgaaccgggcgccacaaccctaccgccagccgcccagccggcccatgggccttgcctctctctaaccctaaccctaacctaccgctgccttctcccaatctcccctgaagctgtgaagcatcccacgccgccgccgccgccctctctctcacgcatcccctccgcggctccgtcctctcccctcgccggcgtcgccgccctctctctctcacgcatcccacgccgccgtgccgccctctctctcacgcatcccctccgccctctcccctcgccggcatcgccgccctctctcacgcatcccacgccgccgccgcgccctctcccctcgccgccctctctcacgcatcccctcgccgccgccgcgccctctcccctcgccgccctctctctcacagtctcacgcatcccatgccgtcgccgccgacaccccgccatctcgcgcgacgccgccgacaccccccctatcctcactgcgccgtcctccctctgtcccccatcctcgccggctcgccgcgtcgtcctccctctgtcccccatcctatgcgctgcctctggtgttgcctatacgacggcagcaacaaccgaggagtcctccaatgtaagctgcctctgctgttgcctgctgctggctcaattttggattgtaatttgtaaatattttttttaga

SEQ ID NO: 15304 - DNA, 1501 bp, Oryza sativa
ctctctggtggtgtcttgtggtttcgagagggtttttttttttttctagaagcgtcgccgcgaggtcggtgtcggacacggtcactgccaggtaggccatacctggtccgattaaactgtacatcgaggccttgggccataagtccaactgcaagatgggccagattaaactgcatactaggccttggtccataagcccatgatcagtaccggcagtctaacgaaagccactcctgactgggcccatgcagagtgattgatctcgcgtgagtttgagattattgcatatatagacatttcatactccctttgtttcgaaatgtttgacaccgttgactttttagcatatgtttgaccgttcgttttattcaaaaaatttaagtaattattaattatttttctatcatttggttcattgttaaatatatttttatataggcatataattttacatattttacaaaagtttttgaataagatttcgaaacgaagggagtacttatcataacaaacaaaattaacgcctaccagaaacagcataaccaccatccactatctaaaataaaaactgatttgctaaaaacatgatgctacatttttcagcttaaccaaaaacaacacgcttccctacaagttaaccttaacaccaaaatttccgtccgcatgagctgcacctgcaccaaaaccgcccttatctgcaacggtaaaacaaatgcacgacttctaatgaccaaatcaacggtggagatgcggccagcaacaccaatatgacgtacggccatcctggcgtcaccgtgacgacgacgagtcgggcgatatgccattgttcatcttgcgagcaaaaagaacggccatatatacaagctggccacttcacgaagagctcggtccgtttattctcaccggagaaaaaaaaagataaaaattcctttcgtgttgcattttgtttcccgcttcgctcgcgaatattaaattcgaaccgaaatttcgtaaaaagtggccgagatattcgcggcaaatccaccgcccgttcgtgcgaggaggaggaaaagccacacgtgttcacacgagctggataagatgaaaccaaaaagtccaaattatttctgtgcagcaaaaaaaaaacaccacaactttttttccattaaaaaagggagaaacgggcggggtgcttggcttgacccggtccgcgtgcaaagtacgcggcgggggttacgcggggcccacacccgaggcccgcgggccacacgcgatccggcgccccggacaccgccggccaatccggcgcggcccacagggttcccccccgcaggatagatccggacgtgacgccgacttattaaatgcgcttctgagacgccgcgctatatgagccatcgcgtccgcccgtgcaccagcaccagcacagggtcgtcgtcgtctccttcctctcgccagtgccaccacagctcaagcgtgatccagcgtcgggccgcgcgtgcgagcgagcgagcgtgcgaga

SEQ ID NO: 15305 - DNA, 1501 bp, Oryza sativa
tcacgcttgagctgtggtggcactggcgagaggaaggagacgacgacgaccctgtgctggtgctggtgcacgggcggacgcgatggctcatatagcgcggcgtctcagaagcgcatttaataagtcggcgtcacgtccggatctatcctgcgggggggaaccctgtgggccgcgccggattggccggcggtgtccggggcgccggatcgcgtgtggcccgcgggcctcgggtgtgggccccgcgtaacccccgccgcgtactttgcacgcggaccgggtcaagccaagcaccccgcccgtttctcccttttttaatggaaaaaaagttgtggtgttttttttttgctgcacagaaataatttggactttttggtttcatcttatccagctcgtgtgaacacgtgtggcttttcctcctcctcgcacgaacgggcggtggatttgccgcgaatatctcggccactttttacgaaatttcggttcgaatttaatattcgcgagcgaagcgggaaacaaaatgcaacacgaaaggaatttttatctttttttttctccggtgagaataaacggaccgagctcttcgtgaagtggccagcttgtatatatggccgttctttttgctcgcaagatgaacaatggcatatcgcccgactcgtcgtcgtcacggtgacgccaggatggccgtacgtcatattggtgttgctggccgcatctccaccgttgatttggtcattagaagtcgtgcatttgttttaccgttgcagataagggcggttttggtgcaggtgcagctcatgcggacggaaattttggtgttaaggttaacttgtagggaagcgtgttgtttttggttaagctgaaaaatgtagcatcatgtttttagcaaatcagtttttattttagatagtggatggtggttatgctgtttctggtaggcgttaattttgtttgttatgataagtactcccttcgtttcgaaatcttattcaaaaacttttgtaaaatatgtaaaattatatgcctatataaaaatatatttaacaatgaaccaaatgatagaaaaataattaataattacttaaattttttgaataaaacgaacggtcaaacatatgctaaaaagtcaacggtgtcaaacatttcgaaacaaagggagtatgaaatgtctatatatgcaataatctcaaactcacgcgagatcaatcactctgcatgggcccagtcaggagtggctttcgttagactgccggtactgatcatgggcttatggaccaaggcctagtatgcagtttaatctggcccatcttgcagttggacttatggcccaaggcctcgatgtacagtttaatcggaccaggtatggcctacctggcagtgaccgtgtccgacaccgacctcgcggcgacgcttctagaaaaaaaaaaaaaccctctcgaaaccacaagacaccaccagagagagttcgccgcgcttccgcgcgcctttcgatcgagagcagcag

SEQ ID NO: 15306 - DNA, 1501 bp, Oryza sativa
aatgttcaggtcggtgtcccatcgcgtcggatcgtgtttcacagttgcgagagctttttctttatttttggctactgcaacgctttctctcttcttcctcttttctgccatgaaagcctactatacgactagtcatctcctgacttgaaaaaaaaaaccagaagaaaaggcgagagagagagagagagagagctcctgtttcgagttatggtgagaggtgacgcgactcacgcaccggacggacaaatccgcgccgtccaatagccagccagccagaccctctttgcgggccccacctgtcagcgccacggtccaatccccgtgccccggcccgagccggatcgtctgcgcgccaaagcccaaaacgacccttgggtggttcgaccggtcgggtcgggtcggcaaactcccacgtgagccgttagatcgggttgtcaggcgatcacgaccgtccatcgcgagggctctctgttctttccggcggttaacagtagccatccgggaaagctacgtcgacgtggaggaggaggaacatgtcgacacttgcatattccgagactcgtactcgcgtactagtaccgagtacagtactaatttttgttcgtacgtacacgtgggcgatacggccagctatacgtacactcgtaccgccgcaccgcgccaatacgtagacgtacggagtgccgggcccaccggtcggcgtgtgtgtgtgactgcggctgtttccggctgggggcaggaagcagcagacagcggcaaccgatctggttcctcgccgtctgcacaactggcggggacgacgacagcgtggacacgacacgcgcatgtgaccgcgccccaccctctggggcggcgggcccacctgtcagtgcctcctgctgttgcgagcgcgcgtataattaacttcggtactcctccgagccaatgctaaaaactcgtccgttaactttttacatcatgtttaaactataaacaaaattttatgaatattatttattttgttgtgatatattttactattgaagaaactagtatggcgtattttaatacacttattctatttatttaaataatataaatgatcaaagttgtttcacaagttaagatttttgtcgtgtactaaaatctggaggtagtactagtaaaattatggcgctgatgaatggtgatgactgccggagccacagctcagagctactgccaccagcagccattttcaactcagccgcagccaaagcgaacagcccgtacattaggaactttaaattaaatcataaagtttaagggcctactatttgtttgggaggaaaaccaagggactcaggggctgtttaggatccctcctatccaaacaccacctcatatttctatggattaatatctactagtgtcatttggttcataggaatgtagatataggaaaaccaaataaaaattttctttcctacaagttgtaaagagaaaacataggaaattttccattcactcaaacctattgaaa

SEQ ID NO: 15307 - DNA, 1501 bp, Oryza sativa
tacaaggatgcatttttgaagcgttgagcgaataatccatttgcataatccagcgaatatgttgttgtatgtatcggacattgacaatattatctgtagaatatagctttaatctccaatttttatttaaaaaatatgttatatttgaaaagataatgaaatttgtgatcgtgtttggattcaacccgagttcaaatcctggttacaaatagaaacatttacgcttagaatcgacctatagagacagggtcctcgtgtattagacacaggttgcctgtttggtagagctctaactcctaaatttagctccaggagttgggtctagaatggagttgtggagctgcctaaacccagctccacctctctagttcattctatgagagagctccacctaactctgcttctattttaggtggagctggagttgaagctgtgccaaataggcccttaattaaggcacgattcataggggatagctcctgtcatcctgtgcaggggacctgcttctatggcctttcttgaatccaaatttaggtatttcttatttgaaataccttgggtaggtatttaatttcccttaaagccgagggtttctttaaaaaaagaaatgaaatttcgatattttgatagtattgtttttcaatagaatttttttttcatgttttcaatctactcactcctattcagagaagtactgacagcaatgtttaaccccacctaacccaaaatcactaattttttgtactcaatggagtatcttgctagattttccaattaagcacataatcgtacatgcatgcatgtacattccacaaaggatgtatacatgcatactccaggagtattagtgatgtcatccgcagggatatggaactgtcacttcttcagagacttcagtgaaaagtaacacttgtttaagaacagagatatcctatatccaacgtcgccgcaggtagtggagtttacagaaatcttttaacttgctagtggacgcacgacgcatgttggggcgaaactgcgtatgaaaattttcgttatcttccccaaattttccacccatatcgtgcaggtattccacagaccaaggatacatatattatgcatatttatgcacgtgattacactgcataaacaaacagttagtgggactgtaacaagacaatcaagcaaaaataggttgtgtcttacgtaagagtaataattaacacagacacagctagctcgtattgtggtttaattgtggattcctactcaaactacacacaatgaacagattaatttggagtagtagtggaatgcagtgaatataatcatgtactacagcagtatattatgcaagtagtccacttcttcagggttcaggggttgccttttacgcctgtataaattggtactcttgcgtagtttacaagcagctcaaaacacttagctagctagctcacaaaagcatcagagttaacgtacactcatctagctagggaagaagaagctaactaagcca

SEQ ID NO: 15308 - DNA, 1501 bp, Oryza sativa
atttcacagctttcatatctcgacatttcgtcaaacacatggtttgcaaatttcaacaaaaaaataaaagtagttttttttcttttgttattccgtcatttcgtcaagcacatggcatgcaacattcaaccgaaaaaaaacacacacaaaatttcctcttcacaacgacgacgctactcaccaacgcgcgagagcaacgggctgatcctgccattgttgccacctacgagagctcggattccatcttcagagcgccttgagcatctcctcggcgctgctggtggtgaaggcgccgccctcctcgaggttgagcaccttgacgacgccgtcgtcggcgaggagcgcgtagcggcgcgacctgacgccgagccccatgggcttgtcggagaggtccatctcgacgccgagcgcgcgcgtgagctccaggttgccgtcggagaggaggagcacgtcggcgtcgccgaggcccaggctctccttccacgcgcgcatcacgaacgcgtcgttcaccgacacgcaggcaatggcgtccacccccttggcgtggagctccccggccttctcgatgaaccccgggaggtgcttctgcgagcacgtcggcgtgaacgcgccgggcaccgcgaacagcaccgccttcctgcccgccgtcagctccgccaccgtcaccgtcttcagctcgccgtccgccgggtcgaagtaggacagcgtcgcgtcggggagcttgtctccgacggcgatggtcgccaccacggtggacgccgacgccgccgacctccgcgccgctctcgcccccgcggcgcggacgcctgttgcgagggggcgggaggagaaggagagggagaaggaggaggtgatgaagcgcttgccggaggtgacgctggcggtggagagggtggagagagctgctgcggtgggagcggccatggagggcggcgacggcgatgtgttcgaggaaatgcttctctgttgggatttggtttgggagtgcgcggcgcgacgcgagagataggaaatagtgggatttggttggtggggtggtgatggcgaggcggaaggaacgggtggacggcgtggtgttgcgctggattaggcgaggcagagccggcccacgggtctggtagcgacggcccaggactacagtgtcgggcctatttttgttgggccgaaacaggattgttcggcctgccttggtgattcgggttgggcctatgaaaatccagcccagttttccccgtttgactctgatggagttgaattttttttatttttaattttttttattaaaagttttacaaaaataattttctattttgaaaattgacggaagtagtcgcctaccgccctctgggaaggcgatttttaaaaatcgccctcccagagggcggcgaaaatgacgtggcagacggccgttcgctctcgggcgacggccgtcaacgaaatttgcaggcggcccccttgccgccctccgcgagggcgattttgtactgtgcggggggccgcc

SEQ ID NO: 15309 - DNA, 1501 bp, Oryza sativa
tcgtcaatggagtgaggctgtctctttttgctcttttggtgaaaaggaagggaggaagggcaaaaaaaagccgtgaagctggggcactctgccgctgtagcctccgaccaactttctctctttcctcctctcgccacgctaccattacagttggtatgcaagcgaaccgaacccggcaatctacttatacgataaataagtggtaacctatgaatttttacatcatgattggatttaccacacctagagatataagtagtttgacctataaatctatttataagttaaattagtaggcaacctacgagtaattttgcctataaacaggttcatgggttagcccgcttgccgtccctacatcacagtacggacgccacagtacagtgtgtggctagctgctagtagctctcacactcttcatcactgctttagcttgagaatttgggtggaagctgtggccataggattcgattcgtcaggggggtggatggatcactgcatatgaaggatttttgggggcgttttttggttctttattctgtggattttagtggggggcgtattgtctttatttgtgctggtttttagtgcaaaatggcgggaactctgcgagtttgttatttccaaaatggtttaaatatgaagccggcatgttttttaggtttatttggaatatgtggattttttttggggtgtgaattctcattttcagctaggcctttatattgtgtatagatggccggaagagcaagaaaagtaggtttacttcaggggaggataaacagtacactagctatggcatttttttaaccgaaaaattaaagattatctcttactgaatcctgacagcagaagaatcatgtcactaggcagtagtttactcctgcctgtcattactgctaatcacttgccatcaccgggatcaatgggtaagcggcgtgcaggccacgttgtacactgaaacggccatgttatcgctggctattttcccagtactagcactagataggtgtagtagtagtagtagtagtagtacaattgggtaacagtgtgcataagtatgtgctgttactgtcgataaacaagacaagatacttggcctagaagagctatattaaacaacttgtgtcaattagtactataagctaagctaggatagccatcatcatcagcttatttctaggttggcccatgcatgctagtaatttgtccatttggtcccatgcagaagctgcaattggcttgcaacttaccatgtatcattctcatgttaagccaagcagtaataagtactaaattcaccttgttgttaatatcatattgatgtgattaaattgttgttgggtggagatcagtatgtggctgacaagtggggccattttctttttgcaggagatggtgaggatagagtgtgagaggtgggcccacaagggggtgaacataacgtaccagatccgggagaaccgcaaggggtacaaggctggtgcactcaaggagggga

SEQ ID NO: 15310 - DNA, 1501 bp, Oryza sativa
cctatgtttaataattcaaatgtatatccgtatactttaaaaaaaattgaaaaagaactaaacacggccctaatatgggagtactacttatcatatttcctcaatattaaaataaatcaacctaaaatacacagactaaatcattttctaggttggtttaatttaaaatgaggggagtatgtacgtagctgtgccggccgtatataggcatattattgttattgttattgttgtacatacatggccaaaaatatactgcattactgataaaatttaaggaagttttttatttcgttgaatgctattagggcatgtttaagggtgtgatcgtccctagcacgcaaagcgaagcagcgtttaatgcatgattaattaagtattagctaaaataaatttgaaaaagggttaatatgatttttatagtaacttttatatatacacacacacacctttagcagtttgcaaagcctgcgcgcagaaaacgaggtaggtgagttggaaagtagagataagaacaagattatggccttgtttagttccaaactttttctttaaactttcaacttttccatcacatcaaaatttttctacatatataaactttcctacacacataaacttccaacttttccatcacatcgttccaatttcaaccaaacttccaattttagcgtgaactaaacacaccctatttagagatcatatatagagattgtaatcattaaatggaaaaatatatattttgttactattttttatttttttttcatcctcgtgcaaccatattttcattttatataaaataagagttaatgttgaaccgatgtttgcctttcctattcttgtgtcttttctaccgaagaaatattttcctaattaatagtaagactaagagacatgtattaatgaccattgcatgcttcttttctccaacttcaaacgtcagctctctccttctccgttagcacatatttcaaaatattaaatggtgcgtaatttgcaaaataaaaagtctacatagaagttgttttaaaaatctaataaatctttttaaaaatttattaatacttaactaattaagtgctaatgagttttttggtttcacgtcctaaaaactaacctctaatatgcatgatcaaatgcagccttaacttactaagccagaaatatcgaatttgtcagatctgtactaagcgtacgtacacgggccatgggccaagccgttagcccaactatggtactccttataagtaggtgttgttaattgtgattgggtggcgctgattgcggtgttttaataacaatactactccgttactgggaaacaaggaaagaaattagttagtgaagatttgatttggcatacgaataaatagaatgaattaaatggtcaatttccgttactgggacccaatatataaggcaccgaattgaaataaatagaatgaattaaatggtcaatttccgttacggggacccgatatacaaggcaccaaattga

SEQ ID NO: 15311 - DNA, 1501 bp, Oryza sativa
taatggatagaaatggtatatagtagtatgcatatccggtgtatgatgattgatgaccagatcaagccactgtatgtattggaaaaaaaagcttcttttttgggcgaggcagtggcgtgtgcaagatcgttctggacgctgataattcacgggaggaggcaaatgatcgttgatgattagttaagagacagggtcgtagcaggtagcatggtgcttctggaacagatgctgccatagggcacagggcaccgcagtcggtggaggagggggataaggaatgaagggcaccggcacgatgccggatggacgcacacgcctctgcacgcggcgggcgcgtcatgcgcgcgtccgcttgtgcagctgatctgctgatgatggctgccatattttctttattttgggtggggttttctttggccctgttcgcctgaggcgacgccggaacggccggcctgcctctcgcgtgctacgctccaccaaccggcgtactatctcgcgtgcgtgaggcgatcgatcgatggacggcgcggcgcacgggcgatgtgatgtagtggccgtgcaccgatcgacgctctcctcggccctcgggtgatggtcgcggaggccgccgttcgaggccgctcagatcgacatgggtgagatcgcgcgcgtaatccctagccagattggcagtttggcccgtctccggcgccagccacgcgcgcgcgcgccaccgaccacgccatgtgtatggagtgccattgatgattgatcgcccgcacacgtacacgtaacgctgctgattgttgttatatatgttgtgaatcgtttatcatctggatatcctatcctgatcagtaatactagtgtaggagaatgtactgcgtacatgaaggagattaatattagttcagtggacaggggtaaaatggtgggcactactactgggttgtgggtaccatagccgcaggtcaactcagcctcaacgtgcacatgcaaaacaccaaccgcaatggtaatcatctcctgttgaccatctggagatggagtgatcctcaagcagcagagctccagagggacaccagtctgcctggctcatgtgtgctcgacaaaccaatctcaatttaagctaagttgatggagttatgtacttaattactagtggtacactaatacacagggcagcctcctgtgcaacagtgcaagggggtccaggggaaagaagaagcagaagaatctcggtgagttgagctgtagctttcgtcacctccctacacccaaaagaaattaaaatcccctttgaaacacgcaccaccacacttacctgtcctcctatcaagcttaggagttaggaccttttaataaaaggccacccccactcctcgcagcacactttccttctactcacacgcacacagtcctcagtatcacacacacactcacgctcacgctccactacaacgcactgtacacagttgattattagctagttgggtttctggcccggccgccggcgagatgg

SEQ ID NO: 15312 - DNA, 1501 bp, Oryza sativa
agtgagggtaatttactttcatctcttccataaaggatggggaaagagactctaaaagggggctgcaaaaaggatggttattcacacaaacttagcctggaagtaaaatgaaaaatatgactgttctacgcagacacgtcgaacctactaaggtttggaactagtgatgcacacatgcacccaaatcactctagagtaatcaatcagacacttcagatatagcaattgccaggtcatataaaagaactttgtttctattagcaattttgcaacgggttcggcacacaataattcacacgcacacattgcagaacagatccacagatgcaggcaccatgcaaaaatacaagcatacaggatgtaagtagtacatacggccagggaccattgggacttcgaagtacagagcttagctagaagacggtcgacctaataccctgctgtgcttatatcagaaaaaatggaggcaagtgcaccatcctgcccgttcttggacatgtcacctaccatccgatcttctttgttccgtttggtgcatccggtagcagtagcaaattggaggcaagtgaagcacgcatgcgattcacggttggtgtgtaaagtagtagtagtactatatacctaaggagaattattgacgtgtccctgtttttctccgctattttgctcgggaaaaggtagggttgggtcaccatatgtgctataactaatcgttccaagtagtgctagtaactgaagtgagaaatgctgtattagtatataagtgaggagcgtctgtcgcggtggacttctgtgacgtgagatgatcggttactctattttggtcgaaacatgtcctagaaagtttcaaattctattataacttattaaagaaatagaaaaaatagccttcacgttcgctctcacggcctagaaattctcatattaatcagagaaaaaaaacagagtctatatagaaatataatctatgaatagttgaaattcagaattaaaaaataagagatattggaagaggagaccagagcccatgttgttatacaatttagaactaatggaaattcagaattaaataagaaaactaaaatttgtttagaattaatatagaaataaaatttggaataactaaaattcggaattaaaataatatagagtacagagttcatatagaaatacaatttagaaataactgaaattttgagttaaaaaataaataatattagcagaaaagtgtcagcgttatggataccacatacctaatagtagtcgactaaatctcggcaggacccaccacataccatgtcttatacggaaacaacatgtggatataggaggagtttcggataaggaaatacaaccagagttctacatggaaacgacaaggactactcggattgtatccataatggtttccctagttctacttggacaaggagacacctatgggtataaatacaaggccccctaggaggagaggggacacactcaacatagacggaacaac

SEQ ID NO: 15313 - DNA, 1501 bp, Oryza sativa
atgtccataaacatgccccctctcagcgcacgtcccatgtgcctcacacagagcccacatgcgctatgcgtcatatgtccgtacactgactcgtacgtgcaaccgcgagggtcggctgggataccatttgtagcagccctccctccaaaaccgtgtagccagcccattcgatgagcgggcccacttatacatgctacttcacttacactttcgtcctcgcttcgtgtaaaagggttaacccaggagtgatatggttataagaaagagaccttataagttggttccgcccttgctaaactagcaatgatactaaaatatgcacacagctcacatgggccacacaggcctcatcctaactggaccaggatgtcacatattaagcatctacttatagactttgcaagtaattatataaggacactatgattgaggcaaccttatacatgaggcctcgccatatgcaataaaaatatcacttttctctcactgctactttgtctctctacaatacaggtacttgccaccatacaggaggggagagcctgccatgggaaaggagaagaagccaggggagtgccaggatagtcgttgaagatccgcccacgacagcctactaccatcgtcaccaaatccgcatgtgacagtcgccgccgccgttggatccgctcacgactgtgtaccacgccgacgcacccgccatcgccgaagccgcccgagtttatcatcgctgaagatggtgtgggggaaaaatagggtaaaaacgacatgaagtgacatcctggtctatactaaaatatgcacacagctcatatggaccacataggtctcatcctaatttattataatgtgggatacatcttaataccctcgcttttcatatatgaaggtaacaatatacctcagtggaacctgtttgggatccaccataagactaacttaggaatatatattgctgatgccctacgcgaacatatattagctctcacgcaaaagctgtttctagacatgctataatataatgcattaattatataaattagagaaagagaaagaagaaaaaagatagagataattttatagttaatccatattatatattagctctaatataaatttatagctagtagttacctctacaattaaacttgctctagtcatggttatgaggaaatacaggcttactagtgtttacatcctctattataatggcactaccattacatgcattgacgtatggggcaataggagggtgggaccaggggcagagctagagtattgtaggagggtgggaccaggggcagagctagagtattgagggaggtacctaggaatccggtaaagaaaaatttgtagatatacctgacctattttcaccatgtgtgcaccccctcgatataaatttagatacccatattagtttaaaattgatataaagcagagtaaattaaacaagtggcactcccctccatctcgctctatctccgcctctgggtgggaccca

SEQ ID NO: 15314 - DNA, 1501 bp, Oryza sativa
ataatcccatgatatagcatttacaatatgtatgatgtaaaatatagatatttttatgtaaacgagatgattaagcagacgccatcaacgaatgccttatcctatcttattataaagttatcccccactaacttcttaagcttaacatacaaagatgccatatcatcatccactaacaagatgccacatcatcattcactaattaacaagatgtcacatcatcatccactaacaatcatcgcatttaaacatcatgcaaacatgctatatctttatagtttttataatttaagagtttttcaaatacaaacatgttaaattatcatccaatataattcacataatgtttcaatgtatatattcatgcaaagatgccacatcatcatccactaacaatcatcacatttaaacatcatgcaaacatgttatatctttatagtttttataatttaagagtttttcaaacacaaacatgttaaattatcatacaacataattcacataatgtttcgatgtatatcttcatactaaattcccgcagcaatgcgcggggtttcacctagtttttattatacaagctgctccttacgagataatcctaatccgtcaccgcatctatctgaaaataaataaagcggtaaatcaggtagcaccgtgaaaaagatcacgtttatgttgattattttgaaattagaaggtcttcataaaaaaaaatagatggtcaaccggttggattgaatccctcctgaccacatgaatctctcaactcatagaaaaaaaacatcatcattagataacatttcataatctcattcatgtaccaaccacacatctccatcatcaaatagagtaattatccttctgtgccaggtattcgaaaaaaaataatcctgatttaccagagcagttgtaaacaattttagtctttcatcatttatcttttggctcatcaaccgctaccaaaatttttaaaaattaaagtttagttttcaattttttaaaccaaagtttgtttttattagcttttgaatcgccaaaaacaaaaatataagttttttatccataaaaaaaaatagcatgattcatatttttccacgtcttatcagcaaatgagtatatgactaagaaactataagcagtataaatatttaacgtctaggactgatcaaacttttaaaactatggtaatctcaataatgtctcaaacaattagttcaaaaagataaaagaaatcatatacgtaaaattttgctcgaagagtaatactcctctactcatattagtacaatatcacaaacttattgtagattttataaatttaatctaatacattttttatcttatcttaaatgtcaaatatattaataatagccatgtgcgtcattagacggtagtacgatcatacataaaatcccagtcaaagacagggaagcagagcagagcaggaggaggaggaaaacttgtagcaagtgatcatttcatttggtcgcgttaacttgtc

SEQ ID NO: 15315 - DNA, 1501 bp, Oryza sativa
tttaaaactttcaagtcaaatttaaaacatccaaaccaaaatttgaaaactttcaactcaagatttaaaaactttacatttaaaatttaaaactttcaactaaaaatttgaaatatcctatttcaaaattaaaattttcagctcacattaaaaaatttcaacctaaattagaaaaaaatcaacttattttatattattttatattataaagctaccagtgtgattaatgctaagcgcttattttattgtacgcgcgagttaggtgtcccccagggttttaaatctcccgctatagatgtttgagaaggattctagctatttgctctcatgtacaatttagccgctatagctccatttagcctgctatagctgcagctatagctgtttaagaagcaaactgctaaatgccttagcccgctatttaaaacattggtgtccccgcataagtcggcttaggtccaataaaatcctgtagacagaagtcgacgatataataggaatgtataatttaggtccatcaatttgtcatcgagtctgaaattcatcccttaaccgcaataccagatatgacacgtccctctactttcaaaaccagtgcaaataaggtcctaagacggttttggcagtttaggctgacatggcgcttacgtggtgttgacgtggcacttaaaattaggaaaaccgtgggaccgacatgtcaatgactgttgtcagggttatggataccacatacctaatagtagttgactaaatctcggcaggatccaccacataccatgtcttatacggaaactgacctcgagggagttccggataaggaaagacaaccaaagttctacatggaaacgacaaggactactcggattgtatccatattggtttccctagttctacttggacaaggggactcctatgggtataaatacaagcccccctaggaggacagggggacacccaccatggggcgatcaacacagacaatcaacgacctcaatcaacacccaacataatacacgggacaacatacaagcctacatacgccaagacaagccgccggatatcgactttagggatagccacggctagtttcctatggtgtctccggatacagtcaggagagacgaaagcgctctctaatctcgccgggcacggattcgaggaggaaggctaccttgttgtcgactacgagtcagaccttcagactgacatgtcgacaatagttagataggctacccacatattgtattggtgtgattatggtgaataagagcaataccggcttcggccaacaggatatagggttattacttgacaactcaggggcccgaacctgtataaaaatctctgtctccgtctcttttacctcagtctcgcgtatatcctagtatcgacgatccccatactatacaaataccagaattgcgacaccaaacatcgacagtgtgtgccaggtagggggattttggtgatctaggatttcgacgagatgggtttaagaaga

SEQ ID NO: 15316 - DNA, 1501 bp, Oryza sativa
agattacatgacatggtggatgcagttgtgcgtgtggattacaaggcaagataggcatgtgttgtgtggaagggaaaaaaagtagtcgtagtagtagtatttaaaataaaattggaatgggaaatgtagatgggatgtaacgcgcgcgctcgatgacgccaccaacccatggcactagcacaagatcgactaccacataagctagaactagaagtgtttggttgcttgcatatatataggataggtgatcgatcgatcggtgatcaatcccctcccctccctggatcggatcgcccaaacatagcagcagcagtttgcgtacttcggccgcacctcacctgccaatccttgtacgacagcgccctcccaaccatctgctctctctaagctctagctctacctttcttcctcctcgatccatccatcatcgatcattcttcttcttcttcacctagctagcttgctcccgccagacggttctaatataatgaaccatcgctagctagttcatcccatcgtacagtgcactagtatagtatatggaggagtacgtgaccgcgggaagcactactcctccgccccatcttcaccagctgctctccggcaccggcgctgcaccaccaccgtcgtctcacgatgacgcccatcctcaccctcatcctcaggtctgatgattgatcccgtcccatccaccttaattgccattgtagctaattaaattcgatcatatcgatgacagtgtccggtaatccattctctgaaaaaaaatacgtactatattgtagtatctgacaaggctagctagctgtttaatttcaattacagagcagaagaacagtgcccgcgcggcggctgcggcagagacttgagcaagaggtaattaattaattagcttaaatttatttgttggatcagcagcagacgcaataagcagtgtacattataaaatataagcaggtgagtgagctgaagaagcagctgcggaacgaggaggcggtgcatgatatcctaaaccgcgcccttcagcactcaaacaccaccaaatcatcatcatcattgtcgtctccatccgtcctccacaacatccctgcattcatcccgcacaaggtagaagccagaagcagagtcgatgagttagtggagtagctaggaatgagaatgaaaatgaaaatggatgcaggccaaggagcttctagcagagctggtgctggtggaggaggagattgcccgcctggagacccagatccgaagcatgaagaaggcggcggccaccacaactacccagaatgcaatcaacctcacccacgacgacactgtcaatgccaatgttaatagtggaggatctgcagcaggagatcatgccaacatcaagtccatgttcttcatcagtcaggccatcaacggcctcgacacaagccgccatcatcatcctctcatgaccatcgtcagcaataaacctcccactcccagtccaaagcttaattcactcgatgatactagt

SEQ ID NO: 15317 - DNA, 1501 bp, Oryza sativa; identical to SEQ ID NO: 15315

SEQ ID NO: 15318 - DNA, 595 bp, Oryza sativa
atggtagaaaattttcacatgattgcattcttatcatcaatttcataagatatatggttcatttttccttgaggtgtaaataaggaacatctctttcagattttttttgttttcaattcatgtagtattgaaaaaccatactaccccgtctcaaaacatagcaaaactctcattttttaattcgtagtattaggtggtctattatagtactccctccgtcttaaaatataagtgattttgatcggtatattttgaatggagggagttgtcagggttatggataccacatatacctaatagtagttgactaaatctcggcaggatccaccacataccatgtcttatacggaaactgacctcgagggagttccggataaggaaagataaccagagttctacatgaaaacgacaaggactactcggattgtatccatattggtttccctagttctacttggacaaggggacacctatgggtataaatacaagacccaccatggaggatcaacacctaacacaatcgacatagaagcctacatacgccaagacacgccgccggatgtcgacttcagggataagcacgctagtaccctac

SEQ ID NO: 15319 - DNA, 706 bp, Oryza sativa
cgcgtcgcctcctcacaccccgccgcactgtgcgtgccgatgtcctcgccgctgagtgtgccacggccgcgccgcagtcatagcagccgcctccggcccccgtccgcgtgcgtgcgcgccgcctccgccgcccccgcctgatgtcgtgcgtgtgacagagacaggggaagagagacatagagtgagactgtgagagagagaagagagaggaaaagagaggatatggcaggtgggtcccatatttttttataaatagaatgctaactgaattgctacacgtacgccacgtagaccaaaaccaccgcggattgggtcgagggggggtaattcatccggtttgcatagttggggagggggggggtgaagaatgtcgtttttgtggtttagaggggtaattcggacgactgcgatagttcaggggggtaatttgtactttttcctattgaatattgaacattgaattctgaaactgaactggcattattttgaagaaaaaaataaagataagtataaaaaaatcccaatcatgttatcttattaaagataagtgatcagggttcaagttgatatggaaccatattattaaatgtttaattttgattattttcctagccatgtactgaagtattgtctaattaatgacaccggaatatgcaatttgacctctttgaattacttgacatttgaattttttctaccttagcca

SEQ ID NO: 15320 - DNA, 1501 bp, Oryza sativa
agataaatcattattagtgataacttgaacatattaagtagtacatatttctctataacttgtttactctgtctacacttcaatacaccaaaagaataaacaacatgtgtcttagcttgtttaatttactgaatttttgcacacatgccaatggtttgctatcagattgcacaattattaacactcaaattccatcgtactttcaggagacctgaattttctaaccacttaaagcaatcctgagattgcacaattattaacattcaaattccaccgtactttcaggagacctgaattttctaaccacttaaagcaatcctgagatcagtaccaatcataaattaaactatgttaataattcctacctgtatattctaatccgaagaactgatgatagaatatatatctactagagatactcgtaatttttgggcaataaaaatatctagtagcgagcaactaaagaattagaaacacaaccatcgtcaggaacttgagtcatacatgtgcaagttagagagcaaattttagtgtgtattacttaaaccataaacaaattaatccaatatccaacatcctggagcaaggagagtagaagaaaccaaaaggatgatgaacattctttcaaaatcattagttgagatgctcctgggatacaatcacaaaagatgaaaatcacaggacatgacaaaattctcacaggggaattccatcgagcagctggtagacacacattaatcaagatgttacctgaggaggaaggatcggggcacggcagagcggcacactccgacgaggtaggagtgctgggcctaggtgtcaggcaccgggctacaggaggtgccgcacctgaaggctcggagtgcgacgggggtgccgacctgcgtcgaggcaagcacgcggcaggggattgttagcgatcatgcgaggaagaaaacaaatgaagaaaattgggtgctacaaactcacggaggggcaaataaatttctccaatcagatgaggaaatcacaattagaccggcaaacatggggagtgggagagatgggataatgggggtcgatgattttggggggaatgccagaaaatcgcaggaaggaaaaagatggattgggacttgggggtttttttcgtgagagctagagagcccttctttttcttttttttttgagttgacggggtttttctagagggctggcaggtttttttttttaagtacgggaaaacttcctttttttcagggagtgggatgtggctgggtcaaaacaaactccagatattccctcattaaaaaactaactcaggataaaatattgcatcaaaaatttatacatggtaatattatttataaaatatatgaaatctcgtgttttctattatacaaaaattatgtaattattttcaaagttacatgaccataagagtaaaatataccatctttaaatatagattttgcatcctttatttctagataatcaatctagaatttttttatttttttca

SEQ ID NO: 15321 - DNA, 1501 bp, Oryza sativa
ttgggcaagaggagatattataagtggcataattttgggtctcattccaccaatgtttgcaaggtcttcaggcagcagatccaagcagctattgagggaggcaaaatcaaatttgatgattctaagaggccgatgaaggttgatggcaatccttttcctgtcaatgtggtgcatacagctggccgaatagccgatgggggacacgcaagaggtttttaggtgaattcggctaaaattatcgacaagtatcagaagaggtatgacaaacaacaggagaggcattacgaggaaggtgatgacggttttgatcctcattggggctgcgagttctttagattttgctggaacgagggtatgaggctgtcatctatcgaagactgtcctggatgtggtaatattgcagaaagctcaagccgatcgtataatagaggcaatcggctaaagcaaacaagagttcctgttcatcaaaggttagtcccggtgaaccaagattgtaaccaagagggcaatgaagacaggaagactcaatggtgtccttctggtatctttataaagaatcagaagagaagggttcaaagattgaggaacagggagcacttttaggaggtcgaacaggaaatcaatcatcggctaaagaaaatgaagccgaagcaggagtggcgagttaagaatcaagctcctatagccgatgaggccgcagccgatgaagcaaagagattggctaaagggaaaagtgttgtaactgcatcggttaacatggttttcacgttgcctgctgaatttggggtcaagcaagccgatgtcgatgaagttgaagaagaatcagctaaattgattttgtcaccagagcaagcaatcttcgaaaagccggaaggaacagagaatcggcatcttaaaccattgtatataaatggctatgtcaatgggaagccgatgtccaagatgatggtcgatggtggggctgcagtgaatttgatgccttatgctacattcaggaagttgggcagaaacgctaaagatctcatcaagacaaacatggtgctcaaggattttggtggcaatccatcagaaaccaaaggagttttaaatgtggaattgaccgtcggcagcaaaactatctctacaacgttctttgagcatcgatgggaagggttcctacagcttgttgcttggaagggattggattcatgccaattgttgtattcctccaaccatgcattaatgcttgattcagtggcaaggcgacaagattgaaattgtgccagccgacaggtcagtcaatgttactagtgccgatttagctctttgggagatggatggtcttgattgtttatctggaaaagtttaggatggagattttctaaaagtgtccgattctgatatacaaccaattgaagatggagaacctaagctattattttgagggcgtcgtggatgatctcgatgacaaacaaggacagggtttcatgtcggccgatgatttggaagaaattgacatagg

SEQ ID NO: 15322 - DNA, 1501 bp, Oryza sativa
tagaatatgaaactaatgatatagcatgcataacacttacagatatatagatatgattggtatgattattagtcaaaagttatcaagtttattcttaaaaaaagttatcaagtttaacttttcagaaaaaagaggacatcctataaattggaacggaaggagtatgttggctccactttccttatgaatgttaacaattgtagttagttgcatggggtgaggattgtgcataaactttatgggaactttcttcttggtaaatctctcaatctcttataaagaaacatgcgcatggatttggtctctgttgttctcacttctcagtatgttcgcttttgtgatcatatcatgcacaaattatcctgctttccagttagttgaagccacttttttaacacttcacacattacttagatgaacagtgttagtagttcgatattgggaagttgttaatgtgaactgttcttcagaagtacatctctatatatgttatcacttacggtggttgttgatgttaactggacctcgatgcatacatgctattgagctgcttctttatactttttccttgagcagaaagctatacgtgttttttctgtgattctgttcttgagaatatagtaaaggaacttctttttcaaagactgattaaaaaaacatgacctttgaatcaagcttgtgacctctcagataacaaactttttctgccacctagttatgagtataatatggcttacatttacgcaggcgaaaaatggaaacgagaaaagaaaaggcacaatgagaaacaacggctgatgtatctattatgttctgcccttctttcactgctgcaaaatcgattttcccaaacggtaaaaaatcaattttcgcatgtggttggtcgaccagcatgtgtgaaaagatccgtgaaaatcatcattttctcatacaggtagcgcaaccacatgtaaaaacgggattttcgcatgcggtcaccttagccaaccgcatgcgaaaatattttcggcgaaaaaaaataaaaattcaaaaaaaaaagccgaaaccctagctggccaccagccacgccagatgacctcatttttgcatgtgaaaatcgattttttcatgcgagccagcctcttaaaaaaccgtatacgaaaatatcctctcgatttttcaggtccatttataatctacggagggtctcgtacaaacatttttaatagtgtttgttgtgacgaaatgtcttaatcacatggatggcggggtagctggctgttgcagtagcattaactgccaactgtgcgctgctaatctgatttgatccaaattatatggttattaatcaaatcgtgcccggagaaagcttctataagatatgctcaaacttgtatattttggtgcttctgatgctgcgacagtgtgatgctctcgcacatcgattggtggaacagagtatcccggtcaaagccattagccaccatcccgacgtcttcctccatctcgcatatctctgcaa

SEQ ID NO: 15323 - DNA, 1501 bp, Oryza sativa
tattgtgttctgcccaaatatcttatgactcaagtatgaatcatagttgtgtagttgtgactgattggcacacactaatacatagtaccgaaaaggtgtcgggttgcaaacctgacaaaaaaatcggttttgcaactggcaccctttatctactagtaccaatgaccaatggttatttggtgctggtggtagaaccaacaccttttgtacttcccacaattaaaaaaaacagagacagactagaagcatcggctcaatgaaccgatgcatccaactaccttcttcaagccgcctttaatccccatacacaatatgtacagatcaagaactctatattgatttagcatcaataatctccattcacatcacagatagaaatattcaattattatttcccatcagtaacaaagcaacaccagcaagatgaagaactacacaacatcaaaaactacacaagtaggataaaaaactcatcttaaataaaataaaaaaaagatcaagaactcacaaccttcccgctgccgcatcattcaccaccagcaccgtcacatttgccatcttcccgtttatcacgatcgcctatgcgtcatccccggtgaccccacccccaatcacctcccaccggcgagagcagcgtgatctccatgcatgcgtgcgtcgtcaccatctccacactgaggtcatcgccgccgatccattggatgcggtgagagtggatgggagttgccacagctgcaggaaaggtggaggaagtgggaagagaggatgatgggcggtgctagtggtgaaggttgtgaggattgggacggcggcgacgatgcacgcagaagtgagctggagtggatgggcggcagcaacaggccgagagaggaggggatgggggcgatgggagagtgcgagagacgataaggttggtggggttaaaaggagtctcacccgtgacagctcagctcagtttcataaagttgtcaatcttttaaagaatcggcacctataatataaatactaggtgaaaccctgcgcattgctgcgggaatttagtatgaagatatacattgaaacattatgtgaattatgttggataataatttaacatgtctgtgtttgaaaagctcttaaattataaaaaactataaagatatagcatgtttgcatgatgtttaaatgtgatgattgttagtggatgatgatgtgacatcttgttaattagtggatgatgatgtggcatcttgttagtgaataatgatgtgacatctttgcatgttaagcttaagtagttagtagggggatgcggtgagagtggatgggagttgccacagttgcaggaaaggtggaggaagtgggaagagaggatgatgggcggtgcagtggtgaaggttgtgaggattgggacggcggcgacgatgcacgcagaagtgagctggagtggatgggaggtagcgacaggccgagagaggaggggatgggggcgatgggagagtgcgagagacgataaggttgg

SEQ ID NO: 15324 - DNA, 1501 bp, Oryza sativa
ggtggatatttctagttgcgaattcctgaaatcctgaaatgttttctccctttttcttttgtatttttcagcagagtcttaacattttgcaactgcaaaaatttggtttgcagctgctgcctttgtttcgtaccaaattctcaacttgatcgttcaaactgaggctttcgttaaaccaagaaaattcagagtgtatatatcaaaccgacgcaattgcgactgtggtcttgtgactacatccggccccagcccacgttttcctctctttttcaggggtcccacggttatttctccttttttaagggtcccatggttattttattcttttaggggtcccacagttattttttttctttttttaagggccctacggttattttttatttttttaagggtcccacggttatttttcagaatgagataagacccagcaaaagcagagacacatcccgagtccccgactcatccgagtctccggcgagagccgccgccgccgacgtgccggactccggccgcaccaccggccaccgcgctagctccgcttcaggtaaatcccctgagcagagaagatgggttgaaatctcatccgtttttttttgatttgaggtctcctacctccggcgatggagtcggcggcggcggcggcggggtgggggctcggagccgtggacggcgtcctgccgccggagctgctgctcgacgtcctgctgcgcctccctgccgggccgatctgccgcctccgcgccgtctgccgctcgtggctcgccttcaccaccgacccgcacttcgtcgccgcgcacgccgcccgccaccctgccccgctcctcgccgtcggcgtgcagggcttccccaggctctgcgtcgacctcgtcgacctctccggcaaccttgtcaagcagatcctccgcgtggggaaaggcagggtggtgagcgggagctccgccgaccgtgtcctcgtcgccggcgaggaccacagcgtccgcgtgctcaaccctaccactggatccatttcaattttacctagccatcgctgcggcggcgcagacccctcaacgattgcggcctggtttgcatttggtcagacagcttccacgggggagtgcaaattagtccggattttactgaatattgataactctcgtcacctatccgaggttatcaccatcggcgacacggatggagagtggagggagacggcgaacccgccaggctaccttggttggaactgcaccaatggagttgtgttcaaaggcgctgcttacttcatcttggattactgtttctctgatccctccttcctcgagaggggctgcatgccttcctttgactttgcgacggagaagtggagtgtggccctccaagggccgttgaacagaattctcgaggaatccaatggcacgctcagctatcatgaccttgccaatcagcttatgttatctggacttaaaggcactttgtgtacatcgcactggaatgatcaattttataccgtggatctatg

SEQ ID NO: 15325 - DNA, 1501 bp, Oryza sativa
tcaacttaaatatatagttttgtgataatttgatcaaagtattcgtagttttgtgaaatttacttttttttttagctagaatgccacatagccgttacgttacataaaagaccagattaaagtgtcacttagatatcacatataacaaaaccaccatctcaaaagtatacaaggagataaattaatccgattttaccagttgtggaagcctttatagccgatagtacggtttgtgaacgtggatcaaactaaccacatagtttaaggacgcaaaataaaccttttccaacgggaaactctctgatacatcgatggaacacgcagttgagacttcagggacatatgaaggagttcaccggaggtccctcaacttaacaacgagatttttttaaagatcccttaaacataaaatcagaaatgtgtacccctaaactcacacaaaccatgcactcaagattctatggtagtatatatgggtggtttcgctgacgtggctcctagtcagcaaaaaaattaaagagtaaattgcatctccggtacacgaacttgttaggtgagtgcaattcagtgtacaaacttgtaaaatgctcgttttggtacatgaacttgtctgctgcgtgcggaggaaggcgaaaaggatactacatagctaatcttattgatttaggggttgattaggatactagtaaacatatatctgagaaggttgatattgacatacacctcttcaatgaaaaatagaataggatatagtgatagtataaaaagtttaaaaaaactgagcaataatataagggttagaaatgtatgaaagtcatcatttccatgataaaggatacaattgagaccaaaattataaatattgcatgtcttatgcatactcactacacgtatgcatgtcacatcctaatcaacatcagcttattttggtccttgttcgcatgaactagacaagttcatgtaatgaaacaagtattttataaatttatgtactaaattgcacctacctaacaaatttgtgtaccaccaatgcaatttactcaaaattaaaaaaagtacataacgcccacatgtcagctgcacatattttttttcttctcttttcttctcttttctctcttctctcttctcttcttcaagccggcggtgggcgagcgccgcggcggagcgctgctgcagagcagcagggagcgagtgcggcagcgaagcggtggcgggctgcgggcggagcacacggcggacgagcgcgacggcggcgaggaggctcgcacgacgacatcgggcgtcactgagatgcgcgcagctatggagtcggcaagctcgtcggctggtgcggccttcccgcggcagatcgggcacgaggcgtgggacgagagccacatgtcgatgcactcctggtggagctgcctcaccatctccccctcgtcgacagcgctgaggcaaaccgcgcactcgaccgacgccgccgtgtccgagatctcgccgttgtcatgggctcgca

SEQ ID NO: 15326 - DNA, 1501 bp, Oryza sativa
gtggagctatacgaaactcctatggcgcgatcggttcccttgccccacgcgatatttttttttgcaccgctctacttttctgttttactaactttatacatatcaagtttacacatctaaaatttatatacctaaagtttgtacacctaaaatttataagtcaaaagtttatatatcagattcaaattcatctttaaacgtatttaaattcaaattcaaatttcaataaatcaagtttacacatctaaaatttatacccctaaagtttgtagacctaaaatttataagtcaaaagtttatatatcagattcaaattcatctttaattgtatttgaattcaaattcaaatttaaatcggtatatcaacttttgacctataaaagatgtgtaaaccctatatgtataaactttggatatataaactaaaaaaactatatggtgaagaaaagaaaaagtggtgaaaaaaacgattgcctgggacaatcaatcgctagttagcgatcccccgtgatatagatccaactcgcatagtcgattgccatcttcaaccaccggaagataatctcatgtccgtacatgccaaaatcgatcctcccgttaaattcggtcgaagaaaaaagcggatgaaaaaacccggaaaaaaggcgacgaaaaaaagttttaaaaaacgtggacagaaaaagaagtgaaaaaagaccgataaaataacagcgaaaaagatagatggacgacaaacagaaaataagaaaaaaaagaaaaagggcgaaaaaaagacagaaagaaagaaaaaaatagacggataaaaaaaagcgaacagaaagaaaggaaaaaaaacaaacggagaaaaaaaagaaaaatggaaaaaaaagaagaaggaaaaacggcgaaaaaaaagacggatgaaatttagaaaaaatgcactgtccagagacccacctgtcagtatttttttttatctctcgttctctgctccttcctccctccgttcttctttcttctttcagagaggcgagaggagggagaggggaggcgagcagggcggcggcgctcctgtagccaggaggcggcgacgtcggaggcaaaacgtgttcccactcgctgtgtaccctgggaaggtggcggcaaacagtgaaattgagggagaagttgggaacgcggtcggcaaaagctctgtcccgaggagagagaggaggctccggtgtggttcatggtggcggcagatggaggggaaacgtagagaaataggttcttctcagcaaggcggagctggtggtgagagggaataggaagggaagctccgattgaggagatcggctagtgatgctagattggccggcggtcggacggctatgcgtacgtgctcgcgacagactctggaaagccggatgaaaaaaccggaatcggactggaacgacgtgcaaaagtagacaaaaacattttaaacttttataataggtaaagatatggtcttttagacaaggacacatctttttttttgaga

SEQ ID NO: 15327 - DNA, 1501 bp, Oryza sativa
taagtgcactgctccacgacgcggccatgcccagcgcccagcccagctagccggtgccggagccccaagccgtcacgcctcgctctggcacaaaaggcctatagccacacacgcctagctagctgctactcgcctagcgcgtggcgcgacagcggcgagcacgacacgcgcgcgcgcgtcctgtccgagtgggacggatggctaagtccgcgcgcggccggatccgtctcggatcagcgctgtccatggcgatgcctgcgtcggccgggcacacgcagccgcgcccaatggtgctacgcaccattgcctccctttcctctctccctgcatgcacgcattattgttcgttccttcccccctttctacttcttctcgcacactgcttcttaatgtggattgatcatatgtatcgatcgatcgatccatcagtggcttcagctcgatcgccattttagtaggtagataggtagatagtacactgatagatcgatagatataggtcccttgtctctcatctgcatggaccgatgccattggtattcattcatcttaatagctgcttgtttgtgagaaatgaatttactatggtgtcatgcatgagtgccggcaaaccgatcggatcgatgatgatgatcatatatagtagtagcagctagcttagtgttcagttgcccgtcgtcctactgtgccgccacttcgtaaggattcagatatttctgcaatatgatgcgtttcagtcgatcgagcaaggatagatttgaagggatccaagcgtatccggcaggagcaactgttcgtaaagcgcaagccaaaatatctcgattagtgaccgtaactgtataatacccataataagatatcgcattagcttgttcgatcgggtgacactagcggttgctagctagtggctcgtgtggctgatcattgaagggcctgtcaatgatcgttcgtcgtcttccaatgcagtgatcaattagacatctcaaatgacgtgcttttgattaattcggaggatctagctctgtacggggccggataatatcggagtaaactcatcatggaacgtatacgatccacgacgctagtggcgtgtctgatgggatgcttccttaagtcagtctcttaatggattctgaaaaatatttgttcagcctaaccttgggcactagcataagagatgattggcctcctaataatactgaaatagggataacaattaacatcctttatgcaatttgcatcagttaaactgacagttcgatctcttccataatcgcaggctaggtccgcgtatataggaaaaataatgtacagcttcaaatttttagccatttttactattactactagtagccaatctctaagtgttacacgagctatatattattaatggtggtataaatattgaaattctaatgttatgataaacatgttggttaccttttgaaattatatagatgcttattaaatgaagagtccacaccaattacaatatgttaat

SEQ ID NO: 15328 - DNA, 1501 bp, Oryza sativa
atttctctgggaataatcaatggatgtgtgaatgtctacttcagtactattcagagatttctggcctttcgatcgataatgactagccatgtgagccgactgatccaattcatcgtctacaactagctagcgccggccactgcagctaaatagctccacgtgcaggatgtgacgtactccacaaataattggtcttctcatgctcctatttaaataaacaataagtttctttagagagcacccaagaatatgctttaattggcactgatatttattgaaatgatgaattatttaccgaaaagtaccggtggtacgattaaatctcatattgtggattcatgatttatcaatatccgtgtgcaattcacctatgagatttaaattgtaatgcacacggatattatatacttacacacgaataatgttttccttttttttccaaaaaaaagagcagattagtaaaattctgtttcttacctttgacataatcacgcgtatcatctactacatcattttttaatatatgacaccgttcactttttgataagcgtttgtctattcatcttatttattttttttgtaaatatataaaaaaataagttatgcttaacgaacatataacgataaatcaagtcgcgataaaataaataaataataagttcataattttttaaaacaaataaaatgaatgattaaatgtatctttaaaaagtcaatgctattatatattaaaaagctacataggagtatctatctacatatttctccagtcttataaaagaccaatctagtattggatgtagtatatgtaatacattctagtcatacgaatctagatatacttatgttcagatttcgttatactaggatgtgtcacgtttagttttagtttgtattttatgggacggatggagtatatgatatgatagtagtgtatatctgtcctatatttatgggacagatgaagtatatgatatgataggagtgtatatctgccctatatatgatcgatcgattccctgtagctgataacgatcgatgaaactgtatgcgagatatcacatgagattgatgagcagtgaggacggctagagatagcttagcttagcttaactagttagatatagatagatagatatagttagttgcagctggagacggatgagcatgagcatatgcgttgcaacattgctgacgccatagacgaccacgcacgagcccatgccgagtcatgccggacgcgaggaataacgaatcacccgattggccttccgattctacccctggtgaccccgaagaattacaaacatttgccactccgcgccacgtcacgctaactgacaaggtcgctcgtgcatataagtggcccttccctccgctgctccggaggatcgatcgatcgatgagcactcgctttgattcgatcaatcgattgatcgagctataggtagccaattacaagctaattaaagcagtaaccgtattagatcgtcgatggaga

SEQ ID NO: 15329 - DNA, 1378 bp, Oryza sativa
gttctagcgaaaaaaccggtacaaaaactaatggggtcgggtttttaaaagaatcggcacctataatatattataggtgccgattcttttaaaaaaccgacaccaatagtatatgtaccggttttttcgctagaaccgacacctatagtgtttaaaggtatcggttttgtatttttccatcatagggaggtgggaaattgtctataggtgccggttttaaataaaccagcacttataagccgatccctatgagggttttttattagtgtcaccgcactcaccgtatgtgccaaaactatcacaaattatagtaaaagatgatacgaattttccaatcatgtctactcatacggagatgttccttttttccattgggacatagcgaacctaaccaaaattatcatagtcctatacatatcacaacacatataatactgtaatttcatcttataatataattaaagtaaaatactgtcagggttatggataccacatacctaatagtagttgactaaatctcggcaggacccaccacataccatgtcttatacggaaacaaccttcggatataggaggagttccgcataagaaaggatgaatagagttctacatgaaaacgacaaggactattcggattgtatccatattggtttccctagttctacttggacaaggagacacttgtaggtataaattcaaggccccctagtaggagaggggacacggaacaatagataagacacaagatcaacatacaagccaacatacgccaagacaagacgccgggtatcgacatcagagataagtatggctagtcccctacggtgtctaaggatactgtcaggagagacatagcgttgtctctgatatcgccggacacggattcgaggagaaagactactctgttgtcgactacgggatgattttatggccaccaagttgacaacagatagataggctaccccaaatattgtactggtgtgattatggtgaataagagcaactaccggcttcggccaacaggagtagggttattacatgacaattcaggggcccgaacctgtataaaaatcctcgtccccatctcttttacctcaatctcgcatatatcctagtaccaacgatccccatactatgcaaatactggaatcgcgacatcaaacgtcgacagtggtgcgtcagataggggatttttggtgcttcaaggttccgacgagatgggttcaagagatggattgtcctacaacctctgagcggacttccaccaccagaattctaaccggatcaaatcggccgaccacgacaaaacgcgctactgatctacaatgacatcaggttcgtcgtcccaaatttctgtgaatagattattcttgtttac

SEQ ID NO: 15330 - DNA, 1501 bp, Oryza sativa
cttactctatttttagacatgaaaatgaaaagcgagcacgcaattaagttacttacattcctcctcttctgagaacaattctacctcctcctgttgttgctcccatttactctttcttcgacgcagaaagagcatctcttggagagtaaagagcctcataaacttgtggaacttgaagagttgaggtacaaccaaaggctgatttacacctcctgaaatcaacacaggcacaactgatgtgtactgttaactggaaattttagtctttgcatactctatatatgcagaaagccattctatcaaatgtagagttgctttctgtagggttcacaaggagaactaaaataataacaaatggaaaaaaaaaagtggagtgatatgatttaggtttacttcaaagatgcatacataaattagacaaccaaaattaaaaacaaaataaattggagtagatttaaagaaactaaacgaacggggccatactagacatactgatgtcagaatgcacatgttgcatttgcacattcgctgcaaataggattactgaagatgggcacgcaaagaagagtgctgaatactcatatgcagaaaaccaaaattaagtgctgaattgaagctgggcatccagggaaaagaaaaaaaaattgctgcagaggggtaagtggggaagtccgcagatccgcgagaacagtagaaaggaaagcaccttgctgcgcagattgcttcttcgaaatcttcttcctccacgttttattacagctgttcttgccgatgccttcgtctccccttatccgggcaggggccatcctcgctgttccagccctccaccccctcgcggcgtagcaaagcaggagagagagaagtgggcgacgaagtcagcggccctagggctaggcgatgatcagcggggtacagggaagatcggaagcaagcaagggcgggatgcggcggcagagcgacggatgggatccctgatgctcaagagaaaaagaaaaaaaaaatccacggaggaggtgaggccgtgagggtcgagagggagagagagagaatagcttgggccgccggactgtatgacttccattatgatcggacccgctgaaattttgatcattttataccttttacagcccgaaaaacttattgctctccgagttgcatcgttttgataaagacacggaggtgagtagagatcgggcgtctgatcgggggaaaaaaaaaatctggcgtccgtgccagccatctgatcgggaagaaaaaaatcagaggccccacagctactatatgcatgcacataaatactataatctgtagtcactgcatgcacagaacatgcagccatgcatgtgtcaagttttttaaataaaatttaaactattttttctctcaaattacttatccaattcacgatccgattgcactattgaatttgttgcaattaaatctttaaaacaagaccacacattgatataatccgatgaaaaaaatttagcttattattgaa

SEQ ID NO: 15331 - DNA, 1501 bp, Oryza sativa
caggatgtgttcctgccgaccggccggttgatcgacccatgcatggacagaactgatcaccacacgcatatactctgtcctgcgtgtaaaccagctagcatgaatgtcatatgcacatgcgcgcgcgcgcgacgccgcgacgcccgatcactcctcggagagcttctcgagcagcatccgcatgagcttcacctgcacctgcaggtcctcgatgtggctcgccgcgtcctggaacagctcgccgagcccgcacggctcgcggcggcagggcaccagcctcctcagctcccgaacctgcttcaccagcctagggtcctccaccacgccgcccctctcgctcccaccggccatggaccgtgccgccgccgccgccgccttgccgctatgccgccctttcatcctccgatcctcctcctcctcctgatcggctctgctcacagcttcttcagttcttctcttctctctcgcccagcagcgagctaacgaagcaggagcgcagcagccagcgaggacgggagaggccggccgcatcactcttgcgcagtagcaatgagtgcgcgcatatatagccgcaatctttgtttggatatatgcacggattgatacgatagaacgtgcaggcgttagctgatcgatcgatcgatcgatgatgatgatgatcaatcatggcgttgccggtgcgcctccatatgcgcatgtccgtggccgtcaccgcgaaccacctacaaaaggatacgagcgcggcttattctaatggcgccgttgctgcggttggccagacacccgccgattctaatagtgatcctagctaggcaagcaacgttctactactagtatattgcttcgcgccgcacacactcgatctctccatcgatcgatccgtcggccgcgcccggcgccttcgcagaaactaagcagctcagctggccggacggacgacggacggctggcttgcacttgcatgtcagtatgctgcatgcatatgcatgcatccgcttggtgtagctaggcttgtagcgtagtgtatagctaggtagccaccagttttaattcattcgctcggcgttgcaacgagaggggaggtctctgcacatgcacccacatgattcgggctatgcgcgccacgccgggccaacaaaccgaacacacaccaactcaggcatatgaatgcaggcattcattcatgcatggtgcgtcaatcgctcgcctttgtgcctaactagcgaagcgagcgatccgtacgtggcgcccgttcgtcgctgggaacaccctggattattcgcccgcctactgcacctttctgttccttgcaccgatcgcgagtatattttagcacgttaggaaggaaggcttgggatgggctccttgggatgggctcctaatcaggtagccctcatgacaccgtcattccagctcagtctgcgtgtactgatcatgtagtgcagttttagagcgagctagctaggtctcttcttgttgcaacgagagaaagagaaaggga

SEQ ID NO: 15332 - DNA, 1501 bp, Oryza sativa
gccttcgcttggtttgacctgcagatgcacacgcacacgcacgcacggtcgcacgctccaaccaaggcaatcgccatgcgttaaccgatggagctgcctgccagtgccagtagcagtacagtacactagtagtactagtgccattaattttagtggttagtcaccgtctactaattaagaaaaagattgttttctggtttagcggtttgatgctgtctggttgcggccaagaacgaacaattgggcagagtgatcaatcggggctcgagtgggactcgatctctgagactgtgcgaggcatatgggccttggaatgaacgagcagcatgcatgtcctacatggctagtacacggccataacatatgtgtacatgtcacgtgatgtggtggtagcgacgacaatggattgatcatgcgaccttgcgacccggaacgcattccacggtcgatgtgctctctgtagcctgttctgtcacagtgacactgcgggccgagtagtactgggtggtaagactgtacgtgtacggtgtaccgtagaggtcgcattcgcatcgcacggcctccgaaagttcggtcaaaactgggccggagaacatgggcttctttgggttggggaactgatcacgcttctagtggtggcctgtctcctttgtttgtactttgtactaaacgagatagaggacaccggcctgaaatgttggaaacactgatggtctgcagtttgtgattctgacaaccgcagcctctctcaaaataaaaaacttcttcaaacagtgtagtttttagtttaaattataaaaagttgtagttatggaatccagaaaataaacttaaaagcaagaaactggtttttctagcttctccagctacttttcaaaatttaaaactcctcaaaacaggtcctaatgtgcccgtacaactctattgatctacagtaggaatacaacatatcctggttttctgttcgggccagagctgacgatttttgtagcattacgagggtttaataatgtggtctttgatgcacgagtctgaaatcaccaaggatgcatcagacagttcgatcttacatatacatgtatttggactgcacacatcgaaagattttcagacactctgatgcatcctttggcgataattaaatggaatgggatcaatgtcatcaagatttttagacagatatccacggacgttcaggcaagttgatcctatctagtagccagattatagacagactggtgctccttcggtggtaaaggggatcaatgtcatcaagatttttagacagatattcaaggactcttctcgctaagatttcagtctcagacaaatattcagacaaactttttaacagttcgatcatccccaatagccagatttttcagacttgctaggtagtagtaatcgctaatacttggccaattaggggcttttcctacttggctacttgctaccttcgaaaacttataatttgaacatctaacttgacgatccatatgga

SEQ ID NO: 15333 - DNA, 1501 bp, Oryza sativa
cgcaccattgcctccctttcctctctccctgcatgcacgcattattgttcgttccttcccccctttctacttcttctcgcacactgcttcttaatgtggattgatcatatgtatcgatcgatcgatccatcagtggcttcagctcgatcgccattttagtaggtagataggtagatagtacactgatagatcgatagatataggtcccttgtctctcatctgcatggaccgatgccattggtattcattcatcttaatagctgcttgtttgtgagaaatgaatttactatggtgtcatgcatgagtgccggcaaaccgatcggatcgatgatgatgatcatatatagtagtagcagctagcttagtgttcagttgcccgtcgtcctactgtgccgccacttcgtaaggattcagatatttctgcaatatgatgcgtttcagtcgatcgagcaaggatagatttgaagggatccaagcgtatccggcaggagcaactgttcgtaaagcgcaagccaaaatatctcgattagtgaccgtaactgtataatacccataataagatatcgcattagcttgttcgatcgggtgacactagcggttgctagctagtggctcgtgtggctgatcattgaagggcctgtcaatgatcgttcgtcgtcttccaatgcagtgatcaattagacatctcaaatgacgtgcttttgattaattcggaggatctagctctgtacggggccggataatatcggagtaaactcatcatggaacgtatacgatccacgacgctagtggcgtgtctgatgggatgcttccttaagtcagtctcttaatggattctgaaaaatatttgttcagcctaaccttgggcactagcataagagatgattggcctcctaataatactgaaatagggataacaattaacatcctttatgcaatttgcatcagttaaactgacagttcgatctcttccataatcgcaggctaggtccgcgtatataggaaaaataatgtacagcttcaaatttttagccatttttactattactactagtagccaatctctaagtgttacacgagctatatattattaatggtggtataaatattgaaattctaatgttatgataaacatgttggttaccttttgaaattatatagatgcttattaaatgaagagtccacaccaattacaatatgttaattactgattttgaatttgagcataaataaataacaataaattgagaatgtaagatggatgcaatatcacatttattaaataggaatttcagaattattaaatcaaagtccattatgttttcaactgcgtgatttatttaccgtcaactctcaacgtacatggtcgatcaaatcaacggctaaatatttctaattaacgtagcagctctctcagagtgtccaattagtataagtatgactatatattagggggttgttatataacggaatcccgttttcgaacgggatgatcccgagt

SEQ ID NO: 15334 - DNA, 1501 bp, Oryza sativa
caactattataaaagcacaaattatccctcttaactccaataccatacattttatattctcaatttttcaaactagacaaaataccgccttaacctagcgaggaacaatatttttgtcctacttgacatacaagaggcaaccccatcaaaaaaacaaattaaaaaaatggttgaacccacgtgtcaatggtcgcctcatcttgatgcactcttcctctcttcgtcacttctctcccatctgccaaccaccggcgaatttgcctcctctccactgcccacgagcagtagcaaaggcgagctcgagctccaacaccgcatccgcctcctctgcagagatccatctccaccatgtgtgtttctaggagctttagcaccgcagcatctcatcacctcttctctttctccctttttgactggagcggtagggtgcggatcaattagagctagtggcagtgtgggcgaatgtggagctctaggcagggtctagtgaggtggaggatgaagtgacatcgacttcttccccctttatcttatctccctccctcacctcatctcgagcttagatatcgctggctgcctagcacatggataccaagaggagatgcatggttgtggctggctggctcaacaagggcaaaaacaactaacgtggatcgctggtcatggagtgcccggtgagctaggcgttggagctgagaaagggaaaggcacttacaatttagtcccaccattttttaaaaatgttgtttgactggattgctacttcagtgccaaaaccgcttgagaacaggaagggggcgccatgtgtccggattaaatactataggaggtcatttgtacttttgaaatcgtgaatgccctaaaagaaggaataagttcaccggaggtccctcaactcaacagcaagatttttcgaggtcccttaaccacaaaaccagaaatgtctacccctaaactcactcaaaccattcaccggaggtccctcggcagtattttcgcctgattttgctgacgtggcatcctagtcagcaaaaaaaaattaaaaaaacacgtggggctccacatttttttcttctcttttcttcttctctcctcttctccttcaggctgtgggcggaggaggagcagccgcgcgccgtggccgccgtcgtcgtcggctctccaccgtcgttgtcgccgtgagcgaggctacgcggcgcggccgtccggcggcgaagcagaggcagcggagcgcggcggcggagcggagcagccgcgcgccgtggccgccctcgtcgtcgtctctccaccgtcgtcgtcgccgtgggcgaggcctagagttacatgcatatatgcattcattcatgaatatatacatatacactttcaacccgtgcagcctgcaaatcaatcacaagctgcttttgctttggtctttttctctctattgcatgcatgtatccctcacttgagaacccatagctatcatgcatgcgttcacgggcttttggcctttcttctc

SEQ ID NO: 15335 - DNA, 1501 bp, Oryza sativa
ctttctctttctctcgttgcaacaagaagagacctagctagctcgctctaaaactgcactacatgatcagtacacgcagactgagctggaatgacggtgtcatgagggctacctgattaggagcccatcccaaggagcccatcccaagccttccttcctaacgtgctaaaatatactcgcgatcggtgcaaggaacagaaaggtgcagtaggcgggcgaataatccagggtgttcccagcgacgaacgggcgccacgtacggatcgctcgcttcgctagttaggcacaaaggcgagcgattgacgcaccatgcatgaatgaatgcctgcattcatatgcctgagttggtgtgtgttcggtttgttggcccggcgtggcgcgcatagcccgaatcatgtgggtgcatgtgcagagacctcccctctcgttgcaacgccgagcgaatgaattaaaactggtggctacctagctatacactacgctacaagcctagctacaccaagcggatgcatgcatatgcatgcagcatactgacatgcaagtgcaagccagccgtccgtcgtccgtccggccagctgagctgcttagtttctgcgaaggcgccgggcgcggccgacggatcgatcgatggagagatcgagtgtgtgcggcgcgaagcaatatactagtagtagaacgttgcttgcctagctaggatcactattagaatcggcgggtgtctggccaaccgcagcaacggcgccattagaataagccgcgctcgtatccttttgtaggtggttcgcggtgacggccacggacatgcgcatatggaggcgcaccggcaacgccatgattgatcatcatcatcatcgatcgatcgatcgatcagctaacgcctgcacgttctatcgtatcaatccgtgcatatatccaaacaaagattgcggctatatatgcgcgcactcattgctactgcgcaagagtgatgcggccggcctctcccgtcctcgctggctgctgcgctcctgcttcgttagctcgctgctgggcgagagagaagagaagaactgaagaagctgtgagcagagccgatcaggaggaggaggaggatcggaggatgaaagggcggcatagcggcaaggcggcggcggcggcggcacggtccatggccggtgggagcgagaggggcggcgtggtggaggaccctaggctggtgaagcaggttcgggagctgaggaggctggtgccctgccgccgcgagccgtgcgggctcggcgagctgttccaggacgcggcgagccacatcgaggacctgcaggtgcaggtgaagctcatgcggatgctgctcgagaagctctccgaggagtgatcgggcgtcgcggcgtcgcgcgcgcgcgcatgtgcatatgacattcatgctagctggtttacacgcaggacagagtatatgcgtgtggtgatcagttctgtccatgcatgggtcgatcaaccggccggtcggcaggaacacatcctgatc

SEQ ID NO: 15336 - DNA, 1501 bp, Oryza sativa
taattaatttgtgggtgagatcttatatgacctctttgccacgatttgaaatggttctagagttaagtaaaaaaaagttctagaggacgaggtctcttataattctttgatttttcttgcacattgtctacctcccgtgtttgagtgtctcctctcctaagaccccaaccactactacacatcgatgtcttgctaacttcatgggtttttgttcaacaaaaaacaaaaacctcatgggttttaactgtgactctgaggccgtggatattcgacctgcccgttagtaaaaccgtgctctgggcccaaacatacaggcttcacacctgtgagccagcttgtcatcccgaatcgccgtgagacggtgagagtgagagggggaataagatcactttgactcccttaactgaccatcgaatctaaatcgtatccctcaactgcaatatcagaaatcttgacccccgaacttgcaaaaccggtgcaatttgactctcctggtagtttagggcggtttcactgccgtggcgcacacgtggtagtgttgacctggtttttgttccacgtggcattgacatgacgcttatatggcattaaaataaaaaaatatatgcgggacccatttgtcattcacacaaaaataaaattgtgggacccacagacatgtgggaccgacatgtcatcttctctctcactacccttcttcctcatctctcccttatctctctctctctctccccttgacatgagtcggcgacggcggcgagcgggtgccggagtggtggcagcggtgggcggtggacctcgggcgacgagcgtgggagcagctcctccctgaaatgggcggtggacctcaggcgacgtgcgacggaatgcgtcgggggagatgggagaacgctcctcgtcccagctctgtgtcgtgggcagtgagttgggtggcggccgcagcgtcgacggcgaggtgggcggtggccgcggtggaaagagagcgatagctcgctgttaacagtgaaatttggtaatcggcaaagacgtcatcggcttagaatcattatcggctgcagcatctcggaatcagccgatgggagttatcaagtcgccaatagtcggattcctgctatattcggttaaggaaatcaatctactaaaggaagcttatccctaagtgaccgagtttaaagaggatgcggtatgtcagtttatctattaattaggaatagtttgttagtttccttttatctttaggaaagtgtgtttagtgtccgataaggactttatcttttcctttttagtttctttcttgtccgacaaggacttgtatcaacccatgggtataaatatgtacacccggggtctatgtaatctatctctatgaccaatacaattcggcgcatcgccaccttttaccttttctactttattttatcgcccagtgggacttggcacccgacgtggggctgcatcgtcttcgatctccggcgaagggataagtccaatgttccgtcgg

SEQ ID NO: 15337 - DNA, 1501 bp, Oryza sativa; identical to SEQ ID NO: 15331

SEQ ID NO: 15338 - DNA, 1501 bp, Oryza sativa
caatttgacttcctcagcggtttgaaagggcggtttcgctgacgtggcgtctacgtgacaatgttgaccaggtctttatgccacgtggcgttgacatgacgcttatgtgacattagattaaaaaattatatgtgacccatttggcatttatgcaaaatattttgtgaggcccacatgtcatgcccctctctctcccttatttctctctttctcttcaccttcatccgatggcggcaggcgagggcttgagtggcggcgacggcggcggtgggcgatgggcacggtggccggcgggcgggcaaatgctggagtggcgaatgaagcttccgaggaactcttcatcgggaaactgttttaagcattcgggtgaatgtccacctgtttcttgcatgtcatctaaatggttatggaaagttttaaaaaaaattgacatgataggataatatgaatatattacttcacaaacatgcaagttcaaatttaacttctacaagttgtaacaaaaataacaaatttgactgtaaatatacgtatactaaaagtttaatttgttattttcgttacaacttgtaaaatttgaatttgaacttgcatgtttgtgaagtgatatattacatattaatctatcttgtaatttttttgaaattttttcataattatttaattgacatgcaagaaacgggtgggcatccacccgagagattagaattcatcctcactcttcatcctctcctccccctgtctcgtatgccgcactgcattgcttggctcgtcctcgtgtgcatgtgtgtgttcgcgcgtgcgagtgctcattctgccttgcctttcgattggttactattccccttgtaatttgatgctgatttgcggtgaagtagatggattcgcctatgtgtttccacattttttttgggtcttgttgcgagcagcgtctggttgttttgtgctgtgcgtgttcggttgtttccagtttttctcccccaatttcgtgcgttctagaggtaaattagtcttgtctcgtggtcaattttttgcgggatatttcgcctccccatatttgatctctgttttggacttttggtgctatttccccccaacaaagagagctgaaataatcatgcattgcatgtgtagtttgacattcggtagagaagataaataacatgccttagagcagtgctcatgtgaagagaaaggggtgagagggaaaaagagagatcatgacatgtgggtcccacaaatcattttttgtaaatgacaaatgagtctcacatattttttttaattctaatgtcatataaacgtcacgtcaataccgtgtggcataaagactaggtcaacaccgccgcgtagatgacatgtcagcgaagccaccctccaaaaccgctgagggagtcatattgcaccggttttaataaatgagggggggggtcaagatatgcagtatcgtggtgagggatacgaatcaggttaagccactggttaagggatacgattgatt

SEQ ID NO: 15339 - DNA, 792 bp, Oryza sativa
  unsure (1)..(792): unsure at all n locations
ctttactactccaaaaaacttacagaatttaccaagtggaaaacattacaattagtttatcgaggttcataatagatttctgatcatatacatggaggtgatatttttcactctgttagtcagtaggtacctttgggaaggcggaaaaaaatgtgaaatgttaattgtgatcgcaactagatactctatccgtcccaaataagttaatctaatacgtgatgtggcatatcgtagtccgatccagattcgcaatattagaatatgtcacatttcgtattatattaatttattttggaacgaaaaggagtatgtttggattgttttttttcctctcaaaagaaaaaggattttgcatttgaattgtttagcttgtataggagtgtcggtgacatggggccgggggtatcgtgactagaggcttgggtagccgcggtcacccacgtggcctgcccccctcgggggggggggggggtcgggcccaagggtnacgtggccacccttcctcctgtctccccgaggggtcgggccgctcctgtttcggccccgagggctggggcaccccgaccccctgtggttttggcgccacgtgtgtgggttaggtgagcacaccgggctcacctacccgcatttatagcaggttggacgagcgcgccacgccgcatttaatgcagcgcagcgcacgcttatccggtccgtgaccggtcgcggtgtgtgaccggtcacagaccggtcagatcgcgggttaggtggcaacaggcggcctgtcacacgcctcgccccgtcccgtcggaa

SEQ ID NO: 15340 - DNA, 1501 bp, Oryza sativa
tgacaggaattatattagtatccagagtaataattttgaatcttacagtaacattctctatggaataacggatggagtaatttcctatactattgtaaaaactactttttgtacactatacaaattaattcatgatattttctgatattataatggtctaatatttattttcgatcaagtgaataacatatatcaaataagcgcgggattttaccatagtaaagcatggttattttgctactccctccgttttttaatagatgacgccgttgactttttctcacatgtttgaccattcgtcttatttaaaaattttatgcaaatgtataagatataaatcacacttaaagtactatgagtaataaaacaactcataacaaaataaattataattacgtaaattttttgaataagaattatgtaaagtcccaagtgttcatatcatatggaatacgtacatatgtgcatgagttgtctgtgggtaactaccgtgtcatgtgtatacatctgcaataaattttaaaattagatagagaagtgcataatatggttgtcatgccattagtgtcgtgacacttattagtaattgactatggatatgcagagtgttgtaggctgtactatcaaccatcacgatttagctggtactattattaagcagcgcgggtgacctgttagtatattgtattatttgctgaacaatgttgaaatatgctttgctagaatgtgacaccatctgactatcactattcgtgactactgttgcgcgttatgaaccaccaaataattagggttttaaatctcccattgtatgtagctgccactatcttccgctatagttgtttgagaagctaaccgctaaatactttagcccgctatttaaaatattacaaataacacggttcaggtgtacaactacgtattatacgtaaggacggaccagtcagctttgaaattcgtttctaaattagtgagagccgagagcgtctacttgcagccatctgtctagcgattgcgttacctcttaccagctagggttaggcaaataaacaacttgcctctaataagactggattacttcctttcttcagcagctttcccacccttctattttaacgattgttggtagactgatgtacggaataccaatgcaactccagcgagttactcctagggaaagaaaaacttcgggtgtgtttagttcacgttaaaattgaaggtttggttgaaattaaaatgatgtgacgcggaaaagttggaagtttatatgtgtaagaaagttttgatgtgatagaaaagttagaagtttgaaaaaaaagtttggaactaaactcagcctttagcaggtcattgccagcttgctgaaaaaaaaatcagtacttccatgcatgcctaatcaatcttaggacatgcggctgtgatgcttccgaacaggggcaattgcaaatttaccactactttgaattattattgcaaaactgccactagaaaattgcaaaaa

SEQ ID NO: 15341 - DNA, 1501 bp, Oryza sativa
tataagtcgttttagcttttatcaaaatcaaactacttcaaatttaattaagtttatagatgaatatagtaatattcacaacactaaattagttttattaaatctataattaaatacattttcataatatatttgacttgagataaaaatatccttttttttctacagatttaattaaacttataatcgagacggatagattatattataggatgaagtatgtaggagtagtttattaagggcatgttcactttaattttattttcaatcttaccaagttttgataaagttgtcaaaaaagtggctacatttagtttgctgtcaatttttagtaactataattgccaaaattttggtaactatactaaaattttgataattttaatgttttttttggcatcaaactgaacatgacatcaagcttaatgcagcttgactgttaatgtggtatgataactcgtactgtcgtacaacccgtttaatactcgatgtcactatcaagtcttttacagtggtaaagtacatttattacgaaggcagattgggggtggtgggtcacccatcaacgctccctttcgctgtaacgtggtccccaccgagacttgaccaaaaagcacatttgccacacgtcccccgagcgtgcaccaatacacgtggcatctcaacccaccaatacctatatacccaaccaccgctcgtgaggcccccagcttttaatcttatccactcacccccccaaccctttttacccacgccaaaaaaaccgacgcgcggcaaccgctttcctccacgtgtcccccatccgcaacgtccagtgagcatcggacggtctccaggatttaccccatgtgaaagccgttgcggtgaaaaggtgaaaggggtaaaaggagtgcgcttttttttcctttctgtttctccctcctctcgtgggcattaaaaaggcgcctcttttctccttcgccgcatctccccatccgccattgttgtgttctcatcctcttcttccatctctctctctgtgcgtgctctccgacgtctctcctctccctctcgcgtgcttggtcgctgtaggagggggttcaattgatttgaggtagccatggctgaggcactgtgcagcggcagcgtcgcgtccccgtgcggggaggtgggtgtggggttcgccgccggccttgtgaggggcgccgcggcggcggcggcgctcgcggagtctgtgccgattggtgggtacagcagcaagagcacgttcccgagtgggagggtggcgctcacggagaggaaggcgaggcccctgccacggaatctcgaagcggcgcatgggcaggtctgttcgtcagttcttcaggagatttttcagcacataatttcatatttttagttctaggcttttggataatactgcaagcatgctatttttaactctttttggggttgggatttagttcgagcagttggagaagttagctgagttcgcgtcggatgcatgctaacgttttcaagt

SEQ ID NO: 15342 - DNA, 1501 bp, Oryza sativa
tggtgaattttgcttcctttgcacatggatgaccgaaattcgatgtgcaaatgctgagcaccgttgctcgcagggaaatcaaatgcaaaactacaatctacaaatccgatgagaaggctggaaatgactggaaatggaaggggaaaacaaaaatcgaaagctcaagtgacgctggctcatgagagcttcagattctattaactccatgaaccaaacggcgattttcactaattcgatgtggacatcctgtaaactattgttgctacgagagtaacagtcaaattcaaacacgatagatcatcttaaactctggagagaaaaaaaaaagctccatatgtctcccaatctcccatcaatggcgccatggcgcgggagaatcatcgagcaatcatcgagcacgacaaagatcctcttagcatggagcggtatacggttggctgttcatacctgcgcgagatgcggatgggtgtgaggtggccggagtcgtcgtgcgcggcgagccccaccgccttcctcgtatgctgcggcggcggcgcctgctccgccgccgccgtggccgtcgtcgtcggcgccattgccgtcgccttggcttgtcggttgctagctggctaggtttatgcgcggtggagctgagctacaggctacggctttaagtagccagtggcggcttgctgatcggcgtgcgcgcgctgctcgttttacagcgctgtttatgactccgccagtgtcttgagctaagagcctataagacgatgggccgagcacgccgtgcgcgctgacgtcactctcgagttggccaaaaggctcgtcaaattttcgttgaaatttatcgattagaatctagaagataatttgttaccaagtcggagttggatttgtaccacgacagcacgaccaaattatactgagactgcctatacatataaattatagtgcaatcatgatgtaattatattgtaacttgtaactttcaaaaatttgttagttacatgctatttttataaaacgaagattgtgggaccgaatcgtcacacatatgcgctcggatttttttctttctaacttgcatgaatgttgaaataaatataacgattaaaattatatgaaagttatattatagttaccatgtaagttataatgtacattaccattatattagaaaaaaatatcgacaaaaatatatatagcaaaaatgtactgtactagaatttgctagcgccggatatattttggcccactatagaactaaggcccaaacaatgggcccacctctctgcagatttccgacgggcccacctagcaacgggccagaagtttttggcccaatcgagcccagttataaatacgcctcagtctttaccaacccacacagagaccaaacgggccaaggagagaggagcagcagcagcgccaccgctcgcgagatctcctactcctcgtcgccgacgagccgcctcctcctcgtcgtcgccggcggcagagcaccggagcagccacccca

SEQ ID NO: 15343 - DNA, 1501 bp, Oryza sativa
gaaatgaaaaataggaaatcaatgatcaagtatcaacgaactaatcaagccctgagcctctggcaatgcatacgatccactagatctaactccagatcacataactcaatatagatctagcccttcgatcacaacaaagcacaccagatccagactcagacatcacgttacagaggcgatgggatcagatccagcgtgctaaccttgtctccggagaggtacagcgcgagcagcttcacggcctgcagcgacgtcgccgcggacgagtcgatctcgctgatcaccaactgcaacagccacatggggggaggggacacgcaccgatcagagccgccaacccgttgtagagcgagcgagcgaccgagggggaagggaagggagctgagctcacctggtaggagccgagcgcgacgtaggagcggaagacgatggcgtcgcgctcggcggcggcgtcggcgtcgaggcccgggacgtcgctgttgttgatggcggcctggtaggcgccgaggtagaagaggttgcgcaggttgaagaggaggtccggggacgccatggggtggctgctccggtgctctgccgccggcgacgacgaggaggaggcggctcgtcggcgacgaggagtaggagatctcgcgagcggtggcgctgctgctgctcctctctccttggcccgtttggtctctgtgtgggttggtaaagactgaggcgtatttataactgggctcgattgggccaaaaacttctggcccgttgctaggtgggcccgtcggaaatctgcagagaggtgggcccattgtttgggccttagttctatagtgggccaaaatatatccggcgctagcaaattctagtacagtacatttttgctatatatatttttgtcgatatttttttctaatataatggtaatgtacattataacttacatggtaactataatataactttcatataattttaatcgttatatttatttcaacattcatgcaagttagaaagaaaaaaatccgagcgcatatgtgtgacgattcggtcccacaatcttcgttttataaaaatagcatgtaactaacaaatttttgaaagttacaagttacaatataattacatcatgattgcactataatttatatgtataggcagtctcagtataatttggtcgtgctgtcgtggtacaaatccaactccgacttggtaacaaattatcttctagattctaatcgataaatttcaacgaaaatttgacgagccttttggccaactcgagagtgacgtcagcgcgcacggcgtgctcggcccatcgtcttataggctcttagctcaagacactggcggagtcataaacagcgctgtaaaacgagcagcgcgcgcacgccgatcagcaagccgccactggctacttaaagccgtagcctgtagctcagctccaccgcgcataaacctagccagctagcaaccgacaagccaaggcgacggcaatggcgccgacgacgacggccac

SEQ ID NO: 15344 - DNA, 1501 bp, Oryza sativa
atatatgagatatatagctggcatcgtagcttctttcgttttataatcgcttctattactaaattgatatttagttctttttgtgtgctacaaggcaagatgacacgtgaggcaaacctccctcctaacctcctaggtggacggggtggccacctacggtgcatgtctcgtggcacatatgacgcgtgggactatcgtgccaacctcccttccatgtagactcaccgcttacgatgcatgtgtcttcctagaacaaagtgacgtgtaggactgtggggctaaccttcattccatgtggggtgcgccgcttatggtgcatgcgtcttgacatgtggaatgcgcgtccacgatccctctcagggtatgcatcaagcgtgaatgccatgtggaccatccctccatcccttcatctcacgtggacatcatgtatgctatgaatatagctggcgcctatgcaaaagaacggtgtgtgtaagatcattatcctctctcttatggatggaaacatctagctattgtgacgcatgcgcgttaccagaagctcggtgcacacttttcgatagtatgaaataaaatattttatcaatcatatataaaaaaatcaaacttaatttaggactatttacgattgtcaggattatggataccacatacttgactaaatctcggcaggacccaccacataccatgtcttatacggaaacaacctgtggatataggaggagttccggataaggaaagacaaccagagttctatatggaaacgacaaagactactcggattgtatccatattggtttccttagttctacttggacaagggaacacctatgggtataaatacaaggctccctaggaatagaggggacagaatcaacacccaccacaattaacatagacgccacaagccaatacaagccaacatacgccaagacaagacgccggatatcgacattagagatacgcctggatcgaccctatccggtacctacagaggccggccatagggatctagcgctgtctttgatctcgccgggtacggattcgaggaggaagactaccctgttgtcgactacgagtcagaccttcagaccgccatgtcgacaacagttagataggctaccccaaatattgtaatggtgtgattatggtgaataagagcaataccggcttcggccaacaggatgtagggttattacctaacaattcagaggcccgaacctatataaaaatctctgtatctgtctcttttatctcagtcttgcgtatatcctagtaccaacgatccccatactatgcaaataccggaatcgcgacatcaaacgtcgacaacgatgtcttaaatattcacattgtgagacgattcatatcacatttattagtgctacaagtttaattaccttaatttgtgccttcgcagagcccataagagcaagttcaatagtatagctaaatactagctccaaatcatctataaccaatgtaatagccaattcataca

SEQ ID NO: 15345 - DNA, 1501 bp, Oryza sativa
ttgtaccaaaggcaaactctggatctcacatttctcctgaggcatcttacaaagtggcagttctcggtgctgctggtggcattggtcaaccgttgggcttgttaattaagatgtctcctctggtctctgcactacatctgtatgatattgcaaatgtcaaaggagttgctgctgatctgagccactgcaacacaccttctcaggttctggactttactgggccctcggaattagccaactgcttgaaaggtgtggatgttgttgtcatccctgctggagtcccaaggaagccaggaatgactcgtgatgatctttttaacatcaatgcgagcattgtcaagacacttgttgaggctgttgcagacaattgtccagaagcctttatccatatcattagcaacccagtaaactcaacagtgcccattgctgctgaggttctgaaacagaagggtgtctataaccccaagaagcttttcggagttaccaccctagatgttgtcagagctaacacatttatagctcagaagaagaacctgaagctcattgatgttgatgtcccagttgttggtggtcatgctgggattactatcctaccattgctgtcaaaaaccagaccatctgtcaccttcacaaatgaggaaactgaagagctgacaaggaggatacagaatgctgggacagaggtggtggaggcgaaagctggtgctggatctgctaccctgtcgatggcctatgcagctgccagatttgttgagtcatccctccgtgcattggctggtgatccagatgtttacgagtgcacatttgttcaatctgaattaactgagctgctgttctttgcatctagggttaagcttggtaagaatggtgttgagtccatcatttcttccgaccttgagggagtgactgaatatgaggccaaggcccttgagtcattgaagcctgagttgaaggccagcattgagaagggcatcgagttcgtccacaaacagcaggctgccgctacttcttgaagtgtggagaatgactatcggcatgagagaagataataaatgcagaaatggttctcaatagcttttagttttgaaggcggaatttttcgtgtctagttgttgcttgtttagtctcttctgatcacatgagggcgtggatgcccaaactgttgcctgttttcatgagctatttgacccttgtgcctgcatcttgatgagatacacaaactaaggaataaagtagtttttgattgttgcctgatttatgttattatatataccttctgggtagtgcaacatggcattgcgccattgcctttggcaaaatagcaacctcattgatatcatctctcactgtgtcactacttaccaatttcatgccaaaattttctgaacagctagggcgaggagctgctgctgcaatgccatggcacgtctgtttctactgaatccgctacaagcctacaactctggtaagaaaacaaggcaaaccatgttgaatttatttc

SEQ ID NO: 15346 - DNA, 1501 bp, Oryza sativa
ggtgaagacgtagacgcccaacaatggcggcataaaggccagccgtgcaggcggaaacaccagtcggcagcggcgaaggcaagccggtcggtgaagatgtagacgcccaacaacggcggcataaacgccagccgtgcaggcggaaacaccagtcggcggcggcgaaggcaagccggtcggtgaagacgtagacgcccaacaacggcggcataaaggccagccgtgcaggcggaaacaccagtcggcggtgacggaggcaggctcccatgaacggtggtgtgaccaaccaaccgtatcggcgaggacaccagtcggcggcgacggaggcaggccggcggtgaagtcgtggacgcccgacaacggcggcataataggccggccgtgcaggcggaaacaccagtaggcagcggcggagtcaagccggtcggtgaagacgtggacgcccatgaacggtggtgtgaccaaccaaccgcttaggcgtggacagcagtcggcggtggtgaagtccggccgatcaatgaagacgtggacgcccatgaacggtggtgtgaccaaccaaccgtataggcgagggcaccagtcggcggtgacggaggcaggttcagggtgaagtcgtagacgtccaacaacggtggcataataggccagctgtgtaggcagagacaccagtcggcggtgacggaggcaggctcccatgaacggtggtgtgaccaaccaaccgtataggcgagggcaccagtcggcggtgacggaggcaggctcagggtgaagtcgtagacgtccaacaacggtggcataataggccagctgtgtaggcagagacaccagtcggcggcggtgaaggtaagccggtgatgatgatggccaccaatattgacagggtagtccagcccgttttgtatcctagattaaaggttgtctgtcgtgttccagtccgagttgaagagaaacttgacaaagtcgtcggcgacatatatggcccagactctcgtagcaaaaatcatatgcatgtgcagatcttctgttggtatgtgtttatgcatacaggtacatagttgttccaggcacgtacaaacgcatgcgatgaccagtaattgctggataagtttgagcattgatatagctcgcgtgtgcccgcagccatacgtcttcattaaaaaatactcgagctgaccaagtgaaaattgctgcttgtatgtactgctccgtgtttttgattttccatgttgagtcagccgagtccgagattgatccaatcagctgtcttatgcaactagccagccgtggtatcggtgacgatgacggtttgaagcttccaacttgatgacacagatctttgatcgccgttctctcgactggttaaaacccaagtcggagaaagagagattgttgaagtcgtcggcagcgaggaagtgaaaactcacgaatcgaagacgaagccgacgaatcatgaaattgattccatcacacttgttgacaggaaactcggcgaacccctacc

SEQ ID NO: 15347 - DNA, 695 bp, Oryza sativa
cttgattatacatttatacttggactgtgtagatatttcgagtttcgcttctatagggctgtttctgatgcaattgcaatagattgcatcacctctgttcattggcagtagttttgtttgctggaactttactggattgttgcttaggctagttcaggggtgcaaatggggatggcattgcctatcaggtcttctcaggttatatacttttcctgtacttgttctgagtgtagtggttcctgaaatgttctgtgctggtttctttaatggaaatgggaggggatctgcccttcttgctaaaaaaaagaagtagattgcaaaatgaacacacatcagtgagttatttcaaaactgtaggattttgtgttgcttgtttcataattattttgctgctgacttatttcaattcttctactgaagcacatttagtgttagagaatctgtaacactgtctaatgttgtgtcatgcaaatgcaaattgaaatgcaatcgtaattcctattctaatcatgaatgaccattgccctgttgttctgtgtggtcctctgatgttctgaacaatgccatatgcacacttactacatccttgcttgatttttttttaactgtggttgtaacaaaggtgcatccagtgctgttttcgagctcaatgcaatgttctcacctgaatatttccgtgtcactcaggtctgcca

SEQ ID NO: 15348 - DNA, 266 bp, Oryza sativa
ctcccgccgcccgccgccagccgctcaccgtccaccgccgcccgccgctccatctaccaccggctgccgtgctgcttcgctccgtcgctgctccgtccgtcgcccctcagcgccgccactcgccttctctccgtagtgtgggaggggagagagggggggatagagagaagagggaggctgatatgtgggaccacatgggcccaccttttttattatttttttgtagctaacatatgggtcccacaatttttattatttttccggga

SEQ ID NO: 15349 - DNA, 1501 bp, Oryza sativa
taaatctttccgttgactctcgcgattccaaacacgatggcttggaattggagctcatacttcgatccattccgttaattaatccagaaatactccattaggcacttcatcattctccatttttgtttgctcctacaagaataatcagtagtgttgtgatcgcatcatcaattcattattcatcatacagcaatggcagctgcagaagtagaacacagcggcagctccctccccaagaagctcgtcacttttgctctctgcgccatcttcaccttgtccctcatctacttctcctcccctcctctcatcatctcctccaccaccaatcttctctcccaattccaaacacgcgcacgagctagaaccaccgatttttctactcatctcccaggtaattattaggatttttttttctgagctcaattgagcagcatttcttgcgatcttgattggtttcttgatttgtttttagactcatttcccaggtaattattaggattttttctgagctgaattgggcatcatttcttgcgatctcgatcgattggtttcttgattttgtttttagattcatctcccaggtaattattagattttttttctgagataaattgggcagcatttcttgcgatcttgattgattggtttcttgatttgtttttagactcatctcccaggtaattattagatttttttctgcgctaaattgggcatcatttcttgcgatgttgattgattggttatcttgattttgtttttaggggtagctgtttggaagcaatgcgactacagtgatgggaagtgggtgtgggacggcgaccatggcggcgccgccgccggcggcggctcgaggtacgacagcgagaactgcgacatgaagatgacgtacaagtgcgtcatcaacggcaagccggacggcggctaccttcactggcggtggcagccggcgtcgtgcaacctcccggcgctcgacccggcggcgttcttgcggctcctccggggcaagcggctggcgttcgtcggcgactcgacggcgcggaaccaggcggaggccctcgtgtgccacctcgccacggcggcgcggccggtgacagtgcggcgcgacgaggagcggctggggcgcaagtctggcggtgggcgttcccgtcgccgcacgacgtgaacgtgtccacgtactggtcgccgttcctggtgcggtcggaggggcactcggaggactacggcatggcgcacgaggtcgtcgtcctcgacgcgctcaccgagccgtgggcgtccgacctcgccgccatggacgtgatggtgatctccgcggggcactggttcccccacagcgccgtctactacgacgacggcgagatcgtcggcgtgcacggccggccggacatgaaccgcaccgagatgagcgccccgtccgtgtaccgcaaggtgttgcgccggacgctggagcacgtgatcaacgccaccatggcggacaagctcgagctcgtcgtggtggagacga

SEQ ID NO: 15350 - DNA, 1501 bp, Oryza sativa
taaatttatgaggtatattgatagagtgtataaatttattgtatgcggctattatatttatgagtttatttgtgagatattatttaacaaaaataacttttatctcgcataacaagatttatcttttaaaaatccgtactagtataacaaaatatgttatatataccgttttcaatggtaaagaatattatttttttgttttatctaaaatagattttatcatagataaaaattattttgttttccctttgcgatgcgaaactaaaatattacttttgttaaataatatctcacaaaataaacttatgcatataatagtcgcatacaataaatttataccctccatcaatatacttcataaatttatattttcttatatcaaaaggcaaaatgggctttataatataaatttaactgtcaactaacggtcaactaatggaaggggtataaaagggatccaaactgaaatttaagggtatgatagggaatgaacaaatctcaggggcataaaagggattaggtgaagtttcacgggtacccaggaaaattttctctatactttgctatgtaaaagttgtgtaacttaagatagggaatccggatcccattcagtaactgtgcctcagcctggcttcagtgtcattgtctgtgctagtgtcagtgtcacgcctctttccttgatagctcccctcgtaattaaggcatggaaatgactattaactgcaccaggatgagagattaattaaagatctctgaacaatgtttactactagtaagagacaacttgtggcatgatctgtggaggaaagagattggcctacctactggcctgaagatctctgaagttctgaaacagctgttctcggaaaattattttacagtacgatttgttcagcaatcagcactgacctcaccaattaacggttgctgctgtcacctatcaggttggatccagtcatcctgccacatggagagagttgaatcgtgtgatattgtttgatcatttctgcacaaacacacggttgttaggaggtcatgtagaattattagtgtgcgttttacacttgtctcgatcgagcagctaatggtggtacggcacagagaagagagcaaatcgttgtttagaacagcatgatggaactttttttttctaatgacggataagacaaggctaataggcttctcgttgacaaaagatgtgctgagttggctgctctttggttaaaataatttgggatttgtggcttaggaaataggaattggtactgctctgatctctctcgatttgtttatgatcaacagacagattctgaattctgttccttgctggctcataaaaatataatgttcttttgaagttttgatccggcaacttatcgtggcgagatctatgtgttggctctctctgatgatgccgattaaatagcattttatcagttagttgtaccttggagctgtctatgtttaaggagagtgttttcttttctcaagaataactgac

SEQ ID NO: 15351 - DNA, 1501 bp, Oryza sativa
ccagctggttgtttactggacccattggtcacccttgtagcgtggattgggcctccttgctcttggcccaagctggactggtacttgcttcttcttggtcttgaagtctggttttcctccttgttcctgggcatctgcttccttgtcgtcaggctccagcacctcttcctcttctgctccttcttgtatcatctcttctgtatcttctcttgctcttggtggagatggaggcctgacaaggcgccgccgccgttatctttctttgtctgctggactggttttcctagcagttgtgggcatggttcttacatttctggtggtaacaactgatctaacattggactctggcaacagctgggacgatcttattttcagtattaccgtcggtgtgttcgtatttcttctgatgtttggtcgggtgattttcgttttgtcaatcttagcaatcccgatatgttggcggcttccaatgcagttgtggaggggcaatcatctgcatttctggcaggacatactgaaagtaatagctgcagctatctttcttgtttatgtatccctcggttttctcatgaccgtgttctctgtccttgaagttgttctcgcatttttctttgtggagattgaaaatgtcactcctagtagtatagaattttgcagctggcacgggtgtgtgatccaacatggtgacctaattgctttgtaccccagttgaggttttgtgaaaatctcttagcttttctcggctactgctgttgcttttatcagtcgtggttctgtaatacgctgctttgctatcgaactgtagctgtagtcctttgtaacagaatttgtttttcatgctatagaaagctctcctactaggcactactacagagtaccttatcactaataggtgaaaagcatcatcaataatggttccttttacccattacagtatttgtgtcactggcatgggatatatcatccataatggttcatgacccgttacagatccattgatctctaacggttttgttaaagtttgtgtcaaatatatatataaagtcggttacaaattaggattaaagttgtattgtattctaatagaagtagagtaatactcttcctaaactctctttaaatagagagacacttgttataaccgcatgacgactgtagcaaatgagggaatgattgaccaatagtgttgtaagtcaaacagtataattgccagttaatggttgttgatacccttatatgtgtaattatgttggattagggaggagcgcctataattagtgtctcggggatataggttccagctgaactttagttaaatatcatggcacgatgtcgccaccacgtttggatcttagtgtatttttgcgtttgattgccaatgtctatttcggtgttggttttataataggttcacaattataaactattatagatgtgaaatattagggggaaatattccgtttacaagttataaaccgataggttatagatgtggattatt

SEQ ID NO: 15352 - DNA, 1501 bp, Oryza sativa
ggaataaatttccatacactgaaaattacaactagcatgtatttggtgctagttcattggtttcattattgttatttggttgtctcctgtgaggactggcatatgtattaagggcttgagatttgagaattcgtatgctagtgatagtggtttacggatatagtattagtccggcaaagtttagctagagtttggcttgtgtcttcagttccttgaaacacttccaatattaaccaaattattgcacttgatttagagaaatgacagaaatgatatggggaaattggttgctgacaagattccagagaataggcacggtgaaagacaccaatttcgtgatgtcaccaaccaaaccaaaacattcctttgcaactaatgctagttccaatgaaagattttgttcagaattagggttttgaccacggcaggattactagctgaacaaattccgtccaactacaacaaatatcgcctgacacaaacgacaaccaattcaatctgaggactagcctagtaaccaatggcatcgacatctcccatttttagtttaatttgtgtcgaactgtcgatgaacgacacactctagaatatcccaagtagtagtcttaaacagtgctttattacatatgttgaacaagatcactgacaacacgataaattattgtagtagattgcaagaatcattatatgtcacaattggtactttgccatttaagaaattaaacatacaaccacgcaacatcgataggagtaaatttggtttgcatatcaaatacagaaaactgatcaaataagaagaccggcgcatataaaattgttctcccaaaataatttgcatagctttaatacataatgtaaaaagatgtcaaactcagagagcatcgatgaaggcaagtgtgtctgtgccatcaacaattaaacatatgattggcactcgacatatctaagaaatatatgatggaaaattatatagtaatgcagcatgaagcatggtgcttcctaatcttatatgcttcctcatttgagaaagaagcatctgcattaaggaaatcatccaaggaatgcccagcaagggattagcatatttccatggaattataacaattaaacatgaactcagtcaatcccattctacatggatgatcttgcaaatttggatcataacgtgtattctttgtgtgacattcaaagcatgctattgttgtggacagtgtgcccaacaccgacagatgtgaggtctgcataattgaagatcatcacatgtgcacatggatatggcatgagtcaacaggtttaaagaacacaagacgagcacaaaacaaaatccttgggcatgaacgcggttataccgggaagacaggaactcaagtactacaatactctctcctagttctaaaacagacaagctatcgtatgcacaaagtacaataaaggacaaccaatgacacttaaaaagtaaaaaactagcataagagcacttactgctcaaaatccagacatg

SEQ ID NO: 15353 - DNA, 1501 bp, Oryza sativa
taattccacgatggcaaaaatgataattagcgatcaactacacgctcaactcagattttctgttgaactaatacgccattaaattggtctaaagtttattcgtacgtaaaatttgtaggtacaaagtttttatacgtacagattatttatctataatgtttcacgtattattttttatatataaagtctacgtataaattctgtttttgccttgactaaaatactactcataatttattaggcctaagattaaacctagagaagtgctaagagctgagggtcagacgctcggcggtgtatgggctggggtgggatgcgatcgtgcggctcctaacgatagatcgatcgcttattagcaatctcccactatggggcaatttggcaataaaaaatacggggtgtagtgaaagtggacatgcggtagtgtggcgggaatcatgccgattgactgcactgtgcattatcgttgcctactccctgagcaacactaactcagtgtcgctgaacctccatgcgagagcggcttgcctcttgacaactctgtaagagagggactagctacatgaagagattcgaacgggttgcaagagtggttgttcgttgggtgacattagcccatggagccatgggacaccagcacgctcttgccttatgtctttggcaatgtccttagccacggagttctcgttgcctcttcctgcggcaccaactcagtgtgaacatccctcgaggcggcaccgccggcatacactcgtgtcgccttcgctactagcgaaatcgagtatatcttcacgatttcttttcgaagatgacatatgtttgcacgatgtcatggaggtcgctcacctcgccgccgctggggtctccgtcctcgagctcgcccgcgtggcgatgccctcccctagtccccttctcctgcgtcgccgccgacgtcgacgccctccttcttctctcgtctctaggcctctccaaccccgagctcgcacgtgcggaacgccctcccttctcccacgtcatcgtcgtcgtcgccgctgccctcctcctctcccgcctcgcccaccctgtcggccagcctacaggaagagaagagtgagagagaggaggaaccgaggaagggaaagaagaggggaagagagggtgatgacatgtcaccaaacatgtcatggaccccacgctgactcagctgccacgttggatgaaaccggggtcaaaatcacctgaggacccaaaatgacccggttttgtaaattgagggatgacatatatcttgttttacggttgggggatgattttgtaattcgatgataaggtgagggacctgtgatgtacttttggctactactctaaataagctggcccaaataggaaaagatcgcgtcggccggtggagaagcgaagcccaaacgaacgcgaggcgcctccgatgtacacgtggcgcctcctccgcccctacaggtggcaagctcaaagcccgaacccgaccactccactgctctgatgc

SEQ ID NO: 15354 - DNA, 1501 bp, Oryza sativa
caaatacccctgcaccacgtcagcaaaaataggcctcccgtcaggccactccccaccacagccagctacctctttcccctctccgccgccgcaccaagccgttaccccgctcggccgctgctgccgcgcgcgagcaccacctgcgcaccactgccgctacgccaccacccgccgtcttcgtcttgctcggggccaccaccacgctgcgagcgccacccccgcgcgcggccaagccaccccgcacagcgcctccacctccgcctcctatgctcggcgctgccccgacacctcctcgctgtgccagccttttctccccatccactcgatgttcccgggccgccttcaggccgccgccgtcgcctcggcccgcgtcgtcgcgcacctgccgcatcccgctcagggcacggcggcacgcatgcgcgtggggagaaagggaaacgagagggagagagatgaggagagatcgagaggagaagaaatcaagagagaagaaaaataagaggagtgggacactgtcaagtgggccccacataaccttattatctctcctcatcccttccaatgcctcaacggcaactgggccccactgtggtaaatttctatttaatcctcctcttaaccaacacaaccgctttaacgtgggacccactactccctccttcatcaacacggcaaggcgtaggggtatttacgtctgactgtgtcaaaaaaggcctcccatccgccattagcacgacaagtatcctttagacggcatggtgtccatcgacaaatatccacgattatgggatgtcttcccccaaaactacactttcatcgtgtccctgagctaaaaccatataattacgatgtcctgtcgcaaaatttacctaaaaaaatatttcagcaaatagcaaaagaatgtttcaattattaaaaaaagtgaaacacggtcagataactagatgaaataatctggtttaacgtatgaaaaaacgatttgaaactattgcaacactacaacccacgtgtccactaagatgaaattattaaacaatatcaaaattcacagtaacatttgattcatacatagtcaaacatcgtgaatacactagctgaaacattgttggtagaacaaataataaaactgatatttctaatatggcgtttccgttatatccgaacggctgttgcaacggggcacgcgtcggcgcgtgatagggacatgtggtgggggcggcgcgcgcacgggaggcgtggtgtgggggcgccccgatatttttttggcgcgcatcgggcacccggcgctgaggattttcctaattagaagcgcccgacttctagttctaagcaaattctcaaaaaaaaaaaaaagttctaacaaaaaaaaaaagtaatattactacaagtatattactgtaaataaagaaattgtaaagtcggttcgtgtcctgcctcagaagcaaatccggtaaaaatcgccgctcccctccaaaccaaaccagaaaccccatttcaaacc

SEQ ID NO: 15355 - DNA, 1501 bp, Oryza sativa
gttggcgcaagtacgctaggtactcaagtcacacacgcatgcacctgcctcgccgattcttctgcccggtttatttcccacccaaaaaaatttcattctcttccatcaaatatttggacacatgcatggagtattaaattaaatataggtaaaaaaattaattacatagattgcgtgtaaattacgatacaaatattctaagcctaattgctccatgatttgacaatgtggtgctacagtaaacatttgctaatgacggattaattaggtttaataaattcatctcgcagtttacaggcggaatctgtaatttgttttgttattagtctacgtttaatacttcaaatgtgtgtccaaatatgtgtccgtatgtccgatgtgacacgccaaaacttttcacccctagatctaaccgcaaccttttttgcgccacacctcctgctcacgctagaaatcagaccccgatttaaaaattttcaggtctcagtactttcatttgttccacaaactttaatcttaaaatcacaaaaacttccaatttgaaaatgtaaacttccatcctaaaccgcaaaaactttcaaatcaagatataaaaacttcatctcaaataaaaaaaatcttttaattgaactccagaacttcatctctagatcacaaaactttcagttgaaagatataaaacttgcatctaaaagaacaaaacttttagtttcaaatatgaaaattgtcagggttatggataccacatacctaatagtagtcgactacatctcggcaagacccaccacataccatgtcttaaacggaaactgacttcagatatggagggagttccggacaaggaaagacaaccagagttctacatggaaacgacaaggactactcgaattttatccatattggtttctctagttctacttggacaaggagacacctatgggtataaatacaaggccccctaggaagagaggagaagaatcaacatacacagaacaatagatcaagacgcaatatcaacatacaagccagcatacgccaagacaagacgccggatatcgacttcagggataagcacggctagtcccatacggtgtctccggatactgtcaggagaaacaaaagcgctatctctgatctcgccgggcacggagtcgatgaggaagactaccctgttgtcgactatgagtcagaacttcagaccgccatatcgacaacagttagataggctaccccaaatattgtattggtgtgattatgataaataagaacaatgaccggctgcggctaacaggatgtagggttattatttgacaattcaggggcccgaacctgtataaaaatcctcgtctccgtctcttttacctcagtctcacgtatatcctagcaccaacgattcccatactatgcaaataccggaatcgcgacatcaaacgtcgacagtggcgcgccaggtaggggatcttttggtgcttcaaggtttcgacgagatgggtttaaaaga

SEQ ID NO: 15356 - DNA, 1501 bp, Oryza sativa
cacgtcaaccaccattcgtcgcggcacttgtcatcctcaccgcctgtcgctacgcaccatcctctgccgcccgtcgccgcgcgccatcctccgccactagagaaggttggcggggcccccaatcagccatcaactactagccatcgcgccaatctactccgtcccaaactcgtctacttcgccacggcatcgccgcccatcgcagccatgtgagtccgcggcttgcctgttgtagctccatcctcactgcccgtcgtggtcgtggcactacttggccttgctttgctgcagtctatgctccattttgcagagaaggccacattacccttcgctttcgcctcatcggcaatggcacgcgacagcagcgctgctccgatcagatcagtggcgtgggctccagaagcttctggaaggcgtccaagagggcccgcctccacggaggcgatggtgggagcggaggaggagtggtagtgcgtggcgctggatgttggagtgctgctgcgccgtccactgatgacgctgagaaacggcctcggtggcggtggcaattacgtgagtagtggccgccggagctaggcggtggcagtagcggtgatgctcgtggtgtcggccgtcgtattgcgctagggcgtcaagaagaagaaaggaggagagagagggggatgggagagatgaagaagatgatatatgggtcccactttattttatttgatgattgagatgccacatggacaccacgtcagcaaaaccgctctgcaaaaccgtcgtgggagttaaattgcaccggttttaatagttggggttgagagatcctctattatggttgagggatacgaattagattcaggcactaggtaagggagtcaaagtggacttattccttcagtcgctcagctattagatgggtcgggctggtatcagatggtaaacaacccccaaaggcgctagagcgagaatccccacatacggtttgctttcttcttcttccccaggtctgtgctctgtagatctccaaaaaaatcgtccattctcttgtcgatttgctcatccttctccgattctttaatcttgtcctctcttaggcattgaggccgcttacttgcgacctcttacctccttgctataatatatcctcctcgtcgtcctgctccgctccaagtttgaagcgatgggatcgattgctcgaatcgttcgatcgatcggccgccatctgcttcagccatcgtcaacttggcagatccatgaaatcccttggctgcagactgcacagagagactcaaatctcttatgccgccgccgccgccgcctcaccgcccacccggtcgccgccgccgcagccctagtcggtgcctcggtggtagcatcggcagccaaatgggccgtctggttgtatatcagactgggcctactttgtggcttggcttagcccggcccatttgaggtacctagccgtgggcgggtatgagtatctggccagcccaaatgttttttctcttcttct

SEQ ID NO: 15357 - DNA, 1501 bp, Oryza sativa
tctctccgtcgccgccgccacgccacgccgccgccgccacggccccgcaacgccacgccgccgccgccgccgtcgccacgccaccgtcgccacgccgtcaccacgtacgccgccgccgtcgccacgccgccgtcgccacgccgtcgccacgccgccgccgtcgccacgccgtcgccacgccgccgccgtcgccacggcgccaaccgccgccccgatgccgccacaccgccattaacgaacgagaacgagaacgatcgaacgaacgagaagcgagaacgaacacgtcaacgtacgttgccgtgagaacgtgaacgagaacgagaacgatcgaacgaacgagagcgagaacgaacacgtcaatgtatgttgccgcgagaacgtgaacgagaacgagaacgatcgaacgaagacaagtgagaacgagggaacgaacgtgaacgagctagggaacgtgaacgagcgaacgaacgaggacgaacgttaacgtgaaatgcaatatatatatatatatgtatatatatatatatgtatatatatatatatgtatatgttacttctcatttatcctaatacatctttttgtatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattactttatttgtaattagacttagtatgtaattattgactacggaagtggtgcgacaagtagcaattgactattgtagtcttaattagacttagcatatacgcacgaaacacttagcatacatgactattttagtcttagcatgtaatattatttgagttttaatataagattactttatttgtaattagacttagtatataattattgactacggaagtggtgcgacaagtagcaattgactattgtagtcttaattacacttagcatatacgcacgaaacacttagcagacatgactattttagtcttagcatgtaattaatattatttgagttttaatataagattactttatttgagattagacttagtatataattatttactacggaaatggtgcgacaagtagcaattgactattgttgtcttaattagacttagcatatatgcacgaaacacttagcatacatgactattttagtcttagcatgtaatattatttgagttttaatataagattactttatttgtaattagacttagtatataattatttactagctagggttgtataatatacgtcacctagacttagcacgtaaggttgtgtagggttctaatgtacgacatttacacttagcatacatgacttagattgttaaaacataaatgtctcgtgacttagcagatgtttcttgtatcaacaga

SEQ ID NO: 15358 - DNA, 1501 bp, Oryza sativa
ctggacccatatgtcatagatacgtgagggctcacatgttatagacagcgagtggcagataattaattgccacatcttaaaagtgacgaaaagttaaatatccctctaatttcacaatcatataaacttttttccaaaaaaaaaatattacagttccttacaagtggttgttggtttggacacttttccaagcttctaccgctatataaacggtgtgttttcttaaaataaatatataaaatttgttttaagggtgtgtttagttatttgggtgtaaagtttttaagtatacggacacatgtttgaagtattaaacgtagactaataataaaacaaattatagattccgcctgtaaactgcgaggcgaatttattaaacctaattaatccgtcattagcaaatgtttacagtagcatcacattgtcagatcatggcgtaattaggctcaaaagattcgtctcgcaatttacatgcaaactgcgcaattagtttttccccacattttgtcagggttatggataccacatacctaatacatacctaatagtagttgactaaatctcggcaggatccaccacataccatgtcttatacggaaactgacctcgaaggagttccagataaggaaagacaaccagagttctacatggaaacgacaagtactactcgaattatatccatattggtttccctagttctacttggacaaggggacacctatgggtataaatacaagcccccctaggaggacagggggacagacatccaccatgaagggatcaacacccaacacaatcgacatagaagccacaacatagaagcctacatatgccaagacacgccgccggatatcgacttcagggataagcacggtctgacgctgtctgttatacaatatcaatttttatacaatatcaattatgcgagtgtttccgatgttaaatcgactacggtctgacgctgtctgttatcttctgtataaatcatgcttgtttacggtttacataatgcctgatatttacatctgctcattatatcctgataattctagaagatccatgcagtttttcgaatacatactcgatattctctgctatatatcctgccttctagaaaatatttttcaggaataattgagcactcgagtaggtcgtggtcgagtacaccgcattatcgagaacgatctcgacaaatgcagaatcgtcgcgcccaacctaccaacgaagaccgacaacctatctcatagcaccggccatcgctggattactcgagaaaaggttgttaacggataattcctcgcgaacgccgtcggcttgatcacccgacatgattgcgaacggacatccggatatgctacaagttgtgtgtgagagtcatgctggccacatgatatgcacatgtaataaaccaactttagcgcccctataggtgattaagagactcctactcctggttctcgaaccagtaagacgcagtgatctctctcgcctcactttaagt

SEQ ID NO: 15359 - DNA, 1501 bp, Oryza sativa
gaaaagctaaggtttcttttgttttctttattttcaatagtttgtttctaaaacggttactgatctttctccctctttcaaaattgtaaatggcagtgaacgccagcttcagttcccacggttttggtgagggtcaccacgtcgctcagcttcgtgacctctcccgtttccttggcttctcgtgtcccgagtacacggggtactccgtggaccgtgttccccctcactgtgagctctcggtgtacctttacccccgtggaggtatacacggagctggccttcgcccccaccacttcactgtggccaggcccactctccagatcgcgtaccaggacctctcctggactgcgcttcgtcgcctggcccacgactacagccaccgtctcggaggttccgccttccggcagcttccacgccttccctctggccactcagacgccaggtacccttgtccgtacagcgagtctcagccagtgctgactcgcgtggtcgagctttcggaggctcaggccactcagcacgacctactccttgaggcttaccgctcccttgcccgccgctacgccgctttggaggcccgtctggccgaggagggtgtcacctcagttgacactatctcttgggactcaggccgcctctgccacgccagccacctgtcctcccacagctcccgcggctctgcccgcactcccagtggcccgcgctcccccagctcgcgtgcgccgtactcaccagtgtactccccctacccacacccagttagcccttcctacacccccggacacaccccagttgcttcctcccgccgtggcccacgctttatccgcaccgcgcggaagcgtgttgttggttcttccaccgtgttccgtttccactacccagctcccccaccgccagcggcccgtgctgctgccggccctcgacaggttccgccagtcccttcgcgtcagccgatcgacgtttcttcgactgaggagccgactacaggaggcagccaggccgacgaggagtagaggaggcagtcttcagcagccgtccgtgtgataggcctttttgttccgccgccaactcttttggagtcgtggccaggtagtgcgtgcgtgtgtttgttgtgggtgttgtttggtagtctggttctcctaggtggtgtgcgcacagtcaagctcggcgtagctctgtgacttgtccacacccgttgtatcaggtgtttttatgatttgaaaaatccagtttatgcctagtgtgtgctatatgagttgctatttgctttgctccttgccctcctaagtgcttatctgactcttaccccgccctcttctgggagtttagatggctagccgtccccgccgtgcagctcgtgcaccagcccgctttggttttaaggatggtagagttgagccagaagaaaatcatgaatcagctaatgagcagtctcaccacagcaaccgttcgcatcgtactgtttcccgcaacgcagaggttgagcaaccccgccgcagca

SEQ ID NO: 15360 - DNA, 1501 bp, Oryza sativa
gcggcggaacaaaaaggcctatcacacggacggctgctgaagactgcctcctctactcctcgtcggcctggctgcctcctgtagtcggctcctcagtcgaagaaacgtcgatcggctgacgcgaagggactggcggaacctgtcgagggccggcagcagcacgggccgctggcggtgggggagctgggtagtggaaacggaacacggtggaagaaccaacaacacgcttccgcgcggtgcggataaagcgtgggccacggcgggaggaagcaactggggtgtgtccgggggtgtaggaagggctaactgggtgtgggtagggggagtacactggtgagtacggcgcacgcgagctgggggagcgcgggccactgggagtgcgggcagagccgcgggagctgtgggaggacaggtggctggcgtggcagaggcggcctgagtcccaagagatagtgtcaactgaggtgacaccctcctcggccagacgggcctccaaagcggcgtagcggcgggcaagggagcggtaagcctcaaggagtaggtcgtgctgagtggcctgagcctccgaaagctcgaccacgcgagtcagcactggctgagactcgctgtacggacaagggtacctggcgtctgagtggccagagggaaggcgtggaagctgccggaaggcggaacctccgagacggtggctgtagtcgtgggccaggcgacgaagcgcagtccaggagaggtcctggtacgcgatctggagagtgggcctggccacagtgaagtggtgggggcgaaggccagctccgtgtatacctccacgggggtaaaggtacaccgagagctcacagtgagggggaacacggtccacggagtaccccgtgtactcgggacacgagaagccaaggaaacgggagaggtcacgaagctgagcgacgtggtgaccctcaccaaaaccgtgggaactgaagctggcgttcactgccatttacaattttgaaagagggagaaagatcagtaaccgttttagaaacaaactattgaaaataaagaaaacaaaagaaaccttagcttttcgcaagtagttttgaacttagtatccttagggtcgtcctaagcgtcgggtttcgccctagggccaagcctgtgctctgataccatctcttgtcacgccccgaactagtcccgaccggaactagcccgtgacgctccaaattaacctgttaatcgataccagtcccaggaaacagtgctggtatcacagggagacagagtatcacagcaacagaggtctctttattatagagtagaagtacagtcatgttgggctgcggacagatcccgagctcacaactgcattacaaaaggaaagcggaagccaggacttggaccaatcatcacaggcgcgacttgggaactaggccgaaaccctaaaactcatcgtagccgacttgctcctggaagaactcctcgtcagcaggatccacttcatcttcttcagcaactggggggg

SEQ ID NO: 15361 - DNA, 1501 bp, Oryza sativa
acccggcgtaagttgaatgtggagcaccgcatcccaaacaagaagaaattgggagatgaccgggacaatgagggcgccgcggatgtcagaaatccaggcgttgtttgctaggccagaagcaaccttgcgcgaaccatgcagacgcgggggcacagcgaagaggagatccggagccaaggaagctaccgagcggccacagatcgattggtcagaccagaaaagaatcgactcaccatcacctggtacgaagaaggtggacgcctcaaacatgtcagagacggctcgctcggctggggccttcaggctatcccagtagggatgccctgagcgttggagccaaagccagcgaacacgcagggaaaaacctgccaacctaaggtcaggaattcccaacccaccgaaagctctgggacgacagacattcgtccaagaaacccgacactgcccaccgtgagccgagtccgtgcccgtccacaagaaggcacgatgcttcttgtcaatggccttgatcacccaggctagaaggccgatcgccatagacacatggaccggaatggaggagataatagattggaccaaaacagagcggccggccatagtggtgagtcgtcccttccagggaggaagacgatgggaaaccttatccacaagcggctgcagggccgccttcggcaacttgtgaacggatagcggaatgccgagataagaacaaggaaaatcagagatcgagtaggaaaagcaggactgaactagctccaggtcttcagccgaacagcggatcggagtaaccgaacacttggcaaagttggtgcgaagtccggacggtacaccaaagacagagaggatatcctatgtagtcccttgatttattgcaccctattttcatttgaattttcatttgaagtggcgtttgaatatataagagcgtacggaagcaccatggcaacaacatggatgaatccttcgccgatcgatctctccagtcgatccatccgtgcacatgtcataacctaaatcctcacggcaaccgagctcaaactctgagacaaaggaaaaaagagcgaccgagtgtgtaaaacaaacacgacacgtccttccgaccttctcccgacgccacagcacaacacaccctttgcgcgactcccctacccatccacctcacccggccacacgtgtcacgccctcccgcacgtgccgcgcgccccccgacccgcctatatacgtgcaccccatcccgagctcacctctactccagcctcgtgtcagtgtcgtggcgtgtgcaagtgcaagctagtcgcagctcgcgcgcggctcgtggacagttgaggcagatagctctaggctctagcccagccatggctgcaccggtcaccttcgccgtggtcgcggcggtggcgctcgtcgcgctgtgcggcggcggcggcgcgcgggcgcaggacatggacaacgagtgggcgcggaacagggggttctacggcggcaccggcggcggcgtggtcgg

SEQ ID NO: 15362 - DNA, 1501 bp, Oryza sativa
aggaaaggagctatgcctaaaagaagaagtgtggtggtaaaaattattgtgcccagcaagcattggccatggcatgcatggagcagaacgatgatgagctagaacatgaactacatacagatctcagttagggtttacgttttttcacgaaaaccgatagtaaatctcagaatttttgaggtttggatacttgatgaaagtatatgctgaaagagattttgaatagttttcaagaatttagatatataataaacagccaattcccgataagaaaatgatgaaaaatgtcgcacctttataagtcagaccagaatcgagcgctcaatcgaaaggtgaactccgacgcttgagatcaggggtcaggagtaactcgttgtgatggcgacgcagcggaggacggctcgccggcgcggtgtatagctgaccagaagctgcgtgcgcggatgcgttgagacggccacgtggcgaatcaggtgccctgaacctgcaatgtcattttccactgcccctgacgccgcggtagctcaggcaagcggcctcaacctggccaatcacccagcggcaacgagataaccccagcttcaggaaagaccttaatctccaatacaccaattgctgatgatctgagaataattccattccaaaatatgcatgactcagctcgcatccgcatcgtgcattcgtgcctactccctccagaaaaaaaaaacaacctaaaatagaatgtgacatattctaatacaacatatatagacagaggtatatccagatacattgtattataatttataccatcttaaacagagggagtaatgaggggctgtttagatgggactaaaaactttttagtccgtgtcacatcggatgtttggacactaatttggagtgttaaaaatatgctaataaaaaactaatttcataaattagagctaattcgtgagacgaattttttaagtctaattaatctataattataaaaaatttactgtagcatcacattgtcaaatcatgacataattaggctcaaaagatttgtctcgtgaattagtataaggttatataattggttttataattaatctatatttaatactctaaattagtgtcaacgtgaataagtcgctgtttccacatggcccctgatactcctatataaaagccaccgggtccgagccggcgttcctcacgaatttccatgctcacaatcacaagttgactcgtgacgacggcgactccatccgacccacttgtcttggacgacgcctctcgctccccgaggcggacgcggaccgcttcacccgcccaatcaaaaccgtccatccatccccgcgtccgcgttcgcgtaggctgcggctgcggcatccatggccgtcgcgaggctggtggccgcgcgggcccctctcctctcccccgccgcggtggcggcggcacaccgatcgcccccggcgctgctgcggctggcgttcgcgccgctcccggcgcggcggctggccgtcccctt

SEQ ID NO: 15363 - DNA, 1501 bp, Oryza sativa
tcggatgaggtactagactactagtattaggtgttggcccctccaccatcatgggctccggcggtcgcctcggctgcatagggccagggccggccctgcatggcagttgttagtaataaaagattttgttaactagtcctgaaaggcatagccgccgtaattcgtactacacggcagcacaaagtgttcccaggaatttccatccaccggtttctttttctcccctgaatttatctacgtgttcatgtactgctacaatcgccataattctctagtttcgtacacctgaaaccgcgatgaaaactcgttgagaaatacgcaagccgcaagcgcgggggaaggttctcaacgaagcccacgcagatgctgacgcagcgcaggcgtggcgactaagggcagccacggggcccaccaggtgagcccgtggccgtggggtcgggtactcgcgtgggcccacctggccggtcaaatcttgttccttcctccctttactacccgtcgtcgtcgtcatcttcttcttcctggtattcgctattcatctctgaccctgcggcgcaccaaaacccccgtttccgtctcgcgttcttcgatcgcctccgcttaaaaagctcgccgcctccgaccgaatccactccccccccatcaatcccgcaaccctaccgaaaccggtaaaccactggaagaaagcgggttcgatcgatcgatcttgctagtgcggctatatctgctagtaggtgaattggtcgctcgacgttggtgatcatggtggagaagacgaagctgcagctgccgctggtgcacaacgagcggctgtgggcgcggccgtggcggtgggccaagacggtgttcttcctcgtctccatgctcgcctcgctgctgctcgtctgcgcgccgccgctgctcatcgtcgtcctcgacctgctactcccgcccgcgctcctctccaacttccaccgcgccgcgaaccaccccacctcgctcatcgaccaggccaggggcttccacttccggtcatcgctcgtcgacctccccgccgtctccgccgcgcgctccctcctcatcctctgtgagtaaccccaccacgcaatcggtatcaagcgtatgtgcgattcgatgcgatccccttaatctttttttctgcgtgttcatcgatctcatgtcgtcatggtggtttggctgacgagcacttggtgggcgttgttgtgcaggcgcgtacacggcgtgcgggggaggcgcggcctacctgtgggtggccgtggcgtgcagcgtcggctcggtgtgctacgtcgtcgccaaggcggccgtggtgttcggcgcggcgcccgacagggccgtgctggggctgcagggcaagggccagctcgtcgccgtggaggccatgttcctcatgtcgctcgcgctcgccgccgcgcacatcgccatggcctaccgcgccagctgccgcgagcgacgccgcctgctcgtctacagaatcgacgtcgaagctgtaagtgatcgattc

SEQ ID NO: 15364 - DNA, 1501 bp, Oryza sativa
caggctgagcattgtagatttgtagtaagttaaatataaccaatctccagttctcaaaaaaagagagaaaattctcctaattaacattgtctcttgcgctattgtaaccatgtttacttgcaatggaatgtggaaccaaggagtagctagtatccggcagggccgttggtagtatagaagagagacaaataagaaagcaaagctagcaaaggtggacgagatgttgatggacccacaaataggcatggtcccaccgttctttttttttgcttgttttaattgtaattagttggaaatgtggaccacccttttcccagttggcgccaggtcctacatctggaatattttgtggggtgtggacaattggagcacatacgctttttagtgttttttctttaccaaaggataactctaaacgacatatttctcgttctttgcaagtacatttcaccaagtgttaaacattatatcgtgtaaaaattttctatacaaaaattcctttttgacgtgtcaccaaaaatcctagccagacagccacatcaaactcaccttaaaagtttcttagtagttttagaatggttatattctacaaagtttaagaaagatttatgtacagttcataaacattgtcatcaacttaatttccttactcctttactccaaataggacgagagaagatgcatgtacgggcgaaaacttaaaatggataaggcttggtcttctaaaaagttttatgcgcaaattatactcttacgtactttacatccatacatagcttgatcaaaatttccatacacaagcaagtgttgcaaacaacttctaattaagcaaacaaaagacacatagccccaaaaaagggatagtgatgccatgtattggattttgtcagctattaagacgaatgatcaaacgtatatgtaaaagttaaatgttgtgattttttttatagcaaatcaacaggagaggctaacactacactaatatactccatcagtttcgaaatgtttgacaccgttgactttttagcacatgtttgaccgttcgtcttattcaaaaactttttgtgagatatgtaaaattatatgcctacataaaaatatatttaacaatgaatcaaatgataggaaaagaattaataattacttaaattttttgaataagacgaacggtcaaacatgtgataaaaagtcaacggcgtcaaacatttcgaaatggatggagtattaaaatacaatatgtacaaaatatttacaggttatattacaacaaagagtatttccacctcttttgctctgtgcgtatggaaaggaaagttttccttgaaatcctttttccaaagaaagaaagagatctgaacatcatggaaaattagagcatatcttctaaaccaaatattccagcaatatattcataaaacttcttgtcgaaactagatttcggcaataataaaagagggtggctatcaagctggaaaagtgtatgggtttggaaacaaaggat

SEQ ID NO: 15365 - DNA, 1501 bp, Oryza sativa
ctatataaaaatataacaattttttaacacaaaacaaacaaactatcaaaatatattcactgttatatttaatgaaattaatttaatattgtagatgttgctaacttgatcaaactaaaaaaaagttttaaaaaaaatcaaaacgacttataacggaacggatgtagtagtagattgtattgcaaaaaagaaaaaaaattcgcccccaccgttccatatcataagtctcattgacttttttaaatcaaacattttaaaaatttgatcaagtttatagaaaatacaacaacatttataatatctattttgatagttcctacaaatttgattaaaactagacaagtttgttttagaaaaatatctaaacgacgtatgccggagtgtagtggaaccccctactccaccctcccttgcgataagagtttttttttctttcttagtagcttatcttctatgtatatgtaatcaaactctgctctcttcttctattatattgccgtgtaattctttttacgtgtccgtaaaagaaaataaacaacttatgccctgttacttctcatgcaaaaaaactttcaccctgtcatatcgaaagtttggacacatgcatggagtattaaatatagaaaaaaactaattacatagattgtgtgtaaattgcgagacgaatcttttaagcctaattgatccatgatttgataatgtggtggtacagtaaaaatttgctaatgacggattaattaggtttaataaattcgtatcgcagtttctaggcggaatctgtaatttgttttgttatcaatctatgtttaatactttaaatgtgtgtccgtatatccgatgtgacacaccaaaacttttcgtctcacgaactccggccgagttatgaaattaatttttccattcgtgtccgaaaacccctttcgacattcggtcaaatatctgacgtgacactcaaatttttttttcgcgaactgaacacaccctaaactgagcctttatcctgctaagctctcccgggttggagtcttcttccatttgctttcgagtcgtcttcaacccctccacccccgacctgttccagccgcatacacgccggtgtgcccattttgtcaacgcgcagtctccctgactttctctcctccccggcgctgcgcttcgccgtggagtgccgtgagcccgtgatgccacgcgacgcgccccccagccgacgccgacggcgacatctctgaaacatttctcctcgaccacggcaacccaaaaccccaccccacccaccaatccccaacccaaccaaacaccaccaccgccgccgcgcccgcgccagcagcagcagcaagtagagccacggcgggggaggcaggggggcagcagggcatgaagccccgcgagctcctggagcgcatcgcacggccgttcagctcgtcgtcctcccgccgcggcgggggcgcggagcggcggcggcgggaggaggaggaggcggacctggaggcgatcgcggcga

SEQ ID NO: 15366 - DNA, 1501 bp, Oryza sativa
ggattacaaactcgatgcagtcctcgacgtcttaggcaaggttacgcacctgcgttacccaggtcctcaccacattgttgttcgcttgccccctcccgacgacgttgaggaaggactgcatcatctggaactcatccgtgatgaacaccaggtcatgctgcaccctctccttgagctggttctcctccaagatcgccgactgcaccttgatcaccgtcccctccaccaccgacttggtgagcccaagcacaatgtccgccattgtttcctcagcctctactctctgatgtgtctgagtttgtggtgagctagaagcaaatgatgccgctaaattgctagatcggaatcatgggtaggagctgcatctggggtcggtattaaaaaggacagatcagccattgaacaataaatttggacattattactgtattaaactagactatccaggtcaatgaaacaagctggactaagtcctaaaaaaaattagtagatttaatctagcgaaagagcccttacgttaacaaatgtggaacagctgatgccttgaatgattggatcagtgagccttccccaacccaatatcttactcaactggagacgtattgattggtactacacgctgtaacatggggattggttgacaaaaaataaataaaattagtcaaattatcacaaacaaatcacaccgtttgataaacaaagtgggagtacattagtacaagcattcctactaattcctcagtctttcagttgtttactatgaattggtttgctaatcagtctatgtctatcatccaagatcccaaatgcgaacgcccaacgcctaactctatcgcaatccaagttgccttgcatacctcgcggctcccgggcgtgggcgctccggttcgcccacgacatcctctcagcctccgacggtggccgccacaccagccatcctcctccgcgacggcgagatccggcggtgagccgccgccgccgcctgtgtcgcctcccatccatgcctaccaaacccaccagtttgctccatttcgacgcgtggaaggccctgtgggctgcaaaagtccattcggatgggccgggccgagaccagtacgagtgagttgggccggcccaatatgcgcaattttatacccgtaactccgtttttcttcaatattgacaacttatgccctctttgtttaggcttaatattattggcttagacttttaagtcagcttattagcttatatgatttataagccggtggatttaatgtcctaagtttaatgatggagtcatgcatctacctcatataagccaaaaaagcttcaccaacctagcttttggcttaatagtgttagaatggcttatggcttcaaaaaagccaaacgaaaaagccgcttgtttgtttagacttagacttttccgtttataagttggcttataagcctaaacaaagagggcctagaactttaattgacaactttaaactacttcctcggttcctaattatttgtc

SEQ ID NO: 15367 - DNA, 1501 bp, Oryza sativa
caccacttgccgactgggcgctccctggtgggagtaccagcctctttctttttgtcgctcgcaggcctcccctttcgggtggcccgcggagcgccctcgacggcgaggacatgaccctcgtcgccggaatggaccgaccacttcttcctcctcctgtcacgccgccctgtctgagcggcggatccgggggcggccgaagctgccactccggaaccggaggggttccaggtccatgcttcctccttacgagccactcggtctgcgagctgaaaaagctccgcggtagtctggggctctttggaagcgatcttttcgagcatgcggttgtgccgcacaccccccctgaacgcgtagatcaccgcgtgtgcagggatgcatggtatggtattgcggacttggcaaaaccgctgaatgtacgagcgaagtgactcatcatcccctcgctgtaccgcgtgcaagtccgcttcttcgcctgggcgcggataagtgccttgaaagttcatagtgaactgttggcataaatcctcccaagagtggaccgacgcaggtggcaggttcattagccaaccccgcgcctgtcccttcagggccatgggaaagaaattcgccatgactctgtcgtcacccccagcggcctcaatcccggtcgtatagacctggagaaactcggtggggttgacactcccatcatacttctcggtgatggtgggccggaaccttgggggccaacggacattccgaagactcgccacaaaggctctacagccgacaccaccagccgggggcacggagggctggtcctcacgtccatgtcgaggtgacactctggacaaagaggcgccctccgttgcgcggggagtacgccggctattacgccggcgctcgatgtcgaggcgggcatccggctctccacgctgatcctcccgagtcggaggtgccgacgagggagtggcagccgaatggcgtgcaacagccgccgctcgccgcgccctccgtcttgacgacacggagccggtagtggcggcgccggaggtcttggtggtggcggaccgtccaccagcacccaggcgctgctgtgccgtcatgaccaagttggccacgtcgtccagccatcgctgggctggagactccgggtcagggacgacgggcgggtgacgtaggagcgcgccagcagcctgaagcgcgccctggggcgtgctgccgtcgccatagacgaggaggcgacgctccccatctcgccgttctcctccatcgcccgcgatcggtgaagccgcggatctgtcgaccctctcgagggcctccccctgcttaggactttggtgtggaggaggcggtggagtacgagctcgacggcgtgggtttggctccccgtcgtcgccgctcacactcggagagaggtcgtgcgcctttgcttgcccggccattaggctgaacaagaaaaacttggcgcacacggaaaagtgcgagagctcagaaaacacacgctgagccccctacctgg

SEQ ID NO: 15368 - DNA, 1501 bp, Oryza sativa
gcgaagtcgccgcgcggagacacgcgcggactcgaacagggttatggcgctctggcctcacacaaatgcatgggccttattcagttgggctgattttctgaggccctaaaaatttggaggtctatacggtcgcatgggccgcatgcccatgtgcacggccctgtttggagtgcattcgttcgcagcaacgaccgaccacgcgatatctgaactgaacacacagattgtcgtcgtttgaacaagagacacggccacaccgtcatgtcagccaaacgggcataaattaagccctgtcgtagcatggcaacatccagatatctcgcctaaactcgaccattgtacaaccctcactgtagctgcaagctctctcattgttcatgtgacattatatttcccccacgttttgctgtgtcaattgtaaaacgtgtagatgtgtaatatgcctcagacgctagctagtggcgctcagatgcctacgtacggccgggaatataatgactacatcgatctgcatagatatctttcacggggtttaatttttcggtttgaccgattctatcggaggtcacggatataccaaatttctaaaattttgatccgaaatttctgaaattttgaacaaatgttggtcaaatttgaacaaaatattatcaaattaaaaaaattaaaaaaatcggccgaaataataatgtatggggtccgaaatttcattccggccggactttcaaaccctaagtttcacgcacaacatttcaattcggcagcagttcgatcgcgatctcggccacgtatccacgcatgcatctggctgcttccgctttcgccgtccactacaacatttcaggacggcagcgagcatcgatcgatcgcgcctcgacacgccgactgatctatctccaaacgatcgattattccgatcgatcaacatagcttttgctctcctttaatttatgctgcgatggagacggccgcgttcgatcgccatttcccacctcactgctcacgctacctaggttaattagctactccctctgttttaaattataaaatgttttaactttgatcaatgttaaactcctttaaatttaactaagtctatacacaaatatagtaatatttataataacaaattagtttcattaaatcaacaattgaatatattctcataataaatttatgttgagttgaaaatattattattattttctataaatttagtcaaacttaaagcagtttaattttaatcaaagttaaaatgtcttgtaacattaaaaacggaggaatacctctaaagcaaaaggcttagcctatatctacgatgctctcctcctctttcttggctatctccatccattgtttctgtccttgaccacagcggcaatgggagagagagagagaaaaaaagatacctgaaatccactttagcccggaccattccggccggccggtgagtggccggcgggccccgccaccggcgatgatgcccagccatcctgcgagc

SEQ ID NO: 15369 - DNA, 1501 bp, Oryza sativa
tctttaggtaacaattaagatgttaatatgtactggtcatcattaattagttccacattttatacgtagtgatgcaacacatgctttttttcaatgtgtggctcagcgtttatcttattgtgctaagagagtagtgaagtcttagcatatctacagtgtcatggattattcgaccactagacgtagtatccgctatttttcaatgtgtgactcagcttttatcttcttgtgcaaagagaatcacaaagtcttggtatatctacagtatttgttatggattattcgaccactagacatagtatccgctaatttttcaatatgtgacttagtgtttatcttattgtgctaagagagtcgcaaggtcttggcatatctaccgtatttgtgatggattattcaaccactagacgtagtatccgctatttttcaatgtgactcagtgtgtttatcttattgtgctaagagagtcgtgaagtcttagtatatctacagtatttgttatggattattcggccactagacttagtatccgctataacgcttgctttgttgactcacgcggttacgccttggctagtccgttttctgctatttctgccttggctgtatgtgacggcccgtacatatcatggaaaagtttccataggagacactcaaatgctgtcctatggaatactgtctgaaataaatacagtgagtggtttataggtacccgtttttaatttaatcctaataaaaaatgaaaacttttttataggagttgattttagacaaaccagcatctataaaagattgaggagaggaatagtatggtcacctgtaccatctagcccgaccgctcattctggccggattccacctacttactatctgtggtgggaataaaagagatctttccctgcaaatttgtttgcgtaattattgatttagctatgtcgggcgtagggtttacattcatggttaatgtcaagaaagatttacgaattattgaaatcagctttagttttgtatattcaggcaagaattaatcctaggtgcaaatatttagcgttcgctacggtatgtttggtagaacttctggcagctgtagcttctcccaaaatcagaagctccccaaatagttcagtatttttctagattttaataaactatagttgtacaatccaaaaaattaattagaagccagaagctgagaaaaccagcattttcagattcttagaagctggctaccaactagttgcttctcataattccacggtaataccgacgggtaggatctagaggaattcaggcagaagtactgcctcctttattggatcgcatgtgaactggcttttcagagacctaaaaagacgaaacccctctcctctctctataactagagagataagactgctatagatagtggttacaacaatgataatgaatgataagttgataaacatgtccttggtacgtgtataaatgggataacttatagtcgtgtgccttctttatatat

SEQ ID NO: 15370 - DNA, 1501 bp, Oryza sativa
gcagagacccataggcagcccatatcaattaagttaggacagcattatttgttaagttgaagataagattagattgagttagagataagattagattgaatccttacttaggggtcaagctatgccatctatataaggatgggattgtgtctattatcatcaagtaatgaatatcaattagtctaacctctccatcccaataatgttcttctccgtagcctagatctacatcccttctccaagagccgacgccacctggctatcttcccggcagtgtttatcctgtcatggcctcgggtcatgacaacttggtatcagagccactcaccatagcttctgatgccgagtgagttctccgtgtcacggtgagtcatctattgtacccggtggatgagtatctactccaccaattgtttgatggctatggagtagaaaagaagattgaagtgcaccagatgggaacatatgtggaagcctctgttccgtttcaaactcgagcagccgctgagcatgcttggaacctcaacggccgtgccatctatgatggttgttggttggacatacagtgggagcaaccgtccaacaactccacgacaccggtgacatctctctccatgatcatcacggagtggaaggaagacatcaaggagttgagggctgtcctgcaggacttggtagcatttttgcaggaggagctggcaaaagaaaaggaagaagggcggcaatgggactaacggtgacgccggcgcttgatatgccatcaattcagtcaatccgtccagtggcctccatgtcgtcacaacttcaagatctccaagcgagcagatctgcgtcacaggccatgccaaggcggccatcgacctcttggagttggacttggcaacggcgtcatcgtcggcaaggtggagtgatggaggcgagcagagccgttgttgtgggcccacgaggacgacgaatgatggacgaactatttccgcgagctctagatgcggcagcggcggcgctgatcttggaggtggcagttggtgggttggatgggcggcacgtcttgctgggcgagaaagaaacacatcaacgccattcttttcacacagtaggttcgcgtcctcattgtttggaggcgctacggacgagagaagctgacgatagggttttttctctgcttctaatgggccgacaactattcatttgggtcgatcaagtggagtggccttccagtgccgcaactcatggcttggctgttgggttggccaggtagacctcggctgcagactaacgggcccatcttggatgtgagaccttggcccatctacaacatccaagatatcatgtgagataagtagtattaaatttaaatatagaaaagtggtgtttgttttgaaagagtagtgtctagtactagtttcttgatgatgtggagtttatgtaaactatgtctagtgtcttgggttgggactagccgtagaatttatatggagttgcattggttccaggcttgtgg

SEQ ID NO: 15371 - DNA, 1501 bp, Oryza sativa
cggagaggcgagccatggccggaagcgtcgggaggaggacgggggacggcggatggaggcgcgcgtcgggaggaggacggggaggaggagcaagagagacgtaagagggaggcagcggcggcggaggaggaggaggctgttcccgcggcgccaccattgttggcatggtggagcagctgcgtgggcgacgtggacaccaccatcaccaaggaggcggggactgggaacggcgcggcgcggcgtggttgacaccgtggcgggcgtggcgctcgttgatggcgacggcgcgtacgcggagggcggcaatctcaccggcgaggcagcggtgcgggaagagcgtggcgagcaggtggtggtaagttcggcatgcatttcttttttgtgagatttggttattttctcaatcgtggtctgatactaacactaacgaattcctttccttttgtcagttccccataaagatgacgacgctcttgcgcctggagaaggagaccggggagcagcaaacgtaggtggtctctacgagctgtatgtgacgttaccgccatgcggaggaggaggagggggctcgagagggcctttttcttcatatgctgtagctggacaagcggtattggtcgatgcagtcctccgagtcgtaggtgagctcgtggagctgcttcatccactctaggacgaagtggtccacggcgccgtcgtcggcctcggactgcacgcggtggagggcgttcatggtggccaggtcgtcgcgcagctcggcgacctcgctgccgacaccgctgagctgctggtattcctcggtcaacaactgaccaacgttgcttacgaggttctaagccgcgttctccatgcttcgatctctctagcttggttggctggaagctagtttggtggccgtggcggagacgcggatgatggccggaggtggcggcgagacgggattgtggcgaagaggcaggtggcaaggcgcgccgacccagctccggccacgagcgccgccgtctgcgccaactgccaccggagccggccgagctcgtcgacctgccgccgccacccaccacccgcccccgcgcggcgccgtgtgcgccgactgccctgagcccgacggcccaagagagagggggggggggagagagacatgagatagggggagtatatatatgacaggtgggccccacaataaaatgctgacgggattcccacatgtacgtcacgtagaccaaaaccaccgcggattgggttgaggggggtaatttgtccggtttgcatagttaggggtgaaaaatatccggttttgtggttctgggggtaatttgaacgaccgcgatagttgggggggtaattcgtactttttccttaaaactactatatttctcatgtaattttacgtgaaaccagatttataagcagagttgaatttaatgtatataacccttgctttgtttttcataaatgcaagtaggggatttttttgtgcggtctagttaaacaagatttgata

SEQ ID NO: 15372 - DNA, 1501 bp, Oryza sativa
acttcttgtatgtgcactagtgatacttgcgtgcaactttcgtcgtgttcggctagaacattaagagtttcagcggtattcaatgcaatttgatgcatcgtgttaccatactctctctgggtcatctgctcggtgaatctagttgaaaatacccattcttgcttataattcttgctctatgagaggtagggtatgtaccatactcttctaaatactaacacgcttattcttctagcctactcattcatgagagtagcttggaggcactggcgagagtttgaaatgctagatcaaactcatcgagtcaatgcctatagcgcgattggattaacggtaccatagagcttcttgctctactgtaattaaaatatgtcagagatactctagattcaacaaattttctaatccgtgatgccagtcatctttcgttattcaaaaatatgcgcaaattaaatgctggtaaaatgcacaagtgttgcaatataatggtacacaaaattcccgcaaacaattccagtatatactatgaaattctattcattttaccgcaacgatattaattaaaagtaataaaagcatcacaaataatcaataatcgtaaatgcgatagataaatttcataatcatatatatcagcaataaaagtacctgaaatacaaagttgggttcgaaattcaatgtcccgtggctcttttatgcgagaatatgattttggtgatatttgcaaatttcgaatgccactcaaacaaaaatcccaatacagagggttaattgtgtattttctgaaaaatctagggtttataaaggcaaatttcctatgcagtagaatatgcacttaatttctaaaaaatacgagggcatttgcaaaatcacgggaatctttccatttttcctttttctttccttctttttttttctttccttttctcttccttatgctttccttgttttctcctcccccgattgcgtcgcctgccatacgcggcagtcggccggcggcgagcggcggcagtgcacccgtgcggcggggcgcggccgaggcggcagcggcgcgggcgcacgttggcaccgggcatggcgaaccaagggcggcgcggcggcgggggcgcacggctatgccgcggagcggcatggcgcggcggccaggaggcgcggtgcggacgcgcctgtgcggtggcggtgcggccaggcggcgcggccgtgcggcggcgggagcgctggccggcggtcgcgatcgtgcggcggcgcgagcgcgcggcgtggcggtggactcgatggcgcgcggagcggagtactagccggccactcagtggcctcggcggcgtgcggccgtgcggcggcagacgtcggtggcgcgacagccgaccgaggcgaagggcgcgcgcggcgtgcggcccttcgtgggcgcggcggacggccaggcggctcacggcgtgacgccgtgcggggcggcatgggagcggtctgggcggcacggggccgtgcagcggcggtcgtgcgt

SEQ ID NO: 15373 - DNA, 1501 bp, Oryza sativa
cgggcccaccggtcagcgacccggggaaaaggaggggcggcggcgccacgtggcggccgaaccgacggccccgatctacccaagggtagatcggacggcggcgcgggacctcgcggccggggcgcgcgggcgcggcgcgagacggcggcgaccatggcgccggcggcgcggcgctcacacggcggcggcgcgcatgcggcagcggcgcaaagcgacgaccgacggcgatcgtccggcggcggagagcggcggctagcggctctaggaggagaggaaggggaaaaggagggaggggatgcctcaccgagggtggccggcgcggaggaaggcgatggcggacggcgacggcaagccacgggaggacggcgtcggctagcggacgagctccggcgtgccctaaggaaggagaagagaggaattagagagagagagatggaccatggcgatcgggatccatggccgaaggcggcggtagaggtggcgctcacccgtgcgcgtggagatgagggctccggcgacgaacctcgacggaggaggggcggacgaggtggacctcggccacgcgaagctaacggcggcgacggcgtgagacggcggcgagcctagcggcggctagcggcggccggagtagcaaaagcggcggcggcgggtggttgcacggcgcggaggcgttggggagctcgggagaggtcggcgcaatggggaaaaagcgagagggggtgccggtgatgcttaaataggggatggggaaaccggacgtggccgggagcggcgggattcgacggccgacgtgggggagtggggaggagagagaggcgggattcggttttcgaatcccggccatctcgggcgcggcgcgagcgggagagggaggggaacgggcgcggagaaggcggcgcacgcgcgggcgtggtcgacgtggcccgggagagacggaggcgtgggcgcggcgtcggttgcggcggtggcggcgcgagcgggatcggcgggaggagggagacgggtccgacaggtgggccccacctgtcggcgaccccgagaggagggaggcgggcggccggctgtcgggctgggcctcggcctgcggccggcccagtaagggaggggaaggaagggagaagtgggccgacggcccacttgacaaaaaggagggaaaagagaggaaaaagaaaaagaaaaggaaaaaggattttccctggaattaacaattgtactttagtgatttttaattggttaaaattatttctagagctctgaaaattccactaaaaatcctgttaatgaatttcgacatgtagaattcaagaaaaattccacatgtcaaatccgattattatttgcattactttcttagggttttctcctgatttcaccagcattttcttagggtcaattataaattacaattttgactagggaggaaaacttcggggtgtgacaaacctaccccccttaaacggaatctcggccccgagattcggtggagctggtgaagaggtac

SEQ ID NO: 15374 - DNA, 1501 bp, Oryza sativa
aatctctcaactctccaaagtagttgttgtctcttctacaaatacatcacacttttgattttaatttttgaaaggagctacatgccgtcgtgagttgtgagtataacaaactcacactttgacttgtataacaaagtcgtttttcatgccatctgaaaatgacattgcaacctgcatatctctagttatttacaacagttggttcacctttgattcaggcggttcaactaggtaggtccgtataggttttgttataactttttttttttgcggggaaacaaggatatattactcagaataggagttctcacaaagcaaatgtgagatagcaatacaagagtcatccggccagaagtaagttaaggattcacttcggcctttatttgctaagaaatgattaatgctattctgagtcctgtgcactttattaagtgcaatcacccttgttccagccatcggggaagattaaggggggaagaaggggcggacgctgggacgtgccacgtcggatttttgctacagtcctacagtaccggggctggtctttttgcgaaaaataagttcaatcacctcgttgactacgcacgcatcagcagacaataccttattcactgacttgatcagctggattgcttcttggcaatcggattcaacgacgatgggcagcagagtccattggagggccagggctattccatctctgcaagctagcagctctgtttctaaagctgatctgcagcgactaatgtggccacagcccaaaatttcctggtggccctcttaacagctggggcaacactcttgtcagctcaaaattcagtgcaatttctggagctgattttgagcaactacagactggcagtaggggttgcgttgaaggatattgagccgaaagacattgttcttggtcgatttcttgccctccaggtcacaacacgactgcatgtgccctgaaaatcgagacgttggtgttccttgttgttttctgcaatcattgcatgttatgttattgtggagattatggatatcccatatctacacggcgatgatatttgggctgaatataggataccgaatatagatagaatatcttatgtgtatcttgggtttgtttctcaacttgtgcatcaaggaaataccctgagacttagtcggtcacgactgtattttatatgtatctgcatattccgttagggatatagattgtcttttgtaacacggactcctccccatatataaggggggtccgggtgcctctaggggcatatgttgtttttccccaaatcatacaatcaataatacactcggcggattcatccccggacaggagtagggtattacttcttttataagaaggcctgaacctgtataaatcctttgtctccaaacccatacacttttccagcttgatagccacccccttttattattgccgaaatctagtttcgacagttggcgcgccaggtaggggttgcgtcaagcttttcgccgatcagtgcaa

SEQ ID NO: 15375 - DNA, 409 bp, Oryza sativa
gcccattcccgcaaccatgcatatggaaacccggattacacatcccaatgcaatgcgtgggacggatttgtttcaatttttgggtacaaattaaggctaattaaaccccaaggcaaaattctatagtttcgcctcgatcgatctggcaatgatcgatatatttacatataacacacactcttaaatttctctaatctctagctcacatgtagctagcacactctgatcctaattctccgttggtttcttcagagattaatttgaattttgaagaagttcatctcatcatcaaattataggtacatatatcgatgtagctaggaatgatgaacctgatgtgaagcgaaggatcaacgatgatatggatcatccatcgatcgatcattgtagctagggcagcaacagaaga

SEQ ID NO: 15376 - DNA, 1501 bp, Oryza sativa
cctgagtgcacgttgactacaaggtcctgttgcctcctcctccgtctcatgcttttgagggcacccactggatctagctcccatggaggaagggggcaaccagctaggagggaggctatcgggaaggaagctgaccagcgtggacttctcgacctcctttttctaggcgcgttgccgatggtgatggaggggcaacctacgaagcttctagatctagagctttcattgacggcgacatgatcgtgagccatcatgatcattgccggagcgtgtgtaggtacgtcgtgctatgtatcgggtctgatacctggtaggtaccatggttagtacccatggtatcatgacttacccatagatagcaaacctgatacctggtacctgcgaggtatcaagtatcatggctggttgtgaggtatcaagtatcatggttggctgcaaggtatcaagtatcatggctggttgcgaggtatcgggtatcatggctggctacgaggtatcaagcaccacacgccctctctcctcttatccctctctcctcttatcccttcccctcgacttgatccttgtgtcctactactactgcaacttcacggctagggactagtcgacgtttgagatcgcaactacggtattttgcatagtatggggattgttgcgcttgtcttggcgtgtgttagcttgatctgttgtatgtcatgtcttgatttgttgttgttgttgttgttgtgtcatctctcccctagggagtcttgtatttataccaatagatgtccccttgtccaaatagaactaggaagaccaatatggatacaatccaggtagtccttgtcgtttccatatagaactctattcatccttccttatccggatctccttctatatacgatgtatgattctctataagacttggtacatagtgggtcctgccgagcttagtcaactactattaggtatgtggtatccataaccatgacaaatgtcactctctacgtcgccctaagtgttggttcaagacgtcaggggcgcgataccaaggaggatattggaggaagagggcactgctgctctggttagctgcggtggcactccctcgacgacctaggaggatccggctagggaaagtagcgaggaatcgcgtggacagcaggcgacacggttgaaaatatctattaatttatcgggtgtttaattatccagtgaaaaatcagcattatttacaattgtccaaaattaaactctctatgctggtctgcgctagctgccctcctaaaaaaaatcagcattatttacaattgtccaaaaaatcagcatccggccacataaaatctgaatcggctttccgtaggctaaaccgggaaactacttctccctccataatcttaaacggaaacccaatccttaatataaagttggacacatattctgaataatagtaagtgtgcacgtgcaaggcacgttaaacattcatggttttacactaagaattgagtacaccctattt

SEQ ID NO: 15377 - DNA, 1501 bp, Oryza sativa
ctttttatttttagtctaaattcagtcttctaatggtttatcatttgcccatcattttctgatattgcgtccacaaaaactgacattcaggtagctttctatgccaaagcaatttctaaaattgatgtgctttttactatgttttttagttggatatattttagaagttggattttactgatatttcataaatatttgtaggtttgatttgaatttaattttagtttgactactgcaacaggttaaactgaataaattggataaaaggagtgccttagtcatccggaactgtaagtaagccaagttttcaaaattttcagctagatgcgttgtgtattgttggcgattctgaatgtctcttcgatttccactgcccattcaagatataatataatggatggattgaatcgctttgcttatactgtgtccaattgaaatgtggtttaatccttggccttaatatgaaagcttggcttggtactattgctatactatgaaatactactttataaaataagttgcttttagtattcgtcctcttatcgggctgcaattttcttttaaattgaagctggaggacaactctgttgatgacaatgccatattttctttttttgtaattttctctattatttggtttccatacattcacacatatttttcttgtgatccattccttccagaaaaacgagggatataataatatagcaccttccaaacagtataaataatctcatccatctttatttttcttcatattagctgaaatagggtgtactcaattcttagtgtaaaaccatgaatgtttaacgtgccttgcacgtgcacacttactattattcagaatatgtgtccaactttatattaaggattgggtttccgtttaagattatggagggagaagtagtttcccggtttagcctacggaaagccgattcagattttatgtggccggatgctgattttttggacaattgtaaataatgctgattttttttaggagggcagctagcgcagaccagcatagagagtttaattttggacaattgtaaataatgctgatttttcactggataattaaacacccgataaattaatagatattttcaaccgtgtcgcctgctgtccacgcgattcctcgctactttccctagccggatcctcctaggtcgtcgagggagtgccaccgcagctaaccagagcagcagtgccctcttcctccaatatcctccttggtatcgcgcccctgacgtcttgaaccaacacttagggcgacgtagagagtgacatttgtcatggttatggataccacatacctaatagtagttgactaagctcggcaggacccactatgtaccaagtcttatagagaatcatacatcgtatatagaaggagatccggataaggaaggatgaatagagttctatatggaaacgacaaggactacctggattgtatccatattggtcttcctagttctatttggacaaggggacatct

SEQ ID NO: 15378 - DNA, 1501 bp, Oryza sativa
tgcatgatgacttagcatagcgagagggagtggctgccggcaacgtctggccgtgagtcgttgtaactctcatacgctgtatatgatggatcggggaggagcgcccgtaataagtgccccagagatgtatactacggctgaactccattaccaaatatcgtgtctcggtgtcgtcatcatgtttggatctcctatgatgttttcttccgcgtttagctaccgatgtagatttcgggactggttttataacaatacggtctacggatatccccgccgataatggtattccctccgtttcatattgtaagccattctagcattgtcctcattcatatagattcatgccaaaaagtcttacattgtgaaacggagaaagtagtttttatgggatgagaatggtgaattgagggagaaacttcctcctattcaatatacacaccttctgtcccataaaaaactcaatcctaaccggtacggatatgaacacgtgggtgcctagattcgtagttatgattgaaaattttctaagaccaagggaatacttggtaggaggtgataattgagagaaaattattcctttacgtcgcctaaacagatcaagtctcaaccattcgtactccctccgtactcgtaaaggaagtcattttggacagcgacacagtcttcaaaacacaactttgacttcttgtttctataaaaatatttattgaaaagtgatattgtcagggttatggataccacatacataatagtagttgactaaatctcggcaggatccaccacatactatgtcttatacggaaactggcctcgagggagttccggataaggaaagacaatcagagttctacatagaaacgacaaggactactcggattgtatccatattggtttccctagttctacttagacaaggggacacctatggatataaatacaagatcccctaggaggagaggggagggggaccatggaagacacccatgacaatcaacgtacgcccaccagaagacacaacatacaagcctacatacgccaagacacgccgccggatatcgacttcagggataggcatggctattcccctacggtgtctccggataatgtcatgagatacgaaagcgctatctctgatctcgccggacacggattcgaggaggaaggctaccctgttgtcgactaaaagtcagaccttcagaccgccatgtcgacaatagttagataggctaccccacatattgtactggtgtgattatggtgaataaaaagcaacatcggctccgaccaacaggatgtagggctattacctgactgctcagggacccgaacctgtataaaaatccctgtccccatctcttttacctcagtctcgcatatatcctaacactaacgatccccatattgtccaaataccgtagtcgagacatcaaacgtcgacagtggtgcgccaggtagggggattttggtgctctaggatttcgacgagatgggtttaagaaga

SEQ ID NO: 15379 - DNA, 1501 bp, Oryza sativa
gttggtagttagcatctgccgccaatttcagaacaagccacatgctcttcagtccttcaccctgagcttgtactagtaatcctgtaaaaaccaaattcacctgaaggtttcaaccgagctgcaagagattagatttaaaaaaagagagagctttacagaatctttgtatctcctagcaaaagaaaaaagaaaatctctgatcctaaactctgcagtgagatagttttcatgtgctggatcttgatcttgactcatattaggaagcattgacactttgacagtaatctttatcaaggcagctgggagctggagcttaagatggccggtggccggtgtatgacagcaacaatgatcatgagacttgagagtagttattagtattaactaattgtagcctgcttcagtaagcttgtgctgcgcccaaaggggttggaagcacgtcacctgtctgcaatctgcaatggatttcttttttcctttggcatcttctcaagcttcctactactactccgtactagcacaggaaaaaagcatatatgtaatttgtttctttgtggttgctgattgctacctgcatcagagttgtttggtttcccgtggccagcagtcaccgacaagtcgacggcgagtcgccggcgtccaccatcaaaagggacatgcatgcagtgatgcaagaatgcatcgaagattcagaaattcaggatcagattgtttcttttcttcagactagtcacctacggtttactattgctcccagctagtatgaccgattaaaccgtgactacagagcaagcaagaataattctgtaggtaatattttacgtatgtatcatttgtggtttaaaagcctatatgaaaaaaatagaaaataataaaaatcttcaaaatcacctttaaatttaaattttggctaacgagagcggatgaaaaactcttcaagaactgcatcgtttcgccaaatactaataatacacaataatagtaatttataagtaaattttttatatatgtgttgttagcgattcaaatgtcattgttggaaaataaacttcgattaaaaaatcaactttaaaattagattttaaaaattaatttttggcattagctgatgcgaggagacgattacgactgcagaatcgctcaccttcttcttcttcttcttcatgggcagcgcgtacaaaatcggagctgattgcctgactatctctgtctccaccgagaacgacaaggtcgcgctccaatccagcgttgccaacatgggttgatgcgtcaggttggacgaatccccaaccccaacccatctggacactagactattttgtctccctctcaaccgtcgctttctccggcgacactccggccgccgccgcggcggcgctgcggttgagctccggccgccatcgtggggggagagcttccaaaaccgaaaccaatccaacggcccatatcagtccataacccaatccgttcaatcccagccgtccatccgtacaagccacgt

SEQ ID NO: 15380 - DNA, 1501 bp, Oryza sativa
cttttttatagcctttgatattcccaaaaatattttttaacagtactagctagacactcctataacctgtggggcgaaatgattcttttggctgtaacccatttaggcaaaatggtcttttttggccacttgacgaaacaacaagcaaaggtggtgtatgtggggcagccgttttcagaaccactaaggcatggctagaaagaaatgctactgcatcttgttaatcttgatacatgtagtatcaacttaccccatgagtcaaaaagaacattttagagcttacgtgaccttttgcctcacaatatatagtttatagagttcttttcccttttcttgccccctaaaggctacatttttatcccgctatatttaatgaaaatgcacggtctcatactgttttcccttaaaaaaccattttacaaataagttgcataacttcttatttattttctttgaaaaatttataacttatgctgcaatccatttttcccttttagagcaaagatcattatattaataatgacccagcttttggtaaaaagcccaagaaacatccatgtgttatatccacccaaaatactatcgatttaacacaacctatctaatttcagattcataatatttgatggtgttaaattgacactatattgttatattataatacagagtatattaattaataaccgttaccataacttttgtgaagtacttggtgttttacacgtttttttaaaaattttaaagtagaccttttgaaaaaatatttttaaatctgaatcttttagccacgctagcctgtttgaccaaataattctgtcacgccagatgtagctggcgttgccaaataactctgtcacgacacgcgctctaccaagccaccgtggttggcgtggccaaaaggttccgttttttaaaagatttatttttaaaatttaaaaaacaaaaggtctaaaaaataaaaaaaatccacatcatacggtggcgtgaggaagagagtgaatttaataagtgatgaagaggatctcaatccgatgaggagaggagaggttagcacagtgcagtggctgctgcactgggcactgccgcatgccgtagagcttgagctactttgcatttatggccttggccatctctccaccccgagcccgcagccactgcatgccctcctcctcttcctcctctcctcccccatccagacctccaagccctgcagtagcagtagcagctgctgtattaatggcgccgtaggcagctcactgcagcatccatcgccccaggcaatggtggtggtagtttgctctcttctccctcctcggctcagcccgagctgcatgccagcttaaatgcttccccagagcgagctcatctcgctctcgcccgatccaacgccgcatagctagctagctagctacctcgtcgctgcgttgtgtttgtgctgctgcattgcgacattccgatcggagcttagcttagctttcgtcgtcgcgaatggcgacgcgag

SEQ ID NO: 15381 - DNA, 1501 bp, Oryza sativa
gagggagtaggcaataaacgtatcaatagcaggttcacatatcctcaagtccccaagagaaaattgccgtaccagcagtccccaagcattcctaacacagctccaagttgagaacacagttcttggttgtcttctttagatttcaactcttccctgatgtcttctgcacacatactgagccttgactttgcactttcaatgttctgtgcgcgaaaagcctggatatgtaaaagtcagaggtattgttaaaatatatagagcattaataaattaatacagaccagaggatgaaggatatatgcaaatttcaaaggtaaaagaagctcagagtaagaagcttatgggagttgatttggtaactgaccctcatcgcttgctggaccagaaaagctcctctctccatggagacatgctcgtaaatgaccttggtcttgtcacttgcggcttcaccatcgcctgcagcatgtgatctcttgattcgggcatggccatcaatgaagcggtcgacaaggccttgaagctcatcatcaggctcgatcccttggatgtcagcaccacacaatggacagtccttaaagcgcaatatgcatgccctgagaaggaaatccagtgttttggagaaagacaaggagatcaagtgagaaggtacatatattgacagaacgaattagaaagctattgaaatatgatacgcacttgcagaacttgtgcgagcacggggtgcatttgctgctttgatgtagcagagcgtggcagaccacgcagctgagtgggccaagcttgaaggtgttgttggagtcatagccaaaggggcactttgctggcaccacacgaggatcggtgttagcattgccagttttttcattatcgtcgtcgtcggtgtgattgttggctgtgacaggacatgaggtggttttgttgtctgattttacggggcatgtggcgccagcagaggcgagtttggcaaacgggcatagagagctcataatcggttggtcttaggtggattattatttacctgcataaaagattggtggcaagcagttgagtgaaagcatgagactagatgcagtagtagaattgaattgaattgagaagaatgagagagattgttaaagtagggagctaagcagaagcttgattattagatagaggttgggaaaaaaattggggttggtttattttgtaagaacaatttatctatcaatctctatctatatctatctataactaaatctatatcatcccaaaataaatccagcacatgagacaatccaatcggaaattgcaaatcacaaaataaatcacacataagatgagagaagaggtggaaatcacaaaataaaatcacatcacgtaggagatgagaggagaggtcgccggaccttatcctcgccgctgtggaggtcccgagctcggagccgaatcccgagccgcggcgccgccgggcagccgctgcgccagggagccactgagcagcctctgcgctgggagccgttga

SEQ ID NO: 15382 - DNA, 784 bp, Oryza sativa
gcaatacaagttggatggataagatttaagcttgcgctgtaaaattataatgcaaagctcgtgattcgcaagacttttaaactgttggataagacttttatggagcttgtcattgactcattgctgctgctgctgtttgtagtttctgattctgctcttgcgtgactgcctgcaatagaagttggatgaattaagattaagcttgcactgtgaaattatattgctttagtttgtgatttccaagagttcaataactgttcgagatgattgatagaaaaatttgcaactttcgtgtgaacttagacatgaactggttcttaactggcctattcatatggttaattcattggcatgtgttatgttactttctgactattagtgagttgtgcctattgcaaccttgtaattttgggggtagcaaaatattaggaagaaccaaaaattgaaactagaaactactctttttggccagtagtcatggctattaattggttatttcgttgattatattggatcactgattgattctgctttactgatcttgtgaactcaaaattactcatggcttcatggacttatccttgcctggacgacacttttgtttatggcgtaaatatgatactgtgttactgcgatttaacctattttggcatcaatgtctcattgttctaccgaagacacgtgtgtatctgcttgtgtgtatgcttgcagtgattgaacatagttggttatttaattctggactgagatatggtggcaacaattcctaattatgacagatggc

SEQ ID NO: 15383 - DNA, 1501 bp, Oryza sativa
ttggtcaaacacaatgcgagcagccattgtccgcccacattttgcatacatatcaatgagtgcattacataagatcgtctgtgaagtagacccatgacggacagccttgcactgcaccagcatactgtacatcaaattcgctgtcgctgagcaggcagtgagagcacatgtcagcgcaattccattaagctcaatcctccccagaatcaagaaagcgtccatgaatgatctgctgttctccacacagcctgaaaaaacagcgttgtacagaacaacatccttttggcaatccgtgcacagtgcactgtgcacatgaacaacctcatcgcttcctcaacaaggacatagctcatatagagatccacaagcgccgtcgccctgatgacatcgtcctggcatgcaagaacgcagcgcgcgtggacctgacaggctgacagccagggcggagggccatggtgcagagggtcgcggccgtgggcgcgaaccgcgcggtggccattccccggaaggcgtacgctgcggtgccggggcgcgcgttccaggcgacggcgtcccgggcgggcatttcgtcgaacaggcgggacgcggcggctgggaggcccgcgttggcgtaggcagtgaggagggctggagggcggtggccgggatagggctggagagggaggaagacttgatgagggtagcatggactacgggagagtcggacgggtgggaggagaggcggcggagcagcgcggcgagcggcggcggccgccgcattgcgcattgcatgggatatctatgacgggataaacgctgtatttagctccggttccagccggcagccgctgccttccgagtcgtggttagagcaaggataatggattaatggtgagttctttctcccaacttttccctgctcatatcctcgtgttccgcgtacgtttttcaaactgctaaacagtatctttttcatgagaaactagaaagcaaacacagcctaatagtagagctcacttcctacaattagtttattttaaagccaacatataaaatatattagctataaaattggctacaattttcttctcctctctatctcacttatacatttaatgtatttgtcctgaagcttgtgttaagctagctcttgtatgagagccaacacccttgattttttctgttacctctcttatttacgtaagcttataataggcttatagcttactattatccttgctcttatctggctttcttgaaacatgttgttgtgtactctttcttctcgattcctgccactgcgaccgccaccgcaaggtttggtggactttggagttatcccgatactggcgatatgaatgctagtatcttacgattatatcaagccgaaacaattccgatctcacatagtatcttaattttcatagtatctcaagacaacatggatagatgacacaaactcacaaaccccacgaggcaaaccaaacaagaatgtagatttaaacgcaaaccaaaccctttt

SEQ ID NO: 15384 - DNA, 1501 bp, Oryza sativa
cgccgccgcaatccgccgccatcgagcatcccccggcgaatccgagccgttggctcgtctcccctcatcccgtgcaacctcccggtgcactcgcccttgcttgcatcgctgtagatcgccccgccgctcgccgccgccatccgccgtccgttccggccgacgtcgtcgtcttcctcacgccggcccacgtggctgccacgaaggcgccacgtcggcgccacctcggccgcgaccgggtcaagctgaccccggtccgccgctcccctctgccctgctcacgcgcgcggtccaccgtgagccgtcaggctgcgcgtaggcccgccgcatccgcacccacagcgagccgtgcgcgtgcaccgcgtccctcccgcaaaccctagcgcgcgccgcgtgctcgctccgtacggtgaactgtgtcaccgacaagcgggtcccactcgggaccacgcgaggtgagcccggtccaccggctccctctctcctccccacccacgcgccctactgggccgagtcctcttgggccggccggcccattagctcggccgagccgcgcttcttctctcgggccgcgccctagccgcccgagggaagtctactcctcctccctctttcttttcttttcaaaagggtttaaataaatcctttttcctttagataaaaaatccaataatcttagaaattcaatatcttctcaatcgtacatccgattgactccgttcaacttccaaaattcctcaaatctcgagatctatctaatggcacgcttagaggtcaataatagggctttgttttctctgtttgttgagttgtcccgtttcgcatgtagtttcggagcccgaagacccgcagtgcgaggatttcgaggatcgagctcaagatctcgagcaaggcaagtcacctttgatcatcttgccctataatttaaatctaagtatttcttttccgcaaatattgcatgaatagtttaacacaagtaattcggccgcggcttgtgagatagcctgccggccccaatcctaattgctgcaattaccctccttgaattattgaacacttaaaacctcctttgtcaactgttgtgcttcgatgcacgggccttcgggcacgggcatcggaacacctcccctcaaatttaaaatatccaacgatgggtaaaacttggggttttacaaaagacttggaaaacccgacacctgggttggtgcttgcgaactaaatgaatttccaaaaccgcagaccgggggacgtactgggagtacggtttctagttcttgcacttaaggaccgtttcccttggaatttcatccgaacataagacaagtgcgaccacatgggtgaaatgggacgcccctggctgagtaattagctaatcgggggagccatgatgccaagagacatgtggattcaacggggtggtgccgaggagaacccccgggcttcctgacacagtatggtctgggacctaacctgatatcagtctgggacccctctcgttggcata

SEQ ID NO: 15385 - DNA, 1308 bp, Oryza sativa
agagggcaaggggcggcagcttaatggcgacgcgacggcagcgcacagggctcggagcggcgatgcgacgggtggcggtgcggggctcggggcggcgcggggctcggcgtgcggtggcaggcggtgatggcgacacgcgcgcggcgacgggacgggcggcggcgcgcggcgatgggacggcgacgcggcggcgcgcggcgatgggacggcgacgcggcggcgacgggcgacgcgacgggttggagacggtgcggcgacggcgacggtgcgcggcgggataggacgcgaggaggcgtggcagcggcgcgcgcagggcgatggcgacggcgaacggcgcggcagggcgatggcgatggcgactagacggcgcgcggtggcgcggggcgcaaggcagcagcaggctagggtgctggctagagagggggtagttaggggacaacatcgaacacctagaggcctatgaacagtactagccgatttctttggattttattagatgttttccaatttagagaatggactattgccacctattttgtcacaacgtatttcacacaaaatctgagttattcaaatgtaaatttgtattcacacttaatattgcccacattttatttttattatatatttttctaccttttcctattttcctacttttagggcttttggttgaattataaattgagaaaaattgcaaaataaatttgtatttactcctaagcatttgagtgaccatattatgtgttcaaatgtgaattttcccaaagtttaatattgtccaatatttatcctagatttttataatttcccatatttggggatttcggtatttatttattttgatgcatattggtttatctttttaaattggttttaccacaacatggatttctataatttaatatttgtgattcaatacaaattatataatatcgaattaattattgcaagtaaaactattttatagatagagttccttctaattaaatggtcatcatttcatgtgcatttatattatcgcacccacctacattattcaaatattttaatatttgataaaatagattaatgataacttttattttattttactatcttgtgcataaatatttgtagggctaaacataaataatatactctcgtaaattatatctattgcttgaatgcagctcttttctttactttctttgtgatcatttacggtttggcaagcaatagcgatcataacaaccagcatgacgcaaaagttttaaaaagttcgaaatttttagtgatttttattgttgggaattttcaggatgttacact

SEQ ID NO: 15386 - DNA, 1501 bp, Oryza sativa
aaaaataaagcataattctggttattctgaactgagaatcaagcatgaaaattaatcagcagtggtacgaattaactcactgtcagagccatgatgaacgccaccaccacagagagccatacggcgtttataggcacctcttgcttgttcactcggtgccagactttcgagaacggcattgctccgtccctggagaacgcatacgccatcctgcatgcagtggctaattaacctaggaaattatcaacatgtacgtagctaattaagctaagctaaattcctgaacacgtcagctgatcgatcgatctgacctcgagttgctagtgatgcaggcgaggccgcagaggaagacggcgacagcgacgactcccaagcagaggatccctcccaggccgctgccgtatctccggtggaaagtggtgtagaaagcttgagcaaccgcgttgccgccggcgtcgttgtcggggctcaacaggtagggaatgtccgtcaccgccgacgtgagtgacactatgtagatccacccgaacacggtcgagagagcaaccgaggttacgatcccgatcgggccactccaatctgcattcttcgtttcctctgtctgatgcatagaatgatatactgtcagagtgtcagtagtatttgcagtttagatatggactactgtgtctaggggcgaaatcgcaacgtaccatatgagcagatgtgtcgtagccggccatcgcgtactggctcatcaacaacccgatgagtaaaatgtaagccttgtcgcgtatccccatgccgttttctgtgttgaagtgagtgaaaatgaactcaacgctcgccctttccgtggcgacagccgggatcaaggccaccagcacaaagacacctagcaaacgaagaacaatagagtgatgatggaatcgatggtgacttaataaggagatcgattgcaagaggaggaaaaaaaaataatttcattacctgccgcattccaaaaagctccaagctggccgaaccaagagaggcactggatcgggaggctgttgatagcgccgtggatgacgagcatggcgccgtagatggcgagcacgacgtagttggaggccatgtagccaccgccgttggctccaccggtgctgagcaagacgatcacctggaccaactgcgccaacgcgaagtccacgctcgtggtagcggcccactatgtcatcaagagatccatatagcgtcagcccactgttaggcttttctgtacggaataagttcacattgagtccctctatttgtcactcagtccgattttcgttcttgaccgcaaaaccgggtatgacccatcccccaacttacaaaaaccgtgtagacgaggtccctcagcggttttgaaggtgattttggctgatgtggcgactacgtggcttgtttgactagatattcgtcccacgtggcattgacgtggcgcttacgtggcaattatatctcgaaaaaataataaaaaacatgggacccgcatgtc

SEQ ID NO: 15387 - DNA, 1501 bp, Oryza sativa; identical to SEQ ID NO: 14932

SEQ ID NO: 15388 - DNA, 1501 bp, Oryza sativa
atcaccccgcccaaagaggacggcggcatcgacaacaagggcaccggcatggccttcttcctcgccgcctacccgtccatgctcccgagcggggtcgatgagctcggctacaacatcggtctcaccgaccaaggcccggacgccgtggcgactggcgacagccggttcgtcgcggtggagttcgacaccttcaacaacaccatggtgcacgaccccgacgccacctacgaccacctcggcatcgatgtcaactcagtcgtgtccaacaagaccttgaccttgcccagcttcaccctcgtcgggaacatgaccgccgtcgtcgagtacgacaacgtctccagcatcctggccatgaggctgcacctcggctatgggcttagtggcccccgtcaccggccggattacaaccttagctacaaggttgacctcaagagcgtgctgccggagctggtctccgttggcttctccgcctccacgaccacatcctttgagctgcatcagctgcattcatggtatttcagctcatcgttggaaccaaaggccgcggtgcgtggcagagttgtagcgggagccaccgttggcacggtaatgttcgtcatactcctcttcgccatggtagcagtccttgtacgacaacgtcagagcaagaagagggagacagaggaggcaaagaacggaggcatggatggcagcgacgacgacgatgacgacgacggcgagaccatcgtagagatcgagatggggacggggccaaggcgatttccatactacgaacttgtcgaggcgaccaagagtttcgcggcggaggagaagcttgggcaaggcggtttcggcacagtgtatcggggctacctcagagagcagggcctcgccgtcgccataaagagattcaccaaagattcctccaagcaaggcaggaaggagtacaagtcagagatcaaggtcataagccgtctgcgccaccgcaatctcgtgcagctcatcggctggtgccatggccacgacgagctccttcttgtttacgagctcgtccccaaccgtagcctcgacatccatctccacggcaatggcaccttcctcacatggccaatgaggttattaactcttgctaattttgtcttaatctttgtagtgtcaacttaattggcgaacatattgtcaaattttactcaggtttacgaacttgctaagtgcacatcgagatctctaaacttggtttagagtatcatctcggtccaaagccgcgtttgaccgtgctcttgcctatgtgacacgccacatagacgatgacatggaattttttttctcctttttcttttttttttctcctgcgcaaccgaatcgttaaccatgttcccttatacagtttcgcatactcgttcgtccagttgttagttattcacaggctgtcgcacgtgtggaacgaagaaggaaaaggaagtatccatgtgctttcctgatgggccacccttacctttcttctaaaattcatcatcatgtc

SEQ ID NO: 15389 - DNA, 1501 bp, Oryza sativa
tagactatggcatctttatgttgcaaatggctgttgcactggaaaaatcactttctacctgtacattttagctgtacttagcttaatatgaaccaccagatggtagttaggtcgccttgctttagcacttcagtgtgatccaaacctacagagagaaaaaaaaaaggtagcttccaaagcaaatgagcttcaagttggaattagcaataagtactaaatatgggaaatgaatggtcataagctctgcaccgaaatgacgaaaactacatgctaatccactgatgaaaaggagtcttaatatatattaagaacagtcctgaatacataccaaaaaaaaaaggtttgatatatttgggcttccagtacaatatcgagtttcagtgagctgtagttgtgccaagctagctattagttgttgtgctgtcgatgttgtaatacttcttcaatgaattctcctctaagcatgccatacctttaacttcgaagtgtaggaaggggcatctgcggccgacagctctttgtttgtcaagatcctcacttgatcagtctccgacaggtcacaggcctggcttcaggggattcactttcatagctgctgtgactttgcaacgcaaacgaagcttcaaggtaacggctcacctgatctgattaagattgctgctgctgctgcttcacaaaggggaatcgcaagaccttgctgtttcctctcaggatcagctgctaacaggtatgttcataactctgttttgcgtagctctcgtttctattcctctcactatctgccagccatggatcaaccttcttcttccttcctacttttcggtttctccaagaaattagtccacttaggaaagtagcacactaaagagctgaattagattcagattcagaaatgcgcactaccaaacaggactgcaaaccactactagtatttcagtgttctttcgctgagcctatctataatcatgtgccaccttttaagcgggcacaaggaagcatcatcttagctgggctgctgggtgtagtgcaggctgcacgaaaaaggaacaagaaaactacacgcaaggaccaaagtaggcgcgcatgcgtgcgtccgtgtacacagttataaacaaaacacacacacagacgtaattggtcctagtttttataggacactgccaacagttgcctccgcgttgtctgatcaatccaacagattacataaatgctaaagctaagctaacctcttccttaatgcccaagtgccccttcactctgagtgactgcatctttggtggtgtccatgtatggtcgtaccagcagcaacactgaaacagcaagctcagcgaggagaagaggtgaggaggtggtggtggtggtggtggggctcgtcattacagagtgcagacttttccctggggcgccgcacagcaccgctcaactcagtagcttcactccagcagcagcggcagcagaagcagaaagcgggtagccatggcagaggagaggaagaaggaga

SEQ ID NO: 15390 - DNA, 1501 bp, Oryza sativa
gtttaggttcagaaccgtttcttgttatttcatctactataatccaatctatcctcattcatctcgattcatctccacataatcttagaccgtgacatatgatcataaaaatcttttgaaagatgcatggatactctcgatgaatacaaagcccatcttctcctcctacgtaacactgctccctacgttcagatttgtttgagtttaataaaaaaaatatgacttagataaaaaaattaaaccataatttaatatttagcgtaattttattttttttcccgttgcaacacacatgcatttagctagtctctactattataaaaattgaagatgtttttaccggtattttggtacgttatccgtgtatgagtcgctttttaagttcattatttgcatttggaaatacaaatccgtgtttgagtcggtatttgaattcgttcgcttttacaaataaagaaggagaaggagacgtataagaaatctcttttataaacttgcatactaacttgacatgatcaaacttataattgcagttcccaccgtgaattttaccttagttaaaccgttcaacaataatatgattaaattagccttcactcgttgctacatacgtgtattttttttcaagtcatctaataaaccaaacaagctgataatccatttttgcttttcagaaatatgctaattcaatttcttcttgtgccccaaccaagcactagctctgaggcgaggcaaagcttttgcctttcttttaaaaaaaacacccaagcactagctaaaaggtgttcacacgaagcaaaacatatcaaatactcctatctctcacaacgtagaataaggaaaaaaacactgtaaaaggtatggaatattcttaacttgttgcaaggaactgatcaaaagcataacctttttagccaaatgcatgatcatattgttgtccatttatactagtacaatcttaacaaacctgtaataaattttggacaaggaaaaaaatattatccatgaaatttgggtgttcattaccatgattgtgactttatgtcaacactgaaatcaaacttactaaattcaacattttctagatatatcgatctctttttagtataaaaaaatatagttacgtgcgtttataaggttgagtgtacgtatattgtgagcgcatacatgatttatatcatgtttcttattaaaaacagtaatcccaaccgttgatcaataaaccagatccttcaatccgaggagaagatgagcccttcccgttcggaatacagtacgtacatacgtatactccgtaacaaatcaggttaattaatttcctctctataagaaatataaaaaattccgcttaataattacctgatctggactacctgagcgacttggtctcgtctcctcgtcttctcgccgccgccgcgagcggaatccccctctctccgtctaaacctcgccgccgcggcgaagcaaaagcacctccctcttcgccgccgcccgccggcaa

SEQ ID NO: 15391 - DNA, 1501 bp, Oryza sativa
ctatggtcatgtggccggtctttagatctgctaatcgatttcccctaagccctattattgtgctcaagcttcatggctttgtgcgcgagcatcactgcctagccctagacttgagttctgcaatccaacataagctttgaaactacgtctgtatgctttgttggtctcacatcttatgtccggtagccccatccccaagttttgccaaccttgaaaatgggctctactacacgctgagagattggtgagcaattggcgggagaacgaggaagaaagatatatccgtccttagttgtataagtgttacttgtgacaaaaagaagtggacatcttctctatttttttttacattttagagtcaataaacttttagataaacagagatgatcctcaactatattatggcataaaatcaattttctccttacagcttattaactgtaaagattataaaatttaaaacattattgttagttcattattagaaaagaaaaggactgaactaccccctaactatagggaccacacgatttaccccacaaaaccacaaaaccagacacccccaaattttcataccggacagatgacatcccccaacctgatttgatctagagcggttttggtcctactcctacgtgatgcgcatgtggcaatctcgtcagcataaaaagtttaaagaacgatgagccagttagagggtaattaggactttttcttattaaaaaaatgaaaagaacattattagtaacaaaaagagagtcgagatttatcagtgtcagcgacgatacgagtcctaaaatcaggtaaaacgtcagagcgcataaactttgcaaccttaaaatatagccaaatgttgtgtgcacagtgcaccgttgtactactttcttggtgcttgagatttaatctatatatagtagtcaaatctactacaaatatgcttttggaatgctttcctcgcaccttcaggagcaactactcttggtttcttcaaaaccgttgcagtcatggatctagcttgctatcttgttgggaagagaaagatttgattgccttttatagtttcatagttagtcctagacgaatttcaagagcttatgttaatttgaccatattcaagagggtcttttgcaaaagtgcttgcactcgcagttaactcccctctagggataaacttcatatgtgtctaattatctatcaatatgtatctaattatctatcaataaaaatgcatgggttttttgtaaaaagaaagtttactaacccaatcatggatgaagtttctggtaatgtccacccggctaccagtcctatatcaaaggtcacgcaaaagcaaccatggaaacatacacggggaacttgtaaagcgtacacaagaccatcaagaagtgtaaaactcaacctgtggattatccgaattaatatgtcaattgtccgaggtgacaaagggacaaaagcacaaagcattgttcttgaaccaagaacagtgcaaaagtaaaactca

SEQ ID NO: 15392 - DNA, 1501 bp, Oryza sativa
gtttaggttcagaaccgtttcttgttatttcatctactataatccaatctatcctcattcatctcgattcatctccacataatcttagaccgtgacatatgatcataaaaatcttttgaaagatgcatggatactctcgatgaatacaaagcccatcttctcctcctacgtaacactgctccctacgttcagatttgtttgagtttaataaaaaaaatatgacttagataaaaaaattaaaccataatttaatatttagcgtaattttattttttttcccgttgcaacacacatgcatttagctagtctctactattataaaaattgaagatgtttttaccggtattttggtacgttatccgtgtatgagtcgctttttaagttcattatttgcatttggaaatacaaatccgtgtttgagtcggtatttgaattcgttcgcttttacaaataaagaaggagaaggagacgtataagaaatctcttttataaacttgcatactaacttgacatgatcaaacttataattgcagttcccaccgtgaattttaccttagttaaaccgttcaacaataatatgattaaattagccttcactcgttgctacatacgtgtattttttttcaagtcatctaataaaccaaacaagctgataatccatttttgcttttcagaaatatgctaattcaatttcttcttgtgccccaaccaagcactagctctgaggcgaggcaaagcttttgcctttcttttaaaaaaaacacccaagcactagctaaaaggtgttcacacgaagcaaaacatatcaaatactcctatctctcacaacgtagaataaggaaaaaaacactgtaaaaggtatggaatattcttaacttgttgcaaggaactgatcaaaagcataacctttttagccaaatgcatgatcatattgttgtccatttatactagtacaatcttaacaaacctgtaataaattttggacaaggaaaaaaatattatccatgaaatttgggtgttcattaccatgattgtgactttatgtcaacactgaaatcaaacttactaaattcaacattttctagatatatcgatctctttttagtataaaaaaatatagttacgtgcgtttataaggttgagtgtacgtatattgtgagcgcatacatgatttatatcatgtttcttattaaaaacagtaatcccaaccgttgatcaataaaccagatccttcaatccgaggagaagatgagcccttcccgttcggaatacagtacgtacatacgtatactccgtaacaaatcaggttaattaatttcctctctataagaaatataaaaaattccgcttaataattacctgatctggactacctgagcgacttggtctcgtctcctcgtcttctcgccgccgccgcgagcggaatccccctctctccgtctaaacctcgccgccgcggcgaagcaaaagcacctccctctttgccgccgcccgccggcaa

SEQ ID NO: 15393 - DNA, 1501 bp, Oryza sativa
ggacgtggccaatgccgtggagtgttacatgaaggagcatggcgtgacaagcgatgtcgcggaggcggagataagtgaaatggtggaaggcgcatggagaaccctaaaccaggcgcgctttgaggaccgcgtgtacctcccgttcgtgcagcggatcgccaatgtgtccatgtccatcgccctcctcttccatggcaagagggacggctacaccaatagccacgagttgaaggatatgttcgagagtcatttcgtcaaccctattccccttgatcatttagatacaattgaagatatgtaaacttggtgctgaagtggcacggaaaatggccatatatatgttaagacaggcgtacaggtacaggacatggatgtaatcaaatcacacgtacattggagaattatctgtatatccctctgcttgtgcatattagacggctcatttgcacacatgaaaaaaaaatcctttagatttgaggtaccgattcaatacattttttttctaacaatgaattaaactggtctctacatctaacatggaaaacttgcatactcggagacaaaagggaagaaccactcaaattatgtaaagcgggaaaggccattccaccaattatccccatttcccacatggaggaccgtgtgtgctgacatgtggagctaaacacacatttatatttagccttacagctttgctagtcttaagatttaacccacgggcagcataccagtaagggacaaagggaatacgaaaatagtatggccaagtagcagcttattgagattcacttacaagaaagtagtagcttgttgggaatattccttaagttgtactactatgcaacaaacttaaagcaatactcttactatcccaatatgatcatcttataagcaaagaacaccaagacaaagacaccaaaacattcatcattgtgaaattaatcctcatcgatcatcattgtgaaattaatcctcattgattaaggtgctttgtcgtttcatgtccaacaaaaattaattcacactttaaacgttatatgcattgaaccaatagaatgtttgttgcatggcatttcacgatgcggatttactctttgcacaaataaacaaaatattttttgttatgatgatcattttgagaaaacctaaaaaaatcttatgtgatgatcaaactgggatggagggagggagtacaatatatacatgaacagtattgaagatttaaaagcaccatgaaccatccgtagaatatattgttgaggatgtaatttaaatacttaataggtgtcaattatgcaagaaacaaaaaccatttttacaacaaccaaactgcagatggtcatgagcctacttgaatttcctggtctctagagcagatattttttttaagcagcagcactgatctaaacaagggccagatcatcaaataactcagcatgcatgcaacagcccaaaaggagtgcttttctcagtaatgggtttatcagcgtatactgcgtcc

SEQ ID NO: 15394 - DNA, 1501 bp, Oryza sativa
agacaaaagtcatgatattcaaaatcctaataacaaaaattatgatagtttaaataagatgcccgcgcaactgcgcgggctaccttcctagttggataaaaaatggtcgaagctgaaattttagtaacaaaagttgatccaaaccataattcactatatatatatatttaaataaggggtattatttatacttctttgaaacagaggagtggtggtggtttcgccacccccaacctcaccaactgcctactatttgctatactatttttaaatgttggtaatagtggtgacactgaatctatcaccatcacgtgtttcacctttgtatggaccctataatgttggtgaaacttttttgcttctcctatgattaatcaaacagaaatagctctatgcctctactctagctaattcagtaagcatcaaaaactcatggtgaagtatagcttgataggtagatagttttaggatttaaaaatgaatgcaaaagtttattttctaaaaattcagtagtaacgcacgagcaaatcagctagtaacatacggggttagagagcttacatgtggtgaaattgtgggtaataaacagaatgcatcacatcgtggagatggttaacaactagcaaatataaacttactaccatgtattagcactttatgtctggtcccatctattttttaattgtagcatgactcatgtttgaagaatttttcagatgggtcccaccttattatctactttacacatatatatattgtggtgcctcttcatcctactattaccacatggcacgagtctaccttactacctagtttacaataaacattgaggatgtctaaagaaaaaaaaagtcatgggaccaaagaatcgacatgtcagtaataaatatatataaaaagaaaataatggccacaacatactaacattacttctcttttacataaaaatttggtgccaaacacagtgacacggattaaaaggagtacaccataagtatataacctaacatagagttactttcttcggttcacaatgtaagttattttagcatttcctacattcctattgatgttaatgaatctagatagatatatatgtctaaatttattaacattagcatgaatgtgggaaatgctagaatgacttacattgtgaaacggagggagtattagctagtcatcatttgttctcttcaccgaccgaccggttgggtcaacctttctatgtacgctcttatacacgatgtcgtcattatgtgattaacacaagaacgcttgttcgtccctcgcctacaatgaaaacagaaactacaggacgcaggtgactagctctgcgtgtcgccatggtcgcgacaccatgttattttcattaccacagaacaagcatttatatgcatatatatgcccgcattttgccattcatcctccacctctcgccgccaagcagcttcaacaacagcagaagggcagacgtgagaacgatatatacatatatccaaca

SEQ ID NO: 15395 - DNA, 1501 bp, Oryza sativa
actaaaagtcctacatgacaatgtagttaatgtcatagacaccattctaggtggagggttagaaatgccctaaatatagtaaactaatcagattaaagacaacgctcaatcccctatacaaaaattcactcggtcgtgtctcatttattactcggtttctattttaagataatggtaattacatctttaaaatagtcaaggtgaggatcacgaatgccttctccccttcttttattgcaaatgtcttgatttgtttgcaaccatcaactgtcagtcaatcaaaatttgccaattgcttgagaatttctcaaacttttcattatacttagcatgttagtactatctttgcaactgactatcaggataaatcttaaaagacagactttatcaccttccaaaaaaaagagactttatcatagggctgtcaacgagccgagctcgagcgagcttacctatataggcttgagctcggcaccaactcaagccgagctcgagtcgagcctgtttaaactgcaagcttagaaatgggctcgagctcggctcgctcgagcctcgagctttcttgagcctaactcgtgtgccctcaaataaccaatacagatgaaaggaggctgcatgcatgcttgtcgagtactactagtactagtagctttttcaaacatgatatgacaactagtagtactattaaatagagctgcatgcatgctagtagtactaataggctagtgctgcagagtaaagtagtactagtaggctagtgcctgcacggtgcagccctgcacgctctgtttctatacagcttttcattgggagtaggagtagtactagctgttgtattgaaaatttaagaacttgacagagggaaatttgggctcgacgagctatttgagctcggctcgtcaagctcgcaagcttggagctaggcttgagttcggctcgaattgttgacgaatcgagctcgagccgagtctacagcgagccgagctcaagcagctcgcgagcttcgagctttttttacagccctactttatcagaatgaagcagatagtaaaacgaactgtttgctatttgttactgctggtttctttatgcaaacaattgcttcaaaccaaagcttcagcacatgtgaaagataacataaatcaatttaatgactgtatttgaacaagtaatagtcaaaatcgagtaatatagaccatgaaaattcagtaacgttatttgactgatgaacgtacagagggaatctttttcagttaacattttgcagcgttgcttggagtattaaaatacagacagcagaagacatcagcatcttgtctctggctaccacaaactgacaaaaacagcagaagacatcagcagaagatgcttcacacaaagtgtgcgcatctttgtgccatccatccgttactagcctgaccaaaagttcggcccataaattgctataatcctatataatctcaagcaaatcagactgacgttggagagaacatatcaatgg

SEQ ID NO: 15396 - DNA, 1501 bp, Oryza sativa
gcagcagttcttctggtttgaaataaaccttgcagaattatattatacgtaataatatcaggactaacaccactgctctccatctccctaaaaagaactaacgcatcttccatcctgctaattttacagtagccattaatcaaagtattatatgtaacacaatcaggtttcattccaactgagaccatgctggcaagtaacttcgttgcttcatccatcttacctgccaagcaatatccatcgatgagagtactgtacgtaatgatatcgggcttcacaccaatacgtaccatcaggtcaaagagtttttcagattctataaccctcccttctttgcaatgactgtcaattattgaattaaagaaaatagtgtccagacagatgcctcgatccaacatttcaagaattaactctttagccttgtcccatttgtcaaagatacagagactatgaattagggagttataaacaatgttgccagggcttagtctttcatcgatcatctgctcaaaataacgcatagcatcttctactctgcctgacttgcaaagtatgcctataactgttccataggtcactgtatccggattcaatccttgctgcctcattttgctgaacacaagcattgcctgatctactttcccttgtttagcgtatgcacatattagaatgctgaaaacataatgattagggtggataccgtttcgtaccatcaaatccaagagaccatgcatctcaacaagggctcctttggtagcatacccctgaagcagggtaccataggtagtaatatcaggctttaggcccctcttggtcatagaatcaaaaatctttcttgcttccgtgcatcttccgttcttgcaaagataatccatgagcgagttataagtaacaacatctggttcgacaccatcactgcgcatctttttgagaaatacaatagcctctttcggctgccctgaagagcaaaacccatgcacaatactattatatgtcatgcaatcaggcatgacaccactcttaaccatggtggtaagtacctccatggccttgtccacagtttgagccttgcatagcgcagcaataatagagttgtaggtcacaacatttggtaaaatcccccggtccagcatttcatggtatgtaccgtaagctttgtccagatccccctccttgaagaagccattgatgacagtggtatacgacaccacatcaggtgggcagtcacctccatcatcaggcatcatttggagcagctcgagagcttcttggcttctgttctcatcacacagccccttgagaagaatattgtaggagaagacatttggtatgcagccaagctgggtcattctgcggagcactatgtccattgcgtcgctcgtcctcttgtcagcacagaggcccttgagcagaggagtgaaggcgatggcgtccactctaaatcccttcttaatgacattgcccaaggccgcgaaaccgaggtccaagcggcccgcgcagc

SEQ ID NO: 15397 - DNA, 1501 bp, Oryza sativa
gctttagacaggtcctttctcaccaatctctgcttcagacggtttatcctgttttggaggcgcttccgttcaccacaagatggccatgttagcggtctgtacataggagagtggatccattcttctctcgcccaccccctcttgttcccaaaagtgtcttgagtgcagttgggatgtcttactgttgtctctcagtagtgggcttttctatcatagacgcgtggcatgactgtctttttcttgattatacctttcgaaggctagtcttataattttttctgttgtatcaatatgaaacattccactatgttatatggtttatttaatagaaagtagttgcattagtaagaaaagaacaaaaatagtaagcgatgcaccggcgaataatgaagtcgtgggtgcattactccaactattaatatttaagtcctaatttccacaaatattatgcacgaataagatgggttttcaataggatttcagtgatgtcaaaaatgtgttgttggtccccgtcttttttagcgtgtgttaggaacatattcccagtgtgtgtggtatcatgtatctagtggcgagtgcgtttaccatataattaaaaatacagtacttcctccgtattaaaatataacaacttctatttcaatttttgtttcaaacataacaaattttgtcactaaactacctatactatctctactatcacttggctttattatagtcctaacttctaagtagtatgagcctgtaccgcacccacctcgaagaggtaacccaagtatttttaaacctcttcttaaaactcatattaaaggctaaaacaaacttgctatgttttcagacagaggaagtaacaaataaaaaggtaataacaaaaagtaaagagaagaaaaaaaatatggactatcttaaaaaatgccgtaagtttttttaggaaaaacttttaaatctaattatagtataattgtaataggcgttttccccgtcgcatgcactagtataattgtataagcaggcgctagcttagctttctcctaaaacgaccctgcaaatggagatgaaccccacgatggatatacagtagctagcagcaaccttcgccggctcggcctgttttgaagccaatttgcaccggcaatcccgataaggtgactcggactcacacatcaaccccagtaatcaacgtactacacacccacccgtccatttcgccggaaagtgaaaactcatcactacaatctcctcctctctcctctcccacttttatgtagtatatagccatgggtggcgcactactagctcagagggagattgctagctgatcacaaggaacccgtcgttgcagcagcagcagcgtagtgcgcttgcttgcactagcagcagcacagtgacgacgacgctagctaagggcagaggagaggagggtgataaatacaggcaattactagctagctgtttcactgcaaggattagatagatcgtagagagtagcaagaagagaaga

SEQ ID NO: 15398 - DNA, 1501 bp, Oryza sativa
gcgacggggaggcaggaggaggaataagaagacgatccatcagcttggtggaagaagtcggcgtgtgcagaaagttcagaaacgaaattcgctatagcttgcttgctcaatgagcagtggtagtagcagaggggattgtttggcaaaaaaagtctgcaacttttgcattatatttgcagaccgatgaactgatacggttatagtgacagactgacagtgaccatggacagaggagaagaagaagaagaagaagaagaagcatgtgtaggagtagcatgcatggacagagttagagtttaattaccagctcgttgccgagctcaatggcggcgtcatggtagctcctcttcttcccctggctgctgccgcagaagacgcagatcctcttgaacctcgactgcctcatctctctctcctctactattctcttctcttcttgctactctctacgatctatctaatccttgcagtgaaacagctagctagtaattgcctgtatttatcaccctcctctcctctgcccttagctagcgtcgtcgtcactgtgctgctgctagtgcaagcaagcgcactacgctgctgctgctgcaacgacgggttccttgtgatcagctagcaatctccctctgagctagtagtgcgccacccatggctatatactacataaaagtgggagaggagagaggaggagattgtagtgatgagttttcactttccggcgaaatggacgggtgggtgtgtagtacgttgattactggggttgatgtgtgagtccgagtcaccttatcgggattgccggtgcaaattggcttcaaaacaggccgagccggcgaaggttgctgctagctactgtatatccatcgtggggttcatctccatttgcagggtcgttttaggagaaagctaagctagcgcctgcttatacaattatactagtgcatgcgacggggaaaacgcctattacaattatactataattagatttaaaagtttttcctaaaaaaacttacggcattttttaagatagtccatattttttttcttctctttactttttgttattacctttttatttgttacttcctctgtctgaaaacatagcaagtttgttttagcctttaatatgagttttaagaagaggtttaaaaatacttgggttacctcttcgaggtgggtgcggtacaggctcatactacttagaagttaggactataataaagccaagtgatagtagagatagtataggtagtttagtgacaaaatttgttatgtttgaaacaaaaattgaaatagaagttgttatattttaatacggaggaagtactgtatttttaattatatggtaaacgcactcgccactagatacatgataccacacacactgggaatatgttcctaacacacgctaaaaaagacggggaccaacaacacatttttgacatcactgaaatcctattgaaaacccatcttattcgtgcataatatttgtggaaattaggac

SEQ ID NO: 15399 - DNA, 1501 bp, Oryza sativa
catgaatatttctgcgccattactgggaattatatttttagtaatgtagttaagaaataccaacaatgtggtcacctactggtgttgagcataagtcacattagaagaacgaaaaaacatgatttttttggttaggaattgccgtgataccataagtaaacattttgaaaagtgattggacaaagttttgacattgaatcttaatttaggtgaaggtgcatatctgtaatttgttatgacacacactctgaaaggtactaccgtactacgacgctcctccttttaggtgctaaccccaccatccgccatcctctattgaacaaaaatgtggagtatttttttaaatttaacaaaaaaaatgtggagtaaatttaacaaagctaatgatatcgtggcttaaatttgttcacgagtttcggttttgaaacattaaccgtgccaaccacaagccagcgtaggcaacggctttaccttttgtataacatagttcattgcggggcaccatactgagaagtggcggagataaacccacgggggtcgctggggagtccatgccttgaattataaggaggtgattatgatccaggaacggtgcgctgtgatggattgtgttatgcgaggggtactgtcacagctcctttccgaggtaccatggtggtattgaggcgcgtggtgacatgttgtggggctatgtcttgtggttacagtggtatatctctgtccagagtaaaactattcgaatagtgtaacatactaaaaattagctattttctaattatgcatcataccggttcttatgtttttattaacctcctaaacctaggatattataattaaagagacctcctaaatttaacctgcataaaatctctttctggtatttaatttcttttgtgtctttcctttaaaaatatatttagttaaattaaggtgtttcttgattttgggttttaatttaaaaaccttcctttgacaaaattccttttattcaaatttagtttgaaaatcttttatgaatcatggtccaagaaatcctccaacactatccttgaacctaaaccgaagcaattccaaatttgttggaattaattgtcaacctatcctttgattccaaacctatccttagttccctttccaaatttcaagtatccaaattccttttttcaatctagccaccaatttaatttccgtggcttgatttcctcctcggcacaaaaataatattattacaaatattgtgaataattgctcttgtgctaagagaatagactttatccctccgccccaaattcaaaacctcgtttagcccatatctaattctctaaatttcataccacatattttgggctagaattctatttactctactccctccatattccctccacatactcaaaaatattcaaatctagagccatattatttatggtattgaatattttgaatttctatttgagtgcattaaataaactccatctctaaagtattgcactcaaaccaa

SEQ ID NO: 15400 - DNA, 1037 bp, Oryza sativa
ccacccgccgagccagccgccgcgctcgccacccgtccgcgagccgccgccgccgcccactgcccttcaacgcgtgcctgagagagaaggggggagggggaagactgaagagaggtaaggacaggtgggccctatattttcttttatttttttttggattggatttccatgtcgacgccacgtgtatgtcacgtaggagcaaaaccgctcattattgagtcggggggggggggtaattcaaccgatatcaatagattgaggtgtaatataaccggttttgtggttcgggggtaattcgtactgtcgcaatagttcgggaggttcctaaagtttatgcatacgtatgtatatacatgtagtatatgaaagagactataggatcagaaactgaccgcgcggctgatctcacattagggcgcccgttcgcgctcctctagtcagcgtgcaacatgacaaaaattaacctacgtgcggccgaagacacgtgttcagcccatgaagcattatagcccacgtactatcctttcctcgttcagcccacaaccgcatgtgcccaaatatatgcttgcatttggactgttgagtctactagttttcaagctcagtaagcaatgtgttgaaaaaatatataaaaactttatatatgtactccctctatttcataatgtaagtcattctaacatttcctacattaacatcaatatatctagattcattaatattaatataaatatgagaaatgttagaatgatttacattatgaagcagaggaactaaaacttatatgtgaaaatttataaatatatattttgtggggacaaactttatacacaaaaaaagtttaaacatatagaaagggtctacacataaactttacatatatatataaaacatattcaaatttgttttcgcaaataaataaataaaataaaacaaacatgtgggccatctgtcttcatcgtattcccacaccacattagatttggcatgctctcgcaaaggaaagaaattaagatgagctaagcacgaaaagaaaa

SEQ ID NO: 15401 - DNA, 1501 bp, Oryza sativa
aaatattatcagtataactttaaaggttgtatattgctagcaggatataaaggtgatgtcacgctttctagtatcattaaatcatcatcgtacttcactgagaacttgcccaaaaccaaaactaagaaaaagtacagactaaacagaaagaattagtaatgtgtatacaccacaagtacaaaatacaccacgatcaaataaaagtataattgatgctttagaatattaaactggtaaaattagtttgcataaaatacacaatttcttgaagatttaaactgatggaatatctttagtttgaaatggaaatcttggagctttgtctactcaataaagagagaatcaaggataaagcagagtaaaatcaaccattccatgcagattcagtcatttgaatataaattaaatttgaaccggctcaaagctgagttcatcagttttatcccaacttaactaccaaacctaactcccatcagaatcccaatttattttctataaacacaagaaatcaaacatagtgagacttgtattgatgtggtagaaactaactcatgattaataaaaatatttggtggattatacataagcttgagactgaagactatcaaaggctactgacttgtattgacattgaaaaacaaattggcagttcagccctgtcagggttatggataccacatacctaatagtagttgactaaatctcggcaggacccaccacataccatgtcctatacggaaacaacctacggatataggagggagttccggataaggaaagacaaccagagttctacatggaaacgacaaggactacttgaattgtatccatattggtttccctagttctacttggacaaggggacacctatgggtataaatacaagcccccctaggaggacagggggacacacacccaccatggaggatcaacacgatcgacccccaccatgagatgatcaacaccaatcatgagacgatcaacacccaccacgagacaatcaactcccaacacaatcaacatagaagcctacatacgccaagacaagccgccggatatcgacatcagagatacgcttggatcgaccctatccggtaccttcagaggctggccgtagggatctagcactgtctctgattccgtcgggcgcgagctcgaggaggaaggctaccctgttgtcgactacgagtcagaccttcagaccgccatatcgacaacagttagataggctacccacatattgtactggtgtgattatggtgaataagagcaataccagcttcggccaacaggatgtagggttattacctgacaactcaggggctcgaacctgtataaaaatccatgtctccatctcttttacctcagtctcgcgtatatcctagcaccaacgatccccatactgtccaaataccgtagtcgtgacatcaaacgtcgacagtggcgcgccaggtagggggattttggtgctttaggatttcgacgagatgggtttaagaga

SEQ ID NO: 15402 - DNA, 1501 bp, Oryza sativa
gcagtgggagcacacctaaaaaataaaaactagtgcactctgttgttgctgtctagaatgcatcactttgcttttggccaaggtcatttgagcttcagattgaacgaccaatactatatgccaattgaatgagcaagaagatacaaaaatttttaaagtcatgctatgaggtggtcaggtggacactgtagtatacattctagttttggtaattttttccatggctttttgtttagcaaaatgcccttgttaaaacttgagaaatgtagctgtccatcttttgttcgaatacctattttactcttagcaatcaatttagcatatttatctattctgaactgctactatgttcacaactagtttcaggaaactgggtgttcagatatattactagaggtcataccatacaaagctatataaattgctattgaatgacaaaaatataatctgttgtgctgaattaaatttcaggagaggcacaggcgtgtggggttggcaaaagtaaagctgaaggagttgatattactcaaggtatttgagaaaaaactaaatacagttgtacttacatttgcctgatatgaagcatttaatcttgcccctgcatatttactagagtaacagaagtaatttgaagttggagagagagagagattgtaggtacaatgttatgtgatcttgctcaggtggcagatggtctcagtttttttttgctagtgaacaggaggctgttattttcaagtaaacatcctaccctagaaggatatcctcactttattaaagttgctatctctgaggtttaaacaaaactaagtacacaaagtacttctggaactagtcaaaatctgaacacattattgatccccctccttccattgcagactgtttatttgctgaaagtattaaaagtatttatgcatgtagccaccttgaatgcctctaatttcatgtttaataatattgtaatacatatgcatattattatgttctcacacatagtttaaagtatagtaattctatatctcttttagtgataaaatcagttcgagaatggcggatgaaattaaaaggaggagagaagaggacgatgatatgatgctttttgtttttcctgcgatgtatatgctgtgcggtatgacaaatagtgagaaaatacctagacatatctcaagactatccggtaaagagcggcttcaagaaatccttgaaggacatgtaatggattgtaaagttgcattccgcatggagcctcatgttttcaagacaatagcgaattatcttagagaggaaaagttgttaaaggatagtagaggcttgaggattgaggagaaacttgggatatttatgttcatgctcgctcacaatgcaagctttcaagatctacaatatgaattcaagcatagtgggtctacacttcatcggcatattaagtctattttcaagataatcccagctctcacctatagatttctcaagcttcctcatgccgaccaaacgcattgga

SEQ ID NO: 15403 - DNA, 768 bp, Oryza sativa
tagtgatctatagctaatctaatggcctattcttgcctgggaatatatcctatgcacacaagcctctcgtgcatactcaatgcacaccaactaacaaatgtcataaaaaattctacaaaaagttggacattccctcctaatagtattacatatatctgtaaagtaccgtattcaaattcattatattttagctgtaacaaaaaagtaaaaaaatatgacagttttaagggtaaaaatctgtcagaattttatctttttttgttacagctaaaatataatgaatttgaaaataagatttcacacgaacgtgtaatactattaggagggaatgtccaatttttttgtagaattttctgtgatatttgctagttggtgtgcacgggaagctttgtgtgcataggatatgtttccttcttacctataaattcatgtatattacaccattaatatctagtctcacctctcgtatacacagcgtcttggaatctgtgctacaattagctataaatttatagcacacttctcttctgttatgattctcacacaagcaaccgaaaactggaagacacatttttattttgtgttgaaaccactttgctctcctctagtatgcttaaacctcactttataaaactgaatggatttgtttagtcattaagagcaacctttcatacacatttttctttgccaagacgcctctatacaaagaaagtatgagtataccgccctgtgcaaaccaaactttctttggtctggagtggatcacca

SEQ ID NO: 15404 - DNA, 1487 bp, Oryza sativa
gccggccccctggggagagtgcaccattatggctggagccatgaggggaggggtggcgccagtatggctagcgttgtcctcctgccacgttagcgcatggcagccacgtggtggcacggggacagcgccaaagatgctggcaccgtccagttggaccacagcactagcgtctctggcgccccaaaaaggaccattcatggaataaatttttctaggggtctatttgtaaaataagttttcgaaaaggaccaaattgcaaaaaatccagaaccacccttccctccctaactaatactcatttaatgaggggcatatatccttttctctcatccttagtctctccaatgaagggtaaaagtccttatattaatggacagagggagtaactaaatttcacaataacacttttttaccctttcagagacatgcgactacagtatgggacattattagcagacattggacttttggatattcctaaagatagcctggtatgtcttttcattatggagaattgcactagggatatcatctttactggaatgcagacttatatcatgttgttcattttctttagttgactgagtcataacagtgacaattttgtatctctagtccttttgtcctacaagctaagtatatgatgactagcaatatataatcatcacatgattggacagctaaatgctacagtacatatagagttgtagttggaaacataggctcctgtagctcttagcaccttagtgacaaccttatgactagttcagtcaatcacttcatatattacaattgactaatttataccaatgaaaagttataaatgcaatggtcaaagtcacatgaagactaaaaattagataatgttaaaaaaggactaaatttgagggagcaagttagtttctttttgggaactttaaaagggtaccctaacttaaattggtaatgtactttcccagccaaatgctgccaaagtcctctatttctaatttgaacggggacagacatcataatcgatcttctaatgtcaattaatcctaatatttttcagaggcctgtggatggaacgaggaaaaatactcttgagagttggtttgcgaatatgtctcttccatttaacttatatgctcgttactcctcagttgtcaaggtaatggcatgattgctaaacatttttgactttttttaacatgtgccaaagtacaaaataaatatgatcatgttgatgagattaatatcctagtgtaatgcttgtttacctttagtaatctgtataagctgttgtttcacttagttcaatttgacgctaatatggttcatttctggaaaatgcttatgtggcatttgcagtcagtcatatgcgcaggtctataccctaatgttgcagctactttagagggtgttgatccaggagctctaggtggcaggaagccatctgattttctgtctggaaaggaccgtcctcgatggtatgatggacgacgaga

SEQ ID NO: 15405 - DNA, 618 bp, Oryza sativa
ggtacataaatgatggaactctgtcattaaagttaggatttcatatccattagcttataaatcatataagaaaaaaactaacttaaaagtctatgaaaataaactcaatcaatagccatgtgagaggagagaggaaagataaattatttttatttttttcataaaggtatatcttatgcataacataaaggcaaattttgctacaggacacccaaaatttgtgtaatttgctgatagacatcgaaaaaacatgtcatggctgaaagacattctaaaaaaactggtaatttgctgtaggacacttttggctcaattgaagggatggattccaaaaaaaagacgagaatgcccctctggccacatgcttcaaacatggtgttagagtaaaaattaagaatttttccaactctaaattttccatagcccaaagtatatcactagcatacaccatatttcattttcactctagtatcggctcaaaaagcttttgaccctagggtcattcttgtctttttgaaaaatttctctctctgattgagccggaagtgtcctctagcaaattaccatttttttagagtgtctttctgatgaaccctgagttcctctcgacactcaagg

SEQ ID NO: 15406 - DNA, 1501 bp, Oryza sativa
ggcgccgcctccgtcatcgtcatcgtagcggcgtgttccacgtcatcctcgtccccgtgcagccgctgccggctgtcctcgtcgcctcctcgccggtcccggtcgtcgtcgtcgtcgtcgtcctctcgtcgttcccggtcgtcgtggcgttcgtccctccgtcgagccgttctcgtccgtcgtccgcattcgtcaagcgcgccgctgcagccccgtcctcgtcttcgtcctcggctccgcgtcgtcaagccccgtgccggccgcgtctcgccttcgtccaaggatcgccgccgaagccgtcccctcgccgttcgtctccgttgtgcccgtctgtctccgccgcgcccgttcgtcgttgtcgttcctacgcctcgtcgcgtggtggtaaggatccgtcctctcgctgccccgttctcgtcctttcggtgtcgcccgtgcccgttgtgcggttgacgaccccggtacccgtgtaccggtgtcggtagtcgttcacgcgtgcgggtggtgaccgtgtagtgtccgcgttagtgtgcccgctcggtagccgcgtggtttccacgtgtgcaggccgtgtggtgtctagtggagtccgtttgtcggccactcgcctcggttgacacacgggatccgcttccgtcgacccgtggaccgactctgtgtactcggtctaccgcggtcctttaggttgacatgtggggtccgcatgtcaacggcgcagccttcctgtcttttccaggctagcgcttgcacatgttttataattgcaaagcttgattataataatccgcaaatctccatataacagcattaaacctcggatgatcatatcttggtcatacgaactccgaatcgacccgttcaagtctcttaatgtttgttataacctaaagaaccctgtgctttctttttatgtattgttattgcttctttataggcttgtagctttgcttgtgtgcttcgcgtagcttctgtcgttccggaggttcccgaagcgtggttcgtggtcgtcgccgaaggttcggaaggccgttctctctgagcaaggcaagtcacatcatccttgagcatattgaatcccagtttacaaaattatttttaatttaaattaatgcattatcgctttatttaaattcccgcgttatcactgttttatttagccatgcctatttacctttgttatgaccttaatattattgttattgatattattaccttgttcaccctagattaaacaaaaccccaactagtgggtactctatttatggttccactagtatgaacttaggtagatgcttcgctggttaattaggcaacattaggtgattttataactttagactttgggaactctcatatcatttggacactatggaatggttggcttatgttggaattggacacacacctccccctcttttcaaaacccccaaaatggtttaggctgggctcgaggtgcgtggttgggttttgttagtcgtacctcgggtactataaggattaa

SEQ ID NO: 15407 - DNA, 1501 bp, Oryza sativa
aggacgaggagaacctcggccacctcttcccatcgccggaaactcactggacgtccgttttcccgtgtgccggtgagcccttcctcccttcctttccgctccggcaggccatgtcgccgccccgtcctccctaacacctcccctcccatcctaggatgcagctgctgctcgtccgcctcttcccgagcgccgcccgtcaccggagcatcgtcgtcttcgtccgccccgagctccgccgtcgccgcctcccgttgccatctcgccgacggccacctccttccgccgtgtgctactccccctcccctttcccgccgctctctcgcacatgccgccgtgccggtggaagccgccggtgaccatcgggccgcacgccgccgcttcccggccggccggtcggcgagccggctcccgcctgcctgtggccgcctgattcaccccgggtgaatctgggtcgtccacatggccgttcggcgccgccccgcatcggtgccctcgtggcgccacgtcgacaccacctttgccgcctgtccaccgtggccgccacatggccgtccacgtggtgcgcccgcgcctgtgccacggtggaccgagtccaccgtgggccgctcctcttgcgccgctgactcatggggccctcctgtcggcgccgacctctttgatgacgtcagcgacggcctttttcctttgaaagaataattaacaattgcgtcataaatcgtatttaattctagaaattcatttaaatggctcaaaacttcgaaaattcataactaattcattcgaactctgaattgagccgttcaacttgcaaaattcatctaaaattgatctctacttgtttgtttactttttatgtaatgtttgcttggtgtttattagagtttttcctcattttgcatgccagcgtgtagaatctgtcgtttcggaagtccgcggttgcgaggaaaagagttcagaagattgtttgaagaagcaaggcaagtcacacattccccttgagcatgttgatcccaatttataaatgttttattgtttgcaaataaatatgcatcgtttcgctaattacatgggaatagggtttacctatctgctcgtgtgtgccatgtttatttgatatatgtcctttgtcaaccttgggtgataaatcgactagcttgtgttactttgatgacctagctagaactatatgcttagccatgcttaattaccactagctcagttgatgggataattgcagtattagacctttttagcatcagaacgagctgcgtgctcgagacacccggccatgtttcagtggtcgtaattatccaactaaaatgcgactgaattgtgggctgtgggtgcatggttttgctagtcgcacccatggcagttaaggaccggttcgcgggaaaccctggaagatttcctcgtactttccacaagccagcgtgggcaacggctgggcttgtagtgtagctttcctctagctgacgcatccaagcaagggtgggcgtga

SEQ ID NO: 15408 - DNA, 1501 bp, Oryza sativa
cctcgctcgcttcgtcaccccgacccaaaatctcccgtggccgggcagccggcccgtgatcccgcgcgcaccgttccggcgtttcggccgatcgacgcgggagcgggagcgggcgcgcgcgtggtcggtggtcgcgcgggcgcggaaccgcggagcccagattttctcccgtgacgggccgtgtaccgctcgggagtgcgggcagaccgaattttttattcataataattaataatgcagaaattaaatatataataaaacaaagtcaatttttacgaaaataggaaggacgctattgcatagggcgtccaggtgtggacgctgttgtagacaacatccagatggggacgcttcttacaagggcgtccataatgctgcagttgaagacctcaaagagccatccaattcaccggactaagattggactttgaatccaatcacacaatggtcgaactctacctcgttactcctatgcagactattgtctctcgttgattgcttgcttgccgagcaggcaccgctctctacctaatctgccagacagggtcgccatcccccggccctccttcaatgcttccgctgttccgcatgacggacactctactcggggtcatatgtgaacagccaccacttttattttgagatatttgattagtttggtttttgttctggtccattgtttactacgcatcgagctctctgctgactgaatcttgagaagcgactgactgaatcttgagaagcggccgccagatgaactgcatgcgaggtcttcgatcgatgcttttttttttccttttgcaacaggccagagattggaagtcatcgggcaatagatgatctgatagaaggaggatgtttgcgtcctacccttcgtaattttgcattctttgtaagctttctattgcagaacatatacacctgaataccaagatctatgaactgagcatacttgctcggccagccacctggagtgaggcgatgcctggacttgctgttaggaaccaagaggggcggacagacgacgcaacacaagccggcacgagtgggttattgttccagcatgactcaaccagaacgtggatagcggctacgacctcccggcgtgaaggcagaaagcggcggtgtcctctccggattcgagagccttcgaggtgagttgaggtgaactgcaacggcagattcctgacgttgtggaggcggaagccggaaggcggctgttgcagtctcccagagtcgaggtgaacggcgggcatggcagcaccttgcccgagccctgcaccaacattgggcccgaggagaggagagtccacaatggcacctctccgcatggcggcatgggcgccccaaaccgagcctggacgtgcttcggtacagcgtccacctctggacacttcttagaacaccgtccaagtctggacgccctttgaaacaacgttcatgctatttttacaaattcaatttaaaatttaccacttatttaattcaagacttattaatt

SEQ ID NO: 15409 - DNA, 1501 bp, Oryza sativa
acggtctacggcgcatgaaggctggccggcggggggtgccggtgtagtggtcccacatgtcggcagaggttggacagtgtggagcatcggggcgccagccatggactcgcaggtggtgagcggcgggtgaaaacccagcccagcctcggccgggccggcaacagtgacgctcaaagcgtcattccccttctgggggcgttatcatgccgtctcatccctcgtgtgtggacgttgggtaaaagtcgagtctcggttctctttgagaccttgacggacgacgacggcagtgttttcgtcgcttctctccttggagacgtcgtttaggtatcccttagccgaaaccccccatccaattggtgcaaactctctctagatttcttcctcctgtggcggcgccctagtctctacaaattggccacgtcggagggcctagaaggacaggagttccattcttctctctcaccctctctccctgactcctgaagacttggatagagcggggctttgtgttgattgtaagggttgggttttgggggatctcagctgtgtttctttgtttgcctagaggcggtcggtcacgcttagcggctgctggcccggtgctagccttttcttggttctgtgttggcactgttgatgtgtggatggtggtatatttttttcctttttcctggttacgaccttccagggttgtaatcttgtaatttttctcctgctctatcaatagaacctcgcacagtcttgtgtgagtcgttcaaaaaaaaaaaagagctcctagtcctgattaggaagacaagaggtgtatgcttcatgcatggctgtatactgaatcctagacatggatacaaagccatccatcaataaatgtagcctcaccattttttttcatatacatatatattattaaatatcaaatgtgggggaaaataataattaatccacacattttttgtaggccaagtaacatggtttgcgtggttctttctgacagtgtaggcctccaagtcgccttctcaccagcactttatctcctgttgttctgagcttctcccacttgcaaggggcaatacacgagtagcagaacatacactacacatcactcctcagtatggcctgtccctctcttccatctctaagagttcctcttcccaattcatgtttctggcatgtgactgccattggggccatattgtagtgtggcccctgttggtcagagccttgagctaggtgacacacttgttgtaaacgggaaggtcactctccctcttgcctgatctcatcaggttcctctatttgcagctagtagtagtctatttaacacgccagtagccacccatttctttctcccgtgcggctgtcttgtgtttctcaaactttgtcttacgccagccaaccgtaaacagacactgtctgcgcgtctctcttgcaagaacagctagctctcccatacatctctcctacgttggctgagatcgattgctgccacctacattggccgata

SEQ ID NO: 15410 - DNA, 1501 bp, Oryza sativa
ctctgtgaagtgtcaaattatcaaatccctcctcctattcgttgtgttgtaagaccagtttaaaacaattgatgaagtggagaattaccaaattccccctaatctctgtctccccctccctcacggcctcacctcttctccctccaaattctccatccccggatccccctctcctcctcctcctccgccgctcgtcggagccggaggcgcggcggccttctcccgcgcccttcgtctcctcacacccgcggcggccggcgagaaggcccagaggcaaaggcgtgaagcggcctcctcccccggcgcggcaccctcggacgcacggcggccggtgagcaggagcaggttcggagggggcgacgcggccgggctccttccaccggccagcatcctggctcgagtcgaattttgaaggtattgattactctcgtagcctccctccctccacctctccgcgatttcatgagccagtgtagattggggttgcagatcccctggagtttgacctccaaatccaccggggtggatttcagctgatgatttctatggatggcggattaagcaagtcactttgttccccatctactcggggtggccacatcatttcaatcctatactgctttgcgacatgtcaatctgtatcttattagctttcctgggctatcagtagttgacaaccagaacttgattggagaagaaacatcttgtgtgaaatacatatgacactgggaacatcatcatatgatagttatgtattacttacttttcagaaacttggggcaccagtatttaccgcaattgattgaatactagtactcccgacggcaaatataaggaaagggtgggagtatattattagcagatcaacagcgaaaattataaaatacggcacaagcattatgccataacttaaattattcattgtcttgtcagttatgaatgtatagctcattatgtgtgggattagggaagaagagggtgacatgggcaaatggctacatctaacgcctaaaaaagaagtaatggtccagatttgcgtaggtggatttggaaccaactctaggggatctgcacctgtagattggagatccatccggactttgctggagaaaattttagagttgagcaccctttaggtctgcacctgtttctagatgttcaattcattggaaattgatgacccaactgatgggcaaacacatttgtgaattgaaaaaaagattgcatgagtactgattaggagctatgttaaaactcagcaatacagtctgaattaaggttgtttgtgtgatcattcggacacaaatgatgtgcatgatgccatgacaacctgttccttctgcaatctaatttccttctaggactagataactaaagccatagtttccatgtgaaactgttatttattgtataatgctaaatggtaagattttcgtattgataggaagcatgaaggttgatgatggtcctggcgtcaatggcagtaggtgggccaaaatga

SEQ ID NO: 15411 - DNA, 323 bp, Oryza sativa
gcatgctgccgtgcgcgtgagagagagaggggaagagtgagacaggtagtgagagagataatagagaggaatagtggaagacgatatgataggtgggtcctacatttttttataaatagaatactaactagagtgccacgcgtacgccacatagaccaaaactaccgcggattgggtcgaggggggtaattcgtccggtttgcatagttagggttgaagaatatccggttttgtggtttagggggtaattcagacgaccgtgatatttcagtggtggtaccttctatctagacattgacaaaaaattgtgttcacgcacaaca

SEQ ID NO: 15412 - DNA, 1501 bp, Oryza sativa
tttctttttttctgaaatcaaagtttagtaatataaacttcatgcatatgaattttcgaaccaaataaagatgtatcttgtatttctaacaggaattttggaacaaaaaaaagtgttttaaaatcagaccacctagggacttgtggtagaaattaactttaaggtatagccaattagtaccaataactaaaattcagcattataatttaattaaaatataggatcacagtcgcatatagagacgcaagaggcattttaaacatattcatctcatgcatgatacgaagaaaatataagtttttgggtcctaattacatcatgacaaaattgcagtttttttaggtttttttttatcgtacacacgtacgttctttgtttgtttttttaatttacagtacctaaatattcatatacgtatgtaagtactttcatacgtacacatatgtaagtatttccatagtacgtaattattttgatgtatatagtatttccggtaaattgctcggatatagaaagcataaactttttaaatagatctaatccgacggtgtaaaataatgggtccaccaatttaaatgaaaatagatggtgggattgtagaatgccacatggcggtctaggaacgcttgtagaagcgccacgtggcggcttcggaacgtttataggatgcttaatggacttttagtatataatagatagatagatattacctaatacctaacacataacttttcgaaacctttgcaaacaagactatgcgtcaccggaggaaccaccttactttgatgcatgaccatggacaatgcttttttttttggacaaattagataacccctatagaagatgtgggatttaccccatgagcccatgacacaaacttatttcaatcatctagcctgtgtttgcaagatatatgacaataaagagatgttcgtgacaaggtcttccaaagccaatacagggttacccatgacacctgaaaagtcctcgaaccaagccattggatgggcatttgccaagccatgcaattatcagcatctcaataagcccaatcccatcacccaaagatccatgatttcctgctctcgaggcttcactgagagccaagggtgtcccataatacctatggtcacaaattagctatgcatggcactctatttgtaggtgcatacaaataggtttttctttgcaccacgtgttgagttctaaatgactttacaagcccacttttcccatagaaaaattacaaaggtgtttcatgttttgctgatacttatactcgaaaggcacagatatcaaggctttcctattatgttacaccaatcacatttagtcatttgttcctctcttttaatatatgcagaatgaagtgttgatgcttttattcaaagttgatccccaaagtgcaatgtccgtttatattcttcataagatggccaaggacaaattaaataaattatcaatgaaagatgctaagtcactgactcagacatatacgagc

SEQ ID NO: 15413 - DNA, 1501 bp, Oryza sativa
aaagtttatgctttctatatccgagcaatttaccggaaatactatatacatcaaaataattacgtactatggaaatacttacatatgtgtacgtatgaaagtacttacatacgtatatgaatatttaggtactgtaaattaaaaaaacaaacaaagaacgtacgtgtgtacgataaaaaaaaacctaaaaaaactgcaattttgtcatgatgtaattaggacccaaaaacttatattttcttcgtatcatgcatgagatgaatatgtttaaaatgcctcttgcgtctctatatgcgactgtgatcctatattttaattaaattataatgctgaattttagttattggtactaattggctataccttaaagttaatttctaccacaagtccctaggtggtctgattttaaaacacttttttttgttccaaaattcctgttagaaatacaagatacatctttatttggttcgaaaattcatatgcatgaagtttatattactaaactttgatttcagaaaaaaagaaagtgagttcaaatagatcatcttgttttatgtgtttctgtttgtgatgtgtagataataacactcctattattgagttgttagtggcactatagttacattcggtggttactgaaaatctgttctaaatatcattgtccagcatctctattatgttttctcgatgattctgacattttgagctaataaaataagaaatatcgctaagtacagttctttgaatagttcagattaaactggttcttttgtttaggaacttttgagatcaatccaaatatcagactgggagcacttgctaattctaatcacattgtctgttcagttctcacctgacactacgcttttcttcttggttaaactaatctgtcctctacttttgttcccttattagttattacacatgcaagcaactgcagcagcaagagtaagagccgattatccgggcaaaagctatagaagacaagggagcttgcaggaagacaagaaaaaatgctacatgagaggacaaggtttgagagagcaacattattggtcccatcgtttcgattatttgtggaataagccaaatggtatatttgcaaacgaaaaataatttgcgaataaaatttttatatatgtgttactagcgatctaaaaataaaggataaaaactaaacttcgataataaaaccctaaaatcagctccaactttaaggttgaaaatttaaattttggttgataagctaagtataagtgaaaattcaattttttttccagaattctcatagcttgaagaattgcaatgagggaatgaatgagcaagtggaaaatgaggtctgttgttttatgatgttgttagccttttcaaaatgtgatcaaacgtatcacttagttacaatatctgtcacatgtgattcagttcctttggcttaatttcagctgttgtatatatgttcattttctccaacaatctcccaaatattatctttgcagtgaat

SEQ ID NO: 15414 - DNA, 1501 bp, Oryza sativa
ttaccccacccatagtgccccagacgatggcattgggtggacgcagtgcaaagggcccagtggggtccggcagcagcggagatgcaaaggagataatggatgaggaagttggtgtggcgaaggctgaggtcgatcagtggtgggaatgctacctccagtaatggcttatagcacatgttgatttgaatgtctacgacagggtacgacaaggtagcctcgagacaacaacatgcttctcatcaacatggagggaagagggagggagaaagtgtcgcctggtcacctccattgtcacactagccactggccagctctcccacaccaccaatgccaggggcgagctttagcacagccaccgcttcacctccaccaccgcactaccctagcttcgcccaacagccaccgtcaacgcctcctctccgtcaacataagagagagagagaagaggagagtagccatgtggggaggaggaatagtacatggggcctaccgtttggcaagttattttgggttgccaagttaggccaataaggggagggatttggccatccggttggaaaggttattggggtagtatctttttactagaattgtcaaaaaaaaatagtttgagagccatttggagaggatgttgcctgttagagatgctcttaggacatcaaattccataaaaacatcagaaaaattctctcgatgaagatttataaccactaaaactgccctcaattcgaagggagttcaaaacaattaaaatcatgttcgaattgagtttcaatttcactttaacccctttgaaatctcaatggtaaaacatcaacccgtcaggtagcatggttctttttattcctttcaaaaagagttaattacaaacagaatcaaaactaacagttaggcccaaggcccatccgagcaaacaatagatcatgggccaggcctgccaccaccctccccctcctggctcccgctcttgaatttcaaaatccaaaaatatcggcacgactggccgccgacggagcgggcggaaaatgacggaacaacccctcgaattctaccccaactacgcccaccaacccacacgccactgacaatccggtcccacccttgtgggcccacctacaagcgagacgtcagtcgctcgcagcaaccagtgggcccacctcccagtgagcggcgggtagatctggactcttacccacccacactaaacaaaacggcatgaatattttgcactaaaaccctcagaaaaattccgatattccaaaccagtacagttcctgaccgttggaggagccaaagtggagcggagtgtaaaattgggaaacttaatcgagggggttaaacgcaaaaacgccgaggcgcctcccgctctatagaaaggggaggagtgggaggtggaaaccctaccacaccgcagagaaaggcgtcttcgtactcgcctctctccgcgccctcctccgccgccgctcgccgccgttcgtctccgccgccaccgccgccgcca

SEQ ID NO: 15415 - DNA, 1501 bp, Oryza sativa
tagcggctactgtggtgctgctccgcgcgccgccatggcgcctactgacggcttcgcgcagccgctccgcctgcagcctgccggcttccgcgcctgcggccgcctttgtttgctcttactcgccaccagacagctagctacggcgctgcagctcgaggcctcgagctcttgcgacttgcgtcggcgtcggctgctccagccgccaccagttgccagcgacagctcccaccctaaacacccccaaccctatccccacctgacctgtgtgagtgtgaagtgtgggaagtgggccactggactgggccattactatcgaattgggacaacctgttagaataattgggctaggcccaatttataataattaaatctcaaagacccataataaatgttgaggataataataccacctcagaatttaagcgagaaatatctcaacctaaatagggagttattagaggctccctgttgaccagttgaggtgggggtcggaatgccacgcgcgcgcgcgccgggccgtgggcgaggcgtggcgtggctggcggcgtgcgtcacgtcacaatccttttgcagccactaacccacgttcccacgattccctccacaaccgcgcttccacgttctttctcctgatagtcacgacgcaatccttttgcagccactaacccacgttctcacgattccctccgcaacagcgcgtccacgttctttctcctgatagataaggaggccgcgagtccgatccgacttcttagcttttttcccggtgttagtttctccttctccgcgcctgagttgctctcgcttccccgcttctgatctcttgcgcgcacgagagattggaagaagcagtggctccgaaaccacacctttgcctgagatctgcaccgggtaggcgggagatcaggtttttggggagtgcctcctgcacgactgctcatcgccatgtctggagttgctgctgccgccgctaccggcggaggtggtacgccgccgccgacaggagctggtgcgccgccgccgacaggagctggtgcgccaggaggaggtgccgtgaacgactacaacaacggaggcaattctgcctcaccatccagcggagggccattctcggggtataatcttctcctcctgctactgctgttagcgctattcctgttcccattgttagcgctatactgtgtgcgctatgttcttgttcctattctacgtgatgcctctagcatgttatcgcgttactggtatgttcctgtttctgacattcatgatgcgcatagtatgctactggttatgttaagattaccctacactgcttatgccatgatcattgtttcaatttcttggattaaaatatgccgaataatgactatatttccaacaatccaaaaacctgataggtcattttcggtagttggctttgctgctgcactgaaaccacatgcttttgatggttcaaactataagagatggaaagcacgtgcactattgtggttgacagcga

SEQ ID NO: 15416 - DNA, 1501 bp, Oryza sativa
gaaggcgacggcgaaggcccacggcgaccggcggtgggatggaaagatcggggattcggaggaaagaggctgatccgaatcgaactcgaatccacgaatttccaaacgattttagccgatgattccaaaagagaaaaggaagaggagatctcaaggatcatttcccctctaaagattcggccggagaagtaaaggatcggccgaatttggaaggagacggcggcggctcgcgctagggtttcaggcggcggcggcggcgcgaggaggacgacgaccctgacaagtgggacccacctgtcagcggctgagagagagaggagagcggcggctcggcggactgggccgacttgggctgactttcggcccaaagccaaaagagacttttaaaaacctttttcaatttaaattattcatgaaatacaattccatttattaaaaatacttccttagctcaaataaatcccagaaaaatctaggaattatagaattaagcaaagtatttaacaaaattttatctagcccaattttatattgagatttaacaaattaaaattagatcttctcttttaggcttttaaaatcatttctaacaattccttttaaacaacaatttataatttaaggatttttaaacaagaaaagctcttaacaaaaataattagatcattaatgatcaaataattactgaactgttctttgtatcatttaggaattgagctccgaaaaatccgagaaaatttcagagagttgacttaatcatggagaatttaataaaaattaaatccatccatgctttatatttaggaaattttatttcccacatttaacttttcttgtaaattaaagaacatttaatataaattctattaataatttattaaataatttataaatcctaaaacgaaaaaatcaggatgtgacagatctaccccccttacaaagaatctcgtcccgagattcggaacggctagaaagaaaaaggcataggtaaactgcagtctatcttattccataactccgataattattctaaggctttatagaaaactactgccgctttgaaactagtggctgagctgtaacacttgaagatgcaactcttgaagacacaactggtactgcattggctcctgtgacgacaatgttgttgacctgaccttgcggctgctgatgcttcggcttcggacactctcttgcaaagtggcctggcttgtaacagttgaaacatacctgctgctcccttctactactgttattctcccgagactgatcctgctgaactggcatcggctgatttatttgctcgatgttaacttcattgctttcattagtctctgatttgatctcaccagcgatattcaactgttgcgactgtccttgaccagcggaagaagattcaccaatttggagtggcttgatacgctgcctctggctactaccttgtgcctcctggaatacaatcattttccttttacggttatccatcctgttcttcttgtct

SEQ ID NO: 15417 - DNA, 1501 bp, Oryza sativa
agagagagaggagagcggcggctcggcggactgggccgacttgggccgactttcggcccaaagccaaaagagacttttaaaaacctttttcaatttaaattattcatgaaatgcaattccatttattaaaaatacttccttagctcaaataaatcccagaaaaatctaggaattatagaattaagcaaagtatttaacaaaattttatctagcccaattttatattgagatttaacaaattaaaattagatcttctcttttaggcttttaaaatcatttctaacaattccttttaaacaacaatttataatttaagcatttttaaacaagaaaagctcttaacaaaaataattagatcattaatgatcaaataattactgaactgttctttgtatcatttaggaattgagctccgaaaaatccgagaaaatttcagagagttgacttaatcatggagaatttaataaaaattaaatccatccatgctttatatttaggaaattttatttcccacatttaacttttcttgtaaattaaagaacatttaatataaattctattaataatttattaaataatttataaatcctaaaacgaaaaaatcaggatgtgacatcggtctgatgatttaagactacgcctgcagacttatgttgtaataattcgcactagactctcgtgtatgtgcatttggtatctcggctatgaactcgtgtgtaccagactacttgatccagggaaatggtactgtttacacgattgattcctgttataaaaacgggggtctacagagcccgatgacattaaaaaataaatgcacagttgaaataaatagagaatttaaatataggatcagcatgctcaaaggaactgtgtttgggatctgtgtgacttgccttgcaataacgggtcttcaattaatcttcttgaatacttccggcgcactcgcgaaccttcgaaacgacggaaacgacaagctaaaacgcaaaacaaggaaaaagactaagaaactccaaataaacaatacatataaagtaaacaaatgtgtagatcatgattttagatgaattatgagacttgaacgggctcattctgacttcatatgaaataattacgaattttacaagatttaatctaattaaagcctatttaaaaaggattaaataaatttaattcaatttatggataattttaatatgtagatctttattttatacaactttagagacttgaaccaactaaaaccgagctaatatgaattagttatgaatttttaaagattaaaccggattaaaacatttatatggattttaattgaattatgacgcaataaagaattatttttgaaacggaaaagggaattattgcgtcagtgggctcggctcacggtggaccgagtgcacggcgatggtctacggaacgggcggccgagatctatcctatccaaaacggacggccgagatcaactcggtctaccgtggtctacggcggacggcgtcga

SEQ ID NO: 15418 - DNA, 1501 bp, Oryza sativa
ccggatgcaggccaagcacggcggtgccgcgcaccagggacgaccgctccgcgagcagctgtacgcgtcccccgggaaccgcttcaactacgacgacttcatcatgagagacgacgaggccacgaacgccgaggccgacaaggcgatggcgctcgtagcgagggagacgccgacgagcgagatgacgctggagcagctcctcgcgaaggcacaactcctcgtgtagtaggacaactttctttaaggatggccgcttttcactaaccacccgattaatccattacttagttaattactgtggttgcaatattaaaaattggagttaaaactaaatttagccgtgattgaatttggcttgcagctggcgccgcattgtcttttgctgccagtggcgatggtggtggtggttcttgctcttgagaagaagctgctggtggtggtgcttggaggagcacttgtagaagccggaggggtcggaggacatcaggcttctcgaggagaaggcatccgtgccgtcgtcgtcggagatggtgaagccataggggttggacgacagcttcggcttcttcccaccattgaaatgcccatgagaccgtgacggtgggagcaatgccggttatgctcttcttcttctctggaggaagcgggtggcggaggaggtcaagcgtcttagagaagggtcgacgcgggggaggaaggcggcggcggtgacggtggaggacgtcgttgtcgtcgaccccgccgcgtgtgcctcccgccgccgccgcccgccgtcctcctgcttgaacgcctggtcgccgtcggcgaggaggcggtggagctcagcccgggcgccgccgccactcccacgtctcccccgctcgccaccgtctccgcccgttgcgggagagagagagagagggagcggcgaggagggagaaggaactggagggaggggagagagaagggacacgtgggtcccataatttttttccgtgtcaatgacaaatgggtcccacacatatttttttaattctaaatgccacctaaacgccacgtgtaaagaagacccgatcaatactgccatgtagacgccacgtcagcaaaaccactctccaaaaccgtcaagggagtcaaattgcaccggttttaagagtttgggggtcgagatacccggttttgtggttttgggtcacggattaaatttcgatcacttttgagggtcactaagtgaacttattcctttccacgcggcacacggccgggtgcatgcggaagggccgagagcttgctactcctccatcctcctataaaaaacaatcaacaaaaatagtacggatcgtgatgtattctaatagtataaatttgaataaatatctatctaaatttatagtgctataatatatcacatctcatatttttttatagacgaagggagtagctggcaccattaataacccaacattttcatgctacacatacataaacgacatagtagcacacatatataaaaacgcggata

SEQ ID NO: 15419 - DNA, 1501 bp, Oryza sativa
ctgctgccgtcgctcgccgtgtgctcaccgcccgagctcagaagcgccactcgtcgccggcctccctcgatgcgattcctcctaatccggcgcaaggggtgggttcccgtagccgcgtagatgctctcgccgccgggaatcggcccctcgtgacctcatcgccgtttcccccttctcccgccgccggttgccgccgccgcaatccgccgccgtcgagcatcccccggcgaatccgagccattggctcgtctcccctcgtcctgtgcaacatcccggtgtgctcgccttcgcctgtatcgccatggttcgctccgccgctcgccgctgtcgtccgccgtccgttccggccggcgtcgtcgtctacctcccgccggctcgcgtggcagccacgtaggcgccacgtcggcgccacctcggccgcgaccgggtcaagcagaccccggtccgccgcttccctccgcccctcgcgcgcgcggtccaccgcgagccgtgaggctgcgcgtgggcccgtcgcaccacgtcctccgcgaaacgcgcgcatgcgccgcgcctccctccccaaaccctagcacgccccgcgtgcacctcgctcacggtgagccgagtcgctgacaagcgggtcccacccgggaccacgcgggatggacccggcccaccggctctctctctcccctccccgcccgcgcgcgcgccttgggccgccttcttgggccggccggcccattaagctcggccgagccgcccctttctctcgggccgcgccctagccgcccgagggaagtctaatttccctccctccttcttttctttttcaaaaaggatttaaataaatccttttcctttagaccaaaaatccaataatcttagaaattcaatatcttcccaaccgtaagtccgtttgactccgttcaacttccaaaattcctcaaatctcgagatctatcgaatggcacgcttagaggtcaataatagggctttatttttgccgtttgctgagctgtcccgtttcgcgtgtagtttcggagcccgaagacccgcagtgcgaggatttcgaggatcaagctcaagatctcgagcgaggcaagccacctttgaacatcttgagcctatatttgaacttaattatgttgcttgaaaaatattatgcattgataggatcgcacttaatctgcttgtcccgtctgcaaggcagattggcggacctacctaatttgttgcatttgaccattccattgtaattgttataccatgttcccttgtacccacctagttgcgcctcggtaatcgtgcactctgcacgggtatcgacggtcgccttcaaacttaaaatctgagaaacatcttgggtaaaacttgcgttttacaaaagacttggaaaatccgacacctgggtcggtgcttgcgaactaaatgaatttccaaaaccgcggaccggggaacgtaccgggtgtacggtttcccgctcttgcacctaaggactgtttccttggaatttcatccg

SEQ ID NO: 15420 - DNA, 1501 bp, Oryza sativa
ttttatgtttttccagcggtctacccaaacaatcatactatatatatatatatatatatatatatatatatatatatatatatatatgcaattatatgttttatcaactacatacgtttaaaaaaatctctaatagtggattggtaacatactaaaacttgttcgattaatcccacccgcaagagaaataaggaggatttgaagggctgttgtggaattatttcccccatatttatggtgtaaaattatttttcctcagtctcctttaaatccttcctcttaggaattaacgaaagtatcacgtcttttttagatgggataaaagcaggtgcatgcgtgcatttttagcgtgcgcgcttacatgctgcgtacatttgaaaagaaaaatgatatgagttttgagatataatgataaacagccagtataacatcatttaaaagttttttgggataacatttcaaagagttaaaaaaacacttaggccatatttggataatgggtttgggatatgattttcaacccctcaaaaggtaagtttcaatcttgggcttattcggtttgtaggattttcaaaccgtaggaatacagaaaacgtgtaatataggaatgcatgtgcaaacctatggattagaaaacataggaaatttttatatggttgggttgcaaacagtccaaaaggattaaaaacattgggttagagtggattatttttttcctttgttttccccctaaaagtggagggataggaatttttcctttcatgcattcctttaaaacgaatgatagtatagtgctcattccaaaggattgaatattcctgtaatttccctttacaaatcctctaaaacgaataagctagccatttattctactcactcatttcatcatattcctccactcatttctatttctcaatcccagctctcctaatccattattcaaacacatcattatagataaagcgttccggtatagtattagagaaaagaaaaagggtgatttttgagagatgtaataatgataaacatatgaagtaacattacaaagagttaatgcgttccgatccggttctttcttaggatggcaagcagttcagtggatcacattacacgtcgccctgatttctcaatcaacagccgttcattcacccaccgaacaatcaccagccgttcgatcgcgttcctgacgtccacggtcaaactcaaaaacagaaaaaatcaccgcgggcgtgcgggtttaatttatctccctcttacgccaacgacgatcgaacagagataagatcgatctaaccaccctaacaaaccgtagatgcaaccgtaataacagcctaaccccaaggaatgcgagatttatccgcccctgcaatgcgctataaatttacttcgaactcacggtgaaaaagtaattagcatcacctccctccttgcttatcaacacgtacgttgcgtttcttggcaatgcgtgctgcaccgacgacgatgtggcgttcgccggcgg

SEQ ID NO: 15421 - DNA, 1501 bp, Oryza sativa
gagctcgattagtttttcaaatgatctgtcaaaaaatatacaaaatccaagaaaatattagatgaactgattgaaacatagaacaaaaatggaattgaaacagtgtttgcatccagcgggtcataatgtctcatgtgttagtgatttttccaatcatatcttcgtcttttatattgcgtatctttttttttaagagctcggttagttttttaaatgatttgtcaaacaactgacaaaatccaaaaaaatattagatgaaacatgattggaattgaaacatattttgtagcaagcacacaaacacgacgcacaccaactaaatcggaacagcgtctgcaacggttgcaacaagcacacaaacactacccgcacacgcacaccaactaaatccaactagagtgaaaagcgtttgcaacaagcacacgaacacgatgcacaccaactaaatcggaacagcgtctgcaatggttgcaacaagcacacaaacacttcccgcacacgcaagggagatggattctaatagctcgattgaacatccatccgtttattgcatgtcaagtagatggttacgaaaaattttcaaaaaaattgacaagatagattaatatgtaatatatcactccacaaacaaacaagttcaaattcaacttctacaagttgtaacaaaaataacaaatttaattgtaaaaatacatatagtaatttgagttttgtttgttatttttgttacaagttgtagaagttgaattttaacttccatgtttgtggttgtaatatatctatcttagttcatattttttcaatttttttataactatttagatgacatgcaataaatgggtggacgtccactcgagcaagagaagcgatgagcagcagaacgttgaggagaaacacacgcacacatcatcatgagactacgatgagcagcacaaacacacgcaccgacgcacgtatgaacgcaaacaacgcacgcacgaacgcacacaacgcgcgaacacaagcacgctacgataagttgagaagaaacacacgcacgctacgataaggagaaacacacgcacacatcatcatgagactacgatgagcaacacaaacacacgcaccgacgcacgtatgaacgcaaacaacgcacgcacgaacgcacacaacacgcgcgaacgcaagcaagaagaagatgaacacaacgcagatgaatgaacacaatgcagatgaacaacacaacgcacaaaaagaacacaacacatataaacgcacactagcagatgagtaagggaagcgagaagcagagcgagcgcacacgacttaccctctcgattttgcgagaacattctccacaaccgacgccgtggcccgtgccgacacgaccactgtggcccgcgccgccgccattggaggagagggaaggaaagggagggggggtttatagttggaggaggaaatatttaagatgcgtagcgaataatgtagaaaaaaaatggtacgagaatcactcaccaat

SEQ ID NO: 15422 - DNA, 1501 bp, Oryza sativa
actgcgaccggtcacggaccggacgagcgcacgctgcgccgtattaaatgcggcgtggcgcgctcgtccaacccgcaataaatgcggttaggtgagcgccactgtgctcacctaacccacacacgtggcgccaataccacaggggtcggggcgccccagccctcgaggccgaaacgggagcggcccgacccctcggggagacagagggaggggtggccacgtcaccctcgggcccgacccccccgagggggtccggccacgtgggtgaccgcggctgcccaagcctctagtcacgatacccccggtcccatgtcaccgacaaacaattttttaaaatatattataagctatttattcagtttattataatatacaatactcttatatcacagaatgtaactggtcagatttgttcagatttgtagtaatatcaggatagatggatatttattcatccttaacattaagaacatcagtttggcccatcaattatatgaaaagaacactgcatgcattagcttcggtgggacatgactatctaaggtgcgtatcagagcaatcaagcagagaggtggcatatcagctaccgcacggtacttaatgaaagttgttggtgctatagctattaatacaacgacgatagtacggagtattagctacgatggtaactttagatggtgctagctacgatggtaactttttttcttaatcaagtttaatcaaatttataaaaaaatttatcaacatctaaaataacaaactaattttataaaatctaacattgaatatcaaaataataatatatttgttttatgttaaaactagtaatatatttctttataaacttagttaaacttaactaaaaaaatatcaaacgacttataataagaaaggatctaaagtttggattcaaacttcagttattttttatcacatcaacttgtcatatacacataacttttcagtcacatcatcttcaattttaaccaaaatctaaattttgcgctgaaatgaacgcaaccaaataaatggagtactccactggctaatgtactgtgtgcagtactagtggggaacaaatgatgctgcagagaagtgatgacaataatttaaccgggagcatgcttctcctcacatgatgcgatgcatcgcacgcacactcacactcgcagtaccacaccatgattaagctttggcgacaacgacggcggctgtctaaacagatacaagaccagatgaaacggccgccaaccacggactgagatgactccacagcccacggtgtgtatgtgcgtacgctctccatcgcttcgcgtgcacgcgacgcgacgctccatacgtgcaaaccccgtcgcggacgtgattgctatacacaccgttgctgcgagacccggcaggttcacgcgtggaaaacatcgttcaatcaacggctgccccgacgtgtacgctagctcgcctctcgtatcacatggcacgcagttaaaataaaaaaaaaggaaaa

SEQ ID NO: 15423 - DNA, 1501 bp, Oryza sativa
cgatgttttccacgcgtgaacctgccgggtctcgcagcaacggtgtgtatagcaatcacgtccgcgacggggtttgcacgtatggagcgtcgcgtcgcgtgcacgcgaagcgatggagagcgtacgcacatacacaccgtgggctgtggagtcatctcagtccgtggttggcggccgtttcatctggtcttgtatctgtttagacagccgccgtcgttgtcgccaaagcttaatcatggtgtggtactgcgagtgtgagtgtgcgtgcgatgcatcgcatcatgtgaggagaagcatgctcccggttaaattattgtcatcacttctctgcagcatcatttgttccccactagtactgcacacagtacattagccagtggagtactccatttatttggttgcgttcatttcagcgcaaaatttagattttggttaaaattgaagatgatgtgactgaaaagttatgtgtatatgacaagttgatgtgataaaaaataactgaagtttgaatccaaactttagatcctttcttattataagtcgtttgatatttttttagttaagtttaactaagtttataaagaaatatattactagttttaacataaaacaaatatattattattttgatattcaatgttagattttataaaattagtttgttattttagatgttgataaatttttttataaatttgattaaacttgattaagaaaaaaagttaccatcgtagctagcaccatctaaagttaccatcgtagctaatactccgtactatcgtcgttgtattaatagctatagcaccaacaactttcattaagtaccgtgcggtagctgatatgccacctctctgcttgattgctctgatacgcaccttagatagtcatgtcccaccgaagctaatgcatgcagtgttcttttcatataattgatgggccaaactgatgttcttaatgttaaggatgaataaatatccatctatcctgatattactacaaatctgaacaaatctgaccagttacattctgtgatataagagtattgtatattataataaactgaataaatagcttataatatattttaaaaaattgtttgtcggtgacatgggaccgggggtatcgtgactagaggcttgggcagccgcggtcacccacgtggccggaccccctcgggggggtcgggcccgagggtgacgtggccacccctccctctgtctccccgaggggtcgggccgctcccgtttcggcctcgagggctggggcgccccgacccctgtggtattggcgccacgtgtgtgggttaggtgagcacagtggcgctcacctaaccgcatttattgcgggttggacgagcgcgccacgccgcatttaatacggcgcagcgtgcgctcgtccggtccgtgaccggtcgcagtgtgtgaccggtcatagaccggtcagatcgcgggttaggtggcaacaggcggcctgtcacacgcctcgccccgtcccgtcggaa

SEQ ID NO: 15424 - DNA, 1501 bp, Oryza sativa
ctacccaaacaatcatactatatatatatatatatatatatatatatatatatatatatatatatatgttatatatatatatatatatatatatatatgtttatcaactacatacgtttaaaaaaatctctaatagtggattggtaacatactaaaacttgttcgattaatcccacccgcaagagaaataaggaggatttgaagggctgttgtggaattatttcccccatatttatggtgtaaaattatttttcctcagtctcctttaaatccttcctcttaggaattaacgaaagtatcacgtcttttttagatgggataaaagcaggtgcatgcgtgcatttttagcgtgcgcgcttacatgctgcgtacatttgaaaagaaaaatgatatgagttttgagatataatgataaacagccagtataacatcatttaaaagttttttgggataacatttcaaagagttaaaaaaacacttaggccatatttggataatgggtttgggatatgattttcaacccctcaaaaggtaagtttcaatcttgggcttattcggtttgtaggattttcaaaccgtaggaatacagaaaacgtgtaatataggaatgcatgtgcaaacctatggattagaaaacataggaaatttttatatggttgggttgcaaacagtccaaaaggattaaaaacattgggttagagtggattatttttttcctttgttttccccctaaaagtggagggataggaatttttcctttcatgcattcctttaaaacgaatgatagtatagtgctcattccaaaggattgaatattcctgtaatttccctttacaaatcctctaaaacgaataagctagccatttattctactcactcatttcatcatattcctccactcatttctatttctcaatcccagctctcctaatccattattcaaacacatcattatagataaagcgttccggtatagtattagagaaaagaaaaagggtgatttttgagagatgtaataatgataaacatatgaagtaacattacaaagagttaatgcgttccgatccggttctttcttaggatggcaagcagttcagtggatcacattacacgtcgccctgatttctcaatcaacagccgttcattcacccaccgaacaatcaccagccgttcgatcgcgttcctgacgtccacggtcaaactcaaaaacagaaaaaatcaccgcgggcgtgcgggtttaatttatctccctcttacgccaacgacgatcgaacagagataagatcgatctaaccaccctaacaaaccgtagatgcaaccgtaataacagcctaaccccaaggaatgcgagatttatccgcccctgcaatgcgctataaatttacttcgaactcacggtgaaaaagtaattagcatcacctcccttcttgcttatcaacacgtacgttgcgtttcttggcaatgcgtgctgcaccgacgacgatgtggcgttcgccggcgg

SEQ ID NO: 15425 - DNA, 769 bp, Oryza sativa
ttgtttgctgcttggctatggatgtgtgatgctgatttcacagcagcagcagttagaacttgttgttgtaccagaagacgcccttgttgtcctcaggctcgacgtagatgcactccttggcctcgcgccatgtcgccttggcgacgggcgtcgggtcgaactggtagtactcgccgaggatggggcggatcgccttagtggcctccatggcgtggtagtgcggcatggtggagaagaggtggtgcgcgacgtgcgtgtccgtgatgttgtggaacaccttgttgaggatgccgtagtcgcggtccacggtggccagcgcgccgcggagccagtcccactcgctcgagtcgtagtgcggcagcgccgggtgggtgtgctgcaggtaggtgatgagcaccagccacgcgttcacgatcagcagcggcacgccgtagacgcgcaccacccaccagaacccgaacgccgacacagcttgaacagggcgagccccgcggacacgacgccgacgtcggagatgaagatctggacgcgctcccggtcgttgtagatcgggccgtaggggtcgaagtggcacgcgaagcgcgggtacgggcggccggacacgttgaacgccaggtacagcggccacccgagggtgagctgcacgaagatgtgcaccagccggccgatcgggttgtggtacacgtacggggtgtaccacgccatcgccgacttctgcttcgggacgaacacctcgtcgcgctccagcgacccggtgttggagtggtgg
